United States Patent 9,328,346 (POLYCOMB-ASSOCIATED NON-CODING RNAS) - sequence listing, part 41

SEQ ID NO: 7252 - RNA, 23822 nt, Mus musculus
cagauuuuaguggaaguauuuucucagacucuauucucucauagaucgcuguguuuuuuaguuuaggaacacucauaacuaauagaauauuuuguccccccagucauucuccaauccccauccugaccccagugaauugggcuaauccgcagcguauuuugcugacgucguacgcaugucuaauggcaauagauuaagaauuagaagacauuuucuggcaccucuuaaaacaaguggucuuugucuucgauuacuuuuaaagaauuuuaaagcuccgcuaacaccuauccugugacagugucgccugguaaaacuggucuauaacccuaauccccacggaaacucggcgcuuccgugccgacacugagcacccgauacguggagaccagaguccaacccggaaaaccggucuuuuccggaacugcucuuugcaauggaagaggcgggacuuccggcuucgcuuuuccggagaccgccccuuccucucggugcgggaggcuccaacugcugccucgcuuuguguuuuguuuguuuguguuuuguuuguuuguguuuuguuccucgcgucgccgaugcugccccagaggacuggaccgguguuucaaccgaaacacuucuuguauccguguuuuuccguagaugugauuauuuuucuuccucaagaaaugcuucucgguaguuaauacauuacggaaggaaccguggagaagcgcuacgcaaacagcacaguucgugccacuugagcaaaauagaggucggucggaggccgagguugcccucccuuccaggugcagaacaacuucgcagcccacagccgccggugaguguugcaaguuuggcgguggucuugcugaggguguuuucccgcccccuucucuuuccccggguuuguuuugaaaaaaaaaacgagccuucaacaugcagaggaggguuuucgguucguuaucccccagaccuaacguguugaauggugagagugcaaacgugaauaaaacgaugcaaagcaccaauuugcucuuaaaauaccagguagagcuaugcgugugugcacauacgucucuucgucuguaaucacgguguuugcuuauuggcguugcaaggauuuaaacaagugacguaaagcaguuacuguggucuuaccugugggaaguuaacccgugacggcaauauagagaugcacugaagacagacgaaaugggagaaagauaguuguaguaaauaagaguucagcuuccaacaaaaggagauaaagggccaaauucaagcgagauuuuaaaaagcaauagaaagcuaguuacaggcagaaagcaucgugaugacaguggugucaucaacgcauaucgugaacucaaggggaagaauuuaaauauuuauucuuucuguauuugaugaaaguuuauuuguccaacagcuuucuuugccuaguacuauuugaggucccagugauacauuuguaaauaagacaggagagaucuguuuugucugaguuucuauccuggugggagguacugauaaagucuaugaggacaaaagauauguuaggauagcaauuauggauggaguaguuuagcuuaggugauaaaguugggccuuggugcaagugguauuuguguugagaugugaguucugaugaagaguuugugauaugauaagcaaggagacgacaagcuagacagagagagcagggcaaaguuccugagaugagaaacaccuucuuucaagagcaaucucuacaaagccagugugauuaaaaugaucagaacaagggaauuaggaagugacauuuggagaaaguggugggcuagccuguguggccucugcaggcuguaguguaggacuauugaucuaauucugugugcaaauaacuaggauuaaugggcuccagcuaaagaauggauuuaggggaugcugcagaaaucugcuuuuggugggagugcuuuuguuauaguuuaaucagauucuguuucucuauggaacaaagacauagaagucuaugcugcuaccgguagccugaauugugcguaccuuauuugcauauuuaaaaauaaaaaaaaagaugaggaugaaaguaaccaucguuauuagguaaggucuugaagagucuuugauuuaaguaaucaauaagaaugauuaaaguaacaacagagauggcaguagagaagaaacccuuacuaacugucuuaguuaggguuuuacugcugugaacagacaccaugaccaaggcaagucuuauaaaaacaacauuuaauuggggcuggcuuacagguucaggccauuaucaucaaggugggagcauggcaguauccaggcaggcauggcgcaggaggagcugagaguucuaugucuucauccaaaggcugcuaguggaagacugaccuccaggcaacuagggugaggaucuuauacccacacccacagugacacacccauuccaaccaggucauaccuauuccaacaaggccacaccuucagauggugccacucccugguccaaggauauacaaaccaucacacuaaccuaaagugggguuggaggaggauggagggaagaguuugggagaggggacaaucuacaacuuagucacagaccaaguaggucuaguaggaugaggucuuaagauauuaguacaaagacauugauggccauuguggauggauuaaugccaguggaaaggcagaggagaaagccaggucguaauagcaugaagauuaguaagaggugcuagcaaggagggguuuacuguacuuuauugauaggaaauugacaugaacucaguaguauugucucugaacaguguucuguuguuguuuuggacuggugagacugaaaauacaggagacaggguuuguguuagaaaagaauugacauucacaagauuuacugggaccuuacaaggcagcuuucguagugcuaggcacugucauggguauuuucucacuuaaaccuacagcaguccuguguaacccgcucauuuuacagauaacagacaucccuaggcaucugccuagcaaagaguggcgcauaagcgaagcccuccaccaccaccgcacaguuauggaaagcauaguaaaaacaggcauuuuggugguaagaaaugaaauagaagaagugagaauacauugaagagacuggauuaacuacuugcuuaguuccggacuggggagcaguguauucugauauuuguauauuuucauggucuuuucuuuuggccugugguuugcauguguuaaaacugauuugcuguguuuuuauuuuauuuuuauguauuauuauuacucuauguauguaugauguaugagugcgggcaugcauauuuuugcuacaacuuuguucucacuuuuccacggugaauuccagagaugcaguucaguucaucagaccugcaugccaagaaucuucacgugcugaaccaucaugccugcccaaauugcuuauauuuuucuuaccaaaguauaauugguuuaucugaaaugagaugcugagcauaucagauacaaauuuaaacuugaggaacaguaaaccacaaaauguuuguuugugauuuugugagcuguccgcgccucccagguuagguuuugacugugucugaguaaaguccucgggauuccucaaggcaguuugugaaggaaguuuauuuuagauccuaaagguaagaggauacacgguggcggguguguugcccuguguucuuaggaaauacauguguuuagcuugacagaacuccugagccuuaagcacacugccugugcugcuguguccccauucccccacaguccaugcugagaagggcggcguagccaggcaugggaauggcagcugaggugcgaauggugcucuaugaggaugauuccguccaagugcacuacgcuuguggguccacgcugcagcucucuccuugcggcucugaauuucucuuugaaaaggcacuuccucccucaacacauccuuuagaacaaccagagagaauccgucaacggacacacuuuguuauuagcaacuaccgaguaaguaaugccacaaaaaauauguuugucuaucugucuaucuauuuaaucucuuuuuaaaucuuuuuuuuuuuuuuuuuuuuuuuuuuugagacacaauuucucuguguaccccugguugguuuggaacuugcuuuguagaccaggcuggccucgaacucacagagauccgucugccucugccucccaaguguugggauuaaaggcaugcgccaccacugucaggcuaaaaguguuccuuuuaauacuagccaggggcugaagcugcugggauguuaagggagcuagggcacuggacuucugucauucuaaacugauuuucagauauuuuacauuucuuuuuuuuuuuuuuuuuuuuuuuuuuuuaaagauuuauuuauuauuuuauguaaguacacuguagcugucuucagacacaccagaagagggagucagaucuuguuauggaugguugugagccaccaugugguugcugggauuugaacucuggaccuuuggaagagcagucaggugcucuuacccacugagccaucucaccagcccuuuacauuucuuuuuauaggagcaacuucagcgggcccuagauuuucgaaacucuucagcuacaugcccuuuuuuaucugaaagcaucauaccuccugaaagaaaaaagguaauuuuuguuucaaaccacauuucuaugaguaacauuuggguacagguuaguuaaacggaagauuuagcacuuaguaagcacgugcuguaaggugacuaggccucugugcucaccaggcuaaggaacguagaagcuacauuugaacuuacguauuuuaucuccucgacauuuccuuuauagcaaggacuauagcauugcagauuugugacuuuucuauucucauaugucucaguguuaagcaucauacaaagucgaguaaacugugugccugcuaauguguauauaaggagauauaugagucuagucugcuucuccugacgcugugauaaaagguuggccaaaggcaacuuggggaggaaaggaguuauuucagcuaguaguuuuucagucuguccuugagggaagccugguagaaucuaaagcagacaccaugaggagcgcugcuuacaggcucguuuucucugguuugcuuagcuacugccuuuuguauauaauccaggcccagggaugguauccacuacagagggacaugcuuuccccgcaugaagcagcaaccaaccaagaaaaugccccacagacguguccagaccaucauggagauuuuuccucaguugauguucggucuuuaccaggacucaauuccugacuaaccuaggcagcccaauacacaauuauguauaaguauaaaauguuuacucuuguuuauauuuuauuuuggggaauaauaguaaauuucguuuacuaagacuauggacuaggaacuagaaccaauguugaaaauauuuaaaggcugagacaagaggauuaccugaccuccuaaacuugagacaaacaugagcaguguaauuagauccuguuuccaaccaaccaaaaacuucagugguaccauuguggcauggguaauauuccccaaacacccauccuuuguguagacgaacuguguugugaaauuuuugaagugacgaaguuaggacuugagccuaguccaucugccucuugguacacgggcgagaacccaggaccccacacaugacaggaaggcacaugacgucaccacugagcaacacccucagccugggugccuguuaauuacccucuacugcuucuaaugcgcucuugccuccuuacugagcaauuucauauuguguuguggcuguuuuaauaguuuuguaccuguuuauauuauggugacagaacaacugagaugagcaaccuuaaggaggagagauuuguuuccuguugcagaggucuuuaguacgagcucauuuggcugaggcuaaagcagaccauugugguggggaauauagggugaagcaaagcauagaggccaggaagcagacggggugagaaggggacaagggagaagcuagacccuucgauggcucucccccaaacacccacuuccuccaggcagaccuagcacaguccaaucaucugagaacucuugaguggauuaauccuuuguggacacuuuuguuuucaugauccaauuuucucucagcagugccaccagcuggagacugcacccuuagcaucuccaccucuguggagaauaccucgcauccacaccuuagcaggcagauguucugagcuaucacuuacuccacagggcuucuucccagcgucuuuugaaggacuucauucauugaaagggguuuuuuugcugcugaugcuguaguguggccacuagacuaugagcuucccugacccuccuuacacagguuaaccaucaguugcugccccuaagaugaguauucugacauggauggcucuguaaagagacucucuugacaacagcuuuaguaaaguuaagguuuaauaaagauggaaggugaaguguugaacuauauccaauaauugaucgcaguacugguguguacaauacggcugauuucuuguuugaaaaagcagauagagauaguuaacuguuuugagugugcucuuuaaggucagcuuacuuuugaauauuugaauugugugaaaugacuuuuaaagccacuccgaauguauguuaggccacagggugcuggcugccuucuauggcaggugauucaugugaauuuucaguucaucugguaauuccaaagccacccuaaacaauaauucugaccuuucucccaugucucccaacacauccguucucuguguugucucggugacuucuacacuauuucuauagcauguaagcucuauugcuuuuauauagcauagucagcccagguucuccuucauccccuuauggcugcucuccuucacaguagguuuuugggaugagugguccgcaaauccaugucucucuaauucauugaacauucuaaaucaaaauaagugugcuaaucuucuuucucuuguguguguguuucuaagagaaacacuauuagcauccagaguauugucuguaaaaccauauguugacuacaguuuucauuuugcuaggugguaaaaacacaaguaugaaaacucuucccuacucucuaacauaauacuuuuaauaacaaaaguauagaaaaauugaacauuaacagaaaauaacauuuuuuucccucucaauucagcauaucuucauugauuucucggaaguagaauggcccagccuugacagagaugacugcaucauguacucggagaguggcguggugaagauaacaucccuggauggacacgcguaccuuugucugcccagaucucagcaugaauuuacaguacauuuuuuguguaaagugagccagaggccagauucaucuggcauacuauccgaaacacagaaucaggaccccaaaaauaaacuaguugagaagaccagaaaagucugcagauguggaaauuuaucagaacaaacguuaaggaauaaagaaaacgaaccuccuuaccagaucuugaaaucuaaaaacgcuucagugaacacauguugugugaaugacagugaggggagaggggagcuuccuucccugggcacaaaucacagauguguguacgcauggguaaagcaggcuuggucuguugccgccuguccagaggcguggaaacacccucugucuuuagcacuucguuuuuauaacaaaguucgugcugcaucugaaauugaugcagauuucccugcgaguagcauugugacuucugacuguccugaagaaagaggaacggagguuucuguccuucccagggccuuguuacucagcugcccugccccacacaugcacagguaaagcaagaaugguuuguugcagagagcaagguuggggcaacuuguccuuaccccaagcgucacuugguuuuuguucugauucugguuuucugagacauggucucacuauguaaccuuggccucuaauucauagaggcccuccugccccugccucccaaaagugcugggguuaaaggcaugagccgccacaccuggccacaucugcuacugcucuuaauuucaguucaguuacuuaacugaaaucuuuaauuuuaagggauaguaaauccuuucccaagcaaagauguuggcuuuuccuacucuguuaguacacugucuggggaagguuaacucuacacuagauucuucauuagguguaauacagagcaaacuaaaacugaaucacuccuuaguguagaguagcagcucaugaaggccgcugucccuacaaggcucaguaaaguacagaagagcaggagccugcucugagcucuuagggagaaagcugagagcggagucuaugucuggucacuggagcccaugagcccacggcgagagcauggaccugcagaguuuugauuauggcuucuuugauaucaguccaaaggcuacccauauuuaguuaacugacuaaaggucuguccuuuuucaaagggauucagucuauggaaaccucuucauggcuagucaaaaacuugucauucacagaugaauaauaguuaaaauuuugcaacacgaacuuuguauaaaugacacaguaacuuuuuugucaaguaacauuuacagaguacuuacugugagacacuggugugcuuauguauuggguguaguaacccuguuacaagaauuaccgugaucuuuuguagaggaaccugagauccagaaauaacgaacuccggcagcuuccaucgcuagcacuuguagaauugaaaguugauccuagguugucucuguauacacuuaaaguuuuugagcuugccauaaauaucuaguuaaaacuggaaauuccaguuauugacagaauagguuuuaggcuccuaaguuaaauguuucuucaccuggauuuagguugaaauccauuuuccuaacagggcucaucagguuuuccaggcugugcuugccuccuucgccauaguccucacucugccaucuuuccuguccgugacuccccugugcuugcgaacuugugcucacucgccucuccuucccugcugcccugcccugcuuuuugcuccaguaggagcauuacacacacacacacacacacacacacacaccuccuucccuugucucaccuuaagccuuacucuuuggggugcucguuucaccaauuauugauaaguucggucauauucaugcccauaacacucauuggcuccuucucuuuagacuucguaauuacuacacugucacgugggaggucuccauucggggcagaagacacagcugcuuugggggaaguuaacuucuuaguguguagaccaugaugccuggccuacuguagacgucucacggaggacuuguugucugaauucagguucaggguuuuguuuguuuguuuguuuuuuguuuuuguuuuuuuuuuuuuuuuuuguuuuuuuucaagacaggguuucucuguguagcucuggcuguccuggaacucacuuuguagaccaggcuggccucaaacucagaaauccgccugccucugccucccgagugcugggacuaaaggcgugcgccaccacacccggccuucagguucaguuuuaaagauuaggaaagcuuuuaauuguauagcuugccaagauccauuaaugaggcuacugagaacuacugaaaagauacacggcaaagugggacuugcucugaagugucucuagugcccguugcauuguggcuucuuugaucuggugaguaaggcgaggagcggcgcuguggcggcgcuguuuuguugacuuaacggcagcuauuuugaggacgcagaguuaguucucaguugacuuuucacagguggaccuucugugacucacuucuacagagacagcccgaugcagaagacuuuuccuauccugagcuugugaagguggugugguauaaggguguuacauacagguaaagccccuucccuucuugaaucaggaguuuuguuaguuuacaauuaauuuauuuuauguauacaaguacacuguagcugucuucagauguaccauaagagggcaucggaccccauuacagguggucgugagccaccaugugguuccugggaguuaaacucaggaccucuggaagagcagucggugcuuuuaaccgcugagccaucucuccagcccuguuuguuuauuucuuaacucacagugggaaugagacuauacuugcaaaccgauucuuauaaacaguuuugcugggucaacugggcugcuguguuuuaucuuuacuuuuacaggucacaaacuaauuuuauuaguaugcauagaggucuuaggacucauguuagccaaguuuacaagacugcgugacagcuaccaagccacugagauucggacuugcuacugaauggaauauaccagaggcuuaggguauccgcuguaccugagaaggucuaguuguguuaccuagugagcauggaaucagccuaagggugauucagucaaaggaagucauuccuuuccuggcugcucuaggccagcacuacuccacugaauucucccuucccuauaacagaguaacucucuagugacgggacacaguguuggccagaugcggucuucuuuccaugacuaaugcuaaaaagcauaccugguggguuuugggugcccgaggcuuuccugucuuguaugaagacccaugcgcucggacaguguuuuuuuuuuuuuuuuuuuuuuuuuuuuuugguuuuuuugagacaggguuucucuguguagcccuggcuguccuggaacucacuuuguagaccaggcuggccucgaacuuagaaauccaccugccuccgccucccaagugcugggauuaaaggcgugcgccaccaccaguguauuuuuuaaaauugcauuuauuuuuuucuggggcuggcaauacaugugugcuacggcaugcauguggaggucagaggacaaccucuucuuccacccugugggucccaggaauugagccaggucaucaggcuuggcagcuucuaccugcugagucaucuugauagccccaacaagauaggaaagacauagcuuuuauaucuguuccaauaaaaguaauuuccaauaaaaauauuuuucaguaauuguauauggaaugcuuagauuauaccuggcuagcacauguguaauuggucacguuuuacauggauagcuaaucucauccaucagguauugauuacaccaguuauauuuauugaagaauaaucuuauuuucagaaccuagaagugugguauuuaacuuguaugugucaacguugcuuuggcgacuauguaccaggugcugugguuggcacuggagaaaugaagacaggauucugaauucuagaagcucugagcuuaguuguugauauaaacacagaaggcacuucauuuguucucuuucucuucaguucaaaaauacccacaucucugguuuugauuuuuuguuuuuugggggauuuuauugucuuaaugauugcuuuaaugcacacauuagacuuaauuagaaaacaaacguuuauuucucuaccuuaggcuuacccauaaaaauguaaacucaauagagauuuuuccuggagacggaucgguuuucaagucagaaggggcucauuuugguaacuauuuuacauauuauccaagucaagaagaaucagaaaagguaagcuaacuaugaaaacucaagaguugguauaaagcucuucuuaaagucauaauaugggaaacgugcugucucuauaacauuacuucccucugcuccggggagaaggcagcgggggaacugaacaaagggcagugcuuauaucggauuucuuaggggcuggagcuuuugaagcagacauuuccaauuugaggauuggugggauuucaaggccugagcuuguggagcucagggauugguggguguuuuuucccuuucccugcauccggcccauggauucgggugggaagucuuuccugacugcagccugguuuugcuggggcaccaucucuguggggcugcugggagcuggggguauggggaaggauguguugccaccuuggacagcuuuguaaggggcagcuccugcugagcaggaaaugagaugccccugugaaggcugcaggcugaggagauguggcugugcugccauuuagacaggaguugccauuuuugacaaauccugccagggcaucuuaccacagcuguaggcuaggacagguagaaggggccagccucagcuuuugcgaccucuuagagaccacaguccuuacugggagauaagagccagacaggagaaucggucccucaccuggcauccuaaaagucaugucucugucugcccugccuagccauuggcugccagcaaccuuauuuuccaaucagaaccaaccggggccagggucccucagugucguaaucucgaguaaauccgggucuuggggacccagauuaacauaauacaaacaguuaugggugcauguauacauaccucaaggaaaaagcuaaauaacgagggucauauuuauugagauuuuguuuguuuuaaacuuucagagagaagagaaaacuuacucuguaaauaaccuuccuccagacagaccaggaaauuucuucucugugcguucucugauuaaacaggcaaccaggugaguuaugauacucaucucguacaucugaaugccuugauguguuuccucugauuaaggguaggauuaagacuggugcaaugggaauaugugucuuugcuacaaaucugacaaguuuucuagucucacaauuuaaaaaaauuucugugucauuacaagagcauuucuggcuaugaaauuuauggagaaacuccauauaguaagugagcagguccugagagggacuaaagugccguucucuggauaaguauagugucccuuauggucgcuacagucaaggugacgauuugaggggacauuugcaauuuucccacuuucuuauuuucagaguaaugaaguuuuaugaguguacuagagauuacgaauagauuaguucuuuauuucaccuuuuuaaaaauucuuuugauuaagaaagcacaauaaugaauuuaauaauuuguuuuuaugaaauuauuuguaaacaauauccaaaucaauuagcaggcucagaaauuacuguuucauuuccuacacauaguugucugcguuuuuugccaucuuuagacugcaccaaagccuugggcaugugacucugucaccucuuuagaauaucugagaagcaggaaggcacuugcuguaggccgaguagccugaguuugaccugcugaagccacauaaagauggaaagagacaacuaaagccauggaguuuccucggaccuuuacacaugcgccugcgcacucgcacacagcggugcacacacacaacuaaguaaacaguuuuaaaagagcaccugagaauuauccauagcauuccuucguuguuaaaaggccgaggaggagucuuagcuggcuacguugagggcagaaggcggugacaguaagucaccuuccugggaguugccauagucaucuaaacuauaauguggcauucaggauguugcuaaaacauuguaccacagaaccagguguuuggaaauacuggaaaaugucauuauuuacaaacacuuagggaauauuuuuuauguuuccagaauucuucaacauugugccaagauaaggcuuucccuaagccacaacuacagagugugcugcuggaaaaugguaugugaaagcaagcucguuaguugucuucuuguuaggauuauuacuugcacauucaaacugcuguuguguaagucaugugagaaagucuuuguaacuuuguuuuuuucaagaaaauaccuaccuugagccagguacaguggugcauaccuuuaguuucugcacuuggaaggcagacgaagacagaucucuugaguucaaggacagccugcgcuacacagaggaacccuggcuuaguugugguuucuauugcuuagacgaaacacaaugaucaaaaacgaccugggagcaaaggguucauuucacucacaguuccacaucacaguuccucuucaaaggcagugagggcaggaacucaagcaggccaggaaccuggagacagaggccauggaaagacccuucuuacuagauuguucaucaugguuuucccagccugcuuucuuauaaaacccaggaccgccugcucagggguagccucacccacagugggccacgucuaucacuaauuaagaaaaagcaggucuuauaaagacauuuucucaauugagguccccuucucucugaucauucaacuuguggcaaguuaacauaaagccagccagcauaaacccugucacaaaaaccuuaaauagaaaaaagagagagggagggagggagggaagaaugccuaccucauagacagguugggagacccggcuucuacuguagucuuuguuuuaagucccaggcguugcagauauggcagauguucugucacuuaggcgucccuugugucccugugcuguacuuuccguguccuagauacuuucuuuaucuacauaagcucuuaccccccaccguguagggauuugagccuggcuuagaacgcgccagucacacacucuuaucacagagcuaugcaagcuucccccgcuccucccgcuuugguuuuuuggugcagaauauugauauguagccugggcuggcuucaaacuugagaucuuccugccuuagccugccaggugcuggaauuacaggugugugccaccacgcucagccgauucuuucuuugcuuuuguuuuaaagauuuauuuauuuauuauauguaaguacacuggagugugaagaagaugucagaucucguuacggauaauugugagccaccaugugguugcugggauuugaacucaggaccuucagacgagcagccagugcucuuaaacacugagccaucucuccagcccucuuucuuuguuuuaaugaggaggaagagauggggauuguucgaauuuugaguuuauguaaaaguacucucaauauaaaucguaauaguaucauauuuuaccuuuuuuacaaauguaaaaguaaauucauuaauucugccuuaaugacucucagacauugauuucuaaauccauacucauuugauuauagaccuauaugcuauuauaauucauaauuuuugccuauguaaaguucauagcagaaugguagcuuacagagauauaagaacuuaaucuuauuaguuagacaguuuuggcugugcaauucuugaaaagauaaaauauagguaagagcucuguauaguacucaacauuugaauaagacucuugaguugcuucagaguucauuaauaauuauugaaaucuuuuucguagaaagcucugucuuaugcuaucuuuguuuacuugguuuuaggcaccuggaguaaguguuagcacuauccugcccgugcuucugaaggaaucccucaucccaggcguggggagauuccuugccuacuccgaugacaaaguccaugcugucuuuuuggauggcgucacaguaacacugaauuggcaucucagcuccucugcugagaagaaacaagugagucugccugagauccccaaccccccagugcuacaaggcucaacucaguuccucaugcuguguggaccccaagccauaacaguauuucuguugcuacugcuuaacuauaauuuugcucugauaugagucauaguguaaauaccugauaugcaggauaucugauaggcgaccucuguguggucacagcccacagauggagaacuguugccuaagacugaaauccauuuauuacacucaguagaauuuauuauacaguguuuguaauugucaccuaugagauaccauuuugguauuagauaguuguguacauuauauauuauuaaugucaggauaaacguuaucuccucaaauguuauuucuuuauuacaaaaacauucaagcuccuauagucuagauuuuuuucaaaucuaauacauuauucuuagcuaugguuugucaauuauagucuaaauauauccugauugguuacuuaucuacaggaacuagaacagaaaacaguacuacauuaucucaaaguauuauauuguuaguuuuuuccuguguauuuauguguaccugugugaguuuaugugcagugcguggaggaucuugggaucaagagagaggaucugaaucccuagaauuggaucacgggcaauuaugagccaccauuugaguucuagagaccaaacuucuguuguuguuguuguucauuagaaauuugguuuuuuccuauuacuucuuauuuucuuucuuuuuuauuaguucauuuucucuauuuacauuucaaauguuauccccuuuccugcuuuccccucugaaaaccccuggcccuauccccuccccccucucccugcucaccaaccuacacacucccacuuccuggcccuggcauuccccuacacuggggcauagagccuucacaggaccaagggccuccccuccuauugaugaccgacuaggccaucuucugcuacauaugcagcugcagccaugaaucccaccauguguacucuuugguugcuuguuuagucccagggagcucugaggauacugguuaguucauauuguuguuucuccuauggggcugcaaaccccuucagcuccuuggguuccuucauugaggacccugugcuccauccaguagauagcugugagcauccacuuguguauuugucaagcacuggcagagccucucaggagacagcuauaucagacuccugucagugggaccaaacuuuuuaaaucuaaaaucuugucaagaggcuuuaugaaccucaguggauuuccuaacaaacauuagaaaaguauaauaaauaaaauguaugacaaauagugguguguuuguauguauuugugugugugugugugugugcacauuauaacaagaaagauuggcauucuuacucucugauaacuaucucuguaggugaugacuuaaacauaccacaagccguuuaaaguacagucauuaaauucucaaaauaaaacuuuaaugauucaucuacuccuuuauucuuuaguagguugcaaauguuuuagcucuuacguuuagaaugauaacccuugccucuucuuuuugcuucuuaagguagaucaagggcucagcuucgguuggugcagauuaacuuuuccugauggacaggaucaguuaauuccaacugaacacccuggagcguaugaaagguacagaagagcaauuuuaucuucauguucuaacuggugggguguaaauaaaauuuaaaucuuacaugcaguuuuaguuuuucuagauuucagaguuuucaaguauacugaaaguuaacauaaugaaauaaaucaagucagcuuuaaacauuuguuugcacgcaaguggucuuuuucaaaauaguauguuuccagcauguucugacuugccguggagaguagaaugcggucaguuguauuagccaguuauucuaacuccuuaauggaauugaaagagagguaguuuacaaaugaccacaaaugaaguuguauguuuucugugaugguuaaaaucuagcugaugguuauuccuaaaugcuuaaacugaguuuuuaggaauauaccuuucaguuaauauagcucacuguuagucacaguuaaugugacucuaucaguaggaguccuaacaugacagcaaccugaccugucagugcccacaggcugcuuguucaacaucuugaaauuauuuuucugguggauggccucauuuugguccaaaugcuccagcauuuaauuguuauuuuaaacaauuucucucaagaagauagcacguuuagcaaauguuuuaaugauuguucuguccugucacuugagaucauucaguuuuuaaacuuguuucauuaaguuacauuucaucauaugcgcgcgagcguguguguguguguguguguguguguguguacuuguauaugcguguauaugcucuaacgggcauuuaaauuuuaguaggcaaaugcuuccauagauuguguaaauauauuuucauaacaagcuuaagggauuugacuuuacuuggaaaagcuaagaagaaaaaguugagauguuuacauuugagcuuucaaugaaguacaaguauuccuuuugugguuuuauuuagauguuuucuuuuauaauaugaauauagguaaaauuauuuuacucuuuaugaguaauguaaaaaauguggccuccucugugucuagugaauacaauuaagaaaauuuuauugccucauuuaaaacuuuucuucauguuuuuuuccaaacugucuuauugauuuuuuucauuucuuacauauuuguagagaauguacaaauuuaggcuagaaguuuagcuagauaguagagcauuuccucagcauagaccagaaucugguuccauccccagcauacaagauggagaaaaauucguaaaaaaaaaacuuaaagccagguguggugacacacccuguaauuccaacacaugucaggaucagaaguucaaggucauuuuuuacuacauaguaagcuagaucccaaguauuguuuuaugaugauucauuuuuauuauuguacauauuaacuauauaaauuaaugggcuuuccuaucaaaucuuugugauguguucuuuccagauaugugacaucaguaauaucauggugcagaggacuaacacagacuagcccaagacaggugcccacacaucucucaccugcucucaaagaaaacugguauuuauauuucuuacauauuuguagagaauauacaaaucuaggcuagaaguuuagcuagauaguagagcauuuccucaggauagaccaugaucugguuccauccccagcauacaagguggagaaaaauuccuuaaaaaaaaacuuaaagccagguauggugaggacugaacuuaggucaucauccuaaguaguaaaccuguaccuacugaaccauauuaccagcccuugugucuuggucacuguucuauugcagugaagagauaccaugaguauggugaaaacuuaaccugugaauaagagccaguacuuaaaaauuaauacggugguuugaacaagaaugacccacauaggcucauauauaaggaaguagcacuguuugaaaggaucagaaggauuaagagguguggccuuguuggaggaaaugugucacuagggagggcauagacauugguguuucaaucugacuggaucaggauguagcugucagcuacugcuccagugucauaacccugugugcugccguguucccugcuacaaugacaauagacuaaacuauaaggaagcccccaauuaaaugcuuuguuucauaagauuugccuuggucaugguaucucuucacugcaauaggaugcauucuuaggaugaugaccuaaguucaguccucagaacccgguguaaaaucaaaguuguccucugacuacauaugcaugcaggcauucccgcacacacacaaugaauaaauguaaaaacaauauuuuugaaguagcaaaugggaaacccugaagccuuuuuuuuuuuuuuuauuacccaaaaagccuuuugguuuuaaacauauucaacucauaaaauguuuuguaguaauauaaucuugaaaauaacuuuuuuuuuaaaaaaaagacuuauuuauuuauauguaaguacacuauaguuguuuucagacaccagaagagggcaucugaucucauuacagguggcugugaguuaccaugugguugcuaagauuugaacucagaaccuuuggaagagcagucagugcucuuaacuguugagccaucucuccagcccugaaaauaacuugauucuuuaaaaaaauacuuguuuuuaagguccuaggaacuggaguuacagaggguugugaacugccauaccugugcugggauguacagaaaacacugcauugaaaauuuuauaucaaaaugaguggcucuuuaucugugguaaauuaaaaauuuuguggaaauuuuaguauuauuaaagaaaauuuaauacuauguaacauacauuuuuaaaaauugacuuuugaauaauuucugucauauuaagucccaaauuauuuagcaaauuaagcaaguauuuuaaucucucaggagacuaggccugggcuccacacaaauguuugaggggcgucagacuucaggaguaacuugagcagagacagaaagcaucauucaggccuggagagaugucagcagcucagagcacuggcuguucuugaacaacacaguuucauucccaguucacaacccuccguaacuccaguuccuaggaccuuauguccucuucuucucuccacacauaugcaggcaaaaaaauacacauacacaugaaauagauuuucauuuuaaaaaguuuuuggccucuggagacagugagaagauaguuuuucaagagcagauaguaucugcuagaauauaaguuuugauggauuaagacugauuuuauaauaaauaaagaaguucgcaugggaugaaaacacaaguucauaaguggaaaaauaauuggaaggucauuaccaacuauuaccacugaguaaaaucuuaguggacuggaaaaggauaccaagagcgauugaagaacauacuuuuuuuuuaagauuuauuuuuauuuuuaauuauguguauauuuaugugccuauguguauauaugcacaagugcaggucagccugagaaagccagagacaugaaaucucccagagagggaaugcaggcaguugugagcugcuaacaugggugcuaggagucaaagaagauccuccacaagagcugucugcgguuuuuuuuuuuuuuuuaauuuuuuuuuuuguuuguuuuuuuuaugaguacacuguagcuguacagaugguugugagccaucaugugguugcugggaauugaacucaggaccccgcucauucuggcauaaagauuuauuuauuauauguaaguacacuguagcugucuucagacacaccaggagaggacguccaaucccauuacagauggugugagccaccaugugguugcugggauuugaacucaggaccucuagaagagcagucgaugcucuuaacugcagagccaucucaccaccccacugacuguguucuuauccaggaauuugcagucccaggaaucugcuuuggaaaccuccuucucggaucagauccaggguguuauauaucuuagggaaauacuucagugccaagcuauagcacaagccuaauucaugagcuuuuaaagaauaagauguaagguaucccagcguacguaacaggauaaugcacagccagagacacauuaaaccugaguuauauccuaugcccgagugaauaccuguuagauuaaaucaaaugaaaacaguagaugugauuuuagugugccugccuuuauaucuccaccuugcagaccccucauccuucagucuguuucacagcaggaaaguuccucaaagcagcuaggaagaagggaaauugcauauguuuauagaacugaucacuaacucagaagaugaauggguuuuuuguuguuguuguuguuuuuuuaacugcuaucuuguuuacauaaaaacugaaagagguaacugcugacauauuaagaaaugaagcccagcauaguggcaaaugccuuaggcccagcacuuggaaggcagaggcaggcaggcaggucuccaugaguuugaagccaaccuggucuuuaugaguuccaggucagccacaguaacacccugucucagacaaaaguaacagugcaguuggugacacagcugggugacggcuggcugugagagacagcuucacuccucagacaucucccagagcucacguugaaugugcuuugaaggaagaaaagagaucacacaggaaauagcucucuaaauuguauuucagcauuuuuuauuuuaccuuaccaucauuagcguauugauucaacuucuuaguaacuuaaauaaaaggguuuuuuagacaaugcccucauuaauuuuucagagguagucaagcugugguauuuguauagcguuccgacucggggacgacaagcuaggacauucaugauaggggcucugcuuguuguuguuauuauccucaugcuucuugaccuccugccuuccugucaugugugguaagagcucauauuccuuugucacccuuuauccuccauaggucuguugcuucugagcuugagaaaauacagaaauuuaacuguauccuuuuacgaaaauauaucauccuucagaaauauucccauuucagucagggcuggguaaugacugcuuuaugacuaugagucuguccauacauguugcugaguuuuguuaagucagaugauaucuaagauauuuccuuguuauguuaacauuuauacuuuuauguuugaauuggguaaagaauggugagcuaggguuaaagucucuuuuggagacauuuucucuaauauauaauuauaauuuaaauuauagcuguugaaaauauaucuguaacuuuauuaugaacccuuccaucugaauuuauuuugucauuuuuauuuucuguaaucuuacuguugugugacauuuccuggggaaauuugauccuucauuuuuucacccuauauaggaccaacaauagaccaaagagacaauucugcccaaauccagcacagugaacuaacgaguuuccuaggauuacuuagaggagucugguugcagggaucuuuacagaagcaucaugacucaaaggcaguagaugugauccccuaaaagcugaggaugucugacagcccauaaaacugcaucucaggaguucccugaucaaccuacaaguaguucaccuacucagaguaaccucuccccagcaacaguuagugguuauagggccuuggcaagggaccuugucaauguuguaacuuuuaggagcuuccugagccuuguaagauucauaugcuuccuggacaguguguguuuuaccuacuucugaguccugugaacucccucuuucccuccaagaaggacuguuucaauugagaaaaaauaguuauauaguauacauaaccuuacucaaauaauaaauuaguucuguaagagaagucaaauuuucuuugauuguagauauuuguuaauuuaaaaaugcaucauucauuguuuauaacuaucauccuacccuuucccuuuuuauuuucuuaacaaauguagguuaagaaauauuacugagguuuucuuuccuuuccuauuaaucugccauccagacacacaucauuucucacuuucccugcacuguggcugguguccucauccauaagggguagacuccaaaaacucgaaagucccagugcugucaagaauucaguagcuauuccuugcaacugagaaauaguauuuucacaccaaagccaagcuuucugaaaaucaaaccauguaaugaaaaacugugggggaaagcaccuuaacuaagucauucagggcuguuggaaaacagugguguccucaaccuaacuucuagcaagaaugagcaguguucuggucacuguaaaucaggaucuucagaaaccuugcuggaagcaaccaaugaagagaggguaucgguagcauugaaaagaacuucugaaauccuccaggauauugaccgucuucugucacucucuagaaagugaaaaaugaaaguauuauaaaaccugaaggacguuucaaguuacuaguguggaauugcuacagacccaagacauugcagauguuacuucugcggaaugauugugcagaacugacuucacuuugauuguguuuugcucaucuuguaaacuuuaguguuuguguguguauacauuuuuuaaauaaagaacaguuuugaaauuuugaac

SEQ ID NO: 7253 - RNA, 2960 nt, Mus musculus
agaaaacaaacguuuauuucucuaccuuaggcuuacccauaaaaauguaaacucaauagagauuuuuccuggagacggaucgguuuucaagucagaaggggcucauuuugguaacuauuuuacauauuauccaagucaagaagaaucagaaaagguaagcuaacuaugaaaacucaagaguugguauaaagcucuucuuaaagucauaauaugggaaacgugcugucucuauaacauuacuucccucugcuccggggagaaggcagcgggggaacugaacaaagggcagugcuuauaucggauuucuuaggggcuggagcuuuugaagcagacauuuccaauuugaggauuggugggauuucaaggccugagcuuguggagcucagggauugguggguguuuuuucccuuucccugcauccggcccauggauucgggugggaagucuuuccugacugcagccugguuuugcuggggcaccaucucuguggggcugcugggagcuggggguauggggaaggauguguugccaccuuggacagcuuuguaaggggcagcuccugcugagcaggaaaugagaugccccugugaaggcugcaggcugaggagauguggcugugcugccauuuagacaggaguugccauuuuugacaaauccugccagggcaucuuaccacagcuguaggcuaggacagguagaaggggccagccucagcuuuugcgaccucuuagagaccacaguccuuacugggagauaagagccagacaggagaaucggucccucaccuggcauccuaaaagucaugucucugucugcccugccuagccauuggcugccagcaaccuuauuuuccaaucagaaccaaccggggccagggucccucagugucguaaucucgaguaaauccgggucuuggggacccagauuaacauaauacaaacaguuaugggugcauguauacauaccucaaggaaaaagcuaaauaacgagggucauauuuauugagauuuuguuuguuuuaaacuuucagagagaagagaaaacuuacucuguaaauaaccuuccuccagacagaccaggaaauuucuucucugugcguucucugauuaaacaggcaaccaggugaguuaugauacucaucucguacaucugaaugccuugauguguuuccucugauuaaggguaggauuaagacuggugcaaugggaauaugugucuuugcuacaaaucugacaaguuuucuagucucacaauuuaaaaaaauuucugugucauuacaagagcauuucuggcuaugaaauuuauggagaaacuccauauaguaagugagcagguccugagagggacuaaagugccguucucuggauaaguauagugucccuuauggucgcuacagucaaggugacgauuugaggggacauuugcaauuuucccacuuucuuauuuucagaguaaugaaguuuuaugaguguacuagagauuacgaauagauuaguucuuuauuucaccuuuuuaaaaauucuuuugauuaagaaagcacaauaaugaauuuaauaauuuguuuuuaugaaauuauuuguaaacaauauccaaaucaauuagcaggcucagaaauuacuguuucauuuccuacacauaguugucugcguuuuuugccaucuuuagacugcaccaaagccuugggcaugugacucugucaccucuuuagaauaucugagaagcaggaaggcacuugcuguaggccgaguagccugaguuugaccugcugaagccacauaaagauggaaagagacaacuaaagccauggaguuuccucggaccuuuacacaugcgccugcgcacucgcacacagcggugcacacacacaacuaaguaaacaguuuuaaaagagcaccugagaauuauccauagcauuccuucguuguuaaaaggccgaggaggagucuuagcuggcuacguugagggcagaaggcggugacaguaagucaccuuccugggaguugccauagucaucuaaacuauaauguggcauucaggauguugcuaaaacauuguaccacagaaccagguguuuggaaauacuggaaaaugucauuauuuacaaacacuuagggaauauuuuuuauguuuccagaauucuucaacauugugccaagauaaggcuuucccuaagccacaacuacagagugugcugcuggaaaaugguaugugaaagcaagcucguuaguugucuucuuguuaggauuauuacuugcacauucaaacugcuguuguguaagucaugugagaaagucuuuguaacuuuguuuuuuucaagaaaauaccuaccuugagccagguacaguggugcauaccuuuaguuucugcacuuggaaggcagacgaagacagaucucuugaguucaaggacagccugcgcuacacagaggaacccuggcuuaguugugguuucuauugcuuagacgaaacacaaugaucaaaaacgaccugggagcaaaggguucauuucacucacaguuccacaucacaguuccucuucaaaggcagugagggcaggaacucaagcaggccaggaaccuggagacagaggccauggaaagacccuucuuacuagauuguucaucaugguuuucccagccugcuuucuuauaaaacccaggaccgccugcucagggguagccucacccacagugggccacgucuaucacuaauuaagaaaaagcaggucuuauaaagacauuuucucaauugagguccccuucucucugaucauucaacuuguggcaaguuaacauaaagccagccagcauaaacccugucacaaaaaccuuaaauagaaaaaagagagagggagggagggagggaagaaugccuaccucauagacagguugggagacccggcuucuacuguagucuuuguuuuaagucccaggcguugcagauauggcagauguucuguca

SEQ ID NO: 7254 - RNA, 1669 nt, Mus musculus
ggaccuugucagugcuguugcugagugaagugcuugccgcggagcugcccuucagaccuuugccgccauggccugcagaccuagaagcccaccugguuaugggagucgccgcgacgguggugugagcccgcgguccccugcgagauggagucucggauggaagcgcagagcagacagaggggaccagaagcccgaggacuccgaggaaggcgagcuccagacuucggaccacggaccugaaagcuuuacaacuccugaaggucauaagccccguucuagauguucugacugggccagugcaauugaagaagaugaaaugagggccagaguuaacaaagagauugcaagguacgaaagaaaacuacucauaaaugacuuuggaagagauagaaaaucaucaucgggaaguucugauucaaaggagucuauguguucagugccugcugauguggagacggaugagagugucuugaugagaaagcagaagcagaucaacuaugggaagaacacuauugccuaugaucgauacauuaaagagguccccagacaccugcgacaaccuggaauccaucccaggucccccaacaaauuuaagaaguacagccggcggucaugggaccaacagauuaaacucuggaagguggcuuugcauuuuggggauccuccugcugaagaacgaugugauuugcaagaaauacaaccuguagaucuuggggaaauggagacagaauucacagaaagcagcucugagucucagacaaguucacaggauaacuuugguggcuggcacacccaccaaagucagacacguggacugccaaguggagggugaguuugauuugaaagcuuguuuaacugaaccuuugaaagacuucucugccaugaguuaaccgccaccuggugguuacucggagaaauccguggcucugccuggccaccuggaaggccugaguggcugugcauuuguauuuguugucucuguuaagaguuuauuuucucaugauaaauuguuuuucuugccuuauuuuuauguaugguaaauguguuagguauguuuuaaauuguaaaugaagcuaaaugcaguggagacuuaacccuauuaucuuucugccccccaaguuagacaacaggaaacuggagccuucaguugccacuuuucagauguguuggcaguggauuuuaaccaugugucuaugggaccaauuuagaaucagcugccuuucagguaacugauaaagaauucucagucaggcagcugcaaugacucuguauaaacuuauuuucuggucuuuuaucaaugugaauguaguuuucccucauacagagcucuggacaaaggaugcuaagcuauuauauuaaugggcugcauguaaguuauauaguuuuaauuuggaacuugaaauagcauuagugugagguaaguaucuuagcacaugcucugugagagcugaggcagaagagagggaguuagaaagaacuuuguuuuuuuaaugaucaguuaauuuaccagguaauauugcuguaaaugauaauguguacagauacucuguucauguauucaguuguaaacuugucaauauuugcacuucuauugcuuuuguauggaaugauaauugcaaaaauaaagacccuuuaacugaaaaacaaacaaacaaacagaaaaaacaag

SEQ ID NO: 7255 - RNA, 133634 nt, Mus musculus
ggcguagcgcgcaggcgccaggccaggcuacuucgcgcccggggacggacgaaggcaguccugauccuguugcggcuaguauagcagcgcuuucuaacccucuccccacuugccucaguuccccuuccccgggcccuuggggcuuuucaucucagucccugcagcucguuguuuccgcguacucucugccuccaggaugccggugacggagaaagaccuggcggaggacgcgccguggaagaagauucagcagaacacguucacgcgcuggugcaacgagcaccucaagugugugaauaaacgcaucgggaaccugcagaccgaccugagcgacgggcuacggcucaucgcgcugcucgaggugcucagccagaagcgcaugcaccacaaguaccaucagcggcccaccuucagacagaugaagcuggagaaugugucuguggcucuggaguuccuagaccacgaaagcauuaagcucguguccauuggugaguguuguggccaggcccuaaauuugcaguaaucgggggguauccggcagcgcgccccacugcgcaucgcuucccgggugugagggagggggagaugguccugggaugaggaccuaggaacauaggccuuuccgcggugccaucugugggcugggaccuggcgugauugcucgacacggugcuccuggcggugccgcugcaguguugggguggguuaagcacucagaccuuccagucacaccuggaauuuaauuugcgggaacuccugggauugcuggggaaaucgucugcugacccuaaugacaacgccguggacucaaguaccaaaucccuacuuuacgcuagccaggugcgccuagagcugagugacccgcccggcugaaagggcguuggcuucgagucugggcguggagaccuaggacgcgaccgcgaccgcucucuugcuuaggaucucaccaccuagguggagacgaggaccugagacccuccccuucuuagaccggaaugggugugggcucugagguuggaaggggcgucacaggggaauguccucacuuccuagcucuggcucagcgcuggccgguuccuucagguugagauaauuuagugguugauaauaauuaauguguguagaaaagggcuugacuggcgcuggcuguguggcucucugaguuauugacguccgguggccugagauguucuuaggcccauuuuacagaagaggggacguuuaccgggcuaauugacguucccagggccaccuccaaugugguccaacuuagaaguaaagcaguccccacccccuuuuccugggucuuccugagagaguuugaguccugcuuuuuuccucccgccuugggugagagaauuaagaccucgaguacuuuaggcuucuaaagagaaaacagggcucuugagaauguguuuugugauggacaagggagguguguauuaugcccgggcucacuuguuugcccccguaggcauucgugugugcacauauagcaucuauuuaugaaaguuuuuuuuuuccguacacagugggugugcaaaguauuauguagaggaugugugcacuucgugaaagggauucuuagggcugagguuucuuccugaggaagcaaggccauucuagugacuccagugacagaaaggaaggaagguggguguggcuucugggacuuucucuaguggaaagggguucccucuggacugagccuccuccuggccucgcccuggacuuuccccacaccugugcuggcagguagaugcgcuugcuacuuccuggggccaggccgcuagcuaccagccugccucccagcaagcucucccucccagggguggguucucaguggaggaagcugccaggggugcaucacauggggggugggcaucucuuuuauugaggagggaggaccucagaauucuacaggaacucuacuuuccuaugaagagugauuuucaaagccugccuggcugagcuggacuugccuucauccauuguuuuaaaugcuauauguauuucauuaacucaacaaagaaaauuaaauuaaaccaggaguuaaaccugacagaacugcuuuuagaagaagaagaaggagaaggaggaggaagaggaggaggaggaggaggaggaggaggaagaggaagaggaggaggagaaggagaaggagaaaagaaagaaaagaaaucacagccccagaaaaucaaggacuuccuaauugacuagcuguuuacucgugggcugcugcucccagccaugcuccuccaagcuugugggucucauucuggccuugccugguggucccucacaguuuucuaauugguccucaugauuuccacucgaaccugcugaggccugagccccccauugccuaacaucucacaguuaucuuccauucaucuguuacccauggccagcugugucaguaguccuucacaaguuguacuguuugauuugucucuuuaaaauacuucuuggaucauauuccccagaguaguauuccuagguuagagggugugaccacauacaacuccucccuagccucccuauugcuuuccagaaagaucucucagcaaacagguuuuccagccucuggagaccuauccaucuugccaggggcccagacugcugcaggaagaaauggagccuaggccuagggauagaugucauagguaaugaccagcccaaaaaaaaugucaucuggcuuggaccuugguucgcguguguugucuugugcuugccaugacaguuuuuacuagggccacccacuguauguucuguugacuguucccauugaauagccaggauaaucaaucaauugauaucaauuaauguccuucugauaaugaucuucucuaacaguccccuagagggucaggcagggguugaguucuguccuaggcugccacauguuacuuagaaagcaguugcuguuguuaaugaugcuguuguuaguauuaguguuuccuacuuaaaaagacaggaaacagaaaugaaccaaauucuagaggcaacagggcuaggaagcccacggagcccagaaugcaugauugccaagcuauugaauuugaacuucgaguggauuucuuucuagugucagagagccaauacagccucccuuccucuucccugcauagaaggguugguagagcuuacuuacacuuugcaguuccaggguguugaagcuggauauccacagucugaaccuuagccucagacgcaguagguagggaucaugggggucuuugaugagagagaggcaagauuaauccucugagcugugaugacaucuccuggaauuaaauguuguaacugucaggagguguuuugucuugcgguugguugacuguugaggaauagcugcugucuccauugguggcguuuuauugagcauucuuguucuccgggggcucauguuuacuccauaacgggggaugcuuauuggaugaauucagagcaucgcuguacaccguggcuaacgcccaacaguuuacacugugagaaccuuuagaaucauguccguaaacccagcugugagacaugagauggucagcagcugccagaggccagugacauaucugccaauaacuucugaaagacagccauggcuauuuguuugcucacauuugugguuuaucagaaguuggucccacccuaggcgcuaucccaacauugagaguuuuguuuaguuuccuaugucuugagcaguucgcagagaggcucagccugccugguuacaggguuuuugucaggaguuggcaguauuauuuacuuguuuucuccacaaaucuuucugacuuuugggcagcccagcuuacuuuggaaagaaaagaagucuccaggcccaagaaugacaauugaggcugcuagaaauuuggguaaucuauuaugguuugguccucugaaaaaggauuuucuucuuccccguuuacaagaugcagcugacgcugaugcacagggucaaccuaggcacuguuagugugaguuccuaagccuuugggucccuggcugggucaccaugccacuagcaucuccuucuuuuugucuccucaucacuaaucugaugcaguucccauuugugauuccuuaugaacgagcaagcaaaagccacuguguucuuuuggaccaugaaaucuaagagccacagagaguacuuauguagcaaaaucucaauuuguuagaauugacaaauucagggccauuugcaacaagacagaagcacauuacugugagguauauuaagggcaaagggggucggucaauucucucuugccacaaaguaacuauuaaaaauuuucuacaccucuauugucuaauugcugaaagagaaauaauaaauaacaccuuagaaaaguuguugcaaggauaauuuuacauaucuuuugcuugcaauaaaaguuaauauuccuaaaaguggcugaaacagggacuggagaguuggcuuaguagcuaagaacucuugcuguucuugcagaggauccgaguucaauucucagcacacauacgaugucucacaacuaucuguaaauccagucccagggaauagugugccucuuuugaacuccauaggcacuaggcacacacacauguaugcaagcaaagcacucaaacaaucaacaaacaaaacaaaacuauuguuugaaguggcuggaguagugcaggguacauagcgagugcucugugagugcuuguuaacuagacaggcuacuaugagauuaucucggguugggcuggaagggugugcgcauuggacugaagcugcaagccgcgcucucggaggccaguucagcuggcuaauguugauccuacuugcuaaaauagaguguggagcugcuuagaggaugucuacucuuggaagggggugacccugcugugcucuggcugcccccaggauccauucacaccagcuuuguuucugagcuggacaggagcuccaggcgccugucauuccaaccucccaccccguucaggaaucucugggccaaaucacuuccagaugguggcugcugggccucugcuaagcuuuaacaaugguggagccagcaugccagugaguggcugccuucauucuuggagggucugugggaagaaggacuuuuauauggagccaaguaugucuuuaggcacucccugacccacggguccagguucugcccugugagcaggcaacacaaagugggcugcugacgguguucaaacccaaagcuuuuugaccauggcaagggauucuagacaucuuacuuuuuauauacauagaaucagcagguucuaggccuguugaccaggcauggacucaagagcuagacugcuuggauuguaaugcucucacucugcuccauaacagcucuaguguguugcuuuaauuuuucuaaaccguggcuuuucuaucuguaaaaugaaggaaaguaauaaguagucccuauagaguaguggcagggaguggaaauccgaccagccuggaucuagagcucaauuggaagaauucuugccuaggauaugcagagcccagaauuugaaccccagaacugagugaaccugucaugguggcacucaccuguaauuccaggacuugguaaaguagaggcaagauggucaaaaguuugagaucaucuucaacuacauggcagaucuaaacuuacucugggcuacaugagacccugccauucacacacacacacacacacacacagauguuaauauguucauuguuaaauuuuuuuguuuguuaagagucucgggcuggugagauggcucaguggguaagagcaccugacugcucuuccgaagguccagaguucaaaucccagcaaccacaugguggcucacaaccauccguaacaagaucugacucccucuucuggugugucugaagacagauacaguguacuuacauauaauaauaaauaaaaaaucuuuaaaaaaaaaaaaaagagucucauguagccuaggcuagccuuggaauugcagauaaugucgccucuucuuuccaauuugaaaucuauacagagccuuuuguaugccagacaaccucucuacuaacauguuauacccuuagugucuuggcuuuucucucuuacuucgucuauuuuauuaucuuauguuuaacuuuacucuuuuuuuauucuaagaagcuggaucugaauuauaaccccgccuuaagccugauggaaugagccauuucaaccuaaauggguaccauuccuacuuuaauaaugauuacaguugccgugcaugauauucuacuagaaaucagcucuuauaucauucauguaacuaguuacugagugugccaaugagcagaguagacucggcuucaucauauaaugagcaauggcauuucuucagaggccuugcggugggacucaugcuuuacacgggacacugaguccaugaccuagggagagcauuuccugggaaagaugauuaacacaccaggugguucucuguaggcuauggugccgaaauggcaagugaggguggguauuggagguaaagacgggggugcugguuauuuuaguuguguugcuuggcgugacaauuggagcugggaaaacccgagcucuauauaagacuccacaucuucaguauguuuuguuagauuguuauugagacaacagcucaggcuggcuuuggccuucaaaucacugaaauuguagacacuaccugcuagcguuugccuuuagugcuuuucuuugauaaaugauaauuguuauaucacuucuacagacuguuauaaaguaauuggauaagacuuuugcuuugccuguauucaguggcaaaggucaccccagaaccgcugcugccacucacccuccuccugccgguccccaugcucuagaacguccuuggccagauucuucuguaccguaagcaggaacauaguuuggcccuugacccuggugacgaagcugcacuguacucgcaguggcugaccgauucuccucccccacccccagaaccugauuuuucugaguaguucagguagaaaccuuggcagggacaguggugugguucuguuuauuuuucuguucuuggaaccagcucugccuccuuccugcuucugcugugcucaauguugagcugugcccccacggccucuccuauaacaccaaguguuuucaugccuucugucugcuaggcauugcucugugcaauucuuaucucuucugccuuauugcaaacccucuaaugcuuuauuauuuuugagauaggcucucacuuuacagugcagauuguucucaaacuugugacccuccuguuuccaccuucugaguguuguaucuuugcauuuuauggaugagaaagcucaggcugaaacccaccucccuuuauaagucagguguggugcagacugcaauuuaugucucaccagaagucacuugucccccaggguggcuaugaaugugacccaugcaaaacuguaaacugacuuaagacauuauguaugaauuguguuccuuucuucuuuuuauuggggcgggggccguaauucaagugugcggucuuguccuaugaacuuuguggaugacuccugucgcagggucaagagcuuacuuagccugaucugugagagucaaguguuuucaugucagacugugcacggccagguaaaugggucuauuguagaaagggguuaugggagagacuuucuccuugauugguugguggugguguuugcuuuauuucuuguuuuguuuugcuucagccuuuacugguuugugcuugauuaaugcaacacuaacguuuucugcuacaagcugagcuucaugaccccgcuucagcugcucaggaggcugagcaucacagauucaaggccagcuuguacagcuuagugggauccugucucagcaugaaguggaaaaagaauagguuugugggguguggacgaggauagcgaucagugcuagaauacgugagaccuagguucaaucccuaguuacgggagguagggagagaaugacauuuccugacccaccuuugugcacauuugccuuaccggccaccacaccagggagcagugauugcgugugcagcgugcuuuccacagugucuuuagauauuucugugaauccuuugccuuugguuugcaguggggaacagcaaaaacuuguuugcuuugaggcagcuguuuggggcuuuguguugugaggccuagaagccagagguggggaaggagguuucccaggaaucucuuauggcuccuguccugccauaaagcaaguguggaccgaggugggggaugugucgagcuggcugugucagcagagcacugguggacauuggcccagcugugcuauguuggaaaugaccucgccuacaucccuuuuuuucugcuaccuuuaaacauuaaccaggggaagguguuuucuggggggugcaguguuccucuccgcacaggucuggcaguggucuuuucuuuguguggcucuggccugccguuccaccaaguggcuuucuguucauuguucagcuggccucaggcaggccaccagcaggaaggaagcugugugcuugaagcucagcuuguguugcccguggccuucuccacccccagagaagcuggucugaaggcccauucagggcucagccuucugaguaguucagggcuggcuuguugaaaggucuggguuuuuacaccgcacuccuguucucugucucugaaggcccuuuaugcuggcaugaauucccuuucucauggagauuggaagcucuuuugacuaaaugggccggucaccuuacuggguauuuucauaaggauuucgccaugccagccaacuuuucuggaauuuccucucugauagaaaggcaaccaaugagguuggaauuauuuggaacuuugcuuggaauguuggcacccucacuauauagggaaacggguggggauuuguggcaaggaguauguaaauuugcugugacacauaaauugagauuuuuaagauggaaaaaaaaaaaaaaaaacccucaagcaguuggcuuuccuuccacaaagaagaaaugguguuuguuuccaccuugugcugagugugacugggacagucaggccucccuugcaaguggagguaggaaagguucugaguggcuaaaaucauguuccucucugcccgcccucugcaagccauccccaacaguuugguuuuugucauguugguaccacaguucuugugugaaucauuccgaguucuuugcauguuccuggagggacuuaacaggcucaaaggaaucaagaaugauucggcaucccacagccugucaagcauuuuuggagaauaaauggaagaguuacuauugguaauaaggcagcaagaaauggggucagacauuuuuugagacaggguaucccaggcuggccuuauacuugguguguaacuaaagaugaccuugaccuuaugauguaccacacaccuuguuucuaugcaggucucugugacuugguaguucccuggcuuagaagggaaaacuccuucagaaagaggcagagcacaguggaaagaucagggaugcuucaggucaucuggaagcaggacccagaagugucaggaauacagaagcuagguagauccaggcuuagaagcaugcguggguggcuugucaugguccuccuagcagcugaagggggguaacugacaccuggggaugggaugacucuggggcagggggauuguuacuggaagggccuagcauucuacuuccggcaaugccucucuuacuacaauccucugugugcgucuuuauguguuuucuccgauauuccaggguuguuacuucaguagauagagaguccguucccuguccuuaggacccguaucccucucuaacaucugacuuggucucuucugcuguuguaauuguuccagggauauaucuuaccucugagcuuagcacuuaagaaauaacuugccgaauaaauaaacagucucuagcacaauggguugaguaauaagcccagugcuuugauuugcuuguaauauguuuguuuguuuguuuguuuguuuguuuguugcaucuuguugcuaaagcgggaacaauuguauagugugaccugugggugucccagacaaacucccaacuuuuggaucugugauguugaacuugauucaguccuucauacucauccucucgucacugacaguugacggucaccuguuagaaagcaagguuucucaagugaagcucagacaaugaacuuaauagugagccacugaggcucagagcccaguagucauagcaaccgcuucauaagaaguagaguguguauauugaguaucugcaaagaaccaggccuuguuauaaagacuuuccaacaauagcuaaaggaagccccauggcaacuuuuuuuguuuuguuuuuguuuuuugagacaugguuucucuguguagcccuggcuguccuggaacacacuuuguagaccaggcuggccucaaacucagaaaucugccugccucugccucccaagugcugggauuaaaggcaugugccaccacugcccagcauucauggcaacuuugaaagacaauuauuguuaaaauguccuuauagagguaaggaaacugaggcacacccagcuggcuaguagggguguguugcauguuugucuauguguagacaucagaucgccugaaacuggaguuacagacaguugugagcuaccacgggggugcugggaauugaaccugggucuucuggaaaagcagucaguauucuuaacuauugaaccgucucuuuagccucaagcauguuuuugaaagaaagguaauuuuuguaggcuggugagguggcuuaggggguuaaaaugcuugggguucaguuccugggacccacauguuagaaggaucaagaacuccuguaaauuguccucugucuucucccacauauccaacaugaugcauguacauacacacaugugcacgcacacacacacacacacacacacacacacacacacacacacacacacacaaaugguuacauacaggggcuggugagauggcucaguggguaagagcacccgacugcucuuccgaaggucugaaguucaaaucccagcaaccacaugguggcucacaaccaucuguaacaagaucugacgcccucuucuggagugucugaagacagcuacaguguacuuacauauaauaaauaaauaaaucuuuaaaaauaaaauaaaauaaaauaaaaugguuacauacauaaauauaauuuuuaaauuuacauuuguaauuauuuauuuugaaaaaaaaaauuaaguacagagaaaagcauggcucuucccugugaagaacuugggugaauuauuuugcuuccuuucagggaguuuggcauacagucucuuuuugcuuguaagugaggagagagaggugcuuuuucucaggaaugagacuguggacuggaacgcucuugugcacucauugcucacacugguguuuguaaccagauucaccuuugagcuuuaacugugcuuggaccagcguuaacauugaauggcuuacuugccccucauuaugguuuggaagucucuugguucaggaauauguuuuggucaaccauggagcagggguguuccagcuacuuccuguguuuuaaaagcuuuaaggaccaacuuuuauugggacugccagggucuguuaauaacaguuauuauguuugguaacuguugcaauuuuugucucauguuuagcugcccaguagagauauucaguuuaguuuuuaguuacucggcuacacccacaguuuaaacuguguuucagaaguccccuggcaggacagaguuggacagccuaguugguuucccuugcccucuuagggacuuguagagauugucccauacuggccggaaggcuucaugcucuuauggaggaacuuuuccccgucgcacaccagacccacagaauaucccauuucuauuuccagugaggcaaaggagauggaaugauagcuacuucugacauagucacguuccaagugcuuaagacaauagggucagaaugacccugccacuuccuugggagucuuggggcaggguuucuggaguguucugauuggaaguacuuuguuugcccugucacagcacucugaaauagcacuccaguccuggaggaccauaaaugucacauaaaucacacccaucccccaucuucucguacccuuccuucauuggugagggucaccucgggcuagaggaagaaggaaucucauuaucaaggaagguuuacccuggcuaggaauuggucaaaucugggagacugagacuguuaucaagagaagaggucaccuggguuuuugauuaucuguugguuagcuaccauuugccuuaguggcauuuucuggccuucugggcaaucuugccuuaaagauagaaagaaugauggcacuuuuacuuguuguuguuuuguucuuuguuuguuuguuuuuguuuuuuggagacagaucuaacuauguagcucuggcuguccuguagaccacgcugcccuugaacucagagaucugccugccucugccuuccaaguucugagauuaaaagcuaaugccuuuuuaaaaaauaaaaaauaaaaaagacagcaucucacacuguagccuaggcagguccaaaacuuggggcaagccuccuaaggcauagauaaaaggcagaagccaccacuccuggcaaugccaaguacucuugacagauucuucuacuuuucuuaucaguuuguauuuuaguugcuuucucauugaugagacaccaugaccaagguaauuuauagaagguuggagucuggugaggagcauggcagcaggcaagcaggcauggugcugggacaguagaggaaaguuaauaucuuaucuguauguaggaggucaagagagcugcgaaugguauagcuuuuaaaagcucaaagcccaucccaggccacaccuccuaauccuucccaaacacuucuacuaaguggggaccaagcauucagauauacgagguuuuggugggcauuuucauccaaaccaccacaguuuggacaaucauuuuccuuuuuuaauuuuuuuucccuacuggcuccuuugcucuucaccuuuucuuucauuaauccauucuuuuugucucuuacaauaucccccccccauuuuuuuucaaauuuaaagcauguguguguguacgugugugagaguguguaccugugcacauguguauauguguaugugagucacaccccauguguaaaggucagaggauaguucuggggggguaguucuguuuuuuuccaccguguauguuguagagauggaaucugagucaucuucaggcuuggcagugggcaucuuuacuugcucgggcaucuugccaaccuucuuuguuuuuuguuuguuuguuuguuguuuuguuuuuuaaaggauguauuuguuguuauugcaugugcgagugaguacuugauuggccagggcaggcaugcauugucacaucacaucacuucaggagaugcuggaggacaacuugugggaauugguucucuccuacaguuuggucuuagagauugaauuuggguugccagguuugcagggcaaacaccuuugucugcuaagcuaucucacaaccuucuuuuaaagguuuuauuuauuucuuuugaugcuguguguaugugcuuaugugggggggggcagguaggacggcuuuuuauaugagugcuggggauugaacucugaccuccauauuuuagaggcaagcacuuuucuugacugggccauuucccccucucuuuucuugcauguuugcuuuugccuugucuguauaagagauggccuuugaaagaauuguaauaugcugaucaccuuuuuguuggcucugacuggccacaggaagauguuucucuccugcucuccagacaggcaaggugaucuguaaucccaggugcuucucagguuuagaggcucauuugagcaugaguguuugaaaccagccugggcaacauagacucuaccagaagggggaggggagggagguaacauuugagagucugaggcaggugaauucaaagccagucugggcuccaaaggaagugagggacaacccuccccccacaacauucucccucauguaguugugggguagaaaaagacacucuggugugucuagcuccuagcaagcacccaggaaaugauagcugauucuguccauagcacugguuccacuuuaucuugcaaaaacaagugcauucugcuaauguccugggugcagcuccugcugucuugucaggauuuaguggaaauuaggagcaguagggagcuagaaagacaagaaggucuuuccaguaucaaucucugcaaccacaaggccaugcugacugccuugcaugcuuucauguggaucaaaguagcaaagugagccaucuguuuccacccagcacccggauagaagacuagcaguccaggacuuggcccuggguaucaauuucucucacuuuaauccaggcucuuaugucugggacauuguagggcagccugugccaccuggcaccagcacuuucacuguccuagguaugcccuuaacccuagcacaguccaaccuugugcuaugaagcuuaugguaguacuuuaacaguaaugcucgggaacuacccugaagaucccugaagguugcuggaucgggaugggcguaggaggcugccauagugaauucuguggauucuaauguaggaguggaucugggaagugacugcaguguccucaguucuccccgcuaccaggcugaagggauguguuugcgucuugcuuccuccauuugccugcugauuccauggguagguuagacuccugacugauaggacaacauaauaaucaucauuuucuuuucugugcccagggaacauccagcccuuuucccaaagguagaguugguaaagguucuugagugaggaaggcagaucuguuuaagcacaggaaggaaugagucagucaacggggcacaauggcuuuuguuucuccagcucgggcaggucaauguaucaauagcaucagcagcuguuuagccaaggcucaggcuagcuauucuuucuuuucuuugguuuuguuguuguuguuguuguuuuuguuuguuuguuuguuuuuggcaggggugggguggguuugguuguuuuguuuuguuuuguuuuguuuuguuuuguuuuguuuuccgagacagguuucucuguguagcccuggcuguccuggaacucacuuuguagaccaggcuggccucgaacucagaaguccgccugccucugccuuccaagugcugggauuaaagacgugggccaccacugccuggcuccaugcuagcuauuccuauucccaggucuaucgcuaaauucauuaggacccccuucucugaccuuacuuuugugucuguaaaaaaacaagaacggaaugaggccagccucuccuggacucacucuggacaguaaaggagccaccuccccucuccuacuuuuacauucuauggcgguguccauuucauccucacuuaauuuuauuuccgccugcaguugacucacuuuuacaacagauguaauugaaaaggagacuuugugucacuaucauaauggaaaagcaacaucacugaguaaauggaagguaaccauaaauaaacccaaaacaguguuauaaaguagcagccagcuugccucugcucagcaggaggccucucugcuuguaguaaaagggggaaaugagcagcugagcuuguggaaaguaaccaugagcgcacuaaugcuaagcccuucuccuggccugcucagaccugauggaggacuggaccugcggggagaaccacaucucugaugcaucaugacugguagccacgcagcucugauuacauuaguaauuuacagugguuucccccuuuaucugugguuggagaccauggagauaaacaaugaguaaguuuuaaguuguaccccgagcuggagguggugucucaccccuuuaaucccaacacuuggaaggcagagguaggugaauugcugaggucgaggccagccuggucuauagagagaguuucaggacagccagggcuacacagagaaacccugucucaaaaaacaagcaaacaaaaaccaaaacaaacaacaaacaaaauuauacccuauucugaguauagauucuuacaccacccacgucauccuuccgggacagauccauucaauugucaggagggucuacgucccauuuauuuauucuaagucugcuuuguaaaacaugauguagguccaagaagcaaacugaaagauuauuugcugcgauacuguuuguguuaaguuuuauuugcauguguaugcaaaaccaauacauauauauauauguucaugggaaugaccgcuaacaaauugugugguugccaggcuguaugugugccguaacuggggcauacaguccagguacacagcugguugugguagugcauuuguuaaaucccagcccuggggguugggguggggggaggaucucugagaguuugaggucagccuggucuguguagagaguucuaggccagccagggcuacauagugagauccugucucaauaacaaaagugggaggggguaugcagaggguuuugauucuucauguauuuaauucuucuguugaaugguaauugugucauauuauaauuucccuguucgguguguuuguauagacgauuucccuuauaaaaaggcugagaauguagcucagugguagaguagccuggcacguacaaaguccuggaagaaagaaaagcauaacugacuagaaaugguggcacaaagcuguaguucucgcuuaucaggagguuuggaggaguuugauucaaccuaacaagacaaauauauggauugauagagcccauuucucuauuugaccauggaaaagagaaacaugccuugcgucuauuauucuguuuggaugucuugcauacaaguuugagcccaguuuguaacaaagaacauagaucauccucaagauguugggauaugauaguaagacaaaagccauucaugcugaguaggaguccuccccacagcuguguugaaagaccugagcuaauuaccuuaggaguauaaggcccuccuguugcuagugaacaugauaagcuugggguucccaaagacacagagccccagaaguuugccuccaggaaccugccgucaauagccuuuugucugagagaagauguuuuucagaguauuccaagguacuacugagauauuugcauucucuaaaaguagguagaaguccagaguaggggauaaucugaccaggaaugaauggcagggagggucgcacucugaccuaaacuuugcacuggccaaauuaauucuguugguccucaacaaguagaguguguucuggucucuaaauuuaaaauuuuaaacaaacaaacaaaaaacauuuuuuuuauuacaacucagauauaguaaaggguacuuuaucauacuugcaggcagauacccuuucacccuuagauauacauuccuucacauagaaggguaccacuaccaauaugaagacagagcauaccuguggaccuaugcaacagccuucaaaguuccuuugaacuuugaccuggacuuugauaucucuccauuucagguuuccaagugcugggauuacagaugugugccuucaugcccagcuugguuuuuguuuggguuuuaaaaauacucuucuuuuaaagaugguugguauaagugacagucauuuuaguuacuuuuacaaaacuuuuaaguuuucauguaaauaguucuuguaacuaauaggcaaagguccccauacucccaccacauggguuaacuaguagcauugguagaggcuucuuaaaaaagcagaauaaaaccuuuccaaccaucauuccacagcuagcccauaagcuacaccuacuaugagccaaguugguaccaaauagucacaucucccacuuauucaucuccguguuauagguaggggaacugacacaccaaacgugugacuugccacacagacaaaaagcaauagaggcagacuuuggauagaaugugguaggaugcagucgcucuaacaguuucaggcccuacugcccuacgucauauggcuugaggaagaagguuggcccccugcucccagcagucccaggaaagucucaggauucagugggauuuauccagucuguguucccugcccuggaguacugacuggucauguaacuguuguauuuccccaauuagaaauuaggaacauugaagguaugggaaaugucugguuuuucccagcuagggcacugugacacuaguuugucaguuuuucuuuagaacacucuucauuuuauaaaaacauaguaucacuguguguuucuuaccuagucacuuuuagguuagccucuuguccacaccugugaagagagauuaucuggucacaucacagacaugagcaggggacacacacucacacgcgugcacacauacucacacgcgugcacgcgcgcacacacacacacacacauacacgcacauacuuuacguuucuuuuuaaaaaguagguucaauuauuuuuaaaaguuucauauguguauuugcuugccugcauauaugacugugcaugugcguguuagugccaaggaggccagaagagaggguauuagauccucuggaacuggaguuccagauggcugugagcugccauguaugcacuggggcgaacccagguccuuggcaagagcagccuguggucuuaacugcugagccaucucuccagcucucaauguacauuccuuaaaagauguuacuuagauauggauaagaaauaaaauucaguuuaacugaaagggacauaacauccacgccuucuggaauaccaaguaacuucacagaccugcagacguacagaauuguauuccaucugaagaggccaccaaauuuggguccaugaaaagcaucaagcaccccaccccaacuuaagaaggaagaauucaaagaacaagugaauguuuggggauuggguugguguccagaauuuguuaaaggaaacaaaaagcaaaaacagaacaauauaagugagcaaacaaacaaacaaaauacagcucaaaccagcagccuggcauuuugaauguguuuccagauuggaagaguacucagauaaagcucggagcuuugaaccuuugaaggcuuugcaugacaccacaacucacacacccaggcuaaaggaugcccacuuguugacuaggcaggagggcuggcugcauccucagcccuggcagugugggcacgauuuuuauuaggaccaaguuuccguagagaggcacaugaaaucuucccacugccacuggugagcucaccagggcuggauccacaaaggccgauuguuucggacccacugccuguaagcuucuuaauuaaugggcagauugacuuuucuuacuguuacaaaaaaagaugaggcacuaauaugcuaauuuuuucuuuaauaauauauuuuauugugggaggggcaugugggagcaggugcaggacauccaugaggaggcuccaggagaacuugggguagagucaguccuuuguuuuuaauauugggucccagggaugaaaguaaagucgucaggcuuggugccaaaugccgcugcccaccgagccagcucacuggucuacccuacccacccagccagcucacuggucugcccuacccaccgagccagcucacuggucugcccuacccaccgagccagcucacuggucugcccuacccaccgagccagcucacuggucuguaccaaacuaagauugacuuucucagcagaauaugauuuucccccuguccagggcuggggacuaaacccaggcccuauguauucuggggaagcucuuaucacuugccuaaauguccaaccuugaacaauuauucuuaauggauggauggguuuuuaaguucugucuuuucuugccuuucauuauuugcuuugugcuuugcccuuuggaaaggccaugguaacucacagugggacucagcaccuggcauagagaaguuuuuguagcuggcuaacagugugguccuucaauaccaacugacaguggagucagcaaccaugcagucgccgagagaagagaaucguaaguuugaggcuacauaaucagaccuugccucaaaaacaaggauuauuuguuuuuaucacuaaacaaggauuaucaaagugguuaaguggaugguuauauaugggggugguuggcucuggcugguucucaauuuuugcuuuccuugaucaagauaugauuggugaaaaaauaaaucauagaacagccguuucauucucaauuuguuugcgacaggguaucuggaguuagucuugaucucacccugucuggaggcggacagugaacaggauccugaccuucuugcugugccccccucccuccaagugcuaggaucucaggcaagcaccauagcacacccaauacaaugccacuggaacagagaaaagaaaaaagaaaaaacaaaaccuguuucuuuugcuacuugagacugagccccagggcucucgugcucuaagcaagcuaccccugagcuacaugcucugcccaguuucauuuuuauuuugagucaggggcucaauaaauugcccaaacaacuuuugaacuugacaaguugccugggccugaacuugguaaggucuugaauugggaaucuuccagccucaucuucuaaguaugcaggcgccacaacaccuggaucagcaaaugcuacagaaaaguggugucuuggguuuucuuuuuuguuuuguuuugguuuugguuuuguuugcaccccccacccccuguagcuugcauguagggaaggccuguuucuaaaggugggaagugauacccaguguuauuauuaguauuucagcauuaaucuggggguaaaccaaggcucucacuguacaccugacuugcagucagccugcuggggaacugaaaaugcagcgugugcugcuugcuuucuuccugaugaauccggacgugcucugcagcacucuggggaggacaucuguugcuuuguugcccucucuccuuucuauuugccaaggaugguauuauuauugguggguaggugcaaguuuuauucuuaauuguucaaggcaaguaccugcuucugguaaggagcuguauucucguaaccugaagaggaucacagaagcaagccagaucccugugguggugcagagacaauccugccuccuucccaacacacacagacacagacacacacacacacacacacacucacacacacacaggcacacaugcacacacacacacacacagacagggagagggagagaccacguucuuaggcucuuuuauaagguuagcaucuuaugcacccugguucaagcagcaaaagcaaacugccagaaacugguacucaggaggaguguacauaaauaguuaucuuucacucccacugagcccgccucugccuagcaaaggauaguuguuugcauuuuucucucugaacuucugggcccuuuuauuaaguguguugggugggagacuucuagacuauaccuguaaguccugauaggagccaguaucuuaucagaaccugauugguagggacuaaaugaguucuuuacagaaugcugcuguuguguaugggggcacaccuguaaucccacucuuuaggaggcugaggcgggaggguugugagugcaaacccaaucuguggaaugauguuaguccuaacuucacaaacgaggaaacugacugaggugccucaguuaaacgugaggccgagccuugcccggcagcagaggugggaagauagcuugaguuccagacccagaacuuaagcgucuugauggacagaaaacuuuuuugcuuucuguauacuuuaugugauuauagccagcucucuguucucaugugugaagagaagggauuugcagcagucagucaccagguguaugcaucuguugcagccaucaaaccuggugugccagguuagucuguauccaacggauauuaagcagggcccucaggccaucugaugucgcagguccuggacccagauggcuccuugcucuagugaaggacuugauuuuccuaaagaucugauuguuccgccacuaccagcaauggggucuaaauuccaaacucaguuuccaaauaauagguaacauaucuacuccuguugcauugguaucuuggauacuuaucagguaagggcaguucacauaacuugccuuggagcgaagucacccugagugcagccuugcaaucaccaguaaacaauuacacagauagcucuaggucauccagauaugcuuuugaaauuccgcaggcuuacuucacgugucuucccugcccuccuucuugauuuuucuuuguggacuucccucuggcggcuuccauccugucuucacuguggccaccuggguggucccaaccccaccauaucaaauagccccggaaagguucccggccuuuuacacucacuugcaggcuucugccucugucuguuguagaguucuugggauuuuagcauucuugagauucuuucugugggugauuugggaaaacauuucauuucuucagugucccacacgacccuguucuaccccuuguccucacaggagccuuagaugacugccacuuuucccaugucacucagcugugccauuugugcuguguggauuuccugugcucuagaaugaaaaggccuucuagaaaccugagcacuggagcaucgcggccugcuuucccaggcugcccuggagacuuggccaagcgauaacuccgguuauggauucuuauuaggagaugcuuuaacagucacuuuuagggaccuuggcgucuguagguucuuacccuauucuugagagccuauucuggagaggagagaggagagggagagagagagagagagagagagagagagagagagagagagagagagagagagagaggauuaaaccuuuugccucaggcaugcugugcugcaagcaauucuaccaucaaacucuucucuccauuccucaucuuaacucccccccaccccucugucucgcuccggccuauuuauugauuauauguaaguacacuguagcuaucuucagucaccccagaagagggcugugguuccugggauuggaacucaugaccucuggaaaagcagucagugcucuuaacugcuaagccaucccuccagcccucaucuugacuuuuugaaagauagauucucuaucauccuccuggcuauccuggaacuuacuauguagaccggcugacuucaaacuuagagagcuaccugccucugccucccaggggcugggcaggugccaccacgcccagcuucaucuugcuauuuauuuugagguaagauuucaacguugcccaggcugacuuugaguuguuaauuuauugcucuauagcucagacaacccuucaguagcaacccuuuugccucagccucccaaaucgcugggauuucaggccugcacuaacaggccuggccaugcccugcuaauggcuuuuauucugggaaaccuggcagggagcaggaagcugggaggaaguuaaccauggaggcgcaagugugaguugacagucauccaccugucuagacuucaggucuucaaguacaccaggaagcaguuggagaguuucacagaccuuuggggguggggguggggcagagagugcugcuuguuuugggguuuuuugagacagaguuucucuguguagcccuggcugcccuggaacucccucuggagaccuggcugucccugacuccugagugaugggauaaaggcaugcaccaccacugcuuggucuuacuaaagcauuguugggucauucuaagaaaacaaaagcuugcuggaaguggcagcgcauaccuuugcuuucagcacuugggaggcagagacaguuggaucucuauggguugaaggccagccugggcuacaaaaugaguucuaggccagagagagcuacguagugggacccuguuuccaaaacaacaacaaaaagaaaaccaagccuuaaacuaaaaauaaauaauaaaauuggaaauuuaguaguuaucacucuuuugaacacaauugagaaaaucuucuuaaaaauuuuuugagacuauuacucuugauacuuugauaucauagacuuaguccucccaaacccaaggcucccccaacuccagcaggggcacauaagcauugcuguguauacuccugagauagacaccuuucucuaaaccaguccuuaugugaaagugcugucacaaguacccaccuuuaugcuggauauuagaucccuguaaggaacuuggauucacaaaccuguacaggggcgggggggcggggggguuaggagcacaagaucaaaagcaauugagguuccugguccugucauuaucguagugucugccucccaccccacccccacccccuuucucucugugugaaucucuguggcauuguauacacccugccuuacccacuccucuggcuguucacaucuugguccuacacucaugcagaaaucucuagggagaauccaguucagcuuaugugagggaauccacuccagucagcuguggacaugacaccaccauuaaacaaauucggguugguggaaaaucaucuuaaagaaguugucaugaaaauuagauggcuccagagggaaagauggggugauuuuuuuuucuuuucuuucuuuuuuuuuggucugguugagggcauuaaguacuuuuucaguccaagauguuaaaaauaagccauguccagggcccgucuccaagcuaggaacaugucacccgaaguuccaauuggcuuacguggcuggcuccuuccugccuggaagcagugcccagaucagcaccuugggagcucuuggagcugccucugccccagugugggggcucuuccuuccugcagucugcaucgcugucugaggcaggauggcuucuccuggaaaacuggaucgaugcauuugcucaaggccaaggaucuccccaaacgcuaaucagaguagauuacuuccaguguguugccucuggcuuugcagcaaguuuguccagcguggcuccagugucuagcuucggcugcugcacaugaugcgaacgaguuuguguggaugagccaaggagaagggacggugucccuuguguggaugagccagggagaagggacggugucccuuaaucauccuggccucugcugggccugacagccucugacuaacaacgucauaggucagugacuagccugccuuccacuuccaguguucacacauggggguggagccaucagagcauaaaauguguuagggaaaagguccauaaaaaucaucaccgccguuaguguuaggugaccuuuuugugguagguuuugaacugagcuucauggcugagcagaaguggagacaugggucugaagucccaagaccaaagggaaacagcuccgugcuguggacuugaagcaugaccuucaauaaacccacugaagguuuaauaguuuuucaaguuuucagaaguuuggaaacugagcuguuuaaaauagaagucaaagaaugagacuugguuuuaaucgaaggucuuugcaaaccuugaugugcuuuuugaugcugccccaccuuuacagcgucacuuagcaggacaacucuguuccguguggcgaggaucuagaucccugcucuuaaucacugggcacuuagcuuuugccuuaguccuacuuauaaucauaguaaaaauccuauaaggaagaagacggagaauacacaggauuuucaagccugcuuuacugagguccaauucauauauggaauguguaggaguaguuaaauuugaaauaaagcugguguguguguguaugugugugugugugugugugugugugugugugucacucaaugauggcauaaauagcauauuuuccuaacaugcggggaccuuggugugacuuguuggcacugcagaaacaagccuauaaaguuuuuggaugccuuuuuccucugccuggugaauauuuucuuggaaugccaagugccugugcauggagaugaaaccggauugcuuccuuucugaagcaguguugcuuuccuuaaguguuuggacaccugggagcaaaguuggcucuuugucuuacugccaagaaaauuaguacauguuaauuaacacaguuguuaagcaggucguugggaggucuuuccugguauuuauuuucugcagaguugacuuauuuugaauuuucccccucccuauaaaaaacagaguuguaacagacccuucuaaaaccuucuaugauccucggcugcacuugcuuggucacuguaggagucacacccagagccugguauaugcuauauuccuagcaccccuguguacuuauuuuuugaguuauuuggaaguaccaagcacucauuccucuacacaugucaguggccuucaagaagauuaucauagucauaauuuccugcauaccugggaguuagcuguuacccaguaauggaaugguacuuuguucucgcucucucccccucccacuuccccauucucacucccacucuguguguguguguguguuccagaaggcaacuuuggggagucuuuucucucuuucugcuaccgugcaggucccaggauugaacuuaggaugucaggccuggcagcaagugccuuuacccaccaaaccagcuuaauagcccaguaagagcauuuugauaaagguuucccuaaguacuucaaagugccuuuguaucuuguguuuguccaugcacguaugggugcacauacuugugugcacaugcauauggaggccagaggucuuccucuguugcuuuccacauuuuuuaaagauauuacuuuuauuuuaaauuuuauuuuaaauuucaugcaugcguguguaugugugcaugcaugcucaagcacucgcacacguacaccacucauaaagaggccggcguguuugaggaaggcucucuuuuauuucuacugcaguguauugcggaccgcaggcucucgggcuuucugcacaguuacaguacucaccacuacaucacggcaggcuuuuauguggguuccacacggggagcucuggugucaggcaugcaagcgccuuuaucuacucagacaucucccuggucccaguggugggugacugacuccuacuuaguuuugauuauguuacaaccuaauuuuguauguacauaguguacagcaugguguguuucaaaaaauaaauauggagauaggagacggcuaaguggauaaaggugcuugcuucuugcugcggaagacuugaguuugaucccuggaucagaguuguccucuacagaggacaugcacauacaccuacacgaugcuaauagauaaaaaaauguaaaugucuauguauguaaaggagauuuuuaagugucuacaggcuuuagagaaaagcucuuccaaaggguacagcuuauucuccuuagcagcucuuucugauugaaauagaguugcaugaccaacagcagaauauuuaaguauuaacuucaaaagaaagaugucuuaggaagugcuccugggagccagcugccaugccggaugcugugaggccuuuccucgugcuggcccuuuaccuguaaggccagggagcuuggcagaauuaauuacaaaugaguucagaaugugaaauagcuuuugggccucacagauuuaaucccaaccugaccuccacccugcaguguggauuuaggcaagguuuugaguuuccucagugaagaagggucauaguggauuuuggacugggcuuaauauaaggccugguucaucgugaaugcacaagauuuguugauugaauuaauuucuaaaucuuuguccuccucccaccccgaugcuggggcuuuaagcucaggcuuucaggcaggcugaguauacacauuguauauacuuacuccaagaaccacaccccaagcucccauuucuaagcuuguuuauguuuaacuuuaaauuuuuuuguuuaaauccauugacuguuuuauaaugauggauggauggaugaauggauggauggauggauggauggauggguggguggguggauggauggauggauggauggauagauggaugggugaaugggugaaugggugguugaugguguggggagccccaggaggugaaaagacaccuuuucuccuucuacuaagugggugccagggauccaacuaagguuguuggguuugguggcaagagccuuuacccaccaaguugucccgacaaccuaguucuuguaucuuuucuugagaccagaucuccuguaacccagacuggcuuggaacuccuguguauagucccauggagccuugaaacccuauccuccaguuuaacuaaaggguuggguuacagauguacccacuauacucaacuccaguuugaguguuucagauggaucuuaauccuuucuuaugugaaaccuauaauuuuaauuauauaguacauaucauuugccaguuuccucagccacccauacuacugauuuaucacaguuuacucaccaaguaaguucuugcccauaucauuauagauuuuguguauuaggcuuucguuuauugagcuaaauuaagaauuccuuuuuuuaaaaaaagaaguaaauuucaaauccauugcaugcaaaugauuguauccuuuauauccuucagccaggggguaguaaauauaaaacauucacaauaaagcccuuuggcaacaggguuuguuauucugcaaauaaucuuaauugucaacauucauucccagaaugucaccucagcuucugcucuguguccugacauuccagaccagggugagcuuccuugccgacaggauuguuccuucuggguuuccauggagggccaagauguuacucugaccaucagugcagugccuggugguuguggaucuucuuugcaaaaucauacugauuucuuggcaacaucauagcuuuguuuuaugagucaggauggaguaaggauacuuggaggagugaggagaguacagaauccuggauuuuugugucauccucgcuucucccucagugccucuaaauaaggucucuaugaggcucuggcugauccacaacugugugggcgccacagucaugccuuugccucccaaguaaugacauuacacguauaagcuaccaugcuuguccccuaauuuucuuucuaaaggcaaguguguguguguguguguguguguguguguguguguguguguuccaacguguguaaaugugugguauacguuuacuucuuuuugaucuacuggaagucagacucaggaccucaagcacacuagacagauacucuacuuucucagcuuuggccaucugucccucagccccucuccccuuccuccuugcucuuccccaucccuccuucuuuuccuaucaugguuccugccuccacauuccaaaugcacggguuacauagugcuggggaguccaucucaaggcugcccccacacuagacaagcauauuaccaacagaguuuuggccccaacccucuugugccuccccuuugucccuucuuccccaucccugucccccacacccuggcaguuuuggcaaucgaguaaaccaaacaaagggauaaaaacucacauguguuaccagagaaaaguuacauuugaauuucagauaagcaauguugauccuucuaauguaagagugccccacaugucgcagcucuugcauguuagaaacucuugcacagggcauacuuauuaaauucauauuuaacuuuaccggaccugucuguguguguuuuguuguauuuucaaacucuggcaacccuggguccuguugcaagcugccucuguuuugucuguuuagaggcugguauuugcagcuucaguagguccuggggcaggggcucacuguuuaggcaucacuuaguggcuuugggcucugggguaggggccagauuagcaauuagcuaaacaugaccucauucuggaggaaugugcucuugcuagguauuagcaaagguuuaagcucuagggagccauugucaggcgcucgcucaucaaugaugucaucagcaggagcagccagcuucaggccucaggagaagcccugaagcuaggacuccaguuuugguaauaaaugggaauggaguuucacaggugggguguggaggaauuuauugggcuaugaaggcugacagagccuucugcuuuggugcagccccaaucaggcuucuagauucugaugagcaaccagaagcuucuaauggggugauuacacgguuggccagaggcccuggaaacaucggcucauucuaugaacacugcaggagcugugaagagggugucagggcuguuuuuguagcuccgagugggggcccuuaaucuggggagucagggaaggugcuuuaagggagagucucuggggccacgcuguuucauucagcuuugugugggagggcucuuugugugggaagggguggguccucuagauuuagaugcauauaaugucuuuuuuuuuaaccuugggagaaaguuaaacuagaacaagcuuaagucauuaaccccaccccaccuuuuuccuucucacucaccuguauuuuccuuuuaaagcugcuaugacuggacacaucauuuccauucacaagccuugcugacccagccgaaacuuagaguuuuggucucaguccuuuacuuuggauaacaagccauuuggaaaacuguaccccuucccuucuuuuauuuuuguuuugugaugagagucuuuguguagcaguggcugucuugaaacuauguagaccaggcuagccucaaacucagagaugcaacugccucugccuuccaacaccuaggaucacagggacaugcucuguaacacuagcuggugaguaacucacuauauauacaccagguuaauucacauauauguugacaugugugucacagccacaggaugauuuguggagucaguucuuuccuucugucuuuauguggauuccagggauugagcucgugccaccaggcuugagcagcaggcacccucacguacugacccauucuauuggcccccuucccugguuuuuaaacgaaaguuuugccaugccagacugaacugucgagagagagaggauguaauagaaauuaaaugcuaagugugauaaccacagccaauuaguuuuauuugauugaaauuucucauaaaauauuacaaaaugugaugacuauucuugguugucaacuuggcuacaucuggaacuaacuaaaauuuaagaccgggggccauaccaguaagggaauuuaugcuuaacuuaaauuaggaagguccccuucuaaucuggauucugaggagggaagacacacacuuuuaucaggccuuaagugagaagacaccuauuuaaucugggcuaccccuucugccggaagccuauauaaggacaugcaagaaggcagcuuuugcuuuuugucuguuugcucucucuugcuagcaaguccauucccuuacuggcauaugaaacuaguuaguccuucaugauuccagugacugcugaagaccagcucaggcaugcaagcuuguggacagagcaagccaguaagcagcacucuuccauggccucugcaucagcuccuggcuccagcuuucugcccugccugaguucuuguccugacuuacuuugaugaugaacugugauguggaagugugagcaggauaaacccuuuccucuccaagcugcuuuggucaugauguuucauaucaguaacucuaacuaagacagcgacguaaggaaggaaggaaggaaggauuugauuuagcuuaccguucaggaauacaguucaucguggcaaggaagguaugauggcuggagcgaggccgagcagugaaugugaaugcucagcccagacccuagucugugagcuuuugcuugacaguuaaaauuaaccauuacacgucauggucucuaguuucaagcguauacguuucucuggauuucuugaaguguucauguauggaauucuaggcauuucuaugcaguugauaugagcacacuuucacagugagcugugugugccugugcaucuguguccugguucugaaguucuuauguaugcuaggcucuacuguuaggcaucuagggaggcauuagacuggcuuggagacacugaagauugaccccuccacucaugauuauaguuggaccucacaucuuauuuccuugugacucauuaagggaaauuuucucuuggucaagagaauaggaacugaguucuucagaccauggacaaagacaugacaaucuaauaaucuaccacaaagaauagaguauugcauucuguuguccucucucuuaaagaguaaauccaacugggcuugucagucaccuagcuaggugacaugcuccugaccuaccguaaagacuugcuaaggagaugaagaaauaauuaucccucaaugagauaaugcguuucuucaccacggggacuugucccuugcagaaguugcuugcagauaggaacacuggcugaaauccuaagcauguguguauugacggacacucgggccuuccuacuggcuucucugagccuucccuucuuccccuuuauugcagaccuucuuuguuugacucuagcucagaaaacaugaccuugucucuuguuaucucccuucuuccaacugguaggauugauaguucaccuacccuaugguuuuauucucacacucuaauaaaauggucuucaagcaucccugugggauggcauaagacucucuuccuacaaagagaacuggauuuccuaaguaaugugucuugucuuauucaguucuuuguucaagaccacaaagaaccccaaaauuuuaucacaggcuaccccaaaauuccuucuaguaaaaugauacacauccuagccaguugggguuuuguuguuguuguugcuuaaaaauuuuuaaguacuuauuugagcuugggugugaaugucugugugccacagagauauguggaagucagaggacagcauguaaguuccucccccacccuccauacacgugaaagcacuuccuucgaagaguuuuguaguuacagaacaaagaaagucauaaaucaggauaauuuugaaauagguugauaaauacaucagguagcagaucacagugagaugaggaacucuguccugauaggcgucauaugcuguauggugacauuguuagcuuuugcguuaggaagcaaauggucugcugagguaauagauuccaaaagguuuuuuaucuauuagucacaggauguuagacacagaagugggcaaggaaauggcuauuuagggggcucagacuagcccaagauaagaugauuaggucugaaugugugacuuucagccucucucccucacugaaguuuggucauccagccagucagucuuugaagauagggcuucuuucaguaauucucauuaacaauuuguuuacagcucaaggcuugcccaggcauuuuccucuaguaagauaccaccucccagugaucuaccacuucccuggcacuggggaacaaaguguucggguucugagccuuagagaacagucucauucagaccccaccagaggagaguuauucaauggggucacacugggaagaggaacaaaaacaggaccagggauccugcaccucaccucacuccaucuucaggcuucugacuggguuacauuucaguagaggcccagacauaagcaguccuggucaggguguggcagucucuccucccgccccagcuccuagccuugacuuagcauugucucagcuccagucucugcucccaggugucagauaagccccuccucuuggccgacaccaggcuucagccuuuuccucuugccagcaugagauuccuggggaaauuccaauuccuuggggaccuuuguuucaaaagaccgauagccaaaguggaagcacaaauaaccccuguagagugccuugccuggacggguacagguggaguuuucaauuuuccccccuuucacaugauuugauaagccaguccucgucugagggauuccucuuuguacugacuucaacaauggccuggauccaggagacccucccacuuccuccuuuaggcacugugcagucuguugauucugacaucagaaguuccaaagcaaauccaggaaggaggaagcugcuuggggcuuggauuccaaucauugcuugcugcuuaagaaugacaguuugcaggggagcauuguggagcauaccuuuaaucacagcccucaggggguggaggcgaaagcauagugaccugacagagagacacacugacaccccaucucaaaaaaaaaaaaauaaauaaauaaauaaaaacaaaaagaaagaaaaagaaaagaaaaaugacagcuugcaccgaacaguaaguugcuucccgaguugguuaucaacagaaccuauaaacacuaguugagggggugcaaagggggugucuuucuuuagcaaccuuaauuaggaaaaugguucagagagccuuuuuuucucucucucuuuuaucuauaaaacuucuagauucccagaggcaggguuauacuuucuuaaucccagcuacagaaccauuguagauuggagaaagaugcuauucuuuguugccugggcuccccuuucgucucuguuuccuaucucucuuacccugggccuaacuguuuauaaaaugcucguuucccagauucugggggauguuuggaggaccugaagagugguuuaaaguagaauuccccagagugaagagaauuagccuccuuugagacaauuuuuauaguguucuccagcucagugauggcucagucgguaaaguacuugaugaaaaagccaugaagguccaaucucaaacccuaucacauuuaaaaagcugggugcaucuguaauuccaaaacugguauggaagggucaggagugggcagacaggugacuuucugagccagugguuuaguuaaaucggggaaccccagguucaauaauagacucugucucaaaaaauaagauugugagauggagaacaaaugaaggagacacauccaauauccugugcccuccacacuuacaugcagcgcacacacaaacuguuaaaugucccacagacuucagaguugguguuaauuaccagcaauccuauaccuggagcuaagccagacugucaacgugagacauggucaguggcacugucuugagggcuuugggacuuaacacacgcgcacacuccacguacucccuaguccaguaacgucuggaaauugaauggaauccuagucaucucuuggagauggucaguauaaauuguauguugaggugcccuguagcagcuuaauuuuuucagacauaaugguuaugguuuaaaacuagcuuggacuacauagugcaccauuucucauacuacauauuaaaagguugagaaccacugauguagggagacccugucccaaaacaacaguuguuuaguguguuacuaguguugcuuuagccaaaacacuucccuaccccaccacauguuugcuuguuuguguguguguguguguguguguguguguguguguguguguguguggucugaaggaacugguagugagcugauguggucucuuuuaagaaauaugccacucaagaugaugaggguacauuuauacaacuaaccuuaauagucgggacuaguauuuucaugaguauuuaaaaaaauguaacuaguguuuuaaaccuguaguuccaugggcauuaucgcuuaagguaugugaggcagggacgaauugaauuaaggaaaauacuggugagugcuccagguaguggaaggaugggaccaggguuaaauguggccugggaacagugggcagcucuccuggaggcaaguguaagcaggacaguuccaaguguuagcugccagggcuuagaggcagcugcagagccacacaggcuguggaugaagaacuggcaauaaggagauuuggcgcacacuggcucuuccuucaguccagcagcagccgguggcugggcuaacgcuguggagauagauuaaucgugugucagucacacgcucugcacucuggacagcaugccucaggaauguuagauggaguuucccccacuuagcagugagucugaccugcuguauucagucuguuuaucuuuuugccaagaccgguugucaugggacaaaauucaagggcgcgaugauaaaucuuuuacgagagugacguaacccucggcauuuuccuuuuuuuaauccuuuucaguuuuucaagcauuugugccaacucuguccauauauugagcacauccuucgugcgccuguuugguucucuagggaaggaugaccaacagcaggcuuuggggucagugaccuaaguucaaaucccugcuuccccuauggagcuauguggcuuuggacuuaauuuacuccuuauuaauuuuuuaaucuggaaauuggagcucacaguggcaucucauaguagcuuugagaauucaggaaugucauugcacuaggucagguuggcuucugaaccuugcaagagugcucaggagaucagggaaaagauccaaagaaguuauuuuuuguugcuguugucuggaaaacgaugucuucucgcuguguaauauaaggcaugucauccccugcuccccugagcuguucagaaaagacggaggccaucucagcggcuuggugccugcagcuccuagugggugugugugugugucuggugaguaaugcauuuucguugugagaaaacugagugagggaacaucucaacaaaacaguuagcagaccugcaaaguuuucuccuccaucuucucugcagagcagcacucagccagccagaguccuaggaacagagcaaaggccccugcuucagugucuucaagacugagccuguacggauaugaccucagucauacacagcccguggcuccccuuucacacacaagucuaccaaaggcacaguuucuauugcuggauaaagccuguugauuuuccccauauuccuggaauccuacagaacccugcaagcagcuuuauugaaaaguuuaauaugugcauuauuguaucucuauccuuugggugguauguguaaaaaaauuuguuuuaaaaggaauaacuauaauucgcaacaacaacaagccaggugguuguagcacacaccauuaaucuuuguaaucagaggaggcagagacaggcagauuucuugaguuccaggcuaaccugauugccaggguaaguuucagaacaguccgggcuacauagagaaacccugucacggaaaaaaacaaaaacaaaaaaaugaaugaguggaaggaaguuaaaauugaaaaauacaagcaguacagaagcauaugucagcaacagcacacaaaagcucuuucugucauugcuccaucucgccagaggcagaggggacaggguaugugcucaguccuuugcuagaauguucccucccuuccuugaugugccaacgcuuaccucuguaggaggagcaaacaaauguuccucauugucuuccagcagcccgcugcuccuguuuguacaguuucuuuaacugcuuguggaguugaagaguuuaaguuguauugauguauuaggcuguuuuaaugauuaacggucuuuuuaauaccaccuccuugcccaugucaaauuagacaaagaaaucucuuucagagacauucuugaaugcuuugugcuucgaauugaauuuagggagccugauuuuaauuuucugucagccauucuggaaucugcugguagggucggggugguggcccacagagcuuagcaaaccagcucagcagcucaccaaacaucuugauucuaucagucuuaagccagggucccugaugggucccauucuucuagcugugagcagauggaauguucuuccacagagaaggcggaguucugggggcaaucagugaugagcacgcuuuaaccagaauaggauaguccuaacccucucucgcagcacugauggcauaccaucccuccccauacuuguguguugacauuuuuacaguagugauaauaguauucacuguagccccguuugugugaugaggcugucauuggguaccugcuuuaccgaauggugucacacugacuucauacgcucaguccacgugcaagcaaguagcucuucuuggccgcacaguuaguaagucgaugcacuuugggugugauuggagcuuuccugaccccagggcagggcaugugaacuucuagcuaugugucacuagcugacccaaccucuuucaucccuagguuccuuggcuaccagguaguuacuucacuaaaugaccccuucuuuuuuucucugaguagccccagguacccuaccuccaugcuuuuuacccagagauuuuagagauagggccuguuaaccugcaacaaggcacccagucucuggguaggguaugcguucagggaucaaauagucuuaaacugggaguacaauuuuuagcugucaguuaagcuaaaucuugccacgggauccagcgccauccacaugugucgcugcugggagcaggaaaggcaugcuguccucgcugcccugcaaauucuuucccccaacuucauccucuuucaguuggugauguugagagccagcugguauaaauuauuuugaauuucccucagcuuuguuccuauucaccacuuuaaauuggaaguuuuguucuuuuuauugcuucacaaucucugggcgcccgccaucuuccuaaugggcucgcaugcccuguaacaugagcuggauuauggagggaagugcaaccuucaucugacucuguaaccagguucaacguuuacauguuuguaauugaacgaauacccauccuguucaccauuauuauuucugauuuaugugcacauauguaugcaugugacgauaucaagagccauagcuuagcauggggaauacaaagccaaaaauucucauuuucccccuuuacuggcucuucacuguacucuguguauacuuuacucuuuucauagacuguuuuagagcaaguuuaaucucuuuucuuguuuaaaauuuaauugguauccagcaugaggucugaugcuuagaagacagaugggaaauuuuuguuggacaugggaacagaagagaaagaacaaacagggcuuucaaaaauauuaaguaagccuaauuuguauuuuccagaggaaagaagcagaguaacagguuuguauugccuugggcagaaccauaucuucuaaggaguuggcuguagaugguuucucucuaagaaccaauaugcagggacuuccuggagagagagagagagagagagagagagagagagagagagagagagagagagagcgccuugauuacuggaaucccagaucucagaaggccuugguggacaaacagcccugacacauuauugcacauccuguguccucuuuuuguuguagccagacuacauacauucugcccacuguguugucuccuagagccuugcaggucuggacagugaaaauggauggaaccaguugaaguucaugugcucugccuguggguuggcagccugguucccauccugagcagcuaugacuuaccagccauaagacccccugccuccucaccugcagagugagaguaaggacuuaaauguuguaauauaaacagacucagagaauuagagcaauggcuuuaucucuauuaucucauuuuuaaaaugggauuuaacuaucagagccaaccuugaauggucuuuguuacagagaagggcuucagggugcacagggcuuagcccugggaaguuucuaaauagaaaaaaaaacaaaaaacaaaaaaacaaaacaaaaaaaccccccaccugucaugcuguuguugaccacagaaagggugcuuaggggucuucucaggccuguuucucaugcccccccccccuuuugguggguugcacauucaggcaaccuagaacucauguugggucuaacuucuagcaagugagcugcauuucaggggagguggccucucuacaugacagccugagauggacucugugaccuccauucacagccaacaguuguuauuucagcuggagauauauagucucugaguggugguggcuggaggcugugagcccaggacugauggcuuucaugcuauggugggccuuaugugcuaauguuggguuuaacccaaaguuuccaguggcuguuuucugcucugugacucaugagcaugcucagaauaguccuuggggccuugcccuguuagucaacccgaaacucuauggugggucagcagugugcgcuuacgcaaggacugauaaaaguguacauaauucagaccauuuuggaguguccuuucuuugcccccuuuuucuuuaacuuuccuaacaagauuauaaucaucauccuaacauuugauaguuuuuuguugagacaugauuuuacuacauagcuugcaacaccauguacgugccaggcuagccuagaauucgagauccuucugucuccaccuccuucccagugcuauuccugaaccuuaaaucuaacuuaaagauuucccaauaaaagaaaaugaaauguuacuuacagaaaauaaggacuagaccgcugcaagacaauugaaaggaagguuuuuauuggacguaggauggagaguacagccagaggcauccgggagaguccagagcauggagaggaaguagugcacugaaccugaccagcagaguggguguggccaagagaggcgaugggaagacaacugagagagcccagagagggcaggggagaaggacuuaaggucaaauggucaaaugaccagguuagacagcagugagaagcuggagagagggaagaacugagaggagccagcuacugagccuggaacccagcaugugcuuugguaugcuaauaggaacccugguuagcuguuuuuucccaaguuuuuggaccagacaauuuauacccucuucucugcuguuuaguauuuaaucauuuagccuaauaucagcuuuauuauuguauauaaacuuaauuuuuaagugaauuuuuuuuuuaaaaaaaaaguauuguuagggagggguaaauagcuacuaaauauugaaaaauguagcuuacaacacaauaccaaaauaaaagccagguauuucuggaaucauuugcuacaacuauuucuauuuaaggcuaaaaguucaacaaguguacaagggacagaaagaauaguuugcuggguaggaaugugucauggcuuucaguagaaauuuuauuuucuacgugccuguuuugguuguuguuuugagacaaggugucacuaugaagccuuugccagcuggaacucaccauguagaccaggcuggcauugaacucauagagauccaccugcuucugccucccucccaaguacugagaugaaaugcaugugccacuaugccagguuugcaguagaaauccccaacauuugaaaauauuuacuagagucuguagcagugaagcccauacugccccucagacagugccaauccugauccccgccaugauauuucugagccuucacuucccaugcagaggccuuguucauggcaagcuuugguaacccaugucagaaucuuguugaggcuagaaguggccucagaguccuccugaauacuccaaaaagacauuuacuucuggccccagugucuuuuuuugggugucauugagacgguugaucuugguugccacguugaugagauugggaauucccacaggaccaccuaugagggacuuucuagauagaauggucgagaugugcagacccaccuuaacuguggaugacaucauucugugggcuggggucccagacaggauacaaaggagagaaugaguugaacacucuccaucucucacuguuucucgacuacagauguaaucugaccaacugccuuaugcccucuuacuguaaccccccaacaugauggacuauguccucucaaacugugagccgaaguagacccugccuucacuugcuuuucucagauacuuuugcaaaaguaacaggacaguuaugaaugaaaucauuuucgaaagcucaccuaucaagaccuucugaaugcacucuugaacaaucaaaacacagucgguauaaaaauuaccucagagcucccugccaaucucugagcagcuugugagcaggagagauaaucggaaauucagcugaucccaguuucccaggccaaccuuuauuguggucuauauugguuuuuguuuuguuuugguuugguuugguuugguuuuugguuuuuugguuuuguuuuuuugagaaaggguuucucuguguagcccuggcuguccuggaacucacucuguagaccaggcuggucucaaacucagaaaucugccugcuucugccucccaagugcugggauuaaaagcauaugccaccacugcccggcuguggucuauauugaaauagacccaugugacaauagaucacguuacugcugucacaaagaggcuuggcugaguguguagcgauggugaugaacugagagacagguggacaacaccaucaggaacaccacuggagaagaauuaaaaugugcuuuucauugucauuuuugaucuuugggagcccuuugguggugguggugguggugguuguuguucucccgguccauaccccaguugggucacagcugaggaagguguagguugcagcagucugggagcuagccacccaucacccagggcuggaguaauggcauucuucacuuuuacccgcugcucacugacaacaccuagaccuuugaaguccagagaggcugggagaaccaucuuucuggaaggagaaagaugauuuuaaugcccuuugccauagcugcucuccagucuucagggccaugagucaccuggcucuacgucacugccuugucuauuuauugcuuuuuuuuuuuuuuuuugguccgaggcccugggaagacagaguacagagaggaaugaagcuggcccaggccucuuacccuuccugggacccccuacacagucugcugugugauuagaaggaccagccauauauaccagaguuaggacccuggucuuaggcaacuggccacaauggaucuucuuuagccaagacucaauguggcuaggcuucguaccuuccacauuuucacugaggaacuggagcaauuggucaguugccuccuuucaacuccaguugcccugccuuuuggacaccugaagacuacaacucaggcaugguuuguggggcuuaacaagucagccucacaaugccagugagccccaggcacgugagcgcacgagggcugugccguugaggguucugugggagcagcccuguccaggaacugcugcuaccagcucaccacaggcucuguuugaacaacaucaucccaguuuccaggugagggaacggagguguagagagaagaggugauggagccgaggauacgcccagaaccuguccuuucugggcucucccugccuuuccuucuaggccuagaagaggaggagauggggggugggggggaguuccaggccaggaacuuugagaaccacagacaaggcaucaugagaucaggacaucuaaacagggcugagcacaugacccagaaaaucugcucugaguaccaugguccuucagccagguucagucagcuccugacuagucucuggggagcgcugugggggaggggcuccuuggggcugugugaguuuuacugcucagcucacugaugucuugcuuaguggagagcucaauucuguaugcccuggguucacaguagugugguggucaggaggggaggccuuggaguggccuccuaauggcucuccuaaugaauggcuuagcugggaacugacaagcugaacaguucaacugcauuuaaguccaccaagcacuucuuuucaucucugguuagaaaugacacuugaacuaugcuuccggcucuagggaggaauauuuuacauacuaugaaaauuauaggugaaugaaugcaggaggagaaagagacuuauuaagcaccuacugugugccagccuucacacucaacucuuggcauucucuggccuuacccucacaccacucugucaaaucauugauuauaauucccauuugucagaugaggaaaauaaaggucagagaagcacuguguuguccaaagagaaaaauguaguugagcugcugguuccauggccaguuuuuguuuuguuuuguuuuguuuguuuacugcuguuguugaugacuuuauagcccguuuauacuuguuguacugaacaaugaauuuugacauuuuuguucacauauaucagguacucugacuauauucauuccccauuacuuuucuuauccuccucucugcuaguuccuuucaucccaucugggguguguuuguuuguguguguguauucccuaauuuccauauaggaaagaaaaugcauuacuuuucuuuuuccagaauaugaugauguccaguuuaaucuauuuuccuacaaauggcacaguuuguucuuuuuagcuguguacauauucuauauuccaugcacacacacacacacacacacacacacacacaccauuuucuuuuuccaucgguggaggccuaagcugauuuuguaacucgguuauucugagucauacagcagcaaacauggauggacagguaucucugugguaugcugacaugguuuccuuugcuguagacccaggaaugaaugguacagcuuaaucauuauaagucagauuuuagcuuuuuuuuuuuuuaagauuuuuuuaaauuuuauuuuauguaugugaguacacuguagcugucuucagacacaccagaagagggcaucagaucucauuacagaugguugugagcugggaauugaccucacgaucucuggaagagcagucagugcucuuagucacugagccaucucuccagcaccaauagauuuuagcucuuaaaugaagcucugaacuaccuucuguaguggcugcuguagucuucauuccuaccaacauuuuguaaggcgccauccuccuuccuuuaccuccgcauuuguuguuuuuauauguuucuuugccuguauguaugcaaguauauacuguguacacuuggaggucagaaguugugucagaucccagaaacuagaauuggcggcaacuauaagggugcuaauauccaaaccccugcccucugcaagagcagcaagugucuuaaccacugagccaucucucagacccuuguuuccuuguuuugcuuguauuuaauuucauucuauguucauugauguuuugacugcacauaugucugugugaggguguuggauccccuggaacaagaguuacagacaugugagccaccaugguggugcugggaauugacccaaguucucuggaagagcaggcagugcucuuaaccacugagccaucucuccaggcccuuguauugucuuuaauguuagucauucugauacuuucauggauuagccaccugucuuccagacuccguaccacacugccuccugacagcgaacaguugcugagugugcagagagcauggaauauuguuccuguagcccuagugacacuuucccucuuaacucccgcaucacuuguugccuguuuauggcccuguagccaacugccucguggucagaggauggcauacuguucucauucuuuugcucgacuccugcuaccuugguuaaucauuggcagccauauagaaaggugccucaggaacucuugugauaugccaguuauagcacuagauguagauguagauguagauguagauguagguaggggacaugguuguuuuggucuggcccuugcuggugagagaugggagagaugaaagucuaccauaucccugacuuuggagaacugacccuucaaagaagcauuucaaaguuauuucugcagaaugcuaaaaaauaucugguauucaccucauaauuggccccauuccacauaaaaauccuccuuaacaaggaccagaggacugauacagaaguaauauaaauaaauuccauuguacaauuuauaguaguucaaaucaacuuuguagcuauuuaaaaaggcagcgcugucauuuauaaguaacuggauaauuguaguuaguuugagaaaguguguguggcuugaggguugggguugccaaucaccaggguaguuauuugggaauugugacuggucggauuugggaggagaagcccauggccggguuccaauccaugaaaacgcaagcagaguaugagagguugggcaggcaugcugggcguuggcuugcuucgucccugaaagcagaggcccuccagccccuuacugugagaaggcuuccauucccucuggucuccuccuccgcugugugucagaaugagcucuccccagcacaccagguccacagcaauggccagaugcacacacugggauacccuuguggcauuuccuuuccaaggccuggggagucuccuguuuccuguggaugggaacaggggagguuuuuugggcaagucuccaucuuuuuuauuguucuaagagcugggcuaaauguuugaaccuuuaccugucaaaaaucacuuuuggaacgaagcccguuuucccuccagcuucuuagacuagcaggaugaagguaucauauaucccaggaaggccauaaagggggcuuuccuguuaggacacccaccuugaacucauucgaaacagaaguccaggucauugcauauuucauaagacugacucugacuuuggcuuggucaugcuuucccaaaugugcuugaaaagagcuuugcguucuucuuuagagcaacauauguaacccagauaaaaauagaaccaccggacuucagguuaugagauaaauaugcccacacacuuacgcaugcaugaguuuugaggcagcgucuugcuacguggcccaggcugggugugaacucacuggcuuugaacuuccgaggauccuccugcguuggccucccuagugcugaaguuacaaaugugugcuaccacaccccguucaaauuuguccuuuuuucuugaaguccuagagauggaacccaggcaggcagaucuccuuuugaaaagcauuucuuuuccacacagcugggagaguuugaguguuacagacuugcaccaguggugaugaggcuucuuagcccugacagugaaagagagugaugucaccagugugcugggcugcuaucagcaccuuacuagacacacucauuaugugcaguuugcuauguguuuaauggucaggugccucgugguugaugcaacaacugcaaggugaagaagacucaguugccguccuccccccccccccccacacacacauuuauuuuuaauaugaauacucucauggauuggcaaccuguccuccaagcucugagccgcacugccuacuaaaaguggaaggcagagggacugguagaagguccugcuguugaaggaaacacauguagcaccaccagccuccgcugugccagaguguauuccagaggaaauaggauggaugaagguucuugcaggcuuggcugccaucuugaaacaggccaacuuugaaccuggguguuaaguaugugguugggugaaugugacaaggaucaguccaacugaauggcauguguuuagguucugugugcuuacagaguuugauuggacaggagguaccaucaauuaguuuggaagaacagaaacacucaacuagaaacauagcauugagguguaaauagcaguucacucaucauggcucucggagauaccaagagacagagaagcugccugucuaugggaaagugcaaaaguuugucaagagauguaauaggaagagacaacacacuguagaaacuguaccagaguccugaagaggaucccaggacagcuacaauguuuucaucuugggguccgaguagaaaagggaugguucuugaugguguuuguggaaggaggagggauaaagagcaaaucuaaagguaguguuuaaauguuggugaguacaggcagaagguggaaagacagagagccauguaauguguuaccugcccauaacauagcacuuggaaggcagaggcaggaggacccuaaaucuaagaccagcuuacacuagaguacaagagucugucucagaaaacaaauaaaaacgaggguagagcuggccaguguauuggcaagcgcucugaaucagagguaggauaagaaaggaaccccuacuuaagcuucucaacagagacuuugccugauugcaggagcuuaaccaucuuuuggauggacaugauugauagcucauugguaagauuaaaggggaagccugccucuuaaaccuauggguaggaauguaaacagaaacaaguuuuguaggaaaaagaugauuaggacauaauuacuagugaaaagaaacauuuaaaagcuuguacagaaaaauauaaaagcaggacagcaaacaggagucaguaguggacgccauuccguuguuauuuccaggacuggauaccuuuuacugucuauacuucugaaaugauuuuuuuuuuaaauuaaacuauacaucaauuuaacauuuauaauauuuuuaaguuauguaucugugugugugcaugugagugcagauacucuuguggccaaggcgucaggucucccuaaagcuagagguauaaauuguugugagccacacaucugugguaggaacuccuuaggucuuuacaaaagcaguauguacuuuuaacugcugagccauuccuucagccuuggaaacugcaacuuuaauugaaagaaaaccaaucagaaacuuaaguacaauaguaagguagcccaaucauaagaaacaaugccaugguaauuauauuuacuggaggcuuggaaaagaauauagauaucauuuuagcuuaagaaguuguaaguuacuugugaauuaacucauuuauaacucauaauauaaaucuucaggucauuuauaauuauauuuauguacucacuuauuuacuuguguguguguguauguguguguguguguguguguguguucaugugcuuggagaacagagggcagccuccuugaaucauguggauuccagggauugaacucucaggcuuggcagcaaaguaccuuuaccucuuaaacccaucuguguagucccucagacauuucuuacugucgacauguauacagcccucucuuggaauaucuccuacauuuaagaaggaaguguacaaaagucuugaguuuccuguaugggaucaauucuuuguuucagccaguuuucaguuggagggacaacuaggucaccccugacugggcagagagcauuauggcauuccauuuuguugugucucuucauccaugucucuaguaguucuaaggagcauguaauuugcuccaaagcuuuugaucauuugagaucuucacauaaauuuguuuaucugagcugagguaugggcucaucuguggcauugguauguuuguugcugaucuaugucauuuaccauguuucaugcagaaauguagagacaauaacauaaugcaucgcaaugauucagggcaaucauuaauaaauaccuuagauuguuguugcagucauuucguuuccagagacccugaagcagauccuagugcugcauucuuuaacaccgaagugucucgguacaguucccugaacuuuuuuacaaagaaucugacucacacuuguguaacacaaaagaaugaccaagccgaugucuugucuucccagacaguaaagccaucguggaugggaaccugaagcucaucuugggccugguauggacuuugauccuucacuacuccaucuccaugcccguaugggaagaugaaggggaugaugaugccaagaagcagacaccaaagcagaggcuacugggauggauucagaacaagauuccauacuugcccaucacuaacuuuaaccagaacuggcaagauggcaaagccuuaggagcccugguagacagcugugcuccagguaagugccuguaguugccuaagccaucucugccgagugggagugcauagauccuaaaucagggucccugugagaaggguugcuugugcuaacugguaugggaguauuaguccauuguccauuaguccacagaggcugagccacagaugguucugugcccuuccaccggcagauguucuaggucuauccauacauguuugucucugaauccaguguuauucauaucaccagaaacacuccagugccugaacuuugagcaggcucugggguuauaguucaccagacuccagcccugugucuucccacauuggugccucauuuccugucggcuuaaagaaaacauguggcucuauucaguggcuuggcaugggagucuaaagccuucugcuaauggaaagugaccguuuucauuaacuacuagcuugacuauauacagcuuucucugccccuuucucucuguaugcugugggauggugcuuggugaggauccaguuagagccuuuccacccuggcucuucucugagugcuugguugaguggacaccaagauguaauuauccucacuagaggccuuagaccgauggguagaguuugcuggcccacacucaguagagaaauuagaaccaguguuuauaugccacccccaaauuauuuuauauaaaaacuccuuacuuuaauaauuauauuuuccauuuccugaauguucuauaugaacgaagcacauucugaguaaggcucaaagcagaacucacuaaugucagggagaaaggagcugugucaaagccucgguccaucuugaaacccuauaaaucagaauaggccagaaaucaaauguauaguguuagggucaccaagcuggcuaagggcccuugucaucaaguuucagugagcugaguuuaauuccugguauccacaugauggaagaagaaaacugaguccuguguccacucagucacacauacacacauauaaauaaauggaacuuuuuuucccuguuuuucaagacaggguuucucuguguagcccuggcuguccuggaacuuacucuguagccaaggcuggccucgaacuuacagagauccaccagccucugccuccugaguguagggaaagaugugugcccccacugccugacuaaauguaacuaacuucuuuaaaaaaaaaguauuagcuaguuuuguaguauccucuuucuucuaccaaaagacacaauugccaggcgugguggcacaugccuuuaaucccaggcagaggcaugcagauuucugaguucgaggccagccuggucuacagagugaguuccaggacagccaggguuacacagagaaacccugucucgaaaaaccaaaaaagaaaaaagaaagaaaagacacaauuuauucucccuccuucguuuaaaucagaguuuuaccuaaguucuacacuacuuacacucauuagggccuuuuaaauaauucuaggauugugccuuugugccaguggaguuuugagucacauaagaugcuagcuuaaucuuuguuagauacgucuaggcacagugcuaaaaauacuuuuccuguauaaaggcaccaagccuaaaugguuuuauagucuuucuuuguuuuaguagcucuuuuuuguuuuguuuuuuucaaggcaggguuucucagucuagcccuggcuguccuagaacucacuuuguagaccaggcuggccucgaacucagaaauccgccugccucugccucccaggugcugcccgguguuucaguagcucuugaaggaauggcuggcucugucuuaaaaccagaaccgaguccuaaagcacagcacgucucugcuaguguagaaugggucccauuaccgucagacuucccgccccuccgauguacaauugguuaagcugucgguggaaauuguugaguuacaagacuaaaugcuuugguuaucaguacauggcuucuuuuaaucucuuuuucagcucauacuaaaagcacuuuucauguauugugaacaggucugugcccagacugggaauccugggacccacggaagccgguggauaaugcccgagaagccaugcagcaggccgaugacuggcugggcgucccacagguauacacacacacacacacacacacacacacacacacacacacacacacacacacacagcaagucccaggagacugcucccacccacuaacuuguugcuggcagucugggugcuuuucuaggucagacuguggccugaccuugguguucagccuuugaagagucuugccucuggcacucccccuccgucuuaguaaugauagguucuuguggguuuaguagcuuauagaucauucagaaaucuucacaucacagacuggcaauuuuuuccccucccauucccaccuuacucaucucuuccucucaccuccaaccuucuagcuuacuauucagucuaggcuggccuugaaccccugaucucccaucucagccccuggagugcuggauuuuaggcauguaucacugcaaauuuuguauucuuuugguucuaaguauuuugaagguuaucauuaaaccccaaucagcaagcaugguccuuaacuaaggggggggggggucauaaggagcuacuaguaguugacuuuuuaaaaacuuguacaaaacgaaagugauuuuaaucugauguuuggaacuuuuuuuuuaaaguguaaaucagguuaacguccauuaguggaaacugcagcagaaucugucuccccaucaucuaucacaugaaucacagaaucugucucccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucucccaucaucuaucacaugaaucacagaaucugucuccccaucaucuaucacaugaaucacagaaucugucuccccaucaucuaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuccccaucaucuaucacaugaaucacagaaucugucuucccaucaucuaucacaugaaucacagaaucugucuccccaucaucuaucacaugaaucacagaaucugucucccaucaucuaucacaugaaucacagaaucugucuucccaucaucuaucacaugaaucacagaaucugucuucccaucaucuaucacaugaaucacaggggggcuuggacuuuugauaaaucagagauagcaucuaaauaguuaugugcguugcuuaacaccaauguuuuccuuguaacaccuccuugaaaauaccauggcugcucccaggaacaaauccacgaucaaagggaaguuguagaaaaccagucccauggaucagaggaccccucauuguagaucauucugaagucuugacuuggagcucaugaguugaguucaguauauuccacaguaggauuauuuggggggugguggugguuugggguccggucuguuucuuugguuugguuuuagagauucugcuccaugaccauucucagaucugucacccucaggaagugcuguauuacaccucucacugccuuucaaucggauacaccucuuugugauacucuguaauguuggacacuauaaaauuauuauaggaguuucuggagagagcuaccagaucaaugcauaguuugcuuuucuuuuuuuuuuuuuuuuuuuuuuuuuuucauaguuugcuuuucaugggcuauuuuguagaucacuguucaaaauuucaguagcuauuuugcuguuagccacuaagccccuuaaugcuuccuguguggucucucaucacuucauugcauuugguugauauauggcugaugagguagagcccucugcugcucugagaaggugucgcuucccacugaauccucacaggggacaggggagacuagcaugcuaggguuacaucagguagggaaucaaggauguugcuaaaacuuuaggacgguuccuuguccauccgagagcuaauguugugccaaagcugauugucaagagaacacaggaacacacuccacuucagguuuggaggggaggguuugcaggggagggggugcaggugugugugugugugugugugugugugugugugugcgugcgcgcgcgcacgcguaguggggguugggggggugcuuucagaggccagaggccuguugugagcugcugggauccaaaaucagauccuuugcaagagugguauccacucuucacagcugagccaucuuucuaguuccuuucccaguuuuaaagguuccuaauauguuaagaccacaugucuagucuguugucuccuauugucuugcuuguuuguuuuuuugagccaggaccucacugugaaucucaggcuaaccccacacuugcuaucuuccugcucagccuccugagcgcugcagcuauaggcauauaguccccuucucacuaguuuucuuuauuucuucuucuuaguacagcgauguguacacaauagaugagcaaaagaagaggccagcuucugugcucuaagaacaucccaaugccuuaugcaaugcuuccgugcucucccguacguuauccccuuucuagaauacgugaccaggggagugaauuggaagccuggggcauggcuugaaucucuggaaaucuugggaggucuuccacccuugcagaggagccagcaccacacuuacaccggaucuuccuauggcuuuagugugauuucauuuguuuccauuuauuuguagcauuuggcuuaagggagaucucgguggauacauaauggcaugcuagagcacucagccaccguguuguuguucuaggucaucacuccugaggagauuauucacccggacguggacgagcacucugugaugaccuaccugucucaguuccccaaagccaagcucaagccaggugcuccucuuaaacccaaacucaacccaaagaaagcccgagccuauggcagaggugagugcuggucuugcugggucugagguauguuugcugccguuagcucugggaggaacgcucugccauuauuagcccagggggcucaggagguggugcagucagugagggcuucuuguacagacaggaagaaccauagccuggucuacaguggcugggaugggucuugccuuaggucacucacuggucaggaauggggguggggacagaaucucugccuucuggaugcugauucauuuucugucuggcagaaagcgcuucagguuuccagaugggcugggaguuauuguuaaucuccagcaacacuuccuugcugagacauccuguuuaugacucucacuguaagaugcccagcaccuuuuggcuggucagagccauuucgggcaucuggucaguuguggucagcaccugauuuaaagcauacuaguuuuuuaaagagaggaguuaacagcuggauguggucguauguguucccuuguaaaucucaaugcuuugggaggcugaagcuggggaaucucaaguuuaaggcugaccagaacaacaguaugacccucucucaaaacaaacaaacaaacaaauaaaacaacaaaugcauggccaggagcuugauuucuggcaagaagacaugaaguauacuauauaucuuaguuuucguaacuaaaauugaagcgacauuugggugcauacccauuuguuaguuaguaaggacuagauggaggcccucaucccauugcccauuggcaucuccaaauugcuuucucugaaccauuacccaaggugaucagugcuaggaggaauagcaaggauaaaagaaaauguuuucuuuuuuuuuuuuuaaagauauauuuauuuauuauauggaaguacauuguagcugucuucagacacuccagaagagggagucagaucucguuacggaugguugugagccaucaugugguugcugggauuugaacucuggaccuucagaagagcagucgggugcucuuacccacugagccaucucaccagcccccagaaaauguuuucuuaauuaaaaaagagaaagaaaaagagaaaagcuaugacucuucaugucacgauacuugccuucagccaaggcauaaaaugcuuguuuguaguaggaaucuuaucacuggcuguucaguuuccucuuuguuagugugagaugguuuccuuccauggugcagucuuccagaaaaugaaugcucacugcagcucaggaauguggccaguccuugccuguuuccuucuuuguaaguguugugaaugcugugggcaaacaagcuguuuuccuuucauuuugggcggguagcucugucucuacgcuuucccuucaucaugauaaacguucagagucuaauguacaguaaaccauggugcucauuaaaccagcucucucuucucuucuuucucaaccccuuucuccuggcacucuccaucauauguaugucgcuguguggaagcagaagaugcaguaugugacuuucuguccagccuaccuuacuugcauacauucucaggauuuuauuauuauuuuuuacauuauaacauauaucacaauuuccaacccuuacuccuccuccucuuccuuaucaucaucauccucauccucaucaucguccuccuucuccuuggaaacaggguuccucuguguagcccuggcuaucuggaacucacucuguagaccaggcuggcuugaacucaaaagaucugccugccucuaccucugaaguguugggauuaaaggcuuacaccacuaccacuuggcucuuccuucccuuuuuauagguggcugauaaucuagugugugugcuguauuugguuucuuuaggcagguauaugcaguauuccaccuauuagucguuaugaacaauacugcccgagagcagggaugcacugggaucuuuuggauguaaaccuagacaugaagugaaagucugugcuucacuuuucuccuuuucaaaucggaaggcaacauagucacuuugggugauggggccacaacacaaggccacauaaguggagcugugagauacacauuucuuccuuggugagaugaaagucaggccaauuuugguaugauucugcuacucaagcuagggauagagaauaaaauuaauaauaauaauaauaauaauaauaauuucuauaagggcucagaaacuugguuuauccuuuagauguagaauagauugcuguugaggccaguuagcgcuugcggaugcaucuguugagcuuugaguguccugugugagucgggugacaggguuuagggucuuuguguaaggcuucccuuugggauuagugucauugaacacuuuuguccacuagcuaagcagagcccuucuccaaacccuauucuguauaaagcacuuaacaacagagacuuacagaaccccaagucucaguaauuagagggacugguuccacacggugcguauagcucuacaggaguuuuauagaguauggggauguggcucagcuuccuaaccaacccugguuagcuagagaauauuacacugacuuaacugagccauugacaaggugcagguacuagagucagauggaguaggugcuugcaaaugguguagauguguauuuaaauccuguuaguaaccugaucauuauauaagcaaaagaauaggacauaaaauauaaaaguccauuuucuaauugcuuuacccuuucuuuccuucaagugugagaccuucauuuuaaaugggauauguguguggcgguaggggugggucauacugagauauccuuaugaaagcgaagacaaccuugagccauaucccugccgccccaaggcagaacacucuuucaagacagugugugcucuguguucagccaaauaucguaggaaagaacuaugcccuucccauauauccaucagcaaaauaaguggcgagccaagacuuugacuagucuaguguuaagguagugaugaugucagcagagacuggguaaggaguaaugagcugcuccucuucuggaugcuagagggggagcuaauacgcccaccauaacuguuagaaaugggagccacucuaauucaaaccucagguaccaauggaagugggauggguauccuggacuuccucuccugcggacagaaaguugaccuaagguccagagucccauaacauaaaacccaaacugcccaaguuucaacuuuaaaaaucacugucacaccaugagccaauaucucaaauuuaaugaaaaugaugguugaugccaagaguggguugauagaaauguacgaauuaccugccagccauuuuaaguuucuguuaucguuaauauuuucaacuagacgaggacuggaaucacugaguugacccagucuguaagacuuucuagguuggguuaacugagguguaaaaaccuaucccaggcucuucuauggccggagagcuuggaugaacugaauaaaaaggaagcgagcugagcaucaguauccucucuucuucuuacaaccgugaugucauguggcccacggaccagccagcuccugccacugaccgcagauucucgaacuauaaaccaguuaaugcuuucuuguugccagguaucugugauggcaaaaauaacuacuacuguggccauauuuuaaaagauaaccugggugagccuguaaacauucaggaaauuuaauuuguaaaauuguaaggacuccuguaaaccuccaggggugagugaggucacuggggaauucucccaaacacuuagagaagaaacaaaacagauuuuuauugucuuaaauaagggaugagagcacuugcuguucuauuuugcuuucugcugcuguagugaaaugcacugaagcagcuugugggaaggagggagggaggguuuacaguccauucugagggaagccugagcaggagcucaagcuagagcaccccccucuaaccccucccccucccccauccccacccugacaccaccaccaccacucauccacccagcccugccccacccccgaagaagcgaggccauagagggcugaugguuacuggcuugcucuuguccagucugcuuucuucuacaguguuaccugcccaggaguggguagguuacacuagguuguaccuacacccacaguaggcuggguccucccacgucagucauuaaucaacauaauccacagaccugcccagagcccaggcugagggaggcaauuccucaauugagguucucucuucccagugacucuagcuugugucaaguugacaaaagccgaccagcugagguagcaaccucacuuuaugaaacaccagagccaauaacaaaacacagagaccaguggacuauagauauaaaaacacaucaugaaacacacacacacacacacacacacacacacacacacacacacacacacacacacacacauauaugcaucauauacacacccacaaaaugaaucagucacacuuugugucuaaaugagguuucuuuuagcaguguaaggcugguccacuauuaaaaaacuugucaauagauuauagaaaccaacuagauuauagaaacagguuagugaaugaaaauaaagaaacaugguugaucauaaugaugauuaaaaagcaagugacaaaauucaaccaucaucuaugauaagacuccaaaaaggggaaggagaaaguuccaguguagaguaacugccacagaagcucugccugacuucucagaacacccagccuuucacugauaagaucuggaucaggguggugccugcuguugcaacauacuaagggggcuugaauggugauguuagguaggacguggggggacagcagaaaagucagaaacaaaacuggccacgauguggugguccaaacugacuuuccaacaauuaaaaaugagaaaagccagguguggugacauauaccuuuaauuacaggcaaaggagguuucugagguuucaggaccagccagacuacauggugagacccucucaaaauaaauuaaaaaaauaaauaaaauaaaaaggucagucccaaaggagaauaaagcuuucuuaggcacaaaagugacccgccagaaucuauucuaguuauacaugguauaauacacauguggauccugaaauuuaaaauggcacaccauuuacugucacauagaaaagaaaauuggugugaguguaauaaaacacacacaugauuuauaaucuaagaacuaaauaaaaggccugaguaagaagagagacuggaacaaagucauggguucuccuugaacugucacagugcauugcaauugaaguuuuggcaaugaacucagccucaguauaccugccuaguacacacgaggucaguuccuagcaccaaaaaucaaaauaaaaagaaaagaaaacagaauuuuuuuuguaggugucaacaaaauuccaaguauaugucaaaagaagaaaggcaagggagcugaggcacuuggguuuugaaagaugugugacaggaaucaguacggugucggaagcacagcuuccaagcugcucugacauugcuggaagauucuagcccagguggaacccugaguuccagggcagccagggcuacauagagaaaccccguuguaaacaacaaacaaaacauuacacccaagcggcuagagauggccacuggcugagaacauugguugugcuaccagaggaucaggguucaagucccggugcccacgucaugacugaagugucccacgggauccagugucgucuucuguucuccauggguaccagacacacacgugguacacagaaauagaggaauaaacguccauacacacaaaauaaauaacuuuuaaaaauagaaucauaccuaacucaaaaaucagcucaaacugaaccauuuaaauaugcaacaugcaucaaacccaccucagagggaaaacaaugagaaucugaauaugaauaugcgacaugcaucaaacccaccucagagggaaaacaaugagaaucugaaaucuaggguuaggggaaaaaagaguucugggauuugacaccaaaagcucaagaagagcaaaaaauuacaacuucaucaaaaauuaaaaacaaaaccaaaccaaaucaaacaacucccccaaaacuuucaagucuuaaauauauaccuauauauguauguauauaucuguauuuugaaaaaccuugccuggacccccacauuacugaugugaagugguccagacauccugugucauucuaaucuuauaugugugugcugccauagugagaaaagagcccauguucucaguagacaccuaccaguagacguguaaaucucauucacgacagcaguugcucgcaucggcccuggccuaucucagccacagcugaacucucggucuccuucuccccauacuuagcuucugcccaacaaaucaguucaucucauagcugcugccuggcauuugcagaggaacugaaggucagcacuagacacugguucaaguaguggacuuauuuacaauuucucucuuacugggcuccaaaucugaguuuccugugacgugcuuaggcuaggcaguaacucggagcucaggaaauacccagguguccugacaauauucuaggaugaaaagugcucucuauccuugggguuuaagggauccugagaguuggcaugggccauguuucuggaagaacacagaaacuucuagauucucaagccuggcuuucugcuggugacagcuccagauugagauucccaccaaaagcuuaucaacccaggcaauuacaggaagcuuaggugccauauaccacgauccgguccuugccacaucaggacccacauuggacauuacagggcguuuuaggggcucugugugaggaaccauguuaggaggaagauauagacauagaacuuuacacuugauuuaaguucucacaaaaucuaugucugaauguucauagcagcuuuggaaaugauagacagcuggauguaacccagacgucccuuggugggagaggguaaacaguugcauagcauagaacauuacucaucagugaaaaagcaucagcggcccacgugaauggaugggauucucaguuagaaggaccgauaccauaagguugccuaauauaugacuccacuuauguaacauucuugaaaugguaaaauuacagagauggagaacagauuagugguugucaggauaagaagaggguggggcggaagggaagugggugggaauccuaaaagggcaacacgagggauccuugugguuaugaaaugcucugugucuugaucauauaauuuuuaguacucuggucaugauaaguaucaucacuuugcaccauugcuaccacccccccaccccccaccccacccccgucauugcacuuccccuuucuccuucccccaacccccaaauccuggugcuguuugaggaaggucagaagaggucuuccaaucccuuggaacuggaguuauaaauggcuguuaaccagcauguaggugcugggacuggaacccagguccuuugcaacggugacaaguacucuucacagcugagccaucucucuagcuccucaccuaacuuucuaguaucuagguucuccauguuagagaaaacacacagaucugacuugcuuuaccccguuacucuuugguuuccuucugaagacuccuuuucccacaaggucuuguuccuacuuuucauauaauuuauauauaagucuagauuucacaugugagaaaaauaugggguauuugucuuugagucuaccuauuauuuaaccuucuuaaaauuaaacgucuaauugcaaauaauagggggauacuuuuuuaaaguauauguacaguguuauuuaaagaaaugugcaacuuccuucuccugcacgaccucgcaaaggcagguccuucugcuagcuacuaccagugugcauuuucacuguuuuguggaccacucucugaaacucucgaauauuuuuaaauuggauaucggcuagguaacaugaagaaaauaagaguuugaaccuaucugguuauuccuucauggcaguuuguucccaucuccuaaauaagaaaaagaaaaacauauaguggguuguagacguggcccaguuuaaaauuuacuguguaaacucaugacaggaaucgaaccuacuggaaacauggugaagcagccagccaaauucacgguagauaccaucagcgcuggacaaggagaugugaugguguuuguugaggacccagaaggaaacaaggaagagguacgcuggaggaugccaccucccuccggagucauuaggccagucacgagaccagagacugcauauucagguccucacaacacucagccaaaaagcuaccaaagaaucccgaggcuuguggcggcugaagcagcugccugagcgcugugccuugagagcaguauucacugauuaacacagacacaguguuugaugacgcaaaugauagguggggugagacaugggacuugucaauugagguguccugauuuuccucuccugaccaucuuugggucucugaucugaucauagcaugaucugaacucauaaauacucugccauauugucuagcuuccucuggggcagggucucugcccaacuucuuguuguauuuuuguucguaaaaccaagacuggcaucuucuacacuuguaacagucagcagaccaauaaacgauccagugagucggcuucauacugaugcauaccuuucaccuucucuaauugauaaucauccucucuucuaggcacgugugaccccagacagugacaagaacaagacauacucuguggaguaucugcccaaagucaccggccugcauaaaguaagauaaggcgccauggccgcggcuugguuuuuggcaguguuuguacagugcuggauguagaauguaggaucucuacauacuaggcaaaagucauaaguuacuuagguuaggauuaugcaaucucauuuaucaaaaaaaaaaaaaaguagaaucccuaauaaaucagacuuggcauuagguagcacaucucgguugucuauauuccccaggggagucauucgugauguccugauuuccucccccuaauugcacaugaguuccuacagauugaagcugucugucuggaguauagauaauguagugaauaaacugcagccucuguccugaaugcuuucuuacucauuccucuuugugauaggccagauuguguacuggucuugagcccagaggacacacaaguucagcucacuagcagcagcaaggaauauacucagcuucugaggaguggcagggagagccuccaggcccuucaccucagcaucguaucugagaccauuccagcaugguuccaucaggcaagagcugagagcauaggcuacagcaagggcuaaccaaggacugugucuucuacgggaagagagccuuugccacacagaaaccaauccuccuauggcaugcucaggcuuuaagacagguucugaauuucugccuugagcuuuugugaauucaccaggauucuucuuacuccagaacuccaugaaucuacgagaaugaaaucuuaaaaaagaacauuuaaaucuaauuaauucauuaauuauuaguagauucacuggaaaccuaguccucuuaaaauaucccaagaugagaaaguuuugcuaaaguuuuagacagaagucauuauauuuuguuucaaaugcauuuaucuggaaaugaucuugguccgugaaaacucuaacuauguucuuggaaugaugaacuuuauucugagagugcagcgaccuuaucugcauuacuaaagaaaccccuugccuagagaucuaaguauaaguggucguuuuauuuucuguuagaagggccaaguacccuacaagaugugcugggguaauaguggugcaaaauuugggggcaggguagggaggggaguggccagccaaugacuggucucacuugaggcccaugcuacaagagggaucccaugucugacacuaccuggauggccuggaaccggagacuggauagcucagagaucuggguuagaaccaagcacaccugggagggaggggaugcccauacccaagugcaucugauguacguacuuuugguuuaagaccgggauuucaugggcauugccauaugccugauggguccagguagugauucaauucuggccacuuucccugauuuuagggcuuguguugccauccaccauuggguauacaaucccgaggaaggugagagaagguugugugugggguuggauaguguucuugccaaccagggagaagcuguuaccucucucuugucacuuguaggucaucguccucuuugcaggacagcacauuucuaagagcccauuugaagugaauguugacaaagcccaaggagaugccagcaaagucacugcaaaaggcccagggcuggaaacuacagggaacauugccaacaagccuaccuauuuugacaucuacacagcugguaauguaucucucucccaggguuuugaccuuugcuggucuugcagggucuaacacagaauccucaggaggguuugggcacccaaaccuuuugucuuuuuaauugaugaaacaacuuuuucucaugagcuaguuguauuuuuacauaucuucacucuugucccugauugagaaguaaucaauuuuuguacaaauuucagucuauacuaaauguuaccagccaugugcuagacuaaguuuuauggaaaaguggaagaaguggacugcacaaauaagaugaauaauaucaauuucuuagcuuucuuuuuucuuuuuuuuuuuaaugagacaggcucucucuguguugcucuggcugcccuagaacuugcucuguagaucaggcuggccucaaauucagaaauccaucugccucuaccuccugagugcugagauuaaaagcaugagucaucacauggcagcuuucuuuucaguuuuuuuuuuuuuucuuuuaagaaaaagaaugacaguugguacagacauucagcugguucagccuggccugaguggcccuuucuguuugcacugugcacugguuggcagagcuuucagaggggaaggggugcucauggaguggccguucuuuucacaggagcuggcgugggggacaucggcauugagguggaggauccccagggcaagaacagcguggagcugcugguggaagacagaggaaaccagguguauagaugugucuacaaaccagugcagccuggcccccauguggucaaggucuccuuugcuggggaugccauucccaagagucccuuugguguacaaauuggggaagguaaguacugaccaacucuaccugucauggagacugacagaccugggcucccuucauccuccggauauuagugcuaacacaaguuguguuccucugcuuuccucccugugucaaaacaucggaaaugaucacauuaauuaauagaugaugaaauuauauguauggcucacggccaugaucacuugggccuguggugaugcuguguagcuacaaugagcacauacaugacauguggcaaaggagcugcuuaccacaaggaagccaugaagccaagaagagguggagagaggcuaggaucucgccaguccuuuccagggcaagcuuccagugaucugacuucuuucugccaaaucccacauuuucaacacuuguacccuuagggaacauuuuaaguccagucuguaucacagauggaguaucgcuaaucugcaaacuagauuacuucaaaacccagaaaacaaaacaaaacaagauaaaacugugcacuaaugugauucuaaauaguuuuauauuucagauuuuaaguuuucagauuagggaagccagucaauaaaguccaugcaaauauuuuuaaacgcguaucugaagugggcuggagcuacggcucggugguggccacuccuccuggguauccagaggaccuguauucaguuuccagcagccucgcacuaacuguucccccuguaacuccagcuucagggcuucugaugcucucucuggcuuccuugggcaccugcacacaucuggcagacacucacauaaaccacacacacuaaaacacacaccacgaccaccaccuuuaaaaccuuauuauagcaagaucuuuuuguucaagcccuuuucuagaagggcuauggaauccgugcgcagagacugaagugugcugguuuuggugucuaggaacaggcuuggcggcagcaggucccuacaguccaggcacuuuacuggcugucuggcacucagcccagcugcauuggcccccaguuggcagguggacucacugaggcuuuggcauugucggucucagaagaaccguaguguccguuggcaugcccguaucuacucugccgaaccccucagcaaccaggagcguggguuuccccuuauauuaaaggcacccucccccucccccucccucucccccuccccccucccccuuccccucccucucccaguccuuguugcucuuuucuguuguuacugcuguuuuccaacugugcugccuuuucuaaccggacuugccucucccucuucuguccuccaccucugcaccugcagaccuggcuccuccuucugaauccugucucugggccagccuggacccugaagcugcuggcuuccuauuugcaagcucugggccagaggcucuugcuuugguaagggcugguugggucggguguauuuugccaguucuuugugcugcuuccgagugacuaaaggaaguuccugugcaggcgauagugaucacggcauguauagccagaucccagccugagcaaggugcugagggauggcaguggaucuggcacaucccacaaacucuucagucgaguuggccgaguguuugaguuggcugagugcucuagggacugagcaguuacagucuuuuuucccauguuuagccuguugacugugcucuguauuuccauagggguuuguguguguauguaugugugugugucaguguguguuagagugcucaccagacauguacaggaccaugguuuccauccuuagaccuucaauacacacauauuaggugucuuuaacagaggaaaaccgauguuacuggccauuaagugccaccguacaccauguucuuccaugaacaauccaacaugaucucuaacugcaaggaugucucuguucccgucuggggaguaauagcuugccacauaaccaacauagggagguuguaucuaaugagcaaguaccuuccaucugcuucuggagcccgugaauaaaggcuguuguaugugcuguuuagagaggaaaagccaaugcauagacaacaggacauugaacccaucaacuucccauuucuacuuaaggagaaagcuguucauguugggcaaaggaucucuaggaagaaucuaugucuuucuaagccuccuccugaccccacuuggaagaguaguuucuagacucugucaagugaagaauauuagccauuaccauaauuuuuguccuugugguuuuuaaaggagaucagaagucauguuagccauggcauuuucugcugaggcuugcuuuguagaugccaggagcuuugucacagccaccuuuggcugagagcuuuuuguuaucuuguccagcuauucacaugcaagacaacagcuaugcccagaucuucagaaaugucuggcccgugcuuuggagcucagacggauauuucaagcacugcauuuuccaaguagacuugaaaacgcauaggauucccagucacuggacccuggaguguggccgugaggucaggcuaguguucagcagucagucuuaaucccccccugcucacaaaaggcuaaaagccaguacaggagccccacaguguggagucacggcucucccauugauggugcccagcgcuuguguggugaggcuggacagucaugguguuccuuccuggcugcugugcuuccucagcagggccccuggcauuagcuguuggaugcucuuuguguaaagcaaccauuuucuuggcggguaugggggaggcccaagauacccuaauuuucuugucuuuugcaaaauauuaaaagguugaacugaugucaaaacucuguuuguagccugcaacccaaaugccugcagagccagcggccgaggucugcagcccaaagguguccggauccgggagacugcagacuuuaagguggacaccaaggcugcuggaagcggagagcuugguguaacugugaagggcccuaguaaguauuuaucucaaauaaaccuuaguuaguucuucagccaugauauauuuauuggucaguccugauugguaucuccuagagagcugugacagagauuugaguccuaucuaugcucuuuagagaucaaguuguagaguuguaacaugugcccuggauauagauuggcaagaccagugagugguuugacagccuuauauauuaauauauucagaccucugggauaggaaacaaagcuguaaggaaguuggaaaaauacugcuuugaggacaacauaucccuccccccaccacaucccccaccccauuaauugaagagaccuagguauaaaguggaagacucuuacagacucacauggauugggguuuucugaccugggauccaagcacaguauuaaaagccaaugauuucuccaguacccuuuacauuuuauagacuaugaaauuauaucaauuacuguauuaguaugaucgcugcuuauaggagaauaaaauguccuagaaugguuuucuuuguaggugguuggcagaguuaagucucugcaguaccuuguuccuccuuccuccuuugggacggagacagcaggcaugaggucagcaucuccugucucccgucuucccaggaacagagaggcagcucuguagucgcacuuggcguuaguucuaagucuguacaggcuuguguuuccuacgccauguuucucucguccuccguauuaguguuagucugcguccaggaguucaaagcugugugagcucaaagcucagagccuuggggaaggauuugccccaagggcagccaagguucuacugcccagaccuagagccaagugcaaguagcucugcagcuguccaucuauccauucacccacccacaguccacuaccccugcucaguuuguugcaacaggagccaaagagguguuguuuucugaccucagaguccuucuuaacucauaacauaaaacagguuucugccugauggcuagauccaaaauuguggauagaaccuaaaaucuggcuucuccuaaauagcuuauaagaaagaacuuucuucuuucgcuguccugcuuuagcaggaaacgauucauaggugcuuaguccuugacaaguaaucacaaagaugagcuuucuuccagugucuguggggcaguggggguggggggcaaaggcagcugggacugucggaaaacacugagacacagcaaacgacccaucuggucuaagagcucagccuccaccagcugagagcuuuuggaagccaguuagcugggaagucuuccauuucucuguccuggaggcugggauggcucugguuuuaguuuuggaaaccgcucccagcuuuugagggagauuucacauucagagucuaguuuuuguacauugccugugucuuguggggagucuccuuguaagccaaggauuauacugcaaaagcugugugcuugcuugcuuuccacagagggccuggaggagcuggucaaacaaaagggcuuucuggauggggucuacucauuugaguacuaccccagcacaccagggaaauacagcguugcaguuaccuggggggggcaccacauucccaagaggugaguccggguuggagaugggccuuguccagagguguguucagccugugacaggcucgcaggagggagcgcucugccucccaggcugccagagggaagagagaucugcuuuguuagaagcuucccccccauccccgccuuuucagaacagcacagacacuuggcuuaugcucaaaagcagcagaaagucacugugguuucagcugcccugcuuuaaaucaaaugcuggugguuugugccuggugggaggcagggaaaccagaaagagcuguaauagagagcaaacgggcugugugucuauacagccuuauauaagcuaaggcucuccuuuucaaugagugccucuguucacagaugccgugggcacagucggcuauggcuuuuacauaaaaacccaucuaugugaaugccuucagggacaagggacccccggccacaccuggggcuauugcaguuuccuuuuuggaccccugugcucugccacucuccugagggcaguuuaaacuuugaauacauucuguuugucuugagaaguaauugagcuuuauaguaguccucccuuguccauaaaguuaccuucuaaaacgauaaauauaugccugaaaccaaccccaggcaacgucauguggcguuuucccccucuagacuugcauacccaugagaaaguuuaauuuauaaaauagacacaauaagagacugauagcaauagcagcgaggcagcagaauggaaguuacgugacuguggucuuaacgaacuauaccacauugugugggacuuccccuucuugugguguucgcugacauaaugcguauacagugagauaaagugaaaagaauauuguaggcaucauggccaagcacugggccacuauuaaucucaaaaugauacauugcagacugcauuugaaacguaagaaaauaaaaccaaggguaaggggaccucuuaaguaggguuuucagugucugcagacugcauuugaaauguaagaaaauaaaaccaaggguaaggggaccucuuaaguaggguuuucagugucuaagcacacuuauuagaaacuucccuugccaaaguuaaagcauguuugaucacauaugaaugacauaaagcccauucaaacuacuucucuuguuauagcauagguaggaggacgaaaaauguggacauucuuaucuuuaaggcuuccacucuagagggcccugccuacuaaaggucacucacuaaugagcaaaccagagcaaguguguugcuugagggacagcccaguuacucccagcucccaaagcaaccauauuacauuauauuguugacauaacaauggcugugggggugaccaguguggggggaaaaaacuugccuagagcuucagccucuguacaaaagaucaggcaaguggaaagaguuauguuaagaguucaugguuauagcagucccuucuaugauccucuucuuuuccuuccuuccggcuagccccuuugaaguucaaguuggcccugaagcaggcaugcagaaaguccgugcauggggcccuggacuccacggcggcauuguuggucggucagcagauuuugugguggaauccauugguucugagguuggaacucuggguaaguagaggcagcugcccagccacuucugcaaggcugaguaacgaggugccuaguguucgagccucacauggccuccuggccgccuggcuagccaaagccuccucuggaggcuguagaguucuaguucuuauuuuccuucuugcuuucaguuguccaaugccugugacacuugauuauuuauucaccauuuccugggagugggguggugguaugcuaaacagcacauacaauaucauagacaaauauugguaacuaacccuuaaauagauggcuugguacaucuugcucaaacucgaaaaaguaaauauauuauuuggcacauaacugaauauauuuuaaguggauaucugauaaaacaugugaucauaauggauuagaagucaggcuuuuucuggacaaggccacauaccugguauuuucaccuugugugugacaugaucucugucacaauuaugugacucuaccauuguggcuuugaaacagucauuaaauacgucagugaguggguaugccuacauuccuguaaaacacuuuagagcccuggaguuggccaaugagcuauauuuuacugacaccuauuuagguauagcaacaaguaaaagagggaaaaauuagaaauuauauauaauuuccaccaguagaaagaugaaucacuuuggaauauacuuguaguuuaaggaaguaauuaaccuuuuaaucuucucuuaggccuuuuuccuguacacacucauaucuuuauaucuuuaugccccagaugaguggagguaacaccuuuauuucccauggcuucugugggauuuuguuauguuuuaaucuauucuuaggcuuuccaguuauauacaagaucuuguuauaugaacaaugcugggugcauaaccucauuuaauuuauucagauaaaagcucagaaauggguuuagauaaacaaacacuggguuaagccuuuuggcauauguugcuguauauucaauagaaggguuuuucuggcccuucuguaccccuccccacucuaugucaucugaaaaccagaaacauccagucuaaugcuuccaccaagagccaguggccuugguuuuauggaagagggacacgcuugauuucaauuuucugcucauuccucgcuuuccagcaggcagaggagauggugguagcccaggauagauaauucucaccauguguaaccgggaaggcccuuuuguucugucccucaggauuugccauugaaggcccuucccaagcaaagaucgaguaugaugaucagaacgauggcucgugugaugucaaauacuggcccaaggagccuggagaauacgccguucacaucaugugcgacgacgaagacaucaaggacagcccauacauggcuuucauccacccugccacaggagacuacaacccagaucuagugagugcacucauucuuuuacccugucuccccuauggcagacagcaguggguuagaucugaggggagaugugaaccucuuagaauuuucaugauguuggaaaaguaguguaccucucuuggcguuuuccucgauggaccaggaaugagagugucuucucccagaguuucugggauggcuaaaggacaugccugugcuguggaagaggcucaucuucccacuuuuuauagcuguccuuagacuaccaucaaugaacuagcguguggcacuuuuuaucucacgguuuauucuuuggccucugguggcugcaaccgucaguccuucaaagugggaaguaaggcacaacuaaagaucugccccagaaacuagaaacuucuaucagcucagaguacagcagguagcuggguuaguuuggauuuuguuuuagaguguuuucuccuucaagaacagcuaguugugguguuaaaauuucagccgauuuuacaauuuuacuuccuauuuccauccuuaacuaaaaaacaggcauuuuguacaccuacucuccaucccauucuuuaacccagaaaaaaaaaauccucauuuuucuguuuuugccuuagguccaagccuaugggccggguuuggagaaaucugguuguacuaucaacaacccagcagaguucauuguggauccuaaggaugccgggagugcucccuuaaagauacuggcgcagguaaguaucuaggccuggggccacuugcacuugugaggucagagguguaauguggaguugcucaugcaucugguccugagcucucccugcacauggggcgcaguaauagcaccccacagcccugagcucuccccuguacauggggcgcaguaauagcaccccacagugacaugaggacuacacuaauggaggaggaauagcagaacguuuuuucaugguauuagugauucaugcucuguuaaaagaaggcuguuuuguuucagauuuuucuauaaugucuuucaguuuggcugggucuauauaauuacuaauagguuugugaucaaaauucagauuauugcuuaucuuaucugauuuaguuaaaauuagccaagggacuucaacucuggaauuaaaaugaagugcuaaguggcacuggcucuaggugggggagaagacagcauuuauucuuaguaauuacgagugaauaaaugaaauugggcacagcaacauguacaugaucccuaguaauuaggaggcccaagguaggacaucaagaucauccugagugagccagugaggccucgcauuugggggacuuuggguuuacuuguuguugccuguggucuguguauaggaaguauuuagcacguuacaguugcugugugauuuccuaagauaaauuggugggauacugaccaucucuagaagccucagugacccccuuuugguggagacacugagaaacacuuugcuucagguucuggcucucuugcaggauggggaaggccagcccauugacauccagaugaagagucggauggacggcacuuaugcuugcucauauaccccacuuaaagccaucaagcacaccaucgcuguggucuggggaggugugaacauaccacacagccccuacaggguaaguugugaggcccaugcugaucauaugagaaacccuggcuauguguugagucugcacuuuguauacagauggucaaggcagacguauaggaagaacccauucuggacacgccuugaaaagaaacuuguccuaaaggacaaaauacucuauagacuuacaaaauggccauuucuacucuuuggcuggacucagggaaggaauauuuuugauagaauguauuuucuguguuccugauuuuucuaggucaacauugggcaagguagccauccccaaaaggucaaaguguuuggcccaggcguggagaggaguggucugaaggcaaaugagccuacucacuuuacaguggauugcacggaggccggggaaggugagcugagguuccuccccccaccccugacugucucuccuuucggaagaacauuguucuaacauuggagggcagagaacuuugcuaaugagcugugcuggcuccuuggugaucuuagcuaauccucuguguccuuuuccaaaaccccaauuugcuuccuccccuuucuuggguuguucuugcaguauguuagcccaagcuggaagugacuguucaagacacguuguugcuugcaaacugguucuaauaagcuggucuguguguuccaggugaugucaguguugguaucaagugcgaugcccgaguuuuaagugacgaugaggaagaugucgauuuugacauuauucacaaugccaaugacacauucacugucaaauacguaccuccugccccugggcgguauaccaucaaaguucucuuugcaucucagguacguuggggccugcgagggacagaauggaaugagccuuguguaucucuccuuuuuugcuuuguuguuguuuguuuagccuugagaacuguguucaguuucucuguuuucuuaaaaccaaaaggaguuggggguggggugcuaagcuuaauuugcacucuuuucugugaguggcuaaaagcaggacccuagcauucacuaagcuuuugauugaaaaguuaggcaacuucuagauguacuucacuuggaccucuuagcauaacucuggucucugcccuuaaacuuuuauagcaagagcuuuuugaagcaucagcuguguguuaauguaguccugugaggaguacucugaaacaaggcauuuugaaauucuaaugaucaaaaugaacuauaugaaaauuaggaagcucaggagaacagucugugccucaaguuaaugaucuuaaguuggcacgaccuaauuaauuuaaucuacuuucauucucacagccugguaauucuuugugaacaauuagucacucucgugaauacuuccuugaagcucucacuccccaggccagcgcuacuccuagaggguauuuccuaccuccuaacccuauauauuguuggguuuuacuuuauucugaguaguacuuuuuuuuuauccuuuguccccaaacaucuggugucaagacaugaggguguuugugcucucaggguuccagaucugccccagugugugcaggcuuugccuacagucauggaaguugcucagcgcuuucaagaggguguuggggcaaacucuguccuucggguuugggcagaagguuacacucugacagugcucuaggaaccauccuucuuuuuuuuuuuuuaaucacugaaacacuaaucacugugguuucaauagccaagcugugggaaugacgucuaugccuggcugugaguaagauuuuuuuuuucccauuuuuuauuagguauuuagcucauuuacauuuccaaugcuauaccaaaagucccccauacccacccacccccacuccccuacccacccacucccccuuuuuggcucuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccaauagcugacugugagcauccacuucuauguuugcuaggccccggcauagucucacaagagacagcuacaucuggguccuuuccauaaaaucuugcuaguguaccauccuucugaaaugugucuuugcuucaggaaauccccgccagcccuuucagagucaaaguugacccuucccaugacgccagcaaggugaaggcagaaggccccggguugaguaaagcagguaagauggcgguggguaagauggcgguggguaaggcuuccauaaccuuugcagcguggguucugucuagaccuagaggggcuuaucuucaucugauguggcagcaacaguguuuggcugcugcugcugucaaaccugucagacugguucuaaaagugaaaccucucuaaccaacccugucucccuguuucauguguccuuucaggcguggaaaaugggaagccaacccacuucacuguucacaccaagggagccggaaaagcuccgcucaacgugcaguucagcagcccccuuccuggggaggcagugaaggacuuggauaucauugauaauuaugacuacucacauacuguuaaauacaccccaacccagcagguaggguccuuccugccucuugcuuuucugcgcaggcacuucccacgcagugcuguguguguggagguaccucagggugcucuccccucucugggugagagccugagggugcugugggauucccagagaaguagcaaggcagcccccucccccaccucaauuugggauuuuuaucagagaaauacuaacuucuuauauacaaaacuaccaggucuacuuucuuaugcagucucccuccuccaucccucugacucccaaucuuuuauuaauuauagaaagcucccaccugcaguuuccuuugcaggcaguugcacauaguuuaccuuuuuuaugagguguuuuagugggaucuuuucucaaagagcccauucagcuuuuagucccuagggcccagagccugcgguuaaggcugcaaauggcucccuuuaacaaaaugcaggaauucugaagaauuuugcugucuaggcagauuuguuauuuuaugcaauaaaggucuaaaaacuaccuuuucuguacaaguuuauaucuguuuccuuaauuuuuaaauucauccuucucauagcaaaaugguaugcuauacacuugauggcgccgcguaggcauugccucugucuagcuuccccaugcucuuaucuugcaaaacugaaauucugaaccugaacaagucuuuaaaauuguguuuuucuucauguucacaccuccagaguuagcauggcagauacccuggcaggagagucuggaucuuuauucaugccucguguuagaaaugcucagucuaagcuucugagaugcuuucaaacuggagggagggacccuccuuuguaaacaagcuaacugucggacaaagagguagcugucugcagaaacacugcucaguccacauggccugggcccucagcaaggggcuggugggagucaagcggggaagagcaggggugcaguaaggaugggggugcaggguguguguagcuagccuucuugcuuuagagguguuguauccuuggaguuaaugucauaggaauacggaguaccucugacagugggaggcauucucuaggggaagaccugaggaccacaucauggaagugcugccucuuaccucuagacauucuuccuguccgcuuaugaagucccacugaaagguuccuuacauuuguagaucgccuguccuugugccuggucagaagauacagugauuaacaggcaguucuuucucacugaugguucugagcacuggugggaccuuaagcuggugggaccuuaggcuggugggaccuuaggcuggugggaccuuaagcuggugggaccuuaggcuggugggaccuuaagcuggugggaccuuaggcuggugggaccuuaagcuggugggaccuuaggcugguaggaccuuaggcuggugggaccuuaggcuggugggaccuuaggcugggugccugacaagcucuuugcugcagguuucucugcauuccuuggaagaacauaccagaaagccaucauaaagaucacaaagccguaggugcuuuucuaaaccuuuuaugacuuagcuuugacgucuacuauccacauaccacauuuucuugucuuuuggaugaguuaguaaguugcagauaccaggauggaaucuuaguuugacuugaacccauuaaaaaaagugaagcugccaaucaggaugcauuucaagaggcccaguccagcuucguugcauuuggagugguucgagauuaagagacacuuuacuuuagaaugacccugagggcaaguucauccuguucucuagaaacagcagcagucgaaggcuguugacaugcuaagaggccucuuggggcuaugauauguccaguaauucugguagagucuugauauucauggugccuucuauacaccaugcauggaucugccucggaggccauuaagagcaagccuuauauucucaucauuccauuucccgguggcaaagaaaucaggugacgugucuccuccagaacuauggcuacccacaguuauuuuuauagagccaaagcccuauauaguuauuuuuuuauugcugugaagagacaucaucaccaaggcaacuuauagacaaagucauuuaauugggggcuugcuuacaguuucagaggguuaauccauuaccaucaugauucagaacauggcucaggcagggaagcaggcauggcacuagaauagaagcugagagcuugcacgcugaaccagaggcagcaggcagagagagggugaggcuaaccuggcguggacuugugaaaccucuaaggcaacccacaaggacaaacuuccuccaacaaggcuacacacaccuccuaauccuuccuuagaaaugaaccuaugaaggcuauucucauucaaaccaccacaagguaggguagcgcuuguccugcaccagagcuuggggcucugagugcucccuguagacgggcagcugauugagggagugguaggaugcgucucuucacaaguuuggcuggcugaggagcauuguaaccugguagaagaguugggaugcacagcuugugucucauucacaggaggagcccaaagccccagauuaggugaaggaaagcguauccggcagccaugcuguggggugugguucauaguccugagcccaucagagggcuguccccugugcggagaagggcacauguucuggaaacgaaugcccaugaacaugccuucuugugaugaauuucugggacugccagacuagacguuuccagaaaggcaacuauuuguuguuuguguguguguguguguguggagaggcauggguucaucuagcccuagauuuuuauauguccuucucagaauguagaccauguuuuugaagagcuaaagcccccgaggaacccaaguauugacugcugacuucuguucccugcuagugcuugaauggcaguuugcacauacuuaccuacaguggacaaaugauaugaaugguuagaaaugucuauaaugauacaguguucagagcugguuuugccuccaagaaguaggcaugauaggugggcuucaggauucucccagagauuagaaaaagguugacuuucucagagagccugggcuuugcccaaggacauugcuugucugcagucuccuagucucaaguggccuagguuucucaccccagaccaacugcugugcuaugucacuagguuuaagcggucacauguacuaccaaugaccucugggaacccugugaucucacaagccucacaggauaguauucccuguguugaaauguccucaacaaagugguggugucucacaggauucuagaggaguuacccaacccaguggggauggugucucucagaagucuccaaagcggagaggccugcagaaggcucucuugcuugaucuucuaggcugucaggucuguguguuugucuucuuuugaauaaaggcugggucucagaagcaugaagggagaaauagaaagcuguuuugcaggcaguuucaucuugguggaacacacaguugcucacugccuuagacaguccugugggagaaaaguuuguucuuagcuuagccucagaagaaacaggaaaggcuuagggcuuggagcuguaagucuccacggcugcacacacccacucccacuccuuaagguuguguaaggcagaguucauuuccuagcugaguuuuguguugcuucugagaguggaaacgaagcauacuuucuuuuaugagcugggcgggcuuaucuggaaagggacuuuuuucauuugcucuagcacuucagggaaauggccagaaaaaucuaucagggaggggaaggcuuucuuaccaagaugccugguuagcccugaaguuggucucaggguuagccuagcacccaaggaguuaagcggcucguggggaaguggaggcucaggagagcuggggguguuggggauagugcagcggcagaaguuagcacuaggggagaccuuuccuguuccuuggcuggcucccagcucuguagaauuugaccuaugcacaguucagcaugaaauguuagacccuuaaggugggccguugauuuugugcaucauauaaaacuccucaaggaccggcuccuccuccuccguugaugcagccaucccuccuccccuuggcucucguucccuucuuuauuuacaaaaggaaugugagaaaauauacaucaggccaaaagcuacacccuuuuaacacucgaucggugacagcuuuuagcagggccugugugccagagagccugcuggauugucuggggacuccucucacucucccacacacuuuguuauuccuggacaucgaggcgaggacaacacggaucugcugagauugcaguaggcuuucguggagccuugcuguggagggggguuaugcagcugaauguagagagaggaagucgguugugagcuggcucaggaccuguggacaaagaacaacagcugcaggguugugcagccaucagggcuuccagcaagggcccugccaggcuuccagcacugcuuuuauuccuucaguggaauuagaaguuaugucuaugugcugaucuaagagcgcuccugugaacaccucccuuguguugcccagugucccgaaacugaaugccaaggcauugaagaacugguucuguugguuauagcccaguggcuguacccauccauggcugggguuggcuguggcauguggugaugugcaguggcagagcagaaaagauaaagguuugggugccaaggguaugaauccaguguguugggggcauguuccauugccccucugaaccaagucuucuugaaaaaugggggaggcagcaguaagaacuacuucuuggaucuauuuugugauuuuuuuuuuuuuuuugauuugucgaaguacacaaaguucauaguacaagccugguguuaguccccagccuguugucccugucuacguuuaucugauuuuucuauuguucuugccauguauuucaaaagcuuagagaguauguuuaagauguuuccugaagccaguaagaggcauacgagauacagcucuguugguagaacgcuugccuggcauaugugaagucauggguuugcucccccguguugcauuaacucggugucacaguacacacaccuauaauccugggagacuggagaauugaaagguagagguucuccucugcugcacagcaagguugaaggcucccugaaagauaugagacccgagaaaagcuaauuagaauuagguuaaugaacuugaguucgccaugucccuggggggaaugaagguucuuggggggcauuaagaauauuuauuucuacccagaggcaugcuccuuuuucucucucauuccagggcaacaugcagguucuagugacuuaugguggcgaucccauuccuaaaaguccuuucacugugggcguugcugcgccacuggaucugagcaagauaaaaauuaauggacuggaaaacaguaagugucgaaugaggucagacgaccagcaacugugacugcuauuauuagauucccuucaaaagaugcaauuuucagagacacuaauucugccuuggagagauguugcaguggauggucuugggccugagcgagagcugugcucugacaugccugccacuuacacucagcaggcuuccucauuugugcaguggggaugggguguuuggggggucacuuagacucauggaaguauuauaaaaauuuuaaaugagguaauaaugcagaaacuggcauguugucagcucugugagacugccgauguuaccacaggaaguuuucauuaagcgagaggcuagagaauguuggcuuucagaugagagucauacugugccaaccaucuugggcaucugcaucacauuaaggucaauggcccuaauagaaaucaacuccuggcucuuagaaaccacagccuucucuuucuguccuugcccuuuagcuuguuguauaucuuaccucauuuuauauuguuauaaguacauuguaacaucguuaguuuauauuagaauuuaaagguuaguuuuguuuguuuuuuaaaagauuuuauuuauuuauuuuauguauaugaguacacuguagcugucuucagacacaccagaagaaggcaucagauccuauuacagaugguugugagcugccaugugguagcugggaauugaacucaggacccccugagccaucucuccaguccuguuuguuuuugugauucugagacuagagcccaggccuuucugcauucugggcaagcacccccugcccuuuauguuuuguuuguuuuguuuuuuuauggaaaacuccuaacauaagagacuagcacaguaugagugcaagcauucuuccuuaugcucacauggucuucaacccacuuuuuuucaccagcaaggucuuaacauacauacaccuccgaccuuuugacauugcagaauguuguaugguaucaucuacagaguucauguuugagaaccacacaguugaagggcuugggggugguuauuguuucaagugauauucucugcaucgguggcuguccuaggcagaguguggcuccauguaaccccagaguugcaggcuggagaugcugauuccucuuucuacaguuaaccacaguucugagaacugacugaugaguuuuacagcaucuuugcguuuuaaauaaggucuugcauguuacuuccaucccuccuccugcaucuacacauacagaugccagagaaaucaccuggcaguauuuauuuucauugaaguuguacugcuuugccuaucguccauggcuugugcuaccuuuuaagguuacauuuugaacauuugacuccaaaagcaggaagaacuuggugccucuuagggaaagccucuguccuguugggacacagagguguggacaguugugauggcuucagcagccuucuccauguccccaggaguugagauuugacugcguuguggcagcaucuuagauucccugugcuuuuguuuuggcuaaaacccuuucccuguuuuuguuaaaauaacaccuggcuuuccugcagccuugucuuacagacuguuuaaagauuuaguuuuauuacuuuuaaauuugauuuugcuuacaugucgggagagaggguugcaugcaccugagagcagcugccuguagagaccguaaaagacuguccaucuccuggagcugucauuauaggcagcuaugggauugcucauguggaugcugggaacugaaguccaguuucugcaagagcaguaugugcuuaaccacugggucaucucucuaacccuaaccuuguaaauaugcaggaucuugcugugugacccagaaaccauuuaaaagacaucaaaguuacuucucagaauuugccagcugugugacuucucccuucuuguggguugggguggcaauaggauugaacuuucugcaggaguuaguaaauaaaacauugacuuaaauuaaggauguauuuacauauaagauuaucaccucaaggaaaugaggaagcaggcagaguuggacuauacuguaacuauaaucuuucaaaucugauugugggauuagaaaauuuaugcuugaaugacagcuuugugaucuguuagauacguugucccagacaauuuacuuaaccucucagggccucaguuuccccaucuguaaaggccacuguuguucacuaacagcccauagaguucuuaugucaguugaaggagacaauguacaguauuugugacuggcauacaaauuguuuaguaaacaauucaguguuaaugagacauugcaguguauaaaugccauuguguuaguccugcuucuggacuuuugagucagcuguuacuuacugagggaaacacccuauguccaccgggccaucuugaccuugcucucucuuuuccuuguugcugucagcucaucacuuuagcuugucucccuuucuacaggaguugagguuggaaaggaccaggaauuugccauugacaccaacggggcaggaggccaggggaagcuggaugugaccauccugagcccuucucggaagguggugccaugcuugguagcaccaguggcuggcagggaaugcagcacagccaaauucaucccucgggaggaggggcuguuugcuguagaugugaccuaugauggacacccagugcccgggagccccuauacuguggaggccucacuaccaccagaucccaccaaggucgguuugggguugcuuucuuguugccauuaugguuuggaguucucugguccuaccuaggaaagauacacggaaagucucuguggugaauaugagcucucaguggcugacugauauucugcaauucagugugccagguucucucaacaguugagccacccucuguucauguuugcugucuguuugcaauucggugagagaccuuuccuuuauuggcuagcauaacaaugguacgagccagcucgcaaggaugggugagaaagaagguggaggccucagcccaguguguuuuacacagauugaguucacccuacagaaacuagcuuagcagacauaaaaauauauuauccuucuucauggucuuuuuaauucaaaugauuugggacuauuucuaguagugagugguaucaauucuauaaaauuaucucuucuaaaacacaguuuuauuaugcaagauuuauugauggauauguaagagucuaagcugcugugaguuaccuucaucaggccacaaugaagcaaacucgugugcgugcagguguguaagagagaguggauaugagauacugacauaugcuuuugugugcuuguggcugacuggucagcaguagcagccacagaguggauuuaauuuuaacucuuuguucaaauaggugaaggcccacgguccuggccuugaaggaggucuuguaggcaagcccgcugaguucaccauugacacuaaaggagcuggaacuggagguuugggccuaacuguggaagguccaugugaggccaaaaucgaaugcucggauaacggugacgggaccugcuccgucuccuaccuucccacaaaacccggagaauacuuugucaacauucucuuugaagaaguccacauuccuggaucucccuucaaagccgacauugaaaugccguuugaccccucuaagguuguagcgucaggaccaggacuugaacacggaaaagugggugaacccggaauccuuugcguugauuguucagaagcagggccugggacucugggccuugaagccgucucagacucaggggcgaaagcugaaguguccauccagaacaauaaagauggcaccuacgcugugaccuaugugccucugacagcuggcauguacacacugaccaugaaguaugguggugagcuuguaccacacuuuccugccugggucaagguggagccagccauagacacuagugggaucaaagccuuugggccaggaaucgaaggcaagggugagucacauaccgggggagggcucucucaccuauagccucuuccucgugugguugauggguagggcagggggaguacagguagagggaaaaggggcgcaugauguuuccagagguuguacuccaccaaguccccauuuuuauguuucucccugaugaauggggcccagcauucuuggcaaguuuucaaguuuuuauggaaaauccagaauuuuuuguuauuuauguuuauaaugucucugagacuaaguuagaaugaaaugguguaaaugugcuuaauaauacacgguggauggaggaggucuaacuuuaccccuguccuagaugccuuaguuuucauuuugagacagggucucacugugcagccuaggcuggucuugaacucacaacccuccugcuucccucuuuugagugacuaaaauuccaggcauaaaccauugccgugaccugauccucaucuuugagaaguuuugcugucugucgcuuggccaagucuagcuugacuuucacagucagcaaaaccacccuuaaggcaccaaauauacuuaauguauuccagaaugugaggagucuucauuuggggguuugcuugggcccaagaugacauuuuuuuuuuuuuaauuucaucauguuuauuuuaaagugaucucuuauggugaaacgaaucauguuaaccugcuccagcaauaaugcuuggaaaagauuaaccauuccauuuccagugccauugcuacuacucgaggacugagaacaggcugugcuccaugaguucugcacgucugcugugccucugacacuggccugggcagucagaucuuugguuucuguuccuuucgugugcagcucguucuuuuccucagaccuuauuucagccuggacuugaaugaagauaugcuuucccuuuccuggcguggcuccuuugcucucagccagacacacugucucugaaccaacaagcauggcacugcuaacagaaccuuugaauaugguucaucucaaagccgguuacacuuuggagccaggcuuguucgauuuuacaaauagcacauuuugcuguagucggaguacugugacaacaggaaaaauucaaacucccucuggggaugauugcaggguuuccuggugaugagucucuggcuuccaagauauuauuauuaucugugugguuguucaacagacguguuucgggaggccacaacggacuucacgguugacucgaggccccuuacccagguuggaggugaccauaucaaagcucaaauuaccaaccccucgggggccuccaccgagugcuuugucaaggacaaugcugaugggaccuaucaggucgaauacacgcccuuugagaaaggugggucauccccucugugcuuguaacucuuuuauucagagcugugcuuagccauuuguuuccaaauuguccugagcucagccugccucagcaaagaacaguguacacgacucagaauuaaaccggucccuuccccggcagccaguggccugaauucagugccuucuuuacugaccuuauauuucacauugcaaaucuccaaucuuaccugagcagauuauagagucaugccguggcauguuagcaagguaugauuuguguacauauuuuuuuaaacaguuuuucuuuuugaauaguacugauuauuaaaauuuugagaaaucaagaaaucauaaagagaaaaggaaagcacuauauauccccuuuccugaguauauggucccauaaauauucucuacagguaucuucagguauuuguagauggcugguuuucuaucucgugaguuuccuguggucuuuuaaugucugguaguguuucccaaaaucaggguaaccugccuagggugacugucuuaaauaaaaguuagcacucauugcuucagggaggguguacagcacacaaacaaaaagcauaaauaguuuuuuguuguuguauuuauuuauuuacuuacuauauguaaguacaccaucuucagacacuccagaagagagcaucagauuucaucacggaugguugugagccaccauguggaugcuggaauuugaacucaggaucuuuggaagaacaguuggugcucuuaaccgcugagccaucucaccagccccgcacaaauaguuuuuaucuuuuaaaauugaaaguacacuggccuuaccauuuucugauuguuuuuuaagugugugugucugugugugugucugugucugugugucucugugugugugugugugugugugugugugugugugugugugugugugugugugugagccuauggagggcagaagaaggcauuagaguccuggaccuggaguuauagcugguguugagccaccuacuguaggugcugggaccuucccacugguccacugcaagagcaaugcauaaccacugagccaccugccuccgacccuguguuacuguguucuuaaucuacucuuuucaaguagcagcuagagaucuagccaaguguuagauaagagucugaagugguaacauuguacacaaaugauauuuuuguuguuuguuuuggggcagguuuccauguaguggaggugacauacgaugaugugcccaucccaaauagcccauucaaaguggcugucacugaaggcugccagccaucucggguccaugcgcaaggcccuggacugaaagaggcguuuaccaacaaaucuaaugucuucacagugguaaccagguaggcaggguccuggguucaggguauugauccccguguaauuaauugauuaagcaaagaaaaaauaguuuauaagucugaggccaaucugagcuacaaaaugagacccugucucaagggagaaaguaaguuaugggucuauuucaauauaggccacagccaggcaguggugguguacuccuuuaaucccagcccuuaggagacagaggcaggaggauuucugaguuugagaccagccuggucuacagaguaaguuccagggcuacacagagaaacccuguaucaaaaaaaaaaaaaaaaaacaaaaaaaaaaaaaaaaagaaaggaaggaagaaagagagagagaaagaaagaagaaagaaauuauaauauuaagauaauaaucacuaagaugcuaagcacacuacuggauagaaauuccuuagcuucaugaugcagaagaauauagccaacucuauaugaaaaauaaauauucaaaacguuccuguuauaauuuacuccgaagggaugugcugguaaaucagugacagaacauaggcucaguaccccuaagguacacacucacauuguauuugucuuuguauucuauaccauagacagguucucagccaaugggguugcuacucuuuuggggaucacauaucagauguuuacauacgauucauaacaguagaaaaauuaguuaugaaguagcaaugaaauaauuuuaugauuagggggucgccacaccacgaggaacuauauuaaaaagucacagcauuagggaagguacuaaauaucugagaaacuccugccugagagguauugccacacuuguggaaucaaguuaacuaaauagaauggcuuauaaaauguuuguaagcgaguucuggcaguaagcaggcuggugugggcugaucacauuucacuccccccucuuuccaggggagcagggaucggugggcuuggcauaacuguggaggggccgucggagucaaagauaaacugcagagacaacaaggauggcagcugcagugcugaguacauuccuuucgcuccaggggauuaugacgucaauaucacguacggaggcguccacaucccuggugagcuacccccuugggcagugcuucaaagaauaagugauagcgcaugaaaacagauuaaagaugguuuugcccaucuuccuuuaauagaacagugugacuuuggagaaaccuuaaauaaggaccacagcaccaagaacacuauaaaucucauucgaacccagcaacaugguagaaagcguugacuugggccuucagcuagaaagagcggcucgugugacuuaguuucugauuuaagcaaaaguuuacucuuuacaauauugaaaaucucuguuuuuaaaguuuuuauuguuguuguuauuauuauuaauauauauuugugguuguaggagcuuaguuauggcauguacacguagguauccauagaagccaaaggauuuugaaucugcugaaauuggaguuacaacaguucugagccacccuauaugggugccagaaauugaacccagguuaucaauaggagcaauaaaugcuuuuacucacuaauccauuccuucagccccaaaacuuugggauuugacuccuuuuuuuuguuguuguuaagauuuacuuauuuauuucauguauaugaguacacugucuuagucuucagacacacuggaagagggaaucugauucuauuacagauggcugugagccaccaugugguugcugggaauugaacucaggaccucugaaagagcggucggugcccuuaaccacugagccaucucuccagcccuggggcuuggcucuuacucacuuuauuuauguaucuugcuuuuuucuuugcacuguuaauuccggcagcugaaaaagacacacuaauacaaauuauuacuuauuaauuuguuuaaugaucuauaucuuuaguguaaaacaggguuucuaccccugacagugcugacaugucuauauaagcuuuaguaguucaaaaugacuaguuucuccucaaacccgugcuugcuacucuuaucaauagaguuugguguuguuuguuuguuuguuugucuguuuguuuuaguccuuaauguagagaauuucagcuagaaauaaagacaaagcucccacuucuggagcaccuacauugaugcagauaaacuuggugcugauuagaagcaagggaauggggagaaaggacagaauggaguugucaggccccccuuugugccuugccacggggcagugcugucucagaguugagcaccaaguaugagcagaagguugucuccggggaggugucugugucucccaccaggcagguaguucugcuggcuucucugugcuucuguugugggaagcacuacuacccuggcuuuucagaaagggcugaaucccacgagcuuuggaauuccccugcaaaaggaccugucaguuagcacuaaacaaaugauuguaacaacaagaaccuuccagagcugaguauccguuuccagaacagucccguguagaggcuccucugagugucagguuauccagccuggacaacuccugagggccgaagcaucugugaccugccagcauccugucugcuuuucuggggacugcgaugauuaagguucagguuuuucuggccugaugcaaaccuuugguggguuuuuggauuuuuuuccguucagauagaaccucagacuuggaaucuuccugccucagccuccuacaugcuggguggugguauuauuucagacagaauaucccaucuuacuucuauuaacuuagugguuuccugcgaugacccagcugcagucuuggugguagaccaguugauuaguugggauucaugaaggguugugaucagcuggugauguuuaccuggaacaucgagcagcauguuggcagauaaugggaucuggacuuguuaggccauugcuuucugcuucaaggcugcucucgggcugaguuuagacaauuuccagguccaguaauuggccacagacauagucuguaguuacuuguugacauuggaacucuccauuaucacccccaaauaaaucacucucuuguuccccuaagucccagcauggaagguggugcucaucuuugccagggucucaguucuucgugcaaguguguuauaaccccugauucugcuaaguggaagcuuucuuagauacacagcagagauauuuaucuccauggcaggagucuggcagucgccauaccuugugaaaugugcaggcuguguccuuccugccuggggcaaaugaugcucugaguucuuugguaaaggucuugguagccugaggcuacuggagacacaggcaagccugccgugugagaaguccuguuggcaauccugguucugcccuuguuucuucuuaauguuucacuuacaaaucuugguuucccuggauucaccaugucuugucagucuuuauacuugacaucauuaaaaagcgagaggcccugagguuucccccacagucauaccacaacguauaguuagaggaguguggaacccagccgccaugugugcucagaaugugcuggcuuccacaggagggaggggcaaggcuaggaugacccacccacucuuuuuuccucuucuguguauacucccaccaagcugcucgcuuccauucuuccaagagccuuucuucuccuccuucucuaugccuuugcaugaguggaccccucugcccuacucuucuuuccgauguuucaggcuuugucuccucccagagcugaauaucaguuuuucugugaacuccacaacuccccguagccagaggcauugcuugucucagugucgugcuucuuggucaggacuagcuccugagaacugaagcauccagcguccuguuugcuuuccugggaauuccccuugaguggaagcugcuuccucuuacaucauuccuugggucuuaauggacaucuuucucuggucuccugcagaccacuuucauugucuccuguguguucugccuuguauaccuuccaguggaugccacacggaauguuagaagaaugugcucguugccagaucuuuggcuuccuauaagguuuacugaggccacagaugcuauguuggcaugugguuagugcuggauggcagaugugggaauaacagugggcacauugcugcuuccacagugaauugacugagacucauacggucaggguccagguagagcagcagugugauucugggucugugcgggugcucucucuauugcuucaugcucagaaucccgugacucuuccaggcagccccuucagaguuccuucaaaagauguuguggaucccagcaaggucaagauugcuggccccggucugagcuccuguguccgagcaugcaucccgcaguccuucacaguggacagcagcaaggcuggccuagcuccccuggaagugaggguccugggcccaagaggugagucugcauccugucugccacccacauucacccaccauggcccagagccaguucuuucuuaugagauuguuuaugagcuuauaguuaaauacucucaguuaauuuacuguuccccagucuagcuagccagcaaguugguguauuauauuuccauaaguccauuucuccuguuaauaacauggcccuaaguuucuuuuuauaguuuuacuuacuuauuucauggugcugaagaccaaacccugaucuuacccaugucaggcagguguccucucagcuagcuuacaucccaggcuuuguuuugguuuucccaaauguggucuaaguaacccagacaggcuuugaacuggcagcccuccuaccucugcuuccugaggacuagaacaucaagcaugugccugaaaaugucccuuucucaaggagccugcugaagggagggcucugugggcuuuagcaugcacuguccacccagcugcaacacuacaugcuuagcaugugggaggugccuaggcuuggucuggaugugagcaggagcuaggguuugaaggugaucccucugagaugcucaguauugcuguggaacguaccagaaucuuggucaggguuauagcuuugucauugucucaacucccugaagagagggucucugggggaaugaguuuuguuggcaguuggccuguacugcugacaaccuggaauuaagguuucaggugacuagcaggccauuuggggacaaaccugaacuucggaaaccuguugccguauuucuuccguauuuaacacguaccucucuuuccauauaaaauagugugccugauuucuuaaguagucuaggccucucuccuccugcccccaacuuccccugugauguguuuguggcuugcagaaguagugagccggggcuuccuccuuugaagagcaaccucuccuuaguggaguucagcaggagguuccgccuuugaagcucagggaaagaguggucugagagaaugaggucauggggcagacuuacccuuagcgaaguuucugaauauagugugugugugugugugugugugugugugugugugugugugucugcugugucuguaugacagggggguuacuuucacagcagccucuaacguggacuucccaaguaaaugaccuuguaacuuaaacugaugcaguggaugucugugugugugugucugugucucuguguguguguguguguguguguguguguggguuuggggggggggggguuacuuacacagcagccucuaguguggaggacuucucaaguaaacagccuuguaacuuaagcugauguaguggauucccugucauagcacagccccuugaaagccuuuugaguuuuuaaagcugacccagagguugccuuuauagagacagguuugagguuugugcucucccauuagcggcugcuuucaacuauguagccugacugccucuagccuagccccaccucuaacugccuuguccucacuucaccugaucuguuuaaugagcaugcccugcugauuaaccuccugugccaucgaccccuccuugaccucaggcucaggucuagaaucuaucaaucuagugcaggccuuaaucaggcuuuaacauucucucgaaucaucacccaucgcaucucauugauggcccucuuguuccuugagauuggcacccuuacuugcucuguaccccagcauguuggccccacuguguucuugcugaaagaugggcccaggucuugacuggccagcccacagguuacuuuuugcuguugagguuucuagacacucgggcacuuucucagcuauagacuaaaacugacacauccaagcauguuuaacuugaaaggauauguaguaugucugcaaagaccuccagcaguaagcaugggcaguccccuuacuuguacuggagggagcuauagcaagcugaguguacuucagcucacaaaacgcuagagguaucucuuggggucaaucccguuacugugacuuauguccugugacuaggccuacuugcuuuuguguuacucuucaguucaugggaauggacgugauucucuuuuauguguagcuggggugcugugagcaggaggccagguugucagucagaccucucauuccuguccuuaggccucguggagccggugaaugugguagauaauggggacggcacccacacagugaccuacacgccaucucaggaggggcccuacauuguuuccgucaaauaugcugaugaagagaucccccgaaggugagcauggcagccuucaggccuggguacaauucagccguagaccuguccacccacaggauugaucacacuguccuagugccaccccauuccccagccacucacccacuguccauuagcacauugaacagagcauugugguggcauccaguaggcaccguggcuucuguucuagggucaacccguucuucugucuuccguuccaagggaagcuaggauugccuauugucuaauggcuuguacuugguggcucuguauuuccaauggaucugguccucuuauuaaauucucuuaccgcuuguaaaaauccuccuuucgccaggcgugguggcacacaccuuuaaucccagcacucgggaggcauaagcaggcggguuucugagcucgagaccagccuggucuacagagugaguuccaggacagccagggcuacacagagaaacccugucuccaaaaaaaaaaaaaaauccuccuuucagccuuaguucuuuguguaagagagaacagauggggcagggcugaccuguauccuuacugaccagucuucuaugugucuaucaagucccuuuaaggucaagguucuucccacauacgaugcaagcaaagugacagccucugggccuggccucagcgccuaugggguacccgccagccuaccuguggaguucgccauugaugccagagaugcuggcgaaggccugcuugcuguccagaucacgguaacugugugguuguuuuguuguauauauagaagagguggggggggggggggcuggugagauggcucagcgguuaggagcaccgacugcucuuccaaagguccugaguucaaaucccagcaaccacaugguggcucacaaccauccguaacaagaucugaugcccucuucuggugucugaaaacagcuacaguguacuuauauacaauaaauaaauaaauuuuaaaaaaaaaaagaguuuaagagguggggccaaaccuuauuaggaauacuuaauauucuggaaagggauaaaaacaggaguuuagugacuguuuucuaccccagugcacauauuuuggggacuucuuugggucagaaucuccacuggagaacauuuaagcuucugcagugaccaugggucgagcaccaguuguucuguguuacuacaucucuucuuacaccgauuuuaaauguuuuaauugccuauuggguuagugagggcuaaaauuuuacauaccacagagccaccaacaugggauuguccuuccuugggaaggaagccagagguaggccaccuaggugcucuauggcucacaaggaagccagcaucucugaccuaguguguggcucuguccuuaaugucuccucauggaccaugagccugcagagcucugcucaucaggaauagaaggugaaccagaaggaaggaagacagggaggaaaauggcucucguagauggacgauccaucucaagcagucacaugguugaaccugguggcagagcugcuagcauguggagucucguauucaguggugugcuuagcuaaggagucuuuuguugguaacaggacaggaagggaaaagagagguggaaagcuuuugccaugucuuuguauuucaguguaugugauacucaguacucuuugucauggguuuagucugugacccucuucuuucccuacccaaaaccaacagaacagggucacagccugccacccuucgucugcucccacauacagaggugccaaguaaagaacauggcuugcugugacugguuucuauauguugauagcagcaucccaaauaucauugcucugugauucacaggaccaggagggaaagccucaaagagcuacuguccacgacaacaaagauggcacauaugccguuaccuauaucccugauaagaccggacgcuauaugauuggagucaccuaugguggagacaacauuccacuuucuccuuaccguauccgggccacacagacaggcgaugccagcaagugcuuggccacaggugagugcaggggaagguaagaguuagggguauguguucuggccuucucuauccacuuaaugucugugcaaccagaggaugcuugggcuuucugacagcagucacacauacaaagugaacauuuuuacagaugagaacauucagacuccagaaucauuuccaggugucagagaugguaucaccagguuauagcaaaaaugggguaaggucaggugagauagacgcugacugugaugucugggccagggggccuguuacuucugaggugagagcaccagugagguuucuggcagaaacugcuauaugagaagcaguaagucucugccucucuaagugaggggcucgcuuguucaggagucauucaagaacaucuuacacagaucagcaguagaaaacaaacauggaaggacuucggauuucccucuccagaaucgaugaauauauuacccucacccuugcuucagcuucucagacgugcuugcuugacuauauaaaagggguuauacacaccgaacucagguccaaggcucacauggaggggaugcagguacuuuuacccacagggccaucuuaccaguccaauaugguauucuccaauuuauaaaagggaggugggucucauguauccuggcuggcuucagacuugcccuguagcagaggaugcugccugcuaccagaugcuagucccucacccacccacccccaugcucgcgcgcgcgcgcgcacucucacacacacacacacacacacacacacacacuaugccucccaagagcugggauuguauauauauaccagcccaccugguguugugccuuccuguuucuaagagugacuugugcaacucaguguugcugcuuuagcagauuuuaaaauaugaaaccugggcuggugaggugggugaggguacuuaccaguaaguucacgucccagagccuacguacugagagaacugucuauacaugcacacaccugccagcaugcuugcacaugcaaauacauacacaugcaguaucagucaacuuauuggugaagaaacaacaaaaccacacaagucacugucucaaagguuaaucauuggcuucucuuguaaauaaaaggaaacugaguguaggccuacccugcaugugaucuguucucuaccucauccugcccaaggcuguaaauaaugcaccuugacccuuuucaucucccccaaugcaagaaccggaaaaccagaccuccacugccagucugugucagugccuaacaacugguugagggcauguguagugagagcuggggaccuccuucuggcuuuucagagcugugucuccucccccuggcuuugcagggaucuuuuucuugggcugcuggugccuguuggccucagcucuuguucugucguuuggagcuguccccucaaccagaugcacacuacuuccucuucccacugugugagcagcuuucuuagcauucccugucgcgcccuucugcacauuuugaccagugugguuucccuucauaacuuguuauacugcuuaaaagugagagacaggccaacuggcuggcuguuguuuggggagggguugcaaagcuaaacaugguugauccagacacuccuuugagcagcacccuugccagugcuuugagaugccccucugccuggcaaacauagacagcacaacauaguauggccuguucugagguaaauauccacagccaaugccucuggucuuuuuuacagguccugguauugcccccacugugaaaacuggcgaggaggugggcuuuguaguggacgcuaagacugcagggaaggggaaaguaaccugcgugauucugaccccagauggcaccgaggcugaggcugacgucauugaaaaugaagauggcaccuaugacauuuucuacacugcugccaagccaggcaccuauguuaucuaugugcgcuuugguggcguugauauucccaauagccccuucacagucaugguaagcaggguuccuucuccugagccggcucuuacuagcagaagcagucacaaccgucauuuguugaacccuuauuuggccaucuucccucacacccuugauccuagguauauaaucgcuagaagcagcaauuuugggggaaaucucuugagucauggaggcaucuggcaugccaaggaaguuaggcaauauccuccuguaagccagcucagagggagacaguuucacaggaacauuggaaaacaguacuaaagauacaugugccucuuuucccauccccacugcuggagaagggggauccucaugcucuugucuacacacuugacugauaucucaggaugcacagagccuccagccguguuugcaugagauucagaagggggaaguguguugucuuuuauagccagaaagaucuggaauagaagggaacuauugugugaacaucccagguaacgaguaacuggagccuuuaauuuucaguccuggaugccuguuagaucuucucuaauuauuaagguccuuccacgaggagcaugguggaacuacggcagacuuaccacauaaacuuuagaagcaagcccuguuugcccugcuagaaugaggagugcccagucuagacagauaucaggugccaugugggcucccucacuguguccuuugaugcagaacagccugggaucuggcugcugguggucugacuccacccaccacuugugaagugcuuucugauugcuucauguuguacggcaguggagaagggcacaaagacuccauuccaaacagaagcccagggacccuguucccaucuauaaucuguuguagcuuuucuccuuuuccuccauguguguuuagcuauaaacauccggccagcggucuggaagcucuuucauaugucaaauauguaaacacuugucgacuuuggacacuguccauuugggaguuuuuucuucucugggggagaaaacauugcaaugagaaugucaguucuacuuagaagcguguucuaguuagaguauagguuguaguuguacuguguuguguuuauccccuaguagguaugaucuuguuaguuagauuagggaagagcagcaacccugggcagagaucucgaugccauugcaauggcugggauaaggagaucccagaugcugagacccgagaaugagcauuccuuaaguccugcgugcuuacaacuugaggggacucacugcacccccuuuccugggugauugaaucucccuuuaaaugcucaagacugggagaacauggacagcugacagcacacugguagcaaauaccuuagggagacccacacacuugugugugucacacccguauggcaugcaggcucauggcggagcagccuaauugacaccauugagaaguucuaguugcgagacugcauauacagccucgaaaggccuuccuguucgugacaugguuuugaguuggccucuugaagagauggcccuagaggcaaagcuagaugucagagaaacccuuucugcagauggcacaguacacagcuucuuuguuccguguuacgacggaggauggugaugagagacccuuccuuguugggucaguuggaucaggagcaugaagcuggacauuuuaaaaaaugaaugugcuuaaacuuucaaauguguuacugacuggaacuggaaagaugguucagccguuaacagcacuggcuacucuuccaaaggacgaccuaaauccaauucccagcacccacucagcagcucacaauugucagaaauuccaguccuaggagaucugacacccuuacacagauacacaucuggcaaaacaccuuugcacacaaaauaaaucauuuuuaaaaucuaccuaacaaaucuuaaagccucuauauccugaagaaagaaagaaagaaagaaagaaagaaagaaagaaagaaagaaagaaagaaagaaggaaggaaggaaggaaggaaggaaggaaggaaggaaggaaggaaggaaggaaggaagaaagaaagaaagaaagaaagaaagaaagaaagaaagaaagaaagaaagaaagcaagcaagcaucguggcagggaugaaaggccaagggcaugggaugcguauaaagcgguuguugugcaagcauggacugagaccagguucccagcacucguaaaagucugggcaugguggcccaugucuguagucaggaggcagaaacgggagaauccuggggacuuacuaaacagcuaaucuaggcaguuagugaacuugaaguucagugagagcccagugcccaauuucaaaaccuggcuguagaagcaggagugcuggcuuagugguuaagagcacuuccuucccacuuuugugggagaccugacugguuuucagcucccacgaccauccguaacucuagcuggagagaugcuaacaccaucuucucaccucugcuggcaccaggcacacacgugguguacauacccagaugcaagcaaaacacucuucaggucaaaucuaucaaaagcuaaaagauacgguagaaaguucuagagaaggagacucugcuguguggagcucuggcuuccacgcuguucacgguuguguuuacaugaacacaaauguaccucacacauccacaaaauaaaacaccaaguaaaagaaaaacagagagccacuucugaugacugccaccagucuucugugccuucccgguggacacuugaguuucaggcaagggaucaugacauguggccucaaugcuugccugcuuccccagcuaacauggauacucuuccauagcaacuugucagacaucaccugcuguuacccuggccagucugaccaauaaccacaaagcugacuucagucuuucaugaccacuuguggcgccggucaaacuccuguacacaucccuuacuugugaauuguggauccaaaggacaagugccugugacauuugcagagaguccagcuuccccucuaaaaaguguaguaagaacauaucgcucuuacaggauauuauaacacgugccuauuaucccagcacuugggagauggagacaggagaguuagcaguucaaggcaauccuuggagagucuuuggaguuuuguggagaguuugaggccagccugguuuacaugagaggcucuguauccaggaacacacacacacacacacacacacacacagagagagagacagagagagagagagagagagagagagagagagagacuagccaguaccugcuggaaauugggggaggggagagcucaagcuguaggaucuuggguaauaaucccucuggugugguucccgauuaacuuccauuugccaucaacuaggccaccgauggggaagucacagccauggaggaggcaccgguaaaugcaugucccccuggauucaggcccuggguacacuuugguuuuucccuuuugcauuucuggguuuauucagccuucauuuuagaaaagcugcugccugcuugugggaaucgcuuaaguccuugguguccuggccguuggugugucccccccccccccacugaucaccucaucacaaccccacuuucucuguaagauccaccuucaugucaccaccugcuccccacgaaucgccagccaucaugucugugaucacgcgcggugcgguuuucccccacguucaaagagcaagauggacggcuauuggcaggccuccuccugacuccaagccaccacuugugcaucugguuucugucuagggcaaagccacccgcuaccacucugugccacuuaaaacacaccuucuuuucuaggccacaagcaacuaaaccucuccagguguggagccucuugggacucagucauugcucucugccgccuccauuuuccugugggcgacauugggaauucuacaagcacccuguugaccaaguguuuucuagcaaaugaucaguggaacuucucagggccguccaacucucuccaggcccagucacacaaagccccauaaauacucguggccacacccccaaauuuaggccucauugccuuguagaguucccagugguuccgcccccccauagcucccccagcccacacugcuguccgguuaccaagugaacgcucucguguuuuuagguuacagaagaggccuaugucccugugagugacaugaacgggcuaggcuucaagcccuuugacuuggugauuccauuugccgucaggaaaggagaaauuacagguaaacccuuguggggcucaccuuacucuuuauuuguuguugcaucugaggcccagagcagugcuugggcggugacuacugucccuuauuuccccagccagacaccagaaaguguuucucugaagaggugguuguuuauagcuugcauuacauugcugaggaagcuuguguuucuccucaggcuaggaacuucuuuguuuagauaccucuugcugccagguuucuguuucuuuuuccaugcuuucucuaaccacucacuuuccaaccugucugucacucagaucugugguaucaguucccuucugggagcccagccucccuucuccugcuucucuuacugcuuuguggucuucucagacccucuuugcacuuguaauuggccuguuagagauaccauguauuuauuuaugagcuaauugcuugcugcauuuuguggaaaccagguggaagccauagaaagccaggcagucucaguuuuccuggggggaggggggggcacuuggacacuucaggcagcaugaguguucugggaucugaggaccucuggugaagacaucugcugcuuggggaaaggucaccagugaccucacugccaugugucacuaugcucuccaggcacggugcauaugccuucugggaagaaggcuacaccugagauuguggacaacaaggacggcacggucacugugagauacgcgcccacugaagucggccuccacgagaugcacaucaaguacaggggcagccacaucccggguaagugggguacagcggcucgcuagccucaggcaucugggagacacagccagggcagauucaggagugugauguuggcuuccauucaaaaacagccuccugggccaggguauagggccaugucgcuaugguugugugucuucauaacugucaaauauggccaacuacaacgcaggcacaggaagugaggcuuucuggccuggccugcaagacccugugggguauggaugcuagccuccucagacacagggcuuagcagacagauggcgcccacacagggaacuaguuuucguuuccuacccauggacagguucagcauugguuguuacucuuuguaaucauuucaauaucuucugauuuuauaauuagauaaugugaucauacauaccuauaaccucccucugcccucuccuggagauugauuguugguaaauuuuauguucaauuuuagaaaaauuuuaagacuacaugcaaguaaaaauacagauuuuaaaauccaacccccuuuuacugaaauuuuacuuacaucagcuguccuugccuuuucccucugaauaacacgagcaggaaagcugugcaugucuacacaugucucucccucaucuggaagacacugcagaugucccaguguaauacuggggaguauuucuucucuuccugccauugcuguugccucuuuuguuggcacucuugguguagcagugcgauuuggccccuugggcaaaagugcuggggggggggggggugcagaccaaagccuuugagacuuggauacacuguagcauagugcucuuccuggggcuguuacauguggagccaagcagugaaggaacgcaccugccuugccacaggcuugcccuguagagucuacuuugcaauuguuugucagucuggugauugaaaaugcaugguaccgagguauuuguuccugcaaaugagaagagacaauuuuccauauauuguaucuuuccaauucuuucucugugagcuguaucuucauauucuucgucuguuuuccuuuuggaaaaaauuaucuuuuaaggugggaagugggaguuuaaaauccuucuugguuugucacuugcuuuaacagauguucacauguauacacaauacuugguuaaagcauuuuuuuuucuguuuaaggauucuaaugauaauaggugcagaacuuaacagucgugacucaagcuucaggcaggcacuagaugucuauauucaggaggcugaggucagccugggcuauacaaugagacuacugaaaacagcaacaguccucuguuggcucucgcccuucuccuccauugccaugugucuaccgucucagaugccugcuauguacuuaagauacaucuuagcgcacuuagauuuauccuguuaaaggaacagcauagugguucuuuucuguuacuguguauguauaauguguauauguauggucacacaugccaagcuaugcauguggaggucagaggaaagguuuguagaguuaguucucucuuuauaccuuuacaugggcuguaaggaucacauucaugucaguaggcuugcacaaguuucuuuacccacacugagccaucauaccagccgcuaugaaauaucaguuuuacauauaaagacaguuugcuuuucucugaugugacauacugcgguuaaccucucaaggucguacucguggaucuuuaauguuccauauguaggucgacucccggaugauuuccugguuugcagguggauccuggagacuaaagagcuuuaauagggaugagaguagccguggaucacugugggcuucuuuccucaagaugagcuucuuaggucaggccuuagguuuugaauggcacuaacaaacagccuucuuucuagaaagcagcaucuaccucccugauacgcauguguccuucucauuuguuaagcugagaugaaaucuccuacaccaguucccuugagcugcuucagaggguggcggacucuccugcugggaggacuuuaauguacugccgauuaucugagguaucuauuuaccauguaaugagucucaguuuuguuuuuguccuuggaaaaugcagagagcccccugcaguucuacgugaacuaccccaacagugggagugugucugcuuaugguccaggccuuguguauggaguagccaacaaaacugccaccuucaccauugucacagaggaugcgggagaagguaugguaugcuuugcguguuuaugcagguauaaccuuccuuuggagagauaaaugagcaugauuaaaaugugcugugaauggaagcacucagguagucucaggagacuguugugggagcaucucgugagcccaggaguccaaaacuagacugagccauauagugagaucgcaucucaaaagaaaaacaaaaaaaaaaucacuauuauaugguaucauuugucucauuauuuucucucauauaaaaauucaucuccaccucaaaauagaaauguuuaaauucuuaugugaaugaaaucagauuuguauuaugagcuauuucaugugacucacugagaauucacgugggcuuuugauugaaaauggcuuuauuuuuguucaguuugcuuguuggucccucaggcccucccacgagguauuuagcuguaaguucuagcugaagugcugugccaaccauaguagucacacauuccucagccuugggcucugaugguggcaucuaccccaagcaccgugagagagacucugugcuagccugagcacugugagagucuguguuugccugagccccgugagagucugcgcuagcccauccugcauaugcuugauguaguacucggucuccuccuuaccucucagacccugggguuauuuaagugucggguugugagugcaguucacagugaugugguuccaugggcuuuccucugaagauugcuuugucuugauacccgcauggaauggcccuggugucagggcccccuccagaggcauugucuuucuagaaauaaaguauuucucucugacuguccucccuccauauccccucuccuagguggucuggacuuggcuauugaaggacccucgaaagcagagaucagcugcauugacaacaaagacgggacauguacagugaccuaccuacccaccuugccaggggacuacagcauucuggucaaguacaaugacaaacauauuccuggcagccccuucacugccaagaucacagguaggguugcccggcuuauaggaauuucucaugggagaucuagcugugccuagccccaccccaucuccucagccugggguagcaagcuagguugguacuugguuuucccauauuugggaaaccuaagucuggucaggcugccuaaauccuccuuuuuucauaacaaaauaaaaacaagaguuaccaaccagaaagcaaauucucagaacgaggcaucaaggcaaugcuuacaggcagagagcaggaacuaaagaggccuuucguuccauacuacauaagauaucugcccuauuaguuuucuggucugaaguucggagagguagccauugagccaaguucacuguauucagaagcagguugucccauuccauaaccuacgcuucuggcucuguucugccugcugaguuaagaacacaugguggguucucuggaagaugcacaaaucaaggcucuugucaaggauucuuagaccugacugaaggaggcaguaacaguggggaguaggagccaagcuucuuugggaauugcccaaagacacagcagcagguggaaaugccuucuguugccaaaaauuucuuuaauuuuuuuuuuauuucauaauucaaaguaauggcuucuauuauggaauuuucauauagaugcauuauacuugguucuaacuccuccuccuccuccuccucacuguaccccucccuuaagauagcuucucccccacccccaccccccaccacccccaccacccccaacccccacccccgcgcaaaaaaaaaaaaaaaaaaaaaaaaaagcugggcgugguggcgcgugccuuuaaucccagcacuugggaggcagaggcagguggauuucugaguuccaggacagccagggauacacagagaaacccugucccaaacaaacaaaaaaaaagauagcuuucuucccucucagggucccuuucuaguuucuucccuccucuuucuguuucucuccaacagacacacacacacacacacacacacacacacacacacacacacacacggcaucugauagaaagcaugugguguuggucuuccugagucagcuugacuucaguuaauaugauaauuuccauucauuuguuuucuugcagauauccugauuuaaauauccugauuuaacuuuuuaaauauuauuucauucuauauacauagcccauugaauugaguuguguacagaaagauauuuaguuuaguucuucugcaugucaaagauuccucuaaaaguguucacagggauuuguagcucagauuccuuccagcuccuugucucccccugaaccagucauaaccacccauuguccugccguggucauuauauacucauugucagaggcacaugaucuucauacaccuguggguaaaagauucuugacgucacaucuccaagugccauguagaccauguucucuagacagcccagcgagcacauguaauaggagcucuguugcuuuuucucagaugauaacagacgcugcucccaagugaagcugggcucagcugcugacuuccuucuggacaucagugagacagaccuuagcacacugacagccaguaucaaggccccaucuggacgugacgagcccugucugcuaaagaggcuacccaacaaccacauuggugagcuuuggccagcaugguggggugugggagggggagcagagacuccuuaggaagugggugauccguuggagguugcuacaguaaaccuguaucacacgcacgcuucccuaucaguguuaacaucuguggacguuggauuguugcaacauaagacaguccuguuuccaauuuugagaauaagcuguauuagucacuuuucccacugcugugacaaacuacccugcaaaugcagcuuaagaacggagagguguauuuugacucauaguucagugauacaacccaucaugauggaaauuuuuaugugacagagagcaaaacagaugaaugcuguugcucugcuugacuuaaucuuuauucagucuggaaccccagccccggagagagcccaacauugaggcuggcucuccccaccucaguuaaccuaaucuagaaaggccacccaucacagacaugcauagggucuuucuccuagauuauuuuagaccgugucaaguugaucaugaacacauucucugucaaccagucuccuccccccacuuguccuucauucuuucuccaccucccauuacuaagccucuaccuguguucugguccaggcauuuccuucaucccccgagaagugggugagcaucuagucagcaucaagaaaaacgguaaccacguggccaacagcccuguguccauuauggugguccagucugaaauuggugaugcacgccgagccaaagucuauggccaaggccugucagaaggccggacuuuugagaugucagacuucaucguggacacaagagaugcaggucuguaggguaguuccaugggaaauacucagagcuuguggcaauggguucauuuuuucauacugccaacucuuuuaccuccaagcauccuucagccucugagaugugagugcuugcugcuaccugaaucacaagaggagcaggacuuugcuuuauagagaaaaaacugagacacaugggaaucaccaucccaucuauuucugaaacccacuccagacccacaagcucucacagaucucuguuaugugugcucauaucacuguugagagccucuguguccucagcucccagggucccccgagcagaccaugguggaacaguuggugcuuuggguaaaauaaggcauagcacacacacacacacacaccccauaucgcucuuugagaugcuuugaguuagguugggcucucucaagccauacuacaucccagugccuucgucuucuguuuucuugacuggcaguggcagccacgugagcucuagacaaaguuauaaucccagggcagagauuggaaagauuucugccccacucaaugcucaccagugggauuucauacuguugaacuuuuagucugcuguuugaaaauucagauaaccccuuaagacaguccaggcauuuauugaggggcauacaguuucaugggccgcauguucaaaugggacauugauagauaccuucaaggaaggaaucgucuggucaaagccauaguuggcagguuauccuguuguagaacuucucagagccuuuugcuuccuccuuugccacaagcuccggagccaagcuggauauuguguugcaggcuaugguggcauauccuuggcaguagaaggacccagcaagguggacauccaaacagaggaccuggaggacggcaccugcaagguguccuacuuccccacugugcccggggucuauaucgucuccaccaaauuugcugacgagcaugugccugguaugagaccccucugcccucccucugugaugcuuggguuuuggguaaaugccauccgugcgucgagguagaccgaggcugcucacggggucccucucggucucccaggaagcccauucacugugaagaucaguggcgagggaagagucagagagagcaucacccggaccagccgggcuccggcuguggccacgguuggcaguaucugugaccugaaccugaagaucccgggugaguguggagcugaugggacagggcggcagccagcacuuugggaccaaguacaggcaugaccuaaagcacgcuguccacccuggggacauuugcauuuuauacuuuuucuuaauuacuuaaaagggggaggggcagggucucaauauguagcacagaguggccucaaacuugugauucuccugccucagccuacgaagugccggggcuguaggcuagggacaccacaaugagcuuuuugucuuuaacagagguuucacuuaggacaaaugugcucaccucuuaccgcuuucucccaaaugcaagcagucuuguugccuugccgaggggaaacagauuugcuuuuagaguucccuuuuccaaugaaaauacugucagagggagcauggccugcugaugccaaugucuacaaguguuuagguggggagaacuagcaacagccuuuuggccucucucucucucucucucugagacaagguuucucuguauagcccuggcuguccuggaacucagucuguaguccaggcuggccucaaacuaaggaauccgccugccucugccuccccaagugcugggauuaaaggcgugcgccaccacugcccagccaucucucuuaucuuuaguggaaggacuagagcugcugcaaagcuggguggcuucacgacaaaucauuuuucacagaggcuucaggcacugugagcaggcucacagccugucugagagaugacuggcagucuuugugcacagucacugugucagugaaagcuucaggacuccucugcccacacauugggaaggcagagcguaacggagugagacagcuauguugguaaagucuuugccacacaagugugaagccuugaguuccgucuccagaacuucuauuugacagaaaagucaggugugacggugccugcauguaaucccagcacuggggaggcagagacaagagguccuaggcccuacuguccggccagucacugauaaucaggcuagugagagacacucuuaaaaaccaggguggauggcuucuaaggaaugggaccugaggcugucgucuggccugcacauaugcacgcauucacacacaugaaaacagaugcaaaagaugcacauacgugaucaaagaggaaagggcucuuucccaacccugcacauuccuacacacacacccuuuagcuggagucaaguacaccaccauuguugucaagugugacuguaguuaacaucuaauuacuacagucaaggucaccuuuuagaaacuguucccuggaugugacaguacaaaguuugugugcuucaagguggacgaagcuggcuggccagugaauuuggacuuggccaugcuuugguaaaccuuccuccagaaauggauuggcuccuguugcuccccaucacccaccaacaggaggugcucuuucuccuggggaagaugugguaucgccauuuuagucuuauuucuaggauuaacuugugauguggaguuugcuuugcuucccacuuucuguuuugcaauuaccuuuccucucucugccgacucuuaccugaggaacucggguaucugcgcaugugguaucugcgcguguggauauuugucccgucugaggccucuuuggcucuuggucauucuuuucaguuacuugauagcagaggagucugcaagaaccacccuccucauguccaccagaugcccucucaucuguuagugaggagaccuuaucaguuccugggaccugggccucuugggugaucuuagucacaaaguagcaucuuaacgacuaguauacuucccuccucccggcuggagaggcugugagucaaaguggauuagcaggaguagauccucuucuggguugcaaguggcugacuaguaugcaaaagcauugcuuuccugaggcugaaagcuuugcucacgcaugguuccuccuuugcgguugaaauggccuguguucacuuuuguaucuuaauuggcuuguguucacuuuuguaucuuaaugccuuugaccuuguugcccgaaagaagcagcagagcuugacgauaagagaugaaggcucuuggggccuaugagauggcucagugucuaaggguccugcugcuaagccugauaacacaggcuugaguccuaggacccucguauuggcuggagagagcuccugcaagcugucuucuagccuucauccacaugcaugcugucgcacacuugcucauagacgacacacauacguacauacguauauaagcucauauaaauguaagagagacacagguagaaacagguggguuuccuuacaugccgcagcugccagcauagguccuagugugaugcugcugccauguacagauaacuagacuccagccacgaaagcuguugacauagcucaguggaaaaggaugugucagugcccccuucaugcuggucacaggaaggcaggccucuagcccacggggaguccaagcaccucccaccccugggcuguaccugccacaaccuucucugcgugaccugugugcccugcauggccucaaaccuuugcccuaacuuuuucucccaaccuuuuaccuuuagagaucaacagcagugacaugucugcccaugucaccagccccucuggccaugucacugaggcagagauugugcccaugggaaagaacucucacugugucagauuugugccccaggagaugggcguucacacugucagcguaaaguaccgcggacagcacguaacaggaagcccguuccaguucaccguggggccccuuggcgaagggggugcccacaagguccgggcaggaggcccuggccuggagaggggagaagcaggcaucccagguaagaauuugggccaaguuuuaacuggacucacaaguaaguguacaacuguacccauugcucuaaagagacaacuccaguggguggcuguaagggacauuccuuauucaaagcuuuuaaagcuaaguaacauugggagucacucacacaaagccaacaggcuuagacagguuuugcuagucuaacauuagugugcauuaagucucuuaaaaagagaguaguuacuguuuccagugcauucuugaauccguguucugugcagcucauuagaacgcugcaaaacugauuugagggguccccuccugcgguggcugcugugugagggaagaaguguggggagucugagugcauucauccuucucuggugugguuuuggguguguuccuggugccggaauccacaugaacuucauggucauuggcggugcuucagaaaccacaaugauggccuucgccuggguucugcuugggacuagggcaaaaggaaagugcuggcaagggccagaccuacgcugcuggcuugagcugaaagaggggcuggggcucugggcugucucacuaaccagguguuucuuugcucucagcugaguucagcaucuggacccgggaagcaggugcuggcggccucuccauugcuguugagggcccuaguaaggccgagaucacauucgaugaccauaaaaaugggucaugcggugugucuuauauugcccaagagccugguauguacucaggggaugucugagggugaucuccuuguuuagagaugguuuaguugccaggaugagaaacuuacagcuuaggucagguauacaggcaugugcaugugggggcacaagggagagccucaggccuucaagagaugaggguccuuguucucaucagugucuugccuuuuacugauggcucugcuugcuugcuugcuuucaaaugcugcguucugcccacugccccuccagaugccccugcgagugacccagagcuggguugacugcuucagcaccugagaaucuaaagcagagauuugucaccuuucgugucccugagacccuuuggacaucugacuuauccuguccucaacauccauuuuuggcauauacaauauaaaguacaucaaaucauaaaaguaaucaauuuuauuaaaauacaguuguaaaugcagauauaguguauaucgcaugauaccuggaaggcugauugcuaggagugugagccagacagugugagcuccaggcugaccugggcuacaaagugaacauuaucuuaaauaaaacuauauuaaaguauaguuaucaaauacauagcaguagaguauauaugacuuuauuaguauauuaaauuaugauaaaguuugcccaaaguacauugauggucuuacuuucaaaguagugaugagugugcaugaugcugucaagauggcuccagugcugaguauacaugaugagugugcaugaugcugucaagaugguuccagugcugaguauacaugaugagugugcaugaugcugucaagauggcuccagugcugaguauacaugaugagugugcaugaugcugucaagauggcuccagugcuuacaguggaauagauccgugaugugugauguguaauauuggcaauacgcggcacagaugcuucgcacuugcuguggugacauuucuaauccuuuuucuuagagauuaauaaaaauauagacgcaacugcuuuuccuuuucaagccccugggucucuuggauucuauacacagauggcucuguggacccaggucaagaaucucuguucuuacuuaacuaauaaaauccuaccgucuggguguuagucaguuagucagcuguggcuuuaaauuaagcacugcuagucucugaagacauuugagcccagcuuaagcccauggccacuauggaaauaccuuucugaacucucugaaaugguggggcuuuccuaucccaacagguaacuacgaggugucuaucaaguucaacgacgagcacaucccggacagcccuuaccuggugcccgucaucgcgcccucagacgacgcucgcugccucacuguucugagccuucaggugaggcacaaggaagcauccaucuccuuggccauaggccaaccagugagacuccuggacuccugagaccacauuaauccuguccuggguaccaaguccuguugagaguuggcacccagguguugccauucaugggguagcaguccuauggcagggucaccuccuuaugcccucaggagucaguuugagcaagcucaaacagacuugauaaacaauauaucuuaccagugagggacaaguuugcuuuuaaauauuuauucaggagaaacaaaggaagccuguuaaucauugguugagggagcagggcagauuucaaaacagaauagacaauccugacagucuagugacuuguaccuauaacacagaauagacaauccugacagucuagugacuuguaccuauaaugaucguuggcuuucuuccccuaaagcuaacagcaucuuuuuguguguaauuacggugacuuguuuaugauaaguguacaggggacuaucuugagaacuuaucaaugucccuuaaguaaauuuuugcaacacccaaaugggcaacuucucuugacuuaauuuuaaagaugguccagagugauucuagccaggaaccaucuaguaugaguuagcaagagugagggcucuguccccaaaaccugcuccccugagacugugcacugagcaucaccacaguugcacgugcacacacgcacuuacauuagcaccagcgccacacugagagccacuagggaugcaucagcuugggacacugaacgugucugaauuagaagaagcaaauagguuauacaauaaugcccaaauacccaaaaccaguuuccaguuaaugcaguuucuaaguagccuuuagcuauuccagcucuuagaaguacuuggauuagaauccacucuggcauuuggaauggaugauacagcaaguagcugcccacuuuugacuuauuuacauugagauucuuucuuaugcugagacaauggacugcugcuaguuagaggcccagacugugauuggugagucucagugggagagcccagagguccuaacuggucgccuugguguagauguuuuucuuguguuucauuuaaaggcuucuuaacaggaguuuguuuuguggccgacuuagcuaaagccuauagagggcgauaaaggcagcacuugucgggggcagagaggcagagcgcugccugccguccugcgucucgaaggucucucuuuagaucuucagaagcuuuucucgcccucuugaggcuuuagcggcaacagacucagguaacaggagugauugcuccuccccagcgcuucuguugaguccuccugucacgguuugcucauaaguauuucuguaaguauggauuccuccgcauggagggauauguaaauuauuuaucagcgccucagcggaggccugaacaacaucugguacuggguagacgugagaagcggguuuuguuuuaucuggcuuuuggggcuucauagaaaaaguggaguuggcuggcauuuugugggggaggggacaaaguggggguuuccuggaaauuaaagaguccuuaaguuuguauuauggccucccucccaggcuguaacccccaagcagcagaguucgcagaacauucugcguucaccuaauugucacagugugguuuaauagucgcuagccacauguggcugcccaauuaagaugcugcuagagaaaccaaauuuuuguuaugaaauuuaaagugcuuuaaauuggucgguuuccaucuguagcucuggacuaacccagggaacgcagugcuguucggaccugcuguagaggggcaguccuugcaccagugccgagccuucccuaggcuuuucuagaaccauugucaaaaucugcauuuuagccgggugugguggcacaugccuuuaaucccagcacucgggaggcagaggcaggcggauuucugaguucaaggccagccuggucuacagagugaguuccaggacugcuagggcgauacagagaaacccugucuugaaaaaaaacaaaaacaaaaacaaaaucugcauuuuaaccacauuccuggguagcuccuuugcauacagcccugcugccucugaagaauggcuguuuaagccaaagcuggggcauguuaaaaccuuacuuuccuggauagugugggccauucauaacaguugcuuaguucugaguaccuagugccuaagcuccucccgccaagaaugugcacuuucuaagacacgcuacgagugaggcugagugagggaagacaaaggccacacuucucggaguugcagaggcaacuucuaaauacgauucauacuuaacaacucgcugacauuuuuggagcaucauuucauguguucuucauaaccagucucucaguuagggucagguaguuuguccauuuugcaaacaaggaaauuugagauucagauuuaacaacgucguuuuacuacuugaaaagaguaauuaagcaaaguucaaccuuugcaugcguugcucugcauguuaucaagagcgcuaccuauuccugcacuuaauuuaaaaaaaaaaaaacauuaacaacaaaagcaaugacauaaaauccagcucaugucaugaacacugcacccagacuccuccuaaaaaggaauuggugaugaugaucaugaugauggugguggugaugaugauaaugaggcagcagcggcaguuuagcugggacagccagggguuugggccugugcagaucuuguuugggauauucucuugucuggagcaucucgagucuccuauccccaaagcagcuccccaguccugcggguuugaacauagggguacaguguguguuucuguuuacugguagaaacguggaagcaaaggcugccccgucuuguuaucagguaugacagaugggaauauucaagccuguccuaugagaauuuccuccuggagccgcccugggucaucgugugcuagugagcaggagcacggggugccauaaccugucugauuuauugaauucucaggaaucaggauuaaaaguuaaccagccagcguccuuugcuauaagguugaauggugcgaaagggaagauugaugcaaaggugcacagccccucaggagccguggaggaaugccacgugucugaacuggagccagguaagcagccaggcugccagcggggucuccacacccgugcuccuggcggugcuccacagcugggccugagagucaagcucuuucacugcugccaggcaucguuucuaaaaugggguagacauguuugccagggacacagagacucucugugugacagcaauaccccuuucuucuaguuucucuaaacaagaucugcuuuauuuucugugacuuuaucagauuccuuuuacaugacauuaauaacaacuuuuauuuuaauaaaaccuuacagcuuuauuauaugguugacuuuauggcacgaggaaggcuauuuuaaucuuaccuuccuccaagagaaucuaagacucuagggcuuaauaccucagauuuaugggacucugaugucaaucaacuuuaaagaggccauucugucagugagcguuuauuauacguuagggauuuggcaggaagcuaaagcuagugaauauacagcucuaccccucaaaacacuacucgaguugguacauaucuuuaaucuagcauuugaaaaacugaagcaggagaacuucaaguucaaggccaaccugggcuacaaagcaagacgcugucucaaaagcaaaacaacaacaauaaaaauaaacaaacaauaaaaaaaaaucaacuggcuaaacuagucugaauaaggcugcaaauuagagacagcccucagugauacccuaagaaaacuaagaagcagauaguggcaugggagaguggguagggcucuuugugcuuuggcaaggucaggagagcucugccaguguggucuuugaugacacccgcugcuguugggcauuugucgugugcuccccuauguccacugaggguggaaaucuagagcagcacuucuuaaucuaugggucaugccccugugggauucaaaugccccuuucauagagcuugccuauggaaaacccagcuguuuacauuaugauucauaacaguaacaaaauuaccauuauaaaguagcaacgaaaaaaaguuuaugguaggagggggugucaccacaaaugaggaacuauacuaaaagauugcaguacuaggaagguugaaagccacuggucuagagcaugcaugaacagcuauguauguuucucucauuggacagaaaagacaaauggaagauggugccaugacggcaucuuggcugacauaaggccauaccauagagaaugagaugguucagucaguaaaguacaaacacaaggaccugaguuugaucuaaccagacaccuaccugugaucccaggggauauggggagagaccagaggcuugcuagcuagccagucagucuaaacacaucagugggcuccagauucaggagagaaccugccucaaaaaaugagauggagagucacugaagaagauaaccagugucggccucuggccuccagacuccaggugugcaagcacacacaugcacaaaccuguaucucgguggauagguaggaaggagcccauacaguuagcucaacugaggauaucugcccagaggcuauacaaggguugaccagggucucuuucuuaauuggagugucucccacauagccagguggugguauuuacuagcucuccaugcauuguuaugugacguuugcccuugguccaggcagccucugaagucccagauuauucuagcaugucauaauugggguguuacugguugccaucauagacuaccagcucaaaggaacacguagucaugagggccaguaauucauagaagugccuccuuuguggucuaugguagaguuuaacaauggcuugaugcagucaccggugguaauccuccaaggccccaaaggcuuuuuguugcuuugcucugcuuugcuuuauuucuugaggcaggcucucuguguagccuaggcuggccugcaauucauacagcccagguaacuuccuacuuaagaccuuccugccucaggcucacaaguguguccuuauucuuucuucauuucaaggcuucuugccuucuugguaguaagauggcuacaggaccaccugcugcuucauuuucagaggucuugagaggcaagaaaucuauaagucuccuagcgagccucugcucccgucccagugagcugggacacaugcccauuccugagucacuuacuguggcuaaagaaauaaauuuaccuuggggaaagaauuuuccucauccuguaagagacugaaucuggacauuggggugggguucacuucccauaaaacauuuugccuuuaagggaggggguggguacccagcugggaagcacuaggagaagugcagugccaaaagauaagaguagcugacuacuacuguccagaacguuccccuguggagaguaccagagaaacaaaagagggccuggguccucaaggagccagggccuaacuggugcagaggccggccacgugauuugccgugcaaggccaaucuaggcaggagaugaccuugacacaugugacccaaaacagaacaggcuaagugcuccacuugcugacauugcuugccuugggcuuaauuacagagccuuagugccaguugcaacuguguuuuucccuucaagaggacaaacagaaacguggugagaaguggacuuuuucauaaaggguggauugugaggcaggagccugagucuauaacagaacucgagagucaagaguguuucccaaagggcugauuagggagacacaaaguaaggcuagcuggccuuaaaaucuguguguuagcugccaggcucccagcagaauggugucuuuaaaugauucagcgcugcccagcucagguugcuugcaaugcuguguccccacucacaccacacugcuuagcauccacguuuaccaugugcaucuucuccuuccagauaaguaugccguucgcuucaucccgcaugagaauggcauccacacgaucgaugucaaguuuaacgggagccacguggucgggagcccuuucaaaguacguguaggagagccuggccaggcaggcaauccugcucuagugucagccuacggugcugggcuugagacgggcaccacagguaagaagcgcugcuucccucguuaccugagcagcucucucugggagagcugagguagacaucguuagccccuggaggccuucugugcucuguccuugggaaaaugcagaccugcgggcuuuggaggaauugggggccauuguuugaaccgggguaaauccagacagaggccuguauuguuauaccucauuacaguuuguuuguagcccagaugucuuucuacagcaaguuccucagcccuauagcaggaugaugacagcaucauuagcgucauuaauuuggaggacuuuucuuuggacagaguuugugguacagcuccuagguccaaagguggacugcucccagccccccaagccugugcauggccuauccauccccuugaauuuucugcucacugccagggaggggaagguguugaaaaggcguggacgcucucaagcuuuauggacauguucugccuucugcaggugugagcacugcuagccaggcacccagucauggaggcuuccccacuugcugccugucccugggcugguguggugcagagcagccaaguugaccaagugguugauuccuugauagacaaaucccuaguucagcuuuaauuugguagaagugagcucacugaaugggcaacucaccuuuucgcugggcaucugaaagauauuucuaggugauccuuuuuacuuguugguuggccuucauaacgaaaagccauguauguggucagcuugagguaggccucagcucggcccaucacgucagcauuagagauaauaaggacucugucccuguaagcgucuguagaggaagugcaccgugaagaagacaccacuucuucuaguugcuguuacuucgggcuuguuggggaaaucuuuggucuuccugccccuugccauacuagggacagaaccgauugucuuuccugugcacuaagacaugguuugcuguacuuagagcaaacccaacccugaagugagagucuccucagugguaaaggagcccugcccaaguuaggaguggccaguggacuggcaugcugccaggaacucuggccaaagcagugcccuccauaaaaccacccccucaguggcguggguccugccagaugcccuuggcacacccagccugacucccugcuucccucugagccaguacuuugcucuuggaugagaucuaccuugcacuuugggagagcaagacaaaauggccccaguggcccagcacucucugggaguccauaggacuugagggucaucuccaggucugugaucuuagaguuuaagagcccuuagcuccugacccuagaagcucauauuauaccccagugggcuuuccugaggcguccuaaaccagaacuccuucccuccagaugcccagagugguuuccaggcauccauacaggcgaggggcccuccuggcaggagaacaguagcagaccuuggcccggccccacggcagccucagcguggccaggagccaucugauccccuguuggcugcuuugucccaaccuuucucuguuuccucuugguauuucucacccuucuggagcucagaugucaggcuguacucuagccuuguagcuaaggaucuggucccagccagaaaaggccuggaacucacccacuugcacccucuguaaauauuucuccguucacagagagggcaucuuguuugccuaggcugccugaccuuagacuuuccacagaugucuguucacacaguugcagcaugaggaaugcuuucagaaaaggauccguguggccagcaaagggccccaugcccugccuguguucucggccaggcuuggaugucugacucaggccuuaccaagggcaaugcagagaauuuagggcaggagucuguguuccagauacaagccugcaguuagaccacagaguuuagggcucuuuggaaaagcccuaaggguuugcaugcagauggaggaagggaaggccaccaccacacacaucacauauugguuauaaccagucgaugaugauauaugucuacuuaugaauuuuuuucucucccgucuugucuugggccaguccuuuggcaauaagauggacagauaucucaucuaagucauacuucugcguaguaaagugaugugggguggguuccagauaguucuugauuuuuaauuccuaauuucccccuguccacaucaucacagccuuuucgggcucuggguugacuaaaaggggcagagcuccuauccaggauggccaacuuugccagcuuaaccuucaggacauuguucuagccaucuuacagccacuuccugaacacaccaccccuuuguggcucgcggccugcauacccacguggccccagcugcuggaggcugggggaggggcuucucagaagcagugucaaggugggaaaguagggagccuuugggacagcagccucaggaguuuccagaaacggcuggcucauguuugggggucacaccauaacagcuccuuugucuuauugauaagcagaacaauaauucuuucucuggcccagaaacuguaguuaaaccaaaauauuucccagcugggcuagcaucugcagcucugucagagguauugugcccccagaagauguuacacuagggugcccccuagagggcuucuaguggacaggagcuggugugugacaccccagcggcucccacugacuaccuagcaccccucuggacuacagacuacaggcacaggggauuaaggguguugaggggccaggguaagucaguaguugauguucucuuugccuuccuuuuugucccagggcaacguggcagugaggucaggugucucgaggcugcaaguaggguguaugugacaguuguccuucguguauaccagucuuccuccccauccucccaugugccuuuccccaccaccauauagugguuucuugggccuagacccaguugugcaccuguggcuugaauguagcacaccacuuuaugguaguacgucccaaguuacacguggccugaacgcaauguggaauaggaaaugcugugacugcacguugugcuugcagagugacacagggccuagggucuggugcggggcucagucagcacaguugcugcucaggugcuucucuuguugcuguauucauggccaaggggguggacuggcagcucacagagcagccacaagauguagacgugucuagaugaggagaaggggaggggagacuggauuuccucagccucuuccaccagaggagaaguguguggucagagagagugccacgccucccuuagaggcucuauugccgggggcagcacuucagacucacagugacaacucacccucagccacauucccagagacaauagccuugcucaggcacucagugggcgaaaugucagccacccucucaaccuagccucaacaagggagcugcacccccaugcccugugcuucuucucugugccgggaacucagauguagagccaguugguuccuaucuaccacaacaagcacuuaaugugggcaaaagugugucucaccgcugugucccucccgaaaaccauccauauaucacacuucuucucucccagguauccaaucagaauucuucaucaauaccacucaggcaggcccagggacauuaucugucaccauugaaggaccauccaaggucaaaauggauugccaggaaaucccagagggguacaaagucauguacacucccauggcuccuggaaauuaccugauuggugucaaauauggcgggcccaaccacaucucgaggaguccauucaaggccaaggugacagguaaugaggagccucuuuguuuuuucucuucugcccugcagagccagucuuauaaaauuacugauaguagcaaccacagucuaaucuugacuauaaagagguuacaugugggcagcacacaugcugaccagcucugugagcacugaggcaggagugccuucccuccuggaagaaagguaauugcuuuccuuuaagccgugacauauuagguuauagauaaauacaacucuggggagcaguguucacgagagccgugaugcacucauagagucuccucggacuucaaguucuucuaagauguaauagagcuauaaacucagcauugucgcaaagggucagggacaguugauuucagggcuguaaaucacacagauucugugagaaugugugggguuuguguggacuggcacagagcuuacugaagaagauaaauuaaacaauaaccugggaugguaaauacauaaauaagagaguagacacacagcuuuuuuguaccaucuucucuuguuuucauuguuuuuugaagagaagcauagcagauuucucauuuauucucacagugcagacgugaauacccuaugcuguauugcccaggggcucugcagagggaagcaauagcucuguucuucaguacacagcauaaagaaauuuaacuuuuuaugacaaaucaaaaacgguagucuugccgggcagugguggcgaaugccuuuaaucccagcacuugggaggcagaggcaggcggauuucugaguucgaggccagccuggucuacagagugaguuccaggacagccagggccacacgggaaaacccugucucgaaaaaacgaaaaacaaaacaaaacaaaacaaaaaaacugguagucuuccuaagaauacucuuaaauuuaagacucaaaagccggugugugggucuagagagacggcucaguguuugagagcacggcagcugauaccuguagcucuagugucagauagucuagugcuguucucugaccucagaagacacuugcaugcacacgacacucaaguucacacagguacauacacacuaaaucaauagauuaaaaaaaaaaaauagugugucugaauccagugugcuccagcccuggaaggcuaacugguuagaaugagagagagaagaaguuaggaaagggugcuggguggcuuucugucucuaucagagaagaaauauuugcagauuggaauaacauauacuagcuuaacucggcccucauuucuaaucuucacuuucugaauuaaaaaaaaaaaaucuauaaaucuuauaaagccuauccuuaaaaaauauugaaauaccaagcaauaaagcucaggguaaccaacauacauacauacauacauacauacauacauacauacauacauacauacauacauacugaaauaccaagcaauaaagcucaggguaaccaacauacauacauacugugcuaagucccuucugggccacaugauucucuguuaccuaagugauguggacucauuguagaaaaauuauaaaacucggauaggaaagucauccucucucaugcuuagaguccauuucgguucucucagccauuuauacugcguuauauaaaguauuccauagaaacaacaacaauaagaagauaugaauucuacuaggacuuaauccuauggagggauuacuaggccuuagcagccauggcugaaccugguccauuuaccgagaaaaccagauuuuaguugccugagacccuaaggaagaaaaggacauagcuugaugguauauacuuaccaucuaccuaccacaaaacacugaggcaggcagagugcaaguuugaggccugucugagcuacauaaugagacccuuucuuuuuuuuuuuuuuuuuuuuuuucuuuugguuuuccgagacagaguuucuuuguguagcccuggcuguccuagaacucacucuguagaccaggcuggccucaaacucagaaauccaccugcuucugccucccaagugcugggauuaaaggugugcgccaccacgccuggcugacccuuucuuuuuaaaaguaacuaugaggacugcaagccaggccuaguacugcacuccuggaacccuaguucauuggaagaccaggcauucaaaacaagcuuuggcgaaaugaggcccugucaaagaaaaagcaagcaaaagcaaccaaaaacccaaugguggauauggaucauggcaguuugauuaccuggcaaugcacagccgucuggauucgaaaccuucuaucacagacauauauacaaaucaaaaauaugaauggagugguuuuuguaucuagguauuagagcuuuucugggucuuuuauaaagggguauauuugccucguggcugacaggaccacacuccacacaaaacacccauuggccuggccauucacaccccccucuuucccauguucuaggccaacgucuggucagcccaggcucagccaacgagaccuccuccaucuugguggaguccguaaccagauccucaacggaaacgugcuauagcgccauucccaagucguccuccgaugccagcaaagugaccuccaagggcgcaggccugucaaaggcuuuugugggccagaagaguucuuuccugguggacugcagcaaagcugguaggcagcacgggucugcugggaaggcuuagcaucgggcugguauagacgagacacuucuccuauuucagugucccucacucuaggauugccugcaaaguccaccccuccccgacuuagaaauaauuauguuucuuccucuguccuucugcucuuaauaucacaugagcaaagugaacuaacugauuaccuaagccacuucucugauaccaguugcuuuacccagaguuuaaaauugauuuaggcugagagaugccucagcaguucagagcacuggcuacucuuccagaggacuggaagggacucuggccagcuugaacgcuacgaguguggcucugucagccuugcccuucuccaccauucccuaugccuugcugaaaaccaguagauuacauuccuaaagcuaacccccaaggucuggucccuucuuuaaccacuuccuccuccuagagcugacuaccaaggucuagcuaucaaaagcugccuuggcucaccuaauuaacaugcccaauuaaagucaaacaccucauccuaacaugggguuucccauuuuaccuuuauagacagauuuuccuaugcacaggucugucuccuuucuauccaggagcagguccucugucuaccagaacggauaacccuccucccccuccggauaacccuccucccccuccuccuccuccuccucccccuccuccuccuccucuuccuccuccuccuuuguucccuuccucuucucccucuuccugaguuuccaguguuugucccuuauucccugaucucugucccucuggggugaauacaucuccuuuugcugagaauuuggucuuggggguccugaaccaauacuuuccuuucaggaccucuguucaauucccagcacacccguggcagcucacccugucuauaacuccaguucuaggucucugacacccucacacacauguacauuauuuccuuagguuucagugcugaguugccuagcucuagcacccagcacaccugggcuggaagucaguugcuccuuccuuccuuccuuccuuccuuccuuccuuccuuccuucccaaagcuuugugcuuagguaccuuggauggguugcuuaacgggaucaccuagaagugaucuuuucccaagugggaaucagugugcuuucccuaaggcucucucaaaaauaagauucuaacagcuggcaguucuguaguucuaugugcuaagaguuugacucagucacuucuauggcauacagaagcuugaagaggcagcugguaaaguuaccugugguggugcacauggguggaucucucaguuugagaccagccuggucuacagagccaguuccaggacagccugggcuacacagagauucugugucuuuaaaaaaaaaaaaaaaagcaaaaaaagaggcagcuuguggccuuccugguuugcaguuuagguagagagcuuuuccugucugaggucaccaaagcaaagggugugagggcuggcaugugagcccaaaucagguugucucuacugaucauggccacgauuugccaccagugaaaggacucuggugccaucaucccagcucggccaguuaucccucaucucucuaccuuugucacaucucugcuuguccugauuggucaggucaguaacaaccuccucuucccgcaggguccaacaugcuguugauugggguccaugggcccaccacccccugugaagaggucuccaugaagcaugugggcaagcaacaguacaacgucaccuacgucgucaaggagaggggcgauuacguucuggcugugaaguggggggaagagcacauccccgguagccccuuucaugucaccgugccuuaaagcaucugauagccaaugcuggacgugucccuuccgguugcuuuuguugcuaguuuguaauucauuuuuuacaauguccacagccugcuggugggccagcguccccaucccaaaccuugccgcucacuccaagugccuuggugcccuagacuugacucgaggucaugugggacaucuucagaaagcaagcuggggccaaaaaagugcagagcccucugcccaaaucaagacucuuaauuucaaaggucauugcagacggaacaagaacauggacaggacugacuggcucuccuaagcuucuggucuacucaagcgauaaccaaacaagaaugucauugcagaaggggguccugcaccccacuugccaaagaacagugcaacccacuuuccucaagacuagacaacaaauaagaaagucugacccagauuauacuccaugccugggcuucgucuuggggcccugaucacuuugacuucauccuaaagccagcucuggagcagaaggcaugcagaacacuccauaccccauuuuuggaauucuguaccugccuacuucuuuauuaacagccuugaaggcaugugcucauggccaaaugcagggccucugccagcugcccccagaguucauugcggcugcuaaauggcagagaccacugauaaauuauuucaggaccuccuccuugcaaaagcuggaagggauggguaccccucuuaugacccaugagaggccuuaaugaccaagacacuagcacgugcacccaccugaggucucuaaagguuuugguguaagcauugucaggcugucaaauggcuggagcgaguguuacacacacacacacacacacacacacacacacacacacacacacacacaaugggguguggugguucucaugaauguggcagggguggaguaggugucccgcaccaaggcacagcagcuggagaggugugggugcuaaaagccaccuguuaggaccuggagcagcugaagccggaugugaaaggcggaauagacacggagaccgaacuggaaucaaaugccgacuauaaaguguaucuuauaacuuauuaaauaaaauguuugcuccauaaac

SEQ ID NO: 7256 - RNA, 29466 nt, Mus musculus
caguacucacaaaaagcgugcuaguuacugccagcuagccuccuccacaccagauccugcugggcucugugccuuugcugaauucugaagaagaaaggaaucauucauuccagcccuuccugcaagacugccagaaaguucugggauaaaaacaaaaagccccagcagacuccuucccccugcauggaguuaggaccaucggaguccuugcagauggagcccucugggcaauacugaagauaccgagggacaagcaauggugagaauauuugccaucagucugggcuuuuuguccaggauggggggacaacaagaaugacauugguacugggugacauaugccagauugaauguucaagucugccuguucaagucuauguucugcaagagcuccugugauggcccauaucccagggaagucauaccugcucucugcucugcucucugcuuucugcucucugcuuucugcucucugcuuucugcucucugcucugcucucuguucucugcucucugcucugcuuucugcucucugcucugcuuucugcucugcucucugcuuucugcuuucugcucucugcucuacucugcucucugcucuacucugcucucugcucugcucugcucucugcucugcucugcuuucugcucucugcucucugcucugcucucugcucucugcucugcguucugcucucugcucuacucugcucucugcucugcucugcuuucugcucugcucugcucucugcucugcucugcucucugcucucugcucugcuuugcucugaggaaacucucagaaaguacugggacuggaauaccuuccagguggggcaacaugucugaggcuacuguguuugucugguccccucuucugucuccugccuuccuaugccuugccugguaucagccacccaugggcacaggcaguuaccccuaguuacuggaaacauggcucugcuguuuucuaucucuuccagugucacucugaagccacauaguagacuuccugguuagcugucaggggcuuaaaaaguagaagguguuuugauggggaaggaaugaacaaaguugggacaauagcaaaagccucaaacuaccagccaaggccugagcagagcugccuggaacaguacuugggcuacuguucaagaucccugauaccccagggcuuugugguuuaguaucacccacauucucuaggcugauaacaaccacagugugggccuguccgguccuaugccugugguggcaauaggggucuggagucaccaucaccgauaucagaaaggaagagacaucagacugcugagcugcugcugcucugaacaccagugggaacuguuccuuuccgaguuucgggaucuuugguuccuaaaccuucaggguagugaaugggaaccuugggccauacagcuccaucaggugaugggaaugaaggauucugacaaucccaguggcucaaggccaaagcuagcugggacaugugacucucauuggcugaaacacaacuccuggaaggugacugccaagacgacugugaaccuaguuccguaauuccucaccaaggcucucaggucugaaugucaauucaaaaccaucccuguguaaaaggaccaugggacuguauaugccaacucaaugcauaaucaauccgacacgcucauguuucugcugucaguguaaguuggaugacauaggaaacaagucuuugcuucacaaugguuugggugaggagaccacgauucuguucuguauguuugcuuaguuucagagucacagauaaagaaugggagccugcucuccagguuucagcucuucuguuggaagaaguggguagcacacagcagaagagaguuuuccagcauggagaagggacagccugaauguggugugugccauagcacccucuuccugaccaucaguagcuugcccuaauauuuuaauuaucaaugucaauaguacauaucacuuuuauuuucuaaauguuaagaagaaagguaccuaugccuccugcccuccccucccccaucauuuuuuuggggggaugucugugcaugcagacacauauacauaccuauaaacauacauaccuauaaacagguacuuuuguggguuuaaaaaaacaaaaauggcauuggaaauguaaaugagcuaaauaccuaauaaaaaaugggaaaaaaaaacaaauaccaaaaaaaaaaaaaaaacauaaauggaagccaggcagcgguggcacacggcuuuuuuuuuuuuuuuuuuuuuugguuuuucgagacaggguuucucuguguagcccuguuuugaaaaaccaaaccaaaacaaaccauaaauggaguuaugcugggaauuauuguugcuccugccaccugcuucucuuaccucuguaccuuuggucucuucuaaaucuaaccccacagagccccagguuucuguaagggaaaugcagaguucuccagauaagaugcaucuaaccauuuauaauggcaaaaaccugugauuccagcuacuuaagaggcuaauacacgagggugacaaguuggaagucagccugugacauccuaucucagaauagaaugaagcgagcuaaggacagagcuccaugacagaguccuuguccugugaggcucuggaagacaggagggggauuggugcuagagugggguaagggacuguguuugaauagcuacggucccacaggcucauguguuugaaugcuuggccauagaugguggcacuauuaggagguguggccuuguuggaggagaugggucacuguggaggugggcuuuuauguuauauaugcucaagugaugcccacugugagacacacacucuugcugccugcagaucaggauaaagagcucugggccccuccagaaccuugucugccugccugcugccaugcuugccacuaugauaaugacgauugacuaaaccucugcaacuuuaagccauccccaauaaaugguuuccuuucuaagaguuucccgggccauggugucucuucauagcaguaaaacccuaacuaagacagggacagauucaagacccacaccaggaaccaauccauuucaguacaggaugguuggauuuuccuguacugaggucuggaggguuguuuuuguucuccaagaucuaucuaaggagagucucccucccucucucucaucauuuacaagcuuagcaaagcuggcugagacacaaagugacugacuuuggugccaacaggcacauaucugcagaagugagggcucugaagcagagacuaagccaugcucucauuaaguguuagagguguuuggaccugcagcucuaggucagggcgucuaaucuauugugauccacugagcugcugcaagaaucccugcccgcacaggccacucauaucccuccagcuccccuuuaguaacuuuugggauccagccuugcuguacacggcugcuggcucagcugacugacaggcugcaaccacccuucucccaccuuuuuguggcugcucgguaaaacaaaagguacccaguaaaaauuuaaugucagaugaguaauaaauacauuuuuaauaaaagcauuuaauuuguguccuacugauuguuuauuuagaacuuggauuuacuggguaucaagauuuaacugauaauccugguuuuuuguuguuuuguguggugugugcauguguggauaugcauguacaugcguguacacauguguguguguguguguguaugcuuagaggaagccauucagcguccugcuccauuacuguaugcauuacucccuugggacgagccucacuuaauccaaagucuaccuuuaugccaggcuggcuggcaguaagcuccugggaccugcugcuuuuuaucccacagguuugcgugcaccugaacucauguggucuccuacugagccaucccaggccaaacuucacagauuuuguuguuguuguugcuugguuugaagguugggguaggaaagagagacagggugagccauguagcccaggcuagccuuaaggucuccauguucuugucucagccuucugaguucucaggugacaggcaugcgccaccguacaaugcauucuuauguucauuugcugcagcugaaagcaaguggccacagacaaggaaggcuugaucuuccuuugagauugccucaaagauugcaagucuuuuauacuccagagcccugugggguacagacuucagaggaagccuguuggaggucagucuggugcuacaaauacagaagcuaaauucugaaccccaagaucugguugccagacaaaugagagaauucucacauacaucaccuuuguuguguaaaccuugcuccccaauuuaaaguuaauugauuaauaaaaggcuuaagccugugaaugagcaguggacagaguaaggcaggacuagaggaucgagugagggcucucagaagagaucaaggggaggagaaagaagauggagggagcagggggucaccauuagaugggauaaaccagaagcacguggccgagagaaguacaccaugaagccagacugauggagcaaagcagccgaagcaagacucagccagcaagcaacgcagcgcauacaguuuguacguagcucagacucaaacagccagcaaugcagggcauacaguuuguauguagcucagaaacucccuguaguggcuauuccugguugucaacuugacaauauuuggaaugaacuacaauccggaauuggaaggcucaccagugacccuuaucuggaggcuuggagauccuuaucuggaucuugguuugaagaucuugauccauaguggcuauggauuccagaagauugaaucuccgaguuuaaggaacacaccuuuaaucugggcuccaccuucugcuggagacaauauaaggacauuggaagaagggagucuagcucgagcucuugcuccuucgccugcuugcugcgugagacugaguaacugcuagauccuuggacuuccauucacagcugcgacugaacaauuguugggaauugggcugccgacuguaagucaucaauaaauuccuuuacuauuuagagacuauucauaaguucugugacucuagagaacccugacuaauacagaaguugguaccaggagugguucuagaguaacagaaguacaaggaugaaucuuuuaaaauacuggaauuggcuuguugauccaccagcacuuucaaauauugaaaccucuccagauucucucccuccugggagcucagagaauuuugaagacccaugguugaaacuauauuccgaacuuaaagaagcuaaugaccuugauuuucuuaaugaauuaggugauucagugcauaaagcuuucuacaagauggggaaaaaaucggaaaaugauuuuacuggcuggcugcucuuaguaucuguggaaagaaugaugaaugaaaggaaggaguugugugauaaaaucgaaaggcuccagacacaaguaaacgaucuaaaaguugcuaaguguguccuugaggagaaucuucucucuuguagcaauagagcucaaguugcagaaaaucaaacagaaacucucauuguaagguuggcugaacuacagcgaaaauucaagucucagccucagagugugucgacaguuaaaguaagggcucuaauuggcaaagaaugggauccuacaacaugggauggggaugugugggaagaccauguugaagcugagaauuuugaauccucagauucucaaggguuugccccaccugaggaaguaguacccucagccccaccucuugaaauaaugccuuccccacaugaggaaauuaauuuugcagagucugcucacggcccaccaauaguuucuucuagaccuguaaccagacucaaagcaaaacaggcuccuagaggggagguagaaaguguaguccaugaggaaauucgcuacacuacuaaggagcuuaaugaguuugcuaauucauucaagcagaaaccuggugaauaugugugggaauggauuuuaagggugugggauaaggguggaaggaacauaaaacuagagcaggcugaguuuauugacauggguccucugaguagagauucuagguuuaauacggaagcucgcauaguuaaaaaaggugucaaaaguuuguuugaaugguuggcugagguguuuaucaaaagauggccuacuggaaaugacuuggagaugccugauauuccauggcuuaguguugaugaagggauuuuaagacuuagggaaauugcaaugcuagaguggauauauuguguaaagcauaauuguccacaaugggaagguccagaagauaugccuuucaccagcucuauaagacgcaaauuggugagaggggcaccagcacauuugaaggguuuuguucuuucccuuuuccuugugccagaucuuagcauuggagaugcuucugcucaauuagaugaauuaaauucacuggguuuaguuggauuccgagguaacaagggccagguggcagcauugaaucgcccgagacaaggugauucuaguuauuauaauggacagcguagacaaaagaauguuuauaauaacauacccaguaauggucagcacaggagaggugaaauuuauaauggcaugacucgguuggaccuuugguacuggcuaaccaaucaugguguuuccaggaaugaaauacauaggaagccuacugcauauuuguuugaucuguauaagcagaaaaauucucaaacaaaugaaagaaaggcuacauuagaucgugguaaacagccaaaugaaagaaaggcuacauuagaucgugguaaacagcaaucucggccagugaaucaauuuccagacuugagacaguuugcagauccagaaccccuugaaugaagggguggccagguuccgcugaggaaggaucuugauaagacacucaaagguuuugcuguuacccuuucuccaguucuucccuagagggaccuacggccuuuuacaaggguaacuguacacuggggaaaaggaaauaaucagacuuuucggggucugcuggauacugguucugaguugacacugaucccaggggaucccaagaaacauuguggcccuccaguuaaaguaggggcuuauggagggcaggugauuaauggaguuuugacugauguccgacucacaguagguccaguagguccccggacacauccuguggugauuuccccaguuccagaauguauaauugggauagauauacucagaaauuggcagaauucucauauugguucccugaacuguaaagugagggcuauuaugguuggaaaggccaaauggaagccuuuagaguugccucugccaaagaaaauagugaaucaaaaacaguaucguauuccuggaggaauugcagaaauuacugccacuaucaaggacuugaaagaugcagggguggugguucccaccacaucuccguuuaacucuccuaucuggccagugcagaaaacagauggaucauggagaaugacaguugauuaucgaaaacuaaaucagguaguaacuccaauugcagcugcuguaccagauguaguuucguuacuugagcaaauuaacacaucuccuggcaccugguaugcagcuauugaucuggcaaaugccuucuucucaguaccuguccauaaggaccaccagaagcaauuugcuuucaguuggcaaggccaacaguauaccuucacaguuuugccucaaggauauauuaacucuccugcccugugucauaauuuaguuagaagggaucuugaucguuuggaucuuccacaaaauaucacauuggugcacuauauugaugacauuaugcugauuggaccaagugagcaggaaguagcaaccacuuuggacucauugguaacacauaugcguaucagaggaugggaaauaaauccaaccaaaauucaaggaccaucuacucagugaaauucuuaggaguccagugguguggagcaugcagagauauuccuucuaaggugaaagauaaguuauugcaccuggccccuccuacaaccaagaaagaagcacaacguuuagugggucuauuuggauucuggagacaacacaucccucacuuggguguguuacuuaggccuauuuaccaagugacucggaaagcugcuagcuuuguguggggccuggaacaggagaaggcccuucaacagguccaggcugcugugcaggcugcucuaccacuuggaccauaugacccagcagacccgaugguacuugaggugucuguggcugauagagaugcuguuuggagccucuggcaggccccuguaggugaaucacagaaaagaccuuugggauuuuggagcaaagcucuaccaucaucugcagacaacuauucucccuuugaaaaacagcucuuggccugcuauugggccuuaguggaaacugaacguuugacaauaggacaccaaguuacuaugcgaccugaacuacccaucaugagcuggguacuaucagacccugcaagucauaaagugggacgcgcacagcagcagucuauuaucaaauggaagugguauauacgugaucgggccagagcagguccugaaggcacaagcaaguuacaugaagaaguugcucaaaugccuaugguuucuacuccuguuacaaugccaucugcugccaagcaugcgccuauagccucaugggguguucccuaugaucgacugaccgaagaggagaagacuagggccugguuuacugauggcucugcacguuaugcaggcaccacccagaaguggacagcugcagcauuacaaccccuuucugggacaaccuugaaagacacaggugaagggaaaucuucacagugggcagaacuucgggcaguacacaugguauuacaguuuguuugcaagaagaaauggccagauguacgauuauucacugacucaugggcuguagccaauggauuggcuggauggucagggacuuggaaagaucacaauuggaaaauuggugagaaagacaucuggggaagaaguauguggauagaucucuccaaaugggcaaaggaugugaagauauuugugucccauguaaaugcucaccaaaaggugacuucagccgaggaggaguucaauaaucaaguggauaagaugacccguucuguggacagucagccucucuccccagccaucccugucauugcucaaugggcacaugaacaaaguggccaugguggucgagauggagguuaugcuugggcucagcaacacgggcuuccacucaccaaagcugaccuggcuacagcugcugcugauugccagaucugccaacagcagaaaccaacacugagccccagauauggcaccauuccucgaggugaccagccagcaaccugguggcagguugacuacauuggaccacuuccuucauggaaaggacagcguuuuguucuuacuggaguagauacuuauucugguuauggauuugcuuuuccugcacguaaugccucugcuaaaaccaccauucauggauugacagaaugccuuaucuaucgucaugguauuccacacaguauugcuucugaccaaggaacucauuucacagccagagaaguacgacagugggcccacgaucauggaauucacuggucuuaccacauuccccaucauccugaagcagcuggucugauagaaagauggaauggccuuuugaagacgcaguuacagcaccaauuaggugguaacagcuuggaaggcuggggcagaguucuucagaaggcaguauaugcuuugaaucagcgcucgauauaugguacaguuucacccauagccaggauucauggguccaggaaucaagggguggaaaacggaauaguuccacuuacuaucacuccuagugacccucuaggaaaauuuuugcuuccuguccccauaacucuagguucugcuggccuagaaguuuuggcuccagagaagggagugcuccuaccaggagcuacaacaaacauuccauugaacuggaagcucagacuucccccuggucauuuugggcuucuaaugcccuuaaaccaacagacuaaaaaaggaauaacaguguuaggaggggugauagauccagauuaccauggggaaauuggauuaccucuucacaauggugguaagcaagauuaugucuggaguguaggagaucccuuaggugucucuuaguacuaccauguccugugauuaaagucaaugggaaacuacaacagccuaauccaagcaggaugacaaaggacgcagacccaucaggaaugaagguaugggucaauccuccaggaaaagagccaagaccugcugaggugcuggcugaaggagaaggaaauacagaauggguaguagaggaagguaguuauaaauaccaauuaaggccacguaaccaguugcagaaacgaggauuauaaaguaauaugaaugcccauuguaaauuuacuaaugcguuugcgauuguacgagggauaguuauaucauguuaggcguauuuacaaccuuguuauuguuucaugugaacaugagauauuauuugugucaaguugacaagggguggauuguaguggcuauuccugguugucaacuugacaauauuuggaaugaacuacaauccggaauuggaaggcucaccagugacccuuaucuggaggcuuggagauccuuaucuggaucuugguuugaagaucuugauccauaguggcuauggauuccagaagauugaaucuccgaguuuaaggaacacaccuuuaaucugggcuccaccuucugcuggagacaauauaaggacauuggaagaagggagucuagcucgagcucuugcuccuucgccugcuugcugcgugagacugaguaacugcuagauccuuggacuuccauucacagcugcgacugaacaauuguugggaauugggcugccgacuguaagucaucaauaaauuccuuuacuauuuagagacuauucauaaguucugugacucuagagaacccugacuaauacacuccccaaucuaggaucacaccguguaaauaaaauaccagguuuuuguaucuuuuauacaggccagcuagaauaaauaauucuuuuuacagaacucaucucgcuuucuaccugccaaacccugcuucccucaucuucagaggcuccacgugaaccacaguuaggugccuuccaguucuuggugaugauccucaggauuuccuugaaggagcgagcagcuugcagccugccucuccaugugggagggauagaauccaccuggagucuucugcggcacuuaaucugugacagguggcaaugauagugccucuguaugaugcagauggcauaaugugagccagcugccuggcacuugguggggcuccuuaaaugaaauauaaagaauggcugcauccgggcgugguggugcacgccuuuaagcccagcacucgggaggcagaggcaggcagauuucugaguucaaggccagucuggucuacaaagugaguugcaggauagccagggcuauacagagaaacccugucucgggggagggggaggccugggggggugaaagaauggaugcaguuaagagcuuuuagcuauggucaucuugaccuuuauccucuugucacagaaucuugcugacacaggagccaagauucccacugcuggcaauuguagaauggauuucaccuugggaacuguaaaagaucuagguggcaccgguuagcaaggccgggaaggaaaagcagagaaaagaagugugaccugaacucuuggucuugaaagacccacaacgugaggauucccccauggucugacucaggagaggcaacacccuaaaucacucacaagaaaggguuuugaugcaaacugcaagaggacuuuuuauuccagaugcgcucuggggcccacagucauacaccacagcagggguggaggaccccggaccacaagugcggaauugggacagcuuuuauggaguuacaacaaagccugugcuucucaaaucaaucaugucauaucaacaaccugcgcagugcgggccaaucgauuuguaccauuccauaguuucuaggccaaucauuuuaaaucaucaagcccgcgcuggggugggggugggggggagacaauugguuuccuauagccucagagguccaaauuugugugggauccugggugggggguggcaaaucgcaguuucagugucuccucucucuuucuuuccuucuauggugcaagugguuuacagaagcuagauaagggguuagucaacucauuuccuguuaucuuacuaggccaggaucauguauucacaggaagugggcccuggagcagcaagaagugugaccuuuuaccuauauacuggcagggagcugggucuggaauuuguguuauuuagggcuucuuaggaggcuggaguuggggcuguauuuucuauccuuucaaccuuugcuacauuaguccauucuaaaaaaaaaaaaaucacacacacacacaaaaaccucaaaccagugcauugaugugugcaguacucaguguuccacuagaacaaugucauggugccuacagucaaaaugcuugggucaguaacugugcuggcuagauguaugucagcuugacacaagccuuagucaucugagaggaggaaaccuccauuuagaaaaugccucccgaagauugggcuauaggcaagccuguagggcacuuuuuaaauuuguguuuaaugaaggaaagcccagccuauuguggauggagugaccccagggcuggugguccugggugauuuguuuugcaauguggagcccugaugcaguagggaguggugccuuagcagacccaugcugaggcaccucccucccccagguacagccagccauucaacaggucuaguagaaaaugaaguuuauuuggggcaugagauggaguguggaaagaaaagggacagaaagagagaggagacagaagagacuggcuggaacacguggagagagugagagaggaaaaaggagagaggacaagggucaggagacaggccauacagaggagagagagagagagagagaggagagaagagagaaaagagagaagagagagagagcgauaaacaguccaaacaguccauuuauagcagccaggcuccuaccuaguugcuagguaacuguuggguggaacuuagaagaaaugcuaacacuggguucuguaagaaagcaggauguauaagacauggagagcaagccaguaagcagcaccccuccauggcaucugcaucagcuccugccuccagguuccugcucuauuugaguuccuauuaugacuuccuucaaugacagacuuauaagcccuccccccuuuuggucauggccuuuuaucacagcagaaguaacccugacuauguacugauuuucacuguuugggagagacuaaauaaagauggcuuacuaagauguauaagacuccacaacagaaaauuaagcuuaguuuaauaugaguuaggaagaauaaaaacaaagaaacaguagagacugugagcuguagugguuaggacaaaaguguuuugugauguccugcaugccuccaagagcuaggcgacugucuuaaucaggguuucuauuccugcacaaacaucaugaccaagaagcaaguuggugaggaaaggguuuauucagcuuacacuuccauguugcuguucaucaccaaggaagucaggacuggaacucaagcagggcaggaagcaggagcugaugcagaggccauggagggauguucuuuacuggcuugcuuccccuggcuugcucagccugcucucuuauagaucccaagacuaccagcccagagauggucccacccacaaggggccuuucccccuugaucacuaauugagaaaaugccuuacagcuggaucucauggaggcauuuccucaacugaagcuccuuucucugugauaacuccagcugugucaaguugacacaaaacuagccaguacagcgaccaaaugguaauugacuugguacauacagcaaaauacagguccuguguaagcagacgccgugcuacacgcgucacugucagcugccuaauccauaggaucuguuaaauaggugacagccucuuacaagauaccuaacugcugcaaagaucagagacacuucaagagcagcacucgccaacaacgugcugguugcaacagaucaaaaauuaguuuucacuacuguccucgagccaagcaucaauuugguauuuaacuugacacaaccuuucucuaacaauuaggaagaacguuccuaacacuuggugacaauuaucuuagcaaggaagcuuuuauaaaaggcugagguggccuugcgagcgugcuuuuucauuugaaagauuuuuuauacaucuuuuuagaugucuguguguucacaaagauacagacgcacagcacauggaggucagaggacaacuuucuucccuuucaccauguggguaccagggauacaacgcaggucuugggcuugucagucaguacccuuaucugaugagccaucuaggcaguccccuugugugguuugauuuaaagugauguuacacuuaaacguucaagagagaaaaccccacacugaacuugugggaggagauuuaagaaacucaaaggggggcuugcagguggguuucaaagaccauuggguaaaacuucauuuuugcaccaaaaauuuaaaaaguuguggaaucucccugaugccuggauucugucagggcucucuuguuaauccagauacaucauaguaccuaguaaaauaauagaauuucauugaaaaaaaaaaacaaggauuaaacagcaaaguacuuauuuuuccaaaguaucucuuuuguccucaacucuggauuaacaagauuaaacccaaaaugcaugugcgucuguuuuuuuucugggucacacggccuggcaagaguaguuuguuggcccagagagacucuuucccgcuauaguuuccuggauaccagacagugcaucagcucuuuucccccuuacaacucugcaagaagucgcuggugauccgucuacacaagaagggaagaagcuggguuggcagcagaggacagauuccagcacaguucuggcaacuacggcauuucagggacuuuuagggguccugcuuggguauaagccuguugucaauuugcggggggggggggcaggcccucagauagacauccagacuugaccagucccccugccaccuccucugcucugugucucagccucccuccucugcccuccccagcuccagcuucaaguuguuucuauuguuacagaauugcaagucaaacucugcauaccaagacuucuugucuuauuuagcgguugucuagaaaaacccaucaccuaagcaaaucucagccguaagauauuuccuaguuugcuaggccuauccuggaacugaguuaugcaaagacucugagagucuaaaaaaaaaaaaaaaaacaaaaaaacaaaaacaaaaacaaaaaaaccaccacucaagaugggcgugguggcgcacgccuuuaaucccagcacuccggaggcagaggcaggcagauuucugaguucgaggccagccuggucuacagagugaguuccagaacagccaggaguacacagagaaacccugucucgaaaaaccaaaaaccaaaaaccaaaaccaaaaacaaaacacucauaaaaucucagauaauaaucacugacaaaagauuucuucaaagcuuagguaccauaacuuccgauucaugucagauacaauaguucugcuaaaauucugcuauaauuaccaaaauacaaacuaguuuugagaaagaaaaugccccucucuggggucuguguuagcuuuucccccuuauuccccaacaagccuuguuuccucugggcaggaaggagaggaaacagaggccacgacuucagagcauggccaaggcaggaaugaaagcuuaggggacaaaaauaucagguuuuuuuuccccaauuacaggaaaggccccaacuuaccugggcacaggcuuggcugugcaaggcauacuguuaccaucacuacugugucccacucaggccaaaucaacgcucaucuuuuuaguaaacucaagcugugugaccacuggugccaaggacugcaauauggugaugagccaucaccaaguucccauacccagagacuaccucagaaggcaguuggguuaagauggugcuccugaacuagucuggacaacacuggcugcuuuaguuaggguuuuacugcugugaacagauaccaugaccaaggcaacucuuauaaaggacauuuaauuggggcuggcuuacagguucagagguucaguucauuaucaucaaggugggagcauggcagccuccaggcugaggugauaguucuacaucuucaucugaaggcuucuagcagaagacuggcuuccaggcagcuaggaugaaggucuuaaagcccacgcccacagugacacaccuacuccaacagugccacucccugggccuagcauauacaaauaucauacuggccaaagcagauaaucuguauuaacacuggcaaccaucaaaggcagacaauuuagucucucucuggccuucaguucccuuauguaaaacagggacuauugcaauaauagcugccuuaagguugcuugaggguuccauuagaucacuuacgugaaaucuucugcacaaugccuggcccaaacguaaauauuaguugcuauuauaacuguuaaauauacacgguaugucacaugaauacaaggaccauauccuauucuccggaguugccagcacucagaauagucgcuaaugcauaacggauucugacuuggugauuagauacagaaguggaauuacuuacaucuggaaauaggagcagcuggauuuuuccacaucaaaacagaaucucuaguguauguuaggagccacauugggaaacugacagacgaucuugucuuuagugcgugacacggauguuccugagauggcaaggcucagauuuagcuuggugguagaggacuugcuuaguauagacaagguugugguuuugaucccuggcauugcaaaaaagaaaaagaaagagaaagcaagaaaggagagggguuguuugauauaaccuguugagcauaaauguagaaauaaaugaccaugaagagugucugacgacaguuccgaggguggacgcuagagggcgcagaaccuguucguccucagcccccgcugaggguuacgcacuaguucagugaccgacgcggcgcggugacgccacguccuguuaugcgucuguggggcggugcgaauguaaauaucaccaguuuuccagguccgaacuugggcugcugcgugggaacuccgacccaugccgaauucuagcggcgugcaagagucaggaacgcgguuauuccagugauccucuccguccugggccgaggcgguuuagccucgcggggcaggugcgcaugcgcgacgcgggagcacgagguggaaguguggcggaccucagguucuucgcugcuguagugucagucugagagccaccgccgggcucuguacagcgcggcuuaggucccggauacaggcggugaccgggagggcugauccggccguuugcugggcucacugcccuugaugugggcgcaaagucaguagcgauuguuaauggagcaagguugggaacaaucuuacucuucggcaguaggggaucggcuuuuuaaacaauugcuuuaguuaugucuugugucccccaaauguucaagacaccgguucgugaguucgugagaagcacuaggguaugaagcagaucucuguuucggagugcagacacugaagcagaaggggagaacuugcaagaacuaggcaaggaggguaugguaccauaauagauaggaugggcagugggacacauugaguaagaucagagaggcuggagagugugagacacguggcuacccagaggcgaugccgaggccaagaggaggaggaagcccagaguguuaggucuuaagaaauuguuucaacacgccuuuaauuccagcgccuaggaggcaguggcaggugaucugugaguuucaggacuccguuacacagaggaauaaacgcuaaacaaacaaacaaauuaauuaauccuuuccuuaaaaauccggcauuuagacaaaggucgggauuccuucagggauuuaagaaggugguuccuacuuccuaaaaggagucuuauuucuggcaaaagccguauugcuucuccauuaaccuggaugguuaccuauuaguauaucgaagucuaugcuagccucuagguucucucagcccauacucacaaguuccuguuagaguggucuuggcugacacaccccuuccccugcccuaaaccucucgucuccagcucccgagauucgcuucacuucccucagcuucucuuuccuauguaagucagccauuucgauuaugcguuauguaugcagucuccuggugggucucucucucucucucucucuuuuuuuuuuuuuuuggcuuuucgagacaggguuucucuguguagccccggcuguccuggaacucacuuuguagaccaggcuggccucgaacucagaaauccaccugccucugccucccaagugcugggacuaaaggcgugcgccaucacacccggcuucuggugcaucucuuaauccugcacacucuuggucccucuucuuucucuugcucuuuucauggccagucuauucuauuggccaaauucaggcuggacccuuccagauaccucuggcugugcucuccuucauagcuacaguaaacuuucuccuuaaccagacccaggagcagccauguccuuauuuuugauucacagaggacagaaacugaggccauggaggaaucgcugaacaagagaucggagccaugcccugaaggcuuagaccuuacucuuacauuacaauguuuaaacuucagagcauuacagugcuugugauguagcuuaaccccacaguggcagcaguguagcuuagagagagggcaggagauugaaagcucagguaagaggcaguugcuaguaagauguuugugaacauuccugcugucaguagacggcaccaacagcguugagugugaugccugaucugagggcaccuccaucucuguacagccugcauggggcagaacugucuuacucugagaacucaagccuaugcagaagucauuaagucauuuucuugagguuacuuuauuuuuauuuaauguauaugaguguuuugccuguuuugugccacuguaccauguugcuacagugcccaggaaggacaaaagaguguaggauccucuggaacuaggguacaaacugaugucagccacccuguggcuucuggaaaaucaacccagcuucucuacaagugcucuuaacagcugagccaucuauccagcccuaaguaaucuuuaauuuauauaaaugcuuguaauuauauguguguuauauauuaauaugcauauauauguguauguauguguguguguauguguguguauauauauauauauauauauauauauauacauauauauauauauauauauauauaugccagacagugguggugcacaccuugaaucccagcacucagaaaucagaggcuguggaucucuugaguuuggggucggccugaucuacaaagugaguuucaguacaaccaaaauuacaccaagaaacaaaaccaaaacaaagaaaaauguacaaugugucauuuauuuauuuauuugucaugcacguuguugugugaccauuaccaaccuccaucuaccuuuaaacugcuccuuaguuuugguauccuaagccucagcuaggaaguuggcaugugucagucgggugguaaaugacugaaguaaacgcgguucugguagagacugguugcugaccgaggagcaucaaguagcugugcugcuguccugaaaccaccugggcccucugggcauucaggccuaccucacugucccucagucacauauguggcagguguucuccuuuuuccagcugucaucugagagugcuuggcauuaggucugacuuagagagguucuugaaauguuccauaacagugugacuuggguaagaaguggagagccaauggcaagacauugcauaacaaacaucugcagaacaagugugagaaagccucccugaaggaggagacauugaaaugggaaugagagcuaugggggauggggguggaggugggggguggggagcaaggucugaguggccucaaggaaaagagauuuucuaagggggaucaguacuugagaguccagaucuguuugaaauggcauugaguguggaaugcccuguacacacccauaaucccagcaggaaaaucaagaaaaaggccagccugggcuauguagcuggguccccccaacccccauuauuacuugaaaagagcaauaguauugcugccuguguuguguaucuucuguugccaguaagaacaccacagacuaagucauuauaaacagcuacgcuuuggcuuauacuucagguccaaggcuaaggggcgacauauaguuauaggcuucuugcuuauagagucccaacauagaaaaugcaauacuacugugaguaacacuguauauccugaugguuacgagcucucugacuccuguagguguccauguuggaagaugccagcgacugcauaugaaagaguaguuuacaagagccccucagaguaucacuacaugaaagucugucuguaagucccucuugugaguucuguuuuauauaaccucuuuuuguuugauuguuuccuguuuugugaauuugaaaagcauggcauuuaaugugauauuuucucuucuuaauacuuuuuuacagagaguuucaagaacaugggguuggacugaacguggcacaguucaaacagcugcucgucucagcccugagagaccuguuuggggagguauggaauagcucggcagauuaacauucuuaagguuuugguacagaauuuuagaaaagggacugagcguauaacucacugggggaaucauggccuaccuugggccuaguuguaccuguuacaaaaaacaaaagaacuuguuuguuuauuuguuugaggcagggccucuguaugacucagguugucuggaaugugcucuguaaaccagacuaacaucaaaucccagagccaccugccucugccuccaaagcccugggauuagaggcucgcaacaucauucccaguuuagaaagagcagcuuguaagaaauauauauauauauguguguguguguguguguguguguguguguguguauguauguauuuaauguuguacuagaaauugucuagaagcuggcuuucagaaauaaugaauucuguagguuauacuaguguauccuguauuugacaagaaaucuaucagacaccagcuuggucucaaacagugcuaucaguuaucgucuggacgguaaccaggagacaucauugccgucuuugaaaaggcaaagggcuuacaugagcacuagcaugcuucagugcgagggacagcgggauguucugaguucggucccuggaagccacaugguagaaggagagaagcagcucucaggacuuucuucuccccucgacacacuugcaguggcacaggcacacauacauauguaugugggcaaacagaccuccauaggugugacgcgacacacauacauguggggaagacacgcacauaaauaaaccuuaaagcaauagaaaggucuaagagugugagcagaagcagcugugcucugugaugcuggcugacauuuccacgugcucucagccugucacagcccagcaccuggagcagcucgcucugagcguucgccuaacagaagaggaacuuuggaaacggaggggaagaacacagauaggguugacugucaggagcugacuuacucuguucaaguuuuccauguaccuuaucagagaaauucugcaaagacuguaagaagauggaaagaugagauuuaggcuagagaaaauauuugaaaacuguaugucugacaaagaaguauuaucuaggguauuagaaagaauucucagaacccaguagugucggguauaaugauuuacaccuguaaucaaucacagcacuagauagguugaaguuggaugaucaagguuauguguagcaagaccccaucacacacuaaggaguccaaucauaagaaaacaaacaguccaaauaaaauaggcugaaacuuucacagacauuucacuagagaguguguauaauuggcaaaaaaaaaaccccacacacaugaaaauauuagauacuaggguaguguguaccagcugccacauuaaaguaaguauguaccuaccauacgauucagcaauagcacucuuggguauuuacaccagaaaacugaaauuuacguuagcaugagagccuauaccguggacaggugagaugguuuagcaggcaaagggguugccgucacgccugaugaccuaaaugugaucccuguaacccagacgguggaagaaaagaacugccuucuucaagcuguccucugacuuccauccgcacaucagggcacauacucaugcucacaauaaguaaauauaauaaaaaaaauaauuuaaagcaaaaaucuacacuuggccccgagaggucccagcaguugcagagcaccuggguucgguuccuaauacccacauagggauacauaacuaucuuguagcucuacuuguauaggaucuguucucuucuucuggcuuccucaggcaccaggcaugcacacgguacacagauacacauguaggcaaaaggcuguguacauaaaaauaaaucuugaaaggaaaaaaaaggaauccugcacaccaguguuugugauagucuuauaauaaccagaagcugaacacaucacauuuguucuuuaauggauggauuguucagugauuguagcuucauaucauggaauauaaucagagaaaagaacaaugcuagacagagcucuagaaaauucggcuaaauggaaaaagccaaccguaaauacguuacuuacuggguaauuucuauguauauaauguucuuccuacaacguaaccuguagaaagaagugguugccaggguuacggaugggaaauggaguggguauaaguaauaaagggccgauagaagagucuugugauggcccagguuuuuaucuuagugguggugguaguuauaagaaguugccuguguggaagcauacacauaaauacaucugcguacacauaaugucugagcugaauaaauccaguuguaucaacaccaguucuacagguuacguuauaggcagagcauuauauacguagaauuacucaguaaguaacguaucuagaguuggcuuuuuccauuuagcuuaauuuucuagagcuuuguucuuuucuagcauuguucuuuucucugauuauauuccaugauaugaagcuacaaucacugaacaauccauccauuaaagaacaaaugugauguguucagcuucugguuauuaugaggcuuugaucacgcacagcaguuacauaagaugcugguuuauggggacgcugagggaagaguguguguacuuuccuauagagugcaacaaauuaaaaaauaaaaccugaaauuaguaugucauaggaaaaugugguuucaggagcuagaguuuaguaagauaugguuucucuccguugggcugucuuguuaaauggugacaaggaggggagauguauagaugagcagaguauagaaucgggcauaaggaagaacucaguaaguagauugaucuugugaucuuauaaaucaggacucuaagcuuguaaauaaggacuuuguuuguuuguuuugguuuguuuuuucgagacaggguuucucuguguaguucuugcuguccuagaacucacucuguagaccaggcuggccacgaacucagaaaucugccugccucugccucccgagugcugggauuaaaggcgugcaccaccaagcccggcuaggaacuguuuuuuuaaaccucugcugucugucucucugucucuguguguaugcauguguguguguguuggcacacagaaauuaaauggcuuguguguacaugugucgaggucagaggacaacuuggaguuaguucucuccuugcaucguauggguccuggggaucaaacuagggaacaagcuuaggucaucaucaggcuuuguaccaggcaccuuuacccacugagccuucucaccagcuggagaaggaccaccuuaaacacagaugcgaagaugaggaugacaaaaacggguaggaauaucccagacaaugggagcucuaagcagucacaggagaccagcagcaccguuaaaugaaagacuggauuucuggguucgugaggacagaugucugcuaauguguugcuccguaccuaggucggugccgcucugccuguggauguucucaccuacgaugagaagacacugucggccaucuugagaauaugcagcagguaugaccccaagacaguuggagaguaacaggcagggagagugguggggcagcacagugaagaugcuuccaggaugagagcgcauggcuggaagaacccgcagcaccuuuggggaauuuacacuggaguuaauaugaacauuccucugagacaccaaauuuuggggguucagacuccaucuuagagauccugaccuaaguuuaaccucaacagcccgcugccuaacuucaguuuccagguaauccuugcacccccaacaagaccugugucuccagguuauucccuaacaagcccgccccugccucacaaccaccagugaggaggaaaacagaaguuacguuuaugggcuggcucccagcaccagccaguuacgcuaaaggccacaguagcaccccaauuagaugcuuuccaggccagaaacacuuaucccucgauugccaucuucuauaaaaccuugucccaaugaguguucagggcuuguucucugagggaagcccaagcuuaagcuuguaaauaaagacccugagugauggcaucagauugguuccugauugaucuucgggauucauaaacacuuccuugguacuauaccuccacuggaguuaugcuaguuagagaaaaccuugugauuaaucacagccaguuucccaguugaugguuauaguuuuaaagucaugaauguguguugcagccgccagcagcucgcaacgugaacgguucgacugagaaggccgcucgagcuguaagagaggaaucuagacggggcggaagaaagaauguagccaagacaguuacucugaucaaggcucaaauuuuauuguugcgacacuaguuaugaaggaagggggaggggacccgauucccgccgaauaaucucugguccaguagaaaggugcacguguguggcuccucagguuccagcagugggcguggcagaacgaaugagcaggaagcuccaccccgagcaagcagguuucaggcuaggggaggggagacuacaaauguguacauuuuauaaagagucuuggggcuuacuuuguucucucugauauguuuuaagguucuauuucauaaccucccgguuuauuaaaaaacagucuuuguagacuaucacaagcaaaaguacugagcucuguuccagcagaaaucuucauuauguuuuccugaucuuuauacaguggucuggucaaauuauggaguucuuugaccuuguuuggagccuauaaaagcaagaagugugccuucagagugauucagguaacagcuuuuccuguacaguuccaagagccgcucagcacugcagugauacaaucugggugggucucaguauuugucuugaggaaagcaguuaacaucuaacaaggggaaucccagaaucugugugcuucuggaacugaggguuagacagauuuuaagucauccuuguugcaggauauuugaucacacugugaaucggagauuguguuauuuacugaaaaaagcguuucuaguugugauguggcucagcccucagcacacaccuuuaaucucuguggcugaaauacagacaagcccuuagcacacaucuuuaaucccaagcaauaaagguaaaguuaguuugaagaaggaagcauccauguuugaaagugaugucuaaucgaguggcagacaaaguggugagucagagagauuuggcagacuaggauaugcccaacucucaggagaagagaaaaaagagauuauguaagagagcagcacagaagaaagggaagaaggaagcaguuuucuaggaaaguuuuacagugacccauugaagagagaaugaguuagacacaggagaagacaggaggagcuagaagguuagaacagauugguagaguuaguuagaggccaagcaaagcaauucaggagaagccaagagaagccagauugaaucggucaguucggagaggaguuugagucagacagaguucagaaagaacuaggaagggugagcauauucaugaguaagcuucagaggaugaaaacauucuaggccuggauaagauuguauggaggcuaggagcuuccaggaccaggccuugaacuuagcagauggcaguaagccucaaagagaacaauuacaucaggcgaauaaaaguuacaacaguuauucauacuggagauauuagaggucaaaguugggauucgugugcuaaagucuuuucuuacugagugcuacgccagugaucuaugucuuggcaugcuguuuccgggcgugggaugauuuguucagcuugggcuuccaugaugcccuuuaaaaugugacugcugcaguacugugcguccugugaaaugugcauguuuuaguuuccaugcagccugaguuaaccuguucuucucuuguaggugucucccuuucuccuugcauuaucuggcaauagcagggaacaaguauuggacugaauacucuuacagguccagauacuuccacucuccacaguguccuuaggugucuacauuauuugaaaacagacgaaggcuaaagccccuguuggugacauuuggagauacugaagauguggcgugggcuucagaggagacuguggcaacaucaugugguaccaacagggcaguguuuucaguaugugcacacgaaaguuggagaccgagcggagcucagcagagccuucacacagcaggauguagcuaccuucucagaguuaacgggagaugccaauccuuugcauuuaagugaagauuuugcaaaacacuccaaguuuggaaagacaauuguucacggaguuuugauaaauggacuuauuucagcucuccugggcaccaaaaugccagggccaggcuguguguuucuuucccaggaaauuaaauuuccugcuccucuauauguuggagagguggucuuagcaucugcagaagugaaaaggcugaagcagucuguugcuguuguugcaguguccuguuguguaauagaaaguaagaagacaguuauggaaggcuggguuaaaguuauggucccggaagcuccuagauccugaaauacaaauuuaaaguuauacauuuaaaaaccugugcucuuauuaucaaaugacacccggggaggugggcugcugcucuuccuggaggaaugcugguauauccagaagcuguguguggaaggggagacuuccagauuggugcaugguuuguccagacuuaaauaugugcaagaucucauugucuaucaagguuuggauuuuuuuuuuccaauuaaaaaaacaauugagaggggcuggagagauggcuuaucaguuaggaucacuggcugcucuuccagaguaucuggguucaauuccuaauacccacauagcugcucacaacuguauguaacuucagucucaggugauccaacaccaucuucuggccugugccgaaacuaccugcacaugguacacagacauacaugcauacgugcaagcaaaauacaaauacaauaauaguaagauaaaaaucuuuuuaaauugggaagacuaucuucauguuuuacuuucagaauuugaaacaguuauauuuguauuugauaacgucuacgucaguguugagggauuuucuugcuggauuuauaccaccauguauaccaagugcagcaaugcaaguauaacugcagcaaugcaaguagagccaucucugaacaccuaauucugagacccuuucucagcggcuucugggcuaggcuuauaauuccuuacaccaagauguaaucuuuuguugcauguggugccacuggccuuuaguucccacuuaggaggcagaggcaggcagaauuuaaagcuaaccugugugcguagcaaguucuagaacagccagggcuacauaaagagacccugucaaaccaauaaaaacaaaaaaugacauuuaauucaaauuucucuguaacuugccuuucaggguuuugcuguuacuggugagggguuuccaugcagccacgacucaguuauauaaaguccuagcauggcagcauuguuggaaauaauagaaacagaauucaucagagggccgggccuagaaauauuagccaguguucuccuuccauguggcuucccaugagugaauugggugacuuuucugaauuggaaguuggcuguucuacauugaucagguuaacaugcugaucuuucagagagcuggccaaucuguuuguuaguauuuuaaaaccgaaggaaagcaucuggaauguaaaggugcuguuuuaaggguucuaauucucucccgcucuugaaaacguggaucuacuuaaaaaaaaaaacaaaaaaagcaacaacaauaaaacuauuauauguguguguguguauauaccuuuauguguguguguguguguacacacauaaaggaggcaggaggaucucuugaguuugacaccagccuagacccuaccuacccuaguuucaggacuaccuagaccccgucucaaaaagaaaaaaaaaagugugagugggugauggcaaaggugugagugcgugauggcagaggaaggccaagcuuuugggucuuuuuuucuuuuuuuuuuuuuaagaacuuggaguuauggggagaaugugcuaaauguguuaguauuaaacaguuacccuaacagccaggacuucuuaaauaugugccguggucuaccugugcucgguagguuaaaugguaacugaucauagcuagaugcuuugauuagaaauacaagaucagcgaggcauggcaucucuuacuauuauaaaacuuaggagcgugugucaccugcuccauauuuccuggaaaagacauuccuucugugucaucuuaagcagauuuuugugggugugugcuuguuuguacauguggaggccaaaugucaggcucgggugucauuacucuugacaagauuaagauucacuuuguguuuuugucucuugcuggcauuaaugucaguaauuaaaugaagcuggcuggccagugagcucaaggaauccaccuguccccacuuccccaagcacugggacuuaucuauaaacacaagcuaccaugcugg

SEQ ID NO: 7257 - RNA, 9492 nt, Mus musculus
auccggcuucccggccuucgccccgcgccgccgauagggggcguccgcguucucggcgccgcgacucugcugagaaggcgccgcccgcgccgggcagcuggagccgcaacuccgggcuccggcucacucguccccucugccgccgccgccgccgccgccgccaccgccgccgcugccgccgcggggcgcgggcucgcucguccccgcgcucgcgcucucgggccgccggcgucucccggccgggucgccuccgcgcucgugcagugaguggggcgcgagcggggccugcgggccggggcugcgggaagucgggcugaggagaacggcggguggcggccgcgcguccccgggcuggcacgagcccgcggcggggccugggcggggaaaucggggacgcgcggccgccucgggcuuugggcuccggcucggguucggggcucggugcgcguggccggccgggcuuggcuugcgggagaccgcggaguagggaccagcgggcucugcggggcaaaggguugguguuuuggggagugguguuuauuagccgccacugcccuaguuuaaagcucugcuuuuuggguuuugugcacaaauugcagcuuuuuaccggaauuuugggaugucacggcgauuuagugcuggguguuaagaggugauccuuggcgaggucguggggagccccugcagcaccugcugggcgauggcagcggaggcugugucugggggugggacggggaaacgaaacgugacugagauccuguuuggauauucugcugaaguugucauguuucuguucuguacaccaguacauacagcaaguugauaaaccugguuucaggauuucgugaugcagacaaauagaccgaugugaccugguuuagcuaagaaugucugggauagcccaaacaaccugcuccaauguaccccccuuggcaggcucaucuuuuucgcuguugcagauauucuaguaugggaauaauggugggguauuacaggcccaaagccagaaguguuucaaaagaguaaagaucuaaguagguagggugggagaaucacccuuuggaugaaaaccaggagcccacacggauucuuaguuuuuuguaauaccguagguagaaagauggccauagaauuugaaaauuuuuaaaguguauuuuagcugaagcaauagcguggaaagcagucuuauggucacuccuaugauccaucgucgcauccuggauuuuaauaguuggggucuauuuuaaacggaacacguaugugugucuucugcuuuaucuugagacaacccugagucaugcuuucuagaagucccgagagcucacgugucuguuugucucugcgaacgcuggacaucauuuuaccuuuaguuuuucucacggcaacugcggugggaucuccgggaaaggagggccagggacgggacagagugggaacacagauugguccuaaccugcauguucgcccaccgugucugacuuaccuauuuaaauuuuggugaugcugcgaguaguaaagggcggucuacucagguucucacagcccucugcuggcaugcugcacgugaauccagagcgccacuccucacugcccugucggccaguuuuaccuccauuguguuuaaacggugugguuacuuuugggaaggucauaauacccauuuugguggaaacugagggaaaguagaauuuuaugauuugugacucugacagcacuuaagcuggagaguauauauucuucugguuugauacugucagaagauucauaauuucuuguaggacuuucucccuuuuugccuacauuuccuuucuucuagcccacgagguugagagagggguuuaguuagugguaauuuagcuuuauaaucccauuauccuugugcgcucgcuacuugugcuggccuguauguggauguuaacuccgaagacgccaggagaugccacugaaccaauuacuauaaaaaguauuucacuuucaaacucccacguucccaagaacagagaaacucaguacaaaggcagcuuggaagguaaguauagguggagagagaaaauuuaccggucuucauuuugggauggcagacacaaagguuucaguagaaaagcacuuggaagggcuacccagaaagcgugggaaggcagugacuacaguuguaucauuacauuuucuaauccgagguuagcauuacggcauauagacuguuacaggggaggaggacuuuugcucuggagcgucuuacucaauagcagaaguaagucuagaauguuugugcugucuuaucauaacccccacuguagcuuugcugugguaaggaggguucucacagguuaaguuguuaacuuccuggagugugcauucuucagauuugcuagggucaguaaauuaguaacuucuuuucaggcuucuagaaauucuucagaauauguuuuucuuaacuaccugcuaacauacuaucagauuuuacacauuaguuacaaugaccuuugaaguucaagcaagcaugauagucuuuaggaccauaauuuuuuuuuuuuuuugaaucaaaggucagguauuuucagguaaaccgauuuuacaagucagaaagccuuucuuugaacuuuauagucguugguuguagccaugacucuaagaaagaucuuucguaagggaaagucacuuaaaggaaucuuaugaggaaacauuucaccuuggccugcuugaugcccccuuggaggccuucugucgccuggcuuguucucauuaagcccuccacuggaggagguugugccggaugggagagaagaugaaagggaaaugaauuguuagcgucccuggagaacgaugagguggaagaagcugaagcuacuucuggguuguguuuauuguauccaccccugagauguucuuggcaggcaucaguucagaguccggcuguuggauaggcuagaaucuugccccucuugucucucuaguugcgucucuguuuauguuuacaaggaacacauaccaauuuuaaaucaaucaagacuacucccauuuugacuuuauuggugaucaauuuaguacaauauuuuaaauagauuuugcuagcuuauauuggaagugacuaguauuuuauuuugauguauuuuauguauaacuauaaggucuugaagugcuuuuuaagaaaccugggcuuguccaggagguaguggcacaugccuuuaauuccagcauuccaggaggcagaggcagauaaaucucugaguucugaguucaagguuagcuuggucuacagagcgaguuucaggacaguuaaggcuauacagagaaacccuguccccuuuuccccacucccccgccccccaaaaaaagaagaaaggaaggaaucugggcuuggaucauggagcuaacuccuuaguaaagauguacgucauugccugugcaucccacuagcccccagccauauauauucacauacauauacacauucccaugacugcuguccuagauuaguaagcuugagcuuuguuauauguguguagccagaccuuggcuuuugcuguagaagagauucagaaacaucuaacuuuuuugauuguuuguguggaugauugcauaagacguuaccguguuuugauuuaggcaugaagacauaaaugugaaagguuaguacuggcauaagagcugucugauuuuuuuuuccuuguguuuugggcuuccauucuucauuagucauuugaauguucaugaacuaggauucuuucugucgcuuaagauggaacagcagccauuauuggcgcuaaugaguagguuacugccauuuuuauuuagugguaggaauuuuuacgggcucauuaugacuagccugaguuuuuguuaaauuguaaauaaagugguagguggauaggauuaauaguugguuaugggaagucuuaaauggaugcuuuucaauuguuugguuuuuggauucuguucuuugaauuucuacuucaagagggcgcuuuuguaaaaaucuagacuaggagucagcaaacacaaguuauuguucagguacuccccagauguggggcugugagcaagucuuguggucuauccugccucuuuauuuuauaacucuauacaugcaugcgugcgugcgugcgugcgugcgugcgugcgugugugugugugugugugugugugugugcgcuuacaagcagaaaggcuguuccaucccugccuauuuaaauuguugcucgauucuagagucucuucucaggcuaggcacuuuuucuuuuagcauuucacuuuucaggcucuuugccaaagcccuccguuuucucccugggagucuagaucucuuccuccugagagcgccuccugucugcccuguucuguagcucuuuggaguuauacuguggacuugggcuguugccuguugccuuccuuuguagacugaaagcuccacgagggucagguuaugcuuccuuauuccuguguaucuagauuuuaccugggcucccuugccccgugauaguggguggaccuuacauacaucuuggcugacugacuauugaggcaguugggaaagaagacgccgagucuugggaagugccuuuaauucacuccauuguugaugugguguuaucuauaacugaacccacaccuggguaaggcccauuucuuccguuucuaucauuugggguuuguggaguaagucagagggaugaaaagguaucccaguggcuuuccauugguucugucucaccauaguacucaggcccguccauccgccugcagccagcugccuggaguggagaaaggcagccgccgacugaaggcuucucccggccacauuuucgcucguuugcuuugaagaauuuguaaagguagagaaauagcugcugcagcucugauuucagccccugcugugcuaugcaaauguucucuacaugccugagugaccuuuugagaaagagccuuugugaucuccuguagccagggcuuguucuuguucuggaaacaggggccagauuccucuaaaagugggauaaauggaucuucaaagaccacauacaaagcuagugacuuuucuagugaauaccagcauguccauguuucuugccuucuuugcuggcgauuuugaaaucugcucugcaguuugcuagcagguugauuuggggacuagcguguaagagagggaacugagggaacucaugaaagcaguucaguagcuggacaacugcuggcaugcccuugaauuguagauaaaaacagauugaagccggcaucauuaguacacaggcauuugccaguggccuaaaacugucucuccauggugcuggcugagugacccucagccagcccuguaagguuuuuuuuuuuuuuuuuuggucucaaauugugccuuaacagcuugucauuuaaauugguuucuguuuguuuuuauuuacaaagagaaauacuucauuauuaaaagccugauugauuuuuuuaauauuauaagauaauaauauucugguguguuuccuuuggaaaacgacuguuacuuuuggagcucaugauuuuaaaugcuuuuacugagauguuuaguuuauacagcuggcaugccgauccaaaggaguuucccuccuuuucccuuacaugaccuuuuugaugaagaucaaaaauugauuaugaacgucauagaccuaaucaugagguucucugaaaauguaaaaauuacaucucugggggagugacaaaauuuguaaguuuuuuuaugacacuuauuuugugugugugaaugggagugaguguggacucagaggacacguguggaaaucaauuuucucuuuccaccgugaagggucaggcaagcggcuuuaccugccgagcccgccuucgugucagcccagaugacagaauuugaaugaugucuucgucuccuugaguguaggcuaguucuuugugccuggugggcucccgagguaaggacagagcacggccuggcuuucuuuccacaucuuuggccagcagguuccaguugaccguauacgaggaguuuuugugagguuuggcuaacuacacuuggcagaacagccuuuuuucucuauuucacgguggugauguguuugcucuucuuccagaguucccuggcuccugagcucugaggacgcagugcuggagcagauggauaauggggacuggggcuauauggugagugcuucuuuacuuuaaggcuggcaagcaauuuugaugucuuucucuucucgcauucauaggcguaucuuaaaaggaugaaaacuaugaauuugcccagcguuaucuaauuucuguagauguccuugaagaagagcauuuuuauuuggcuugacguuuuaguggaggacucaauggauauucuccaaauaacuuuauuauuauuauuauuauuauuauuauuauuauuauuauuauguggggggaagcagugcgugcagugcccuuagaggccagaagagggcgucugauccccuggagcugcugugagccacccgaaugcagcucagguccacuguacuagcccguggcuuuuaacuccugacaucucuccugcuccccuaguaacuauuggcaaucacuaauuucagauacaccacgauguuucagucuuugcuguauauugcuuuuuaaauucucuuuucaugggauggugaugcuuaaagggccuauggauaauggaaugaagacuucuucauuguaguaaagggauuacuaguuagacaguguuucuccucacauggguccaugccucccuguuuucuucuuuaucugguaagacauauuuuacuuucuuaguaccugaaggccauuccuuguuuuuucuuaaauaggguuucuaaagcugaagguauguuauuuugagaagcuugcuucucagaauuaaaggucagauuacaaccugaauguuguaaaaaugaauacacagucagauaugacaguuuaaagcugcucccagcccuuugacaugugguaguuuguuuggggcuagaagaugagcuagauuggguucaccaaaccauguauuuuuuaaucuaguguuuacaacuuagucccugggcguggugacacaggccuguaauacagcaccggggauaggcaggagguguguguuucuagccugcuuuaucuauauaguaagaugcugucacaacaacaacugcaacaacagcagccagaaaagaagaaacuguugcuuccagaaaaaaauuacucagauugauuuuaaacaaauuuuuguuucuaaaauacauuuggguguggagacaggggucagcaguuaagagcacuuacgcucuuacagaggaccuggguuugguuccuagcuccuacucaaugccucacaaccgucccuaacucucaguuccuagagccauacccuugguacaaaugagguacacacacgugcacacaggcagcacacucauauaagagacaugaauauauauauauauaucuacacacacacacacacacauauauauauauauauguauauauguauauuuuccacagcugggugugacaguauacaccuguggucuuagcacuguccuagcagugggacagaggcaggagaaucaggaauucuagaccauccuuagcuacacaaugagugugaggccagccuaaguuaugugaaacacugucucaaaaaaaaaaaaaaaaaguuagaucuucugacuccuuugaggagaaaaacccaacacaauuccuaaauuaauuauuguuacauuaucagauuauuuuuauauucuagcuuauguuaaauuuuuaaaaacugacgguuuugccaagggugguggcacacaccuuuaaucccagcacuagggaaguagaagcaggcagauugacccaaaaagcucuucagaugcuggacuucacuguaugacacuaaaggucacaccugguagacuuauaggaaacuuuugaaggauuggauuuauucuguuugaaaccaaauauugaagcccuucucuuggguggguuuuaucauuggaaguaaagccguuuaguccccuugugcugccagauauauuagcuugaaaggguguuaugcuuugcuuguuaauacugauuuucuuaauuuguuaguuaagauuuuaagguuucagguaauuaauuggauuuuuaaaaauugcagaugagugacccagucacauuaaauguagguggacacuuguacacgacaucgcuuaccacguugacacgcuacccggauucuaugcuuggagcuauguuugggggugacuuccccacagcccgagacccucaaggcaauuacuucauugaucgagacggaccgcucuuccgcuauguccuuaacuuccuacggacuucagaacugacacucccccuggacuuuaaggaguuugaucugcuucggaaagaggcugauuucuaccagaucgaacccuugauucagugucucaaugaccccaggccucuguauccuauggauacuuuugaagaagucguagagcugucuagcacucggaagcuuucuaaauauuccaauccgguggccgucaucaucacccaguuaaccaucaccacaaagguccacuccuuacucgaaggcaucucaaacuauuucaccaaguggaauaagcacaugauggacaccagagacugccaggucuccuucaccuuuggaccgugcgauuaccaccaggaagucucucuccggguccaucugauggaguacaucacgaagcaagguuucacgauccgcaauacucgggugcaucacaugagcgagcgggccaaugagaacacaguagagcacaacuggacuuucuguagacuggcccgcaagacggacgacugacugcuggccagcccucagagaacuuccugcaagcucacguuuugggacauggaagagacuguuguuggguuuuagugugggcccucuuuuuuuuuuuaauuuuuugauucagucuuuguauuuauuugaaggcauugaggaccagaaggaaguuuugugugugagcagucuccucccuguuuuguucccaaguaugcaugugccuguuccgagucucuagaaaccuuuuuuauaaaaagagaucugaaaaucauuaugguauauaaucuacccuuaacagugauaaaaugauuucugagaacgugguuccugacucgacuggaaggcuaaaaacaggaauaaaagauuaaagaggguauucaugaugucuuugagaaaaaucagaauaucauguagggcgaccuaguuuccagaccaguaggcaguauugugguguuaaaggaagacuggcccagucaucugaggguacuuguuaaggacugcuuucuacaguuuugacaacuguuucuuucuaugcauauaaaucaagcaaccaaauaucuguagccauggaaaugucugacuagaaauauuuauauuggauucucaauacaaaaugucccugugguagaaaccuuaugccugguacaguuucauucccaagguacugucuaccaggaaagaaaaaucuaauaaaaaauggaauaugaauauuaaag

SEQ ID NO: 7258 - RNA, 2708 nt, Mus musculus
ccggacuucccgcuuugcccucaaaccuaccuaucacccucgaugccugcugaaagaucuuggauuggggacccugccuggcaccagcccugacagggaccucgcgggaccucugcaggcagaacacguaguguuaacagaagugugcacgcgcauguauuuccacacucaggaagagggcacugauggaagaggagagagagaagaaacggaaggacaaaguaagaagugaugaagaaacgucgaagcuuugagaugaugggaagaagaaacuuggcgauaaggaaggaaggaccaggggcgcugcugucugcagaggguggugguguaguucccacuuaccugaccugagcagcacggcucgguacagcccgguggccucggcgggcgcacuggcccacucgcccagcuucugcgccaugcccugcgcuguguauccccaccgcggagccuggacugagggcuugagcagcuucucacugauagugacgcguccggcugcuccacccgcaggggaucugguuaccgugggcugugugcgagauccagccugcuucccagaucuacguggggugugcgguggaccaaggggcacaggcagucucugugccccgggaagcgggaggguguccagacauuuuugcagcaucacacagagcacuaccagccuggccuccugcucaccucacccaggucuuggccacugaccucugugaaagcugcaagcagguacgggauuaggaagcguuauuccuuggaucuguucccagcugagcuggcaaagagaagcccaggguccucaucugagacgcgcagggauccauaguuccccacucacacgguuacaaggugaggcguggcagguauaagagggagugcuuggaaucugccagguucggagcagacacuaugcaccgguacuucuaaagaugacgugugaucugaggauguugcucacuugguagagugcuuacgugaagcccuggguuugagacccagcaucgcauaaaacuggggauggugauguacaucuguuacccuagaacuuaagaaguggaggcaggaggaucaagaguucaaggucuuccccagcuacauagcuaguuugaggccacaagaggugucuuagaacacaagcaaguaaacaaacacaccacaaagauuugagugguaaugugaggcuggggcaaugcugggguagggaaaaagucaguaggacuucucaaggccgaacugauuucucugguuuuguggugucucuuaaacagccagaggaggagaccaauggaagagucugaagguggauggggcaaaaucccaccaugcaguuguggaauauuggagauguccacagccuugguuacucacucugccagcacugggcugcucugcaucuaaaacaagaugagaucugguucauuuacucuuuaugaaguugagucucuuagcauucugauuuuacagaggagugcuugccacagacacaguccugaguuuaugaguccagaacccauauaaggcuggguauaguggcauacauuuguaguuccagugccaggagguggagacagauuugugggucaggcuggccagugagucuaauugacuuagugagcugcagauucaaggagacaucccugaggauagcucagcuggugacaaugcuugccuccaagucaaaccgcuuaaguuugaucucagggacucacucaguggaaggagcuaauuguccuuugacauccacaugugaccgccacagccauggcacauguguuccucccuucaaucccauuuccccuccaaaucgcugagucuuuggccacagagaggacugauagguaaggacacaccagaagcagcaucagauuccauuacagauggucgugagccaccaugugguugcugggaauugaacucaggaccucuggaagagcagucagugcucuuaaccgcugagccaucucuccagcccucauuauaauauuuugaauaugugugcauuuacaugauguauuuucuuuuaugugugugggugcuuguggaggucagaucccuuggaguuauaggucaaugugagccauccuaugugagugaugggaacugaacacagguccccugcaagaauaacaacuguucuuaacaugagucauuucccaacguuucuucaacaacaacuaggacaacaacaacaacaacaacaagaggaauguauguaguagcuuucuuuugcuaacucaaggcaaacaauugaaaguagggagauuugccaacuugauccauauuuuucaccuuccaucccaggaaugccaccaauuaugacuccaucgauagaccaaucuacccaggaagugaguccucauggccuaaagugggggaagugaccuccccaaagccucacacucacuguuaugaccacugggaccaagcuuuggacacauaagcuuuugcagaguauaggggggcccuccacauuuaaaaguuaagaagacaguacaaagaguuucuuguauuccacacccagugucccuguccuuaacaucauaauguacauagggcaggcaagaugacucagcaggcaagggcacuugaagccaagcuugaggacuccccgacaugacuccuacuagcugccguaugaucucuacaaacaugcuauggcaugcauacccuccuacaaagaaguaaauaaauaaguguaaucaaaugca

SEQ ID NO: 7259 - RNA, 2645 nt, Mus musculus
aaacauuuucauguuuggaaaaaguggcguauguggcuuguuuuacagaucuuguuuauuuuuuagcuucugagugucguuuaugagaaaguggagaaagaaauguacuaaugcagaaagggaaaaguuaaccugauggccaugcaugcagccacccacacgaagggccgugcacgcagccacacgaccauuucuaagacuuagccgaggacaaggcucuacucuuaaccuucacucguaucauuuauuauuugugaaauugcugcagagaccagaagauaaagagauuaaugaugccuuuaugguuccuaauguagauuauuauugaaaaucugucaauuuaacuggcaagcuuuuggcucaaaaaauaagguccucauuuauaauuugcagacaaugaucacucaaauuauaggaaguaacugggaaauaaaaauaacuauuaugaugaaaaccacauaauuaucuuucucauuaagagcaugaggcauucuauuauuccugggaugugcagcauacucuuuaacagcuguugcaaaugaacuaaaacaucugaaugggaaagaaaaugcauuacugaucacucaaacgaugaaaaauaaguagcguuguaauggcccgagugcuccaaagcacagccuagcaggaagucccucccacaagaaaccacaaccaagccacaugcagacccuucuagaauccacuucagcuuuccucccucacuugucuuaacagaguucugcuugcugaugguagcaugugauaggaugguacguccucugcucugguguggagauuugggguuuucuaagaacaccuucuuuucuuuagggcuagaaaaguaugagacaugccaaucccuuugugaaguuaaucuuggcaaucaacucaucuggacugagagaugccuagagaauugugauagcacacuuucuaggugugucuguaaagguguuuccugaaaagcuuuacauuuucgucagggacugaagggaaacaccacgccaaaggugagucacguuacccaaccagaugugguccuacggagcagcagugguuguaggccuccagcccugggcuggguugugucacugguuccuccugggcuggguugugucacugguuccuccugggcugggaugugucacugguuccuucugggcugggauaugucacuggucccucuugcucugaggcuuccagcugccuggugggagcagcuacugauuccucaaccuauccaagcacagauggccaccaugggcuuugaagccucugauucuguaagcuaucuaauaaauugacuucauauauacauuagauggguuauuuuccucuccagagccuugagcagcauguuauuuuaaaaguuauuucuaucuguuugccucacugaaggauucuugcuuucuggagcuccuucuuccagggaggcccuuucuaggccccugcccccaucugcuuguccugcucuguagugggcuagugcaaauguacugguacuugagacuggagaagccuggacacuguggucaucccauguuaaggaauacacuggaagucacuuuggauagaaacuugugaauaagauaucaaguacaaguuuugacaagucaauacgcucuaugaauaagacacuuuuauuuuaauauaaagagaaaagcuugaacagcuaaaauagcuauacaaauuauaaauagggacuaaucauuugcugaaaugccuuuccauacucuaccaagauuggaucaggcacacuuuucuacccccaaguaagucaucagagaacauuuaaaaaaauauccacauaguugcuuuaaagacuaucuaaaacaagauccacaaauuaccgacagcaucuaagaauggugcgcguugucuacaugcagagcuaaguguaggaggagaaaaaguaaagcucaaggcauuuagcugauuuaaaugaagaaaugguauucuaagaaaaugugggcuuagggggcguuuuugacugcugucaggcaguuuucuuguuuaggaacaguagauaauaaaguguguuuuauaucguguuuuucuuacaugaauauuucaauggagagcuuauuguuuccagaguagaucaacguccucuucaauaugauugcuuggaaagcuggaagugaaugcuaggagaguucacauauauaguucuuugauuuauccauaggaaagagcugagagaagauaauucuauaccuaaaaucaaugcccauggaaaaauuaaguauuagaaaggagcaauauggugcaauuuccaugcuauacaauauuauauauuacaucauaaaaauuuccugcuauauuguaauaucuaaagaaagaacuauaucauuguauguacuuuaugguugauuuuucuagugugacucacuaauguucauguacaguaaggaaaugaguguuaaauaagcuuguaucaggggacagauaaagucauagcauauuuagaaggcauuagguagugucugaagacccauguccugacaccaaauauacauagccucagcaaaccaugccucgaccauccauacagucacacagaaccaaauuuacaguuauuacccaaauuugguaucuuaaaacaaaauauuuuuauguuaaugcuggauuaaaggcugggauua

SEQ ID NO: 7260 - RNA, 7189 nt, Mus musculus
cucugaucaaggcucaaauuuuauuguugcgacacuaguuaugaaggaagggggaggggacccgauucccgccgaauaaucucugguccaguagaaaggugcacguguguggcuccucagguuccagcagugggcguggcagaacgaaugagcaggaagcuccaccccgagcaagcagguuucaggcuaggggaggggagacuacaucuccucccuauuauuaacaaaauaaaaaaaaagaaaaagcuggccugaggggggaaaauuaucuaugcucaauaguucugccuggaaucuagggcuaaagaaaaaacuugcuucacugggauucuuuaacuuuucuuaugguaaacuguaucuggcuuaagacuguccuuucuaguaaacaacuaacugaaaggccuggagcugcagacucugacuuuauaaugcuaauuaguacuugguagguaacuuucuaguugaauuuuaaguagggcguuggaacucuggcuaaguuugacuggcuaaguuugacugaacgaugugaaaauaacacuaaguugaauuccuccacauuuuuggaagauaggugggaaacagggagaaggagugaccggcucuuguaguacaaggccaauuggcuuuuuuauuugggugggaggcagugaaaggcuugcccuuucaauaguacgucuccaaucucucuccccccuauuaauuaaguuaaauaaggcaacgcuuaacugaggugaucaaaugauuuucucauccguagaugagugggcuuuuaaccuuggcuuggguggacauggacccgauuccucccguggguaaaacccacacauguggcucuugguaccuuuuggggaggcgagguagagccggagaauauuuuuuauuuuuaaccaaaauuugguaccaaccucuuucaaaccggguuuaucucacaggaaacucagaaauggucaagccggaccuucccuugcaguaaguaucucugcaccaagcggugcccauacugaauuuguacaaucacaaaccaguaugcacaguucugagugcugugcagcuccuaaaggagaauuaucaaccucagaauuagcaaagccuaagcaagaauuaugucguuaguaacaccacgauuuguggcuaaaauaggagcuggaagucguuccuccucaucccuguuuuuuccacagccuauugagcuaaggacaccuugcaguaacagcaagggugaaaagccagaggucagcuaaggggcuaagccugucuaucaaaauaaaaaccaaucuuuauuaauauggaaauaucuacucuucuagcccucuagguaaaccuaaauuuuuaacucagacugaaagccacaugcuggaaauguccugagacuggggguaacagcugccgccugugugcucuaggggggcggggaugcacauccgcugguccgccucgggaauguugauuuaccugcuugaaagacaaaaucuugaaagacagugagaaaguaggaaagcagaacuucuuucggggaagucuagguacuuuauuuaaaugcaaauuguaaagcugaggcuagucuccggccuccugucgggagcugguucagagaguagcuggagacacaaacagcuuugagagcuguugcucucagcugaauuuuaagcacaaaaggaauuuuagucuuuagaaugauacuuaccagaagagucagaaucuguguucaucugacgaauuaaucucucuggcagccaccgcgcuccaucuucaucucgugaaaaaacacaaacugagccccuaccccaaauuagaacuggaucuggacccuuccauucauuagucaggggguccuuccauuuuaccaaugcauaagaauuagaaguaacuggaugccaguggcgauccgcugcagacuggcccuugauaucggugugcaagaaauuuaggacaaauaaagugaaggcaaggugggccuuuggugaccuugggggauauagcugacccucuuuugucuuaaaaagccaauucuuuaaggugcgaugagcacguucaacuauuccuugucccaugggguuguaaggaauuccaguuuuauguuuaauaccgaauucuuuacagaaugaaauaaaguuuuuacuggaauaagauggcccauugucugucuuaauaaguuuaggcaaucccauggcauuaaaugcuuguaggcaaugaucaauuacguuuuuugaagcuucuccuguaugcagagaagcaaaaagaaauccugaacaaguaucaaugcaaacauguauauauuuuaguuuuccaaauucugcauaauggguuauauccauuugccaaauaugauuaggcauaaggccucuaggauuaacuccuagaugcggcacuggagauaaaguaauacauuuaggacauuguuuuacgaucauucucgcuugcuccuuugugaucuuaugucggagccuuaggguauggcuagaaagaugaaaccuuucgugaucacguugggccaaagcaacccgaucugaaacuaaggcuucuccuauuagagcucugucaaugcgaucauuacccucugccagagguccaggaagaccagagugagaccguauguggccaauauaaaacggauuuuuccgggcgagaaugauguuuuguaauucugaaaauaaagauccugacggcguauugaaguuaaacguaccacagguuuccaguaaggguacugacugagcaacauauaaacugucaguaaaaauauuaaaagccucaugcacagacugaaaaaccuucaguacugcuguuaauucggcgagcugagccgagagaccaggagucucuacgauaaccuguugauuacuaauaagauauccagcucgcccuuuagaggagccaucaguaaaaaucaacagagcauuauuuaaaggcuguaaggaagucaucuuaggaaauaucauaucaugcacauuuaagaauuuuaucaaccuaucuuggggguaguggcuaucuagaguuccuucaaacccuaauugcgcaagcaaccaaucuguacuaugcuguuucagccaaguguccugacucacgcuguaaggcuggacaaugauaucuggcuccuuuccaaaauaagucaaugccugccuucuuccagugauaaucaucugagccacugcuucgugauauggcaagauauuacguuugggagaaauccucgaauguauccacauuauaggaaauuuuugccauagcaaucccguaggcacaugagucguauuaaaaauuaacaggugcagcggcagggaguaaucuauguaagugacaaacuguucuucaauagccuuuuccacuagcuguaaggccagcaacccuucugagguuagggaucuaggggaagugggaucagaacucccuuuaagaauaucaaauaaagguuucaacuccccuguaguaagcuuuagauaagggcgaagccaauuuauaucaccuaacaauuuuugaaaaucauuuaagguccuuaaguuaucucuacgaauaacaauuuucuggggaaaaacagcuugaucagugagucuaaaacccaaauaauuauaaggauccugaguuuguaucuuuucagaagcaauuuguaaucccuuaucagccagggccuuuuguaagucuccauaacacaaaagcaaaucuuggggguccuuucccgccaucaggacaucaucugugaaauggaugauguaaauauuuggccauuguugucuaacaggcugaauugccuuugccacaaaccuuugacauaaggugggacuauuagccaugcccugcgggagaacuguccaaugauaucuuuucauggguuccuugaaauuuacagaaggaacacuaaaagcaaaucucucacaauccuuuggaugcaaagggaugguaaagaaacaaucuuucaaaucuauaacaaucuuauaauaucccuuaggaauggcuacuggggagggaagccccgguuguaaaguucccauaaguaccaugguuucauuaaccuuucuuaaauccugcaauagucuccauuuucccgauuucuuccugauaaugaaaauggguguauuccagggagagugagacuccaccaaauguccugcuucuaacugcuccugcacuagcaaagaagcggccucuauuuucucuuuaggcaaggaccacugaucuacccauaccggaauaucauuacgccauugaauuuuuucggcgugggaugcaggcaagacaguggccgcuacugaaaauacuguaaaccucucacguuagagugggguuuaagauccucaaaggucuuaauuuucugucccuucuuuauuaguccacgaucaggcaggggucccugccugaacgucuguucagucaccaucuccuuagaacugcacaggauaacgcccaucugugacaacagaucucuuccccacaggguuacaggcaaauuuggcauaacauacggcugaauauuuccugauuuuccauccucaucucuccagguuagcaauuuggaacuacguuuuggguuacuggcauaaccaauuccuugaaggugagucaaggaaacagacaggggccaguuugagggccaguccugcccucuaauuaucguuacaucggccccgguaucuauuaauccuucaaagcuuuuuccaucaagaaucaauuuaagguuaggucucugauuagugauagauuucacccaauuuacgccaagggagucaaaguuauucuguccuucuucauuuucaaagaauuuagauagugaccagcgcaaagggaucaaaguaaguugagcaauuuucugauuagcggguauaguuauagcaccacgagggcaagcggcuaugauuuuaauuucucccucauaaucauuacuuauaacaccuggauaaaucugcaggccuucuacaauagaacugcuucguccuaagagaaaaccacagguuccuacagguagugguccaaaaacuccgguaggcagaguuuggacucccacuucugggguuaaugcuacauggacaguggaacagagguccagucuugcauuuccuggguuugaccugacaagcucaagaacugaucuuguuggcugggcagcagauuuauagccccauaagcugucuucuuugaguaacucggggccuggggcugaccccuuuccucguuucccggcaccgggcggcucaaaacccucguuuuaugcuuacaaucuuucgcccaguggcggcccuuuccacaccggggacauauuccugggccacggccuguuugucuaaccucggcacccuuguucugaggacaaucaauucuaaaaugaucuaaaccuccacacuuaaagcauacauuuuucccucguuuccuugagaacauugccugcgcguggguucccugcaaggucucgcaggaaggcccgaugucugcgcaaaggcggacauaucccgccaaaucugucguucccuuaugcgguugaaucgcagcucggcaaauugcauuagcauucucauaagccaauugcauaacgaaaggacuucccguguccggacuuccaagaauucuacuagcugaaaucaaaagccuguccacaaaauccugauaugguucaucagaacucugccgaaugcuagcuaaacuuccaccaaucucuccuuugacuggcaaccuuccccaagcacggcgugcggccgucgcaauuugcgcguacacugcaacgggaaaaucaaucugauuugucugucccucauaagggcccucuccuaaaagcauguugcuaucccagucugaguuaccagccugagcguuagaagcagcaguuuuuuuacuggcgucucgccauucagaaucccaaagcaaaaaaucuccuccugacaggguagccuuagaaagagucuuccaaucuaaagggguuaagugugacuccacaacuguguccaguaaugcuugagugaacggggcugaagggccauauugcacaacagccgccuuuaacucuuuuaucaacuugaaaucuaaggucugguaaugucugccccuaguaucuuguugaucaacuaccucgaccaccggaaaggcuagcguauuagacauauucuguccuuucccacgagccugacucacaaccuuuucuagcggcaccuggugaacuacagaagaguuacucuucuccgcuucugacaucuuuuuuaguucccgaagcucauuagucagccucugaagcuuaaucucaaacucuaacucgcuuagucgugugucccuaugaguggcaccucccgaaguggggacuacagguggagcgggagauucacaagaggaccaauucucauuaagguaaugggcagcuccucuaucugagugauuuuuguuaaaaaucaguuuuucauccgaguuuccacauuuaucaauuuuugaguuaagaagaucuuuuucugaggaggcccucucugacaggcacuccuccugagauaccacaagcuccgccugggggcaacuuagcccuggggaaguggcaucuuuuauugcaucauuuacgagcgcccagaggccuaggguaaaauuaucugccugagugauuuuuaaggccucaccaacuuucucccagguuccacaaucuaguguuucuucuuccuugaaccaugggcaacagcuaucuaucuuaccuaaaaaauuuuuuacuaauuguacuucgagccuuacuccucuggccugaaacaacuccugaaaacuauuggcaaccgccugauccaugacuuuaaacccuuucuucuuccaccuaagcagcuuccuaaaaagcugcggcuaaccugccuguuuccguuucuaguuccgauuaacacgcugcugacccaagcagaaccagcguuggguuagcacugauucaagcuuaauucguauccuaccgcauccucagcaacacuuuacaaaacugaaauuuuaagcuagcgcuagcauguguaccuguccguugcuccgauguccgauacgaagauccuuuccuguggagcuccaaugcagcguuccucuuagcaucucucugccauucuucaggucccaguucuggcgccaaaauguugcggccgccagcagcucgcaacgugaacgguucgacugagaaggccgcucgagcuguaagagaggaaucuagacggggcggaagaaaaaauguagccaagacaguuacucugaucaaggcuca

SEQ ID NO: 7261 - RNA, 2586 nt, Mus musculus
gggcuggagauugaguucagugguagaagacuugcccaucuuggcaagcucuggguucaacuccuaacuuuauagaacuccaaaccaaagcaaaacacagaagaaaaccaaucaacaaacaaaaaaauauagucaggucuguuuucacauacaaguaauuccaacccuuaagaggcuguugaggagccuugcaaguaagacaggcaggcuacauuggcuauauagcugcaugacaagccugagcuacaaaugagaccuugucucagaagaaaagcaaaagacugaagagaaagcacuucaguagagcacuuggucaggauguacaaggcucuagcuucagucuucaguaauacaaaaaagaaaaaaagaaagaaauuucauuugaauguguuacuuucuuuucuucuggcucacugucugaaauuuuugaucaaggggggaauauauauaguauguguauaauuguauuuauagucuuuuccuuuugucucaauauuucccaaauaauguuuuuaguuaaugaauauuuauugaaugaaaaguggaacaacacaaaauucuuaaagguguuuuggcuuuaaucuguucucuugacuuuucaguuuauggauuuuuauucacuaauucauuuaaaugcucauuuauagaccacuuguugaaaaacucucgguaugaaauguucucacaucauuuacuuuagguuguaugggacugaaauuauugagcauuaaguagacauugauuugaauucuguaagaaagaaaaauuaucauaauuaugacucauuucugaaaauaaauuuuuacuagccuuacgauuugucacucaaagauuugaauaaugcuacacugggaacuuucaaacucaggaauuaagcauccacagguuucccccuaagaaggcaugaacuuuguucuugaaugagugaagaauaauggguuuaucugguaauauauuuuauuuagauuagggauauagaacugcaauacuuauugcugcugguguuguuguugagcagaguacauuuucauuuaguuacuuauauuuaaauaagcugaguccugacuuguugcugcuuucauaagaaaccccacacucuuggaggaaauauucuucacaggggcuguggcucaguggcagaaaagcuuacuguauaaugcuuacuauacaagcccugacaggauaugcccagcacccacgugaagccugauaugguaccucacaucucuauugcccuggccugcauuacuuaaacaacaggguucuugagggaagggggcuacaaugacaaauuuugggaucagaaaacaugaaggaaggaggcaagacaaaaguuuaguucaagccuuguuuauucaaggaaaauggggggcuuuuaaagcugaaaacugcgagcagaauuugcucagguacacagaccaaacugguagugcuagcuaacacguuaaggucaaaggaaugcccccauuguagaaagguccugaaaggagugcccucauuauaaaaugaaagcaaugcccucauugugaaaugcaggagucaauuacagaacagaagcaagauaguggaagaagcaaaagaauguuagauaagggcccugggacaggauuccaggggcuuccgggccccaacacuguauauccagaacaccuucagcaacauggaaggcagucaggagaaucccccaagguccugggccagauagcauggauuauguaauggagagaaauccagacccugccucaaagaauguggaaggagacuuccucagguccuucccaccccacgcgguuguuggcgccagacucaaacagggaggcugccucgcgcagcaugucaaagaaaagaggacugaguggggaggaaaagagaacccggaugauggagauauuuuuugagacaaaagauguauuccagcugaaagaccuggagaagcuugcucccaaagagaaaggcauaaccgccaugucagugaaggaugccuaguggaugacgguaugguugacugcgagaggaucgggacguccaauuacuacugggcuuuuccgagcaaggcucuucaugccaggaagcacaaguuggaggcucugaacucucagcugucagagggaagccagaagcaugcagacuuacagaagagcauugagaaagcaagaguuggccggcaagagacgcaagaacgaaccauguuugcaaaagaacuuucuucauuucgagacuaaaggcaacaacuuaaggcagaaguggaaaaauaucgagaaugugacccacagguuguggaagagauucgugaagcaaauaaaguagcuaaagaagccgccaaucgauggacugauaacauauuugcaauaaaauccugggccaaaagaaaauuuggguuugaagaaaguaaaauugauaaaaacuuuggaauuccagaagacuuugacuacauagacuaaaauguuggugcuguacaaggaucugggagcuugugaauaugucaagguuuaaacagcuaacuaauguuacccaguuaucaucuaucugcuaauuguuuaucauuuuguagcuuuaaauaaaguauacaauaaggaaaaaaaaaag

SEQ ID NO: 7262 - RNA, 19061 nt, Mus musculus
gcguaaaguacgcaaacauggcugccugaccacgcccaggucuugcgcaggcgucguccauggcgcguucccggaagagcucagaggugggcgcaguguggucacagcccguagccccugaggcaagggggggaugaggaggaagcuaaugaggggagccaggugaccagaaagguuuuccagaguuuucugggacgaaaggcgggacuugggguggccguugggcgcuuccucgcuucaaaaggcagaguuuuucuugaacugcucccgaaggagaggaagagaggcggcaggaguggcuuuccaggggcgccuggacgcugcccuggucggcugcaaaccucgccgggaggaaggcgaggaagccgggcgugaggugggcccugggcggagaaggagccugcugaagggccgggcaggccccugugcagugugcggagcacccagagcucgggcguccggucgccauccgauccugagcgagcggcguuuaauuucagaaaguuuagggaagucuccuucacggaaugucaguguuggaugugucucccuuugguggggcaccuuuagcuugugugcucagccuagcgcguucagagcacgucauuagcccaccaucuauacuugugcaaguacuuuagccaaggggaguggugccugguguagugugccauaggaagucuccaaacgcgagugcugacuugcuagaacgcggcgggcagacuuaaucgacuuuuuccuaaguuacacauguaaaaauacuuccccuguuuggaagggucaugguagcacugagcagucuuccgcuaaaggcaagaccaugaguucccaguugguccucagacguguuugccuuucugucuaugaguguguguugaauuuuuagguuuuuuuuuuucuuucuguuaaaauguccauuagucuuagugccggcuguuuguuuguugaaauucuguuuaagauuagagcuuggguggagguagcagauaugaagcgucuugaguuuaccugauccaugguguuuugagugaauuugacaaaugcaaaaaaaaaaaaaaaaauuaauaaaaaugugcuugagugcauucuuucacauuacacauaaaauugucaguuuucucuuuugagagaauuaauguauuguuucaguacuaaaaccaaaucgcacaguugaacacauggguaaagauaacuaaauguuuuuauuauuuagcagaaaacuuauagcccagcuuugauuaaagauggcuuccuuguuuacucaagaaauucaccuuucuaaaagacaugaagaaauguaaguuuuugaaaaagauacuucaaauacagaguguauguuaccuuuauuagugaaacaugcacaggaagacaaaaaugugaaaguaucauuuucugacaggacauuuuauuguagauaacuucauugucucuuaagaaugagaguaaacgacacaauuauguucuaaacauccacauagcuauuuauuuuuauauauuaauaucaaaauguucccuuccuucacccuuucuaaaguucaaauuagauuuuaauagaaacuuugugguuguaaggguucugagacagggucuccuguaacccagacugguuuugaacguucuucacaacuaaaacuguucuugaaccccugauuuuacugcuucugucucaugagugcuuggaguaaggauaguuaccaccauucuuggcucuuauuuuucuuuaaguaaaaauuuuaaaccuuuauuaaauacuuucaauuaaauaauuguguguguguguacgcguguguugugugugugugugugugacuacagauggccaggcagcucagaagagggugagagggcaccagaaucccuggagcuaagacuaacaggcaguugauugcugcuuuauguggaugcuaagaacuaaacucaaguccuuaagaaaagcagcaagaaccuguaacuucugagccauauuuccaacuccauguuuggcuuucaguagacuucuugaaauuccuuauccagagccggcuuuaugcucauggagugugaccuguauaguuaugggccuugcacuugacuagaauguucuaaugccauugucuuucaucauuuugcacucaauccagcacacuguauagggagccaugaucuuauaguuaauauuaaucuucaucuauuugugggcucucagauuuuccucuuguuuaauuacuuaccaggcucucuggcuaucuaauacacuauuuucauaaaaacaaaaacaacgcaaauguucauugaccuuuuuaguucuauauucaagacaccccuauaaaacaguuauuauuuauuuauuuauuauuuuauuuaauuauauuguuuucuguauaccacuaauauauuuuucauuguuguacauaauuuucauccuuuagggaaccaaaccaguucuaaaaaugaacaaaaaaauuuucaaguguguucuauauaaugaaaugguuaaaggauuuacucauagcuuuuccucucuuucuaaacacugguuuaccuuguaagcaugcauacauacauacugccucucacucauaucaaaccaucaucuuucucuuggaaaaagagauaaaaaauauuuuuauugcuucuucaaacauauggaaguuuagcacaauucuaaauguguaacaugagauucagggguacugaaguguuaagcagaagguuuccuauagcaaguuauagcaauguauauguguggggagguauauauaacuauguguacaaggagauauguauuacaguuugcauuuucaccaaaaauuacauaucuucaacacucuacaauaauuucaaaagaccgcaguggcuaaaaaccagaggcauauacuuauggcauuuggggaaguauauguuaaugaaaacaaaaauaauuuuacccauacugacuuaagacacaguaaacuaucuacucuuuucauuuucucauugguugauauaaugauuggcuucaaauaauaggucauugcugaaguuagaugcaauuaagaaagaaauguuaaguauuggucaagcaauaaaauauuugcuuuucaauuuuucuucugcauauaaucuucacuuuuuuccagauuaucacaaagauuaauguuacuucagaaaaugaaaaacaaauuuggagaugaaaacacagaaagggcaucucuccuccaagccacugagacugcuucuagaagaaaccuccgacucuugaagguaauucucaugacuuggguguggacguuuuccccgguccuaagguauuuacaugugucucacaauuuugacucacaucauuucuuuguuuuuaguaacuagcagaauuaaugagccaaugucuuuuucaagcccauguuaguuaggcaaauagcauauggauucuugcuuuuugaaagugaaaaaaagugaaguuuacauaagcuagauuuuguucugucaaccaaaaaaauucaaugacgacaggaagaauauuaaggucaccuuugugcaagaagcagcggaaaucauaucuuuacguuuuuucauacucucccuuucaagaaaggaccgcaaagaugugugugugugauguguuuagacccaacucaaauacuaagcagcacaaaaaugugaaccauuugauuuuucccaacuaauuccacaguaaacauguagaauucauugugugagagcucauuucccagacuccuuugggugguuguggaauagguggucaaaguguaugacugcauagggccucaccauuuggccaaugugcccauuuggaauaaaaucauauguguaacauuuuuggcugcuugcuauacugugcuuccagaauuguguggcuucauccauaauuaaaacccuagaguuugcuuccauucaagcuuccaagagauccuaugacuaaaacauuugguaguaagacuauauuauuuaaguuauaaagcaguguuuucaguuuuuauuguuaaauauuuucaucgauaggcaugauacagcuaucuucuauccucacuacaggauaaagggagaggaaaauucaguuaucuucucagcuucuggcaguuugauccacaguaauuuaagucacagccauagugcuaccaaagcauucuauauugccauaugucuuacuugcccaaugguguuaacaauauuuauuuuuaaauggaaauauauaggauacucuggaaauugcugugaaaaguuagagaaacuaaauuggaagacuugaucgcuacuaccuggagcaaguggugugcuguuugguuuucaaggguuuuucuuuuaaugagcaagcaucugaugaaugccuggagcugaaaguagagauaacagaggaaggcuccaucaaaguucuuucuugagggagguuacagauuagagagcaucagaccucucuaagcuccuuaugaccaaagacccauagucuagaugagcagaugcuaaguuaaacgagguaaaauggagacugugaggauuaagacugaaaauguacuugagggcuauuuuaggauauuuucugcaccuuucuaaaacauuuugcgugaauuuaugauucuggugugauuucuuuguucugaauauuagacauaauuaaugagacagaacuaauguaaaaauauuaguaaagaccucugaggugaagcugaagcucaccuguauuuaaauaauugaaacauucuacuggauucuuaaguuaaaaaaaauagucaagagcaaaaagaugaguggcccuauugauguuaguggaauuaugagcuaacuagcuugaaaauucacaagacacaaaguuguguuuguucagcgacuguaaugguuugaauaaaaaaauguuccccauaguuuacagguuugaacacauagucuccaguucguggugcugcuugggaagagucuauacucuuccuauaccuuuaggaggucuggcuuugcuggaggaaguaucucacuggaaguggacuuuaagagguuauagccucaccucacuuccaguuugcauucccugcuuccugaauguaauugguaugugaucucuaagcuuccugcuacacauacacacacacacacacacacacacacacacacacacauacacagacuuaaagaagauugacuuucuccuuagaugauucaggaauagugaaauaggcuggagagaaggcucagcggugcgggugcaguacaggcugcucuuccaguggaccaaauuugauccucaguucccacaugcuugcucaccaccauccauaacuccaguaugagggaaucggacaccucuuuugaccccagaggguucuuguacacacauagcacacagucauacacucagaaacacacacauacaucuaagaauuuuuuaaaaugaauagagaaacuauucuuuaauagugguaaggcuagaagcuaaaaaauaaaaauaaaaaaauaaaaagccaucaagccagucuuauauuuucuuuuauauuuuauauaaaauucaauuuuauauaaaguucuguuuguauacauacauguuuguguguguaugucuguguaaaguucaguuuuauauuuuauaaaguucuauagauuggauauaguaaaugcaguccaaauaaggaucccuggauauaauccaucauagauucaggaacaucagaguauaaagaagggaauggacuggccuccauaacugaaagaaaaguuuagugugcugggauuucccagacugucauagugaaaagaaacugaaaggacaaacugccugucuucauaguauccuacucauauagugaacacuuccugcauugcaggacaaacugccugucuucauaguauccuacucauauagugaacacuuccugcauugcaggacaaacugccuguuuucauaguauccuacucauauaaugaacacuuccugcauugcaggacaaacugccugucuucauaguauccuacucauauaaugaacacuuccugcauugcaggcacagugauuguugcuaggcaugaucuuuucccugccuuuguuugauacauuuaauuacauaugcacuuuuaaauccuguguugcuuucauuuuuaaaaaacuuucaaagcagcauuaaugguacuacuauagaaaucacuguaaaaguaagaugaagagaauuugaaucuuugagaauuuuguguugagagauauuuucuggggagauagggugcuagagaauagacccaggcccucauguaugcuaugugcacagucuaccaaagaacuacuuucuguuucccaagagagauauuguguagaggaggggucugggagaguagauuaaacccuaagcaagcauuccacuacuggacuauauccucagaccuuauuuuacuuuugauuuguauauuggggaagagggugccacagauuuuugugagggucagaggauaauuuauggaagacauuucuuugugcuccauguggguucuagagauugacucagggucuccccuuucgucaagcacacuuccccaugagcuugcuuuuccuucugaaaaaagggcugaguuucccagacugcucuucaacuuacuugguugccuugacaggaagugaauguacaaacaauaauccuccugccucagucuccugagaagcugugauuauaggccugugccacaaggcauagcuuaugggaaaaacauuaaauagcaugucuacuacauuaacugaaagguuaaaaauuauuuuuaacauuaaauguuuuucaaagguuuagaaauagauaaaagugaacuugagcugccuuugcucauucucacagaggagacucucauuuaccuacacucggcacagaguuauuuacacauagaguuugauccuaacaaaauguccugugaaugugauaacgugccugugaaucauuugugaaagacaaacuaguaugaauagguaagaugaaaacagaagugaagcaggugggaggggaccagcaagagggaggagagggagugcgaaggaaagggauggguacgcacagaagguagggacacucgcgcacacgugggaaugcccuaacaacguccauuaguuuguaugguaacuuuaaaauuauuuuuuaaagcaguaucaaaugcaggaauuuuuuaaaaggagacauaaggaaaagauuaaucccaugaaauauuugacaucuuaguuaauuaauugaaccugaagcaagacaauucugagucaaauuucagucaauaauugccauaaagagaucaugcacuuaaaaaaaugcgagcugacugacuuuucccuauuaguauccagaauaucagucuuaagaaacaaucaucaugguugugcaguuagaggagagagaggauuuuguucacauaaauacuucugugcuauaaaaugugaucucucccugcuccccucccagaaaacucagccucacacagcaagaccuuucgaucucacagggaagccguaugaacccugcaggcaaagacaggacaggaaagcauuaccaucagcagcagaaugggggucugucucuacugagaucagccugggagcagucauggggcaggcagugguugagcagggacuuagcaaacugucaucuggguggcccgugacagguacaaacgacuuuuuggguuuuuuuuguuuguuuguuuguuuguuuucaagacacgguuucucuguguagccuuggcuguccuggaacucacuuuguagaucaggcuggccucgaacucagaaauccgccugccucugccucccaacugcugagauuaaaggccugagccaccacacccggcuacaaacuacuuuuaacaaagacaaaggagacagcugaacauacaugcacaaggccugggcuggagucccagaaccauaaaauccaacaugagaguaaguuaauuuuugaaguaauuauaaaauauuguaaauguuugcuuuaaauuuuuuuucucucuugccuucaaauuuuggauuguauuuuauaccuaaguacauuguaacuaacaacugccccgcuucaagcccugguagguuagguuacuggguaagaguaauauuaauccaucccauaaucagcaaccaaacgcagacacuauugcauaugcccgcaagauuuugcugaaaggacccugauauagcugucucuugugaggcuaugccagugccuggcaaacacagaaguagaugcucacagucagcuauuggauggaacacagggcccccaauggaggagcuagagaaaguaccccagcaucugaaggggucugcaacccuauagguggaacaacaauaugaacuaaccaguacccccagagcucgugucucuagcugcauauguagcagaagauggccuagccagccaucauugggaagagagaccccuugguauugcaaacuuuauaugccccaguacagaggaaugccggggccaagaagugggaguggguggguaggggagcagggcaggggaggguauagggaacuuuugggauagcauuugaaauguaaauaaagaaaauauauaauaauaauaauaauaauaauaauaauaauaauaauagaauggaaacagaggaagguuugaguuugauguuuggggcaagagcacaucagcguuggugaucacugucuggaaauauucuaaaggcugcaggcagcagcaggggcuuggugugaguuacaaaccagucuccucaguaaggcaagcuuaggcuagccgaauguaacacagcaauacucaaguuuagaaaggaaaaacaagucaaccuuguguuccaguuauuuuacuccuucucauuugacuucugauuuguauuuguuuaaagagaaucugcucuaugucagugaccuuguuguguguaguuaauggcggaaacaguacacugaaugcuugauuccuuuuguaaauuuaguuguucuuguuuuucacaacuagauaucaaaucuaagcccuugaacauguuaggcaacuacuaagucacaauuccugcccuuuauuuaguuauuucauaaagauuugguuuuaguuauguguuaugcacaggaggcaggugccugugaaggccagaagcgggcaucugaucuccuggagcuggaguuucaggaccuugugagguaccugauauggguacugggaaccaagccacugagucaucucuucagccccuucacugaguuuuuaaaacaagccaguuucccaccauuccuccagggugacuuaucagucguugcuuuaucugagauuggcaauguuucagcucuuugugacuuuuuauuccucauacugggauuaggccauuauuaccaaacggaaggcucuccaaggcagccccagaugccucuaccauauaguaacagucucugguaguuuccucucuuucugaccugauggguucuugcaggcucccuguaucugccagccagacuuggaauuggucauugcuucaaggagcuuuggcuccuuuuggcaggaaauauauuuagagcucucaaucugggcacugggacuauuuauugcaacuucuuugauuuuccuuuuugagauaagauacaacaagaacuccuaucaguaauuccaauucaguuaaaguauuacaagguuuuuaacuuaaaaccauugauuuugugccccuaauccucccucccccuauacgagaaaccucaguucugaacggagcgggauagcuuacaccuguaaucuugggaggugaaggaggauggcugugaguuugacacaagccugagccgcagauugaaaccuuauuugaaaaacaaacccaaacccgugguccucaaagagccccccaacaucaccuaccuguaugcaguaguccucuuaaucuguggggcucccagaugcuccaagaugucccaccagacaugcggaaccguggagaaugccacauccuauguacaauguucacucauauuugcacacuuguaaugaggcuuaauguauaaauaaggcacagaaaagaaucagcaacaauaaaguauggagguuauauucuaauaaaaacuggguggaugugguuucagagggauguauuguacuccccauuccugugguacaaaugagugccucagugauggcaugaaagugaggcaagugaccacagacuugccaaccacccaagggucacuuagacaaaagcccuguuauacuugaaagacagaugggacaacccagacaacugccaagugaccaguguagcauauuuacauacuguguacauaacugacagagaugguaugcaacccaaggugugaacccaggggaagucaugaaauuucacuaugccacacagaauggugcacaacuuaaaacuuauuaguugcuuuuucugauguacauguccaagcuggauacugaugccaaggcccacauaugcugugugcuagcauguaccauacuacugagaugcaccccuaguccccaacuuucaauuugcuaucugcaguccacugucaaccgugaaaucugaaacuggacaucaaaacuaaagauaaggacaauugcugcacugacuguccugugauacaggcaucacuacugccaccauugugaccauuggaaguccuuuguaguaggacacuuuguuucuagggcuuguccuaccagggaaguucagucaauacuauguucaaagaccugcuaauaguuaugccacuaccaagacaguacaucuguuuugcuugguugccaacuucugaugcuugcuuuuucauguucuuuaacugcucagucuucuuuuuaauuaauuaauuuauuccacaucugcaguuucuccuaccuccuguccucccaguccucucccccucccccaccccauccauuccuugucuaccucuccucagaaaaggugaggccucccaugaauaucaaacagcccugucauaucaagcucuguucagacuuuuaagggucaaaguggcagaucuguaagacagagugauaguucauaggcaggugaguccagcuugcuccugcucucugcucuagacuuuuccuugcucaucuuagcaccauuuuuuuuucuuuuuuaaguuucugaguuugcucaagaaacuuugcaauugugguuauccacucagugacuauuuaaaugcauauaaaagagacguguaccauggauacagcugucauugaggggauguuguguagcaguaucaagggacauguauaccaugacuacaguugucaucgaggggguguuguguagcaauaucaagauauaccuucuuacagaaugugcucaucaaauuguggucuuuuuguuuguuuuacuccagucgggcaaaggaagccacauuucacccuguuuaccugggcauccauuuuuucugagccuaagauauaugaggauagguuucaagugguuguuuaaccaacaagucgauccuaggacaauuaugaaauaaaacaaaguauucucucggccuguuucaaagcaaauacuagaugagcgcuugaaugaacgaaucaagucacacgacugaggcgcuggggaugaaguggggacaguggaaggcaucuggaaaggacagucuagagagcuauguggucaugcuagcaaggugccaugaagaugggugccacagaagcaccuggcugucagacgccagccccaagcagcccacucaaugaggggcuuuacccaguagauccaugaaaggcgagguagaagucuagcccuucgcuacaauggugcuggaagcuggguaagaggcagucacgagagaagagaguaaacaugggaagacagacaucacacaguuaagaaagccauacuuagaaguaaaggaagaaaagcaacccagcugaagaggaguggucaccuaagugcucaguucagggaugugguagugccgguagaugcuguaccugccuccgcuggugucugugcaucugcuucucugugcaauaggaaguguccuuauuuucugucuucaagaaaaaacccugauaauaucagagcuaagugucacccagaucugccccugacagcaacaguggagcuguucucagaauccugucagaucugaggccacaaguauucuguguuuuguuuguaagauuacuaacaauaaauuauuacuuuuacaaaccuuguaaaaucucaauaaaacagucacagaauagucauaccucugcaucugucauggcauccgcauguaucuuuaacaugcauccuagcuguaaacuucugguaggggauagacaugcuaacaucaguuuuuauauuccugaauuguguauuuuuccuucaaaucaccuuccccuagacagcaggugcauuaaugguugugcaacuuuggggagucccuuuagggaauuuccuguuuuuccuuuuuacauuucacacccaucccuuacucccgccgcuaccaucugcuaucuuuuuucuccuguucagcauuggcuucuucacaccccacucccacgcccucuucauuucucgccgucuguccaacagcccucuacuuagauugcuccgaugcgugugcauggaucaagagaacuuugugcuagcaauacacuaagcucagaggagacacagaaugugccaagccuugcaccagaccucugugaacuuaacauaguaaguaugcucuagacagcagugcugcugguguggagagcauuucuuagccagacucaaauguuucuguaacaacaugcagagccccacauuucuuugcuuguguuuaagguguguagggaaggaaaauuuauaccagguuaagcuuaauugcgcugcuguuuuuauaaccauaaaaauaugcuuaucuugaaauuaaacuccaaauuuaaguaugguucuuaaugccauccacuaaguaguguacugccuagcagugacacuuccuauugguaaauaccauccuuuaaguaguguacugaccagcagugacacuucccauuaaauuaacaugaaaauccaguccugaagaccuguaggugcuuuuaccacacagccugagggcugcccauggccaaggauagcuaguauacagccaaaggcagaauugcaaacuuuuacuuaaaccauuauaaaaugggaaggaguguaacuugaucauguaguucucaaacaugaccucgguagauguuucaaaaugucaaaaggugaaauagaauauuuuuuaaagcuccuguuacaaaguaguaagauaagucauuaaggagccauaagaaauauuuacagaaguaccaccauguucucagguuaaaugaaaaacccugcacuugcaguggaaguggguuacuugauuuauaauaaaggucccuaccucuguguccuccauuacagcgugaauucacugaauccaaaaaagggcagaggugaggcuuggaguacagacacuggggguguaggugccauuuccauuacauauaaauacacuuuaguuuuaaaaugcugugucuguuacaggacauagaugcugcagaggaggcuuuucagaccaagcuuaucccacacccacagccuucgaugcuuucucuugagguaagacccuaaguuaacucuaacaagaauaacaacucuaaguucccugcaagauaaacaagggcuucccagcuauauugcccagguuuuagucaacaagaaaaguaauaaaggauugguuaauauuuuuauguccacaguacaauauuuuauauguuguuagcaauuaagggauaucuugaugaaaaaaauuaucuaaucagaauugauaauuuuaaaaaucuacauccaguuuguguuuaugaaugcaugugugcagcacauauucauacacaagugccaugcaugcacacaugcugugguacauauguggaggucagaagauaaccugcaaucauuguuucucuccucccgucauguggauucugggacucaaauucagauaaucaggcucaguggcaagugucuuaaccugccagcauccuaguucucugauggaauacagaucauaucuaucucuagcccccaugucccucccccuuuaaaauaaccuauucaguccaguuagagcugcccuacaugugcauggaugugagggauucacugaagcauggcaaacuuaccaguuaccaccucaacaaagagugagucuugucccccagcaguuacccacugccaauagcucuucaucucuccccucucugcugggcuucuggcugccuugauccuguguagguaaccacagcagcugugugcuuaugacugugauagccaugccauguccagaagacagcauuucaagcacucaucaucacccucugacuuucacauucuuuuggccuccucuucuaaauagaauugcccugcagagguagacaaugucaaugacaugagcuuuuaaaugaaaacuggaugcuuccugugaguuauuggucaagaagccugcaaagucuccaagacaacaaagccuauugcuguugccaucauacuugguuaccuaccauagugcaugauaagaugcuacugcugcagacaccauacucuuggcuucuagauauggagaagugaauuuuaaacugacuggaaacuuccucccugcugccuagguuucauagugucaggagaugcuauguaggcugcuggaagagaaaagacaucaguggucuuacguaguacuaaacccuaugugcuccacugccaggcugccaggaaagacaugcccccugcuauaauaauguuacaacuguuaaugggguaacuaacugcuuucucauuggauuucagaccugcuucacaggguggaauuucuuguuugauacuggaaucuuggucaaaaguccauggcuguggaguccauaggcccuagaauauuguuauuuuccuaaaugggcaugcugucaaaguugccuuccaaauauuuaugccuauacccauauacccauauugacugcugucagccucagucagagaaacuucuuucuguaaugggcaguagucagugcagcugcagaacuaacuggucacagugcugaggagagacucggugcucauccugaaugggacaucaauauucaccaaggcucagggaacagagagcauaaauguuauaaaaaucuugucuugucacauugaagcagcuguccuaaugaaccaggacuauaggcugacucuucacauugacauauugcccaaccaaggagugcuuguuggaaauguaaggaggaacaauagcauuccuagaccaggcuguggccaaagccauucagaugcaaaccaccaguuacaugguagaaggcugagacaggagacugcugugagucuacauguggagaaaacaaaaauggaagauaaaagaaagaagaaaaaaaugucuaccuccaugcuuaucacccaauacaaacaacuguauuagucagauuucaaaagcagacuggaagaagauuggccauacuugguacuuggaugaguuuguguggauaggaauuuacuacauggaaaauaguuucauuuucuacuucuaaugagcuuucucagauguaauuuuucuuuuugcccaaucagggauaagaauagauucaaaagucugaggcugagaaucugccccucaauuuucugugucauuuaggguaacaagaagaagcagugauccaaugcggaaaaaucucuggcucaaaguugugcauuggguauguccuccuuuguugaguucaccaaugccuuauuuuagcaaauacagggcacacaauagugguuaauucagccgugaauggcacagaaccccccucccccaucucuggccuuggauaguauucugagcuacucuggcacagcaggguaaccuuuaucuuacguaugucaagccguuucucagaccacaugcacagauguauagauauuuagaaucucucacgccaucuucaaacaucagaaccacuguaucuuugucgugcucagaaugaaaacuuauguguuccuagugcuaucugauucaaugcugaauuauccucccccaaguacugauuauguucauccaauagaaaauaccaucccaugaugaaaacuuuggcaccccaagcccuccuuuacacagugcagcaguagacagccaacagucagacauauacagcaucuuaauuugcaagcaguuuccaucaaaauggguacauuaguuauuuucucauuauaaaaaucuaaagagcuggagaguuaacugacucagcagguaagaggacuugcugauuaagaccugaaauuggaucccagcacccacuuaaagagccagacauggcccaaaugccguaaaccccagcucuguggagcaaaacacaggaggacuacuauugccaggcuagcuccaggauuaaaggcacugucucaaaggaguaaggcagagcaugguagacgggacuucgcaguauccuaguuuccauggacaugugugcacacacaugugcacaugcaccacacauggacacuaaauuuguauacaagcacauaaauuuaagaaaaaugacaauuugucgugucaaguguucuuuuaaaagacuuguggauauuuaacaccccacacaccuugaggcgccaacuuacguguuauugcauucuugaucuuagguccaggucucauucucuccuguuaauucuaaggaaauugcucauguauaaucuuuuauaaucauuucacuauggauaaccccaguuaugggauguagaauuguaaacaaaaacauuuaauaacagguaccauaagugacaguacugauaauaaucacaaggcuggccacaagagggcguguaaaaucaaaauaaaauuuaaaaccuuaauucugccaggcucugguuugcugagaaauuugaaaauuaacucuaguaaguagccaguucuuucccccaaaauuaacauaaaauauacuaaagagaaaaugcacucuacauguacgugagagaguguguacaggugcacacauacacacugaagauaauaaacauuuaggcuguugugaagaaccaaauucaacaguuugauaugcuuucuuacuuuuuuuuuucagacucguuacugggcaucaguagaagaacauauccccaagugggaacuguuucuuuuaggaagagcaccauauccaauuggugcugaaaaucaaaaugagguaccauucguucaaaccgaggcaaaguuguaacuuauucaugugcucuuugaaacuuuuuuuuuuuuauaaaacuauguaaauccauggcggggacuuagggaagaaguuucauuuuguuauuguuuucuauugucucauuguuuccucagcagcaacgucaguuugagagcccucugaaaggucucagguuagauccuugcacagucauagacuugccaagaaaaguguaaaaauuaaugguaagacauaauguuuguuaaauaugguauuaaaccaguguuaugugugcuuaaaacccacacccucauucccaacuaaacagguuggcugcagguauccuaaaguugcgauuuuucaucauucacuuugggaacagaagcaggaacaaggugcugccuuccuuacaugaaagucugccacgcuuagcugcucuuguucaauacuaguuaucagaaaauagauuccugggguugugugcuuccuacagacuccuccaaguccuuaacucgaaagcauucaauauguggccaguuugggacagcgcgagugguuuugaaaaaaaaaaaucuaugagagcugggaauggcuacugaauucugacaggcuuauuugaagauuaccaacguugugaaaacaaauaccccuuccuaaaugucaucuuucaacucguccuccccuccuuucuauuauuaucucuaaaacuuaagaauaaaacccagaaagcuguggaucacggcccucuugagucuccaguuccuuccuggcugccgagcacuggggagaagacagagcgagcuuuccuagcuguggagacagcuucuagugagggggagccuacacuguuccacaguggggauuccagucacaaaugugccuucacugugguaaagguucuucuuuuguuuuuguuuuuuguuuuuauugccuuuaagauaaaaaucucacccuguagaccaaccuggccuugaagucacagccauucuccuguuuuagccucugauaacugagauuacagguaugagccccaauauuuaggucauuuguauuuuuaaaagaaaacaacagaaaaaguuaaaaugcauauaagcccucacuacaacaaaaacuaguaaaucauccauuguguaacauguuccuguucacugccaucuuggaaauguccuguugaguggguguugguguggguaacaauaacauuguuuucauaauaugugcuggcagauuagcacacuucucugcaguguuaacaguuguaauuaaggaauaaacagcacaaggugucaguccgaugacaauuucaucuauagugucacaauacaaaaugucacaaaauauuagagcuguuacauacauagcuauaaaaaguaucggcuuaagagcugaaggcaucuuuaagagaggagacagagaggaggcaauggaacacugacuuagcggccagaacaauuuuauacauucucaagacugucaugaaaacaaauugauaauuuuuucuguuacauuacaguuugggcuccagccaugcaguugauuuagcagggaaaugcagguuucucagcaacuccaaaucaguaaacagauuuagacguagacaggaacacgaggaagggcucuuuuuaaacauccagucucccagcauaugcacauaaaaaggugaaugaagcaacgugaaacguacuucucuucagucaagugaaaaaggcuaaacauuuguuagcugguaaaauauugugucaaguaagccggaagauuccaaaauuaaacagugguugauauguuaacguccucaaauauuugagugcacacuuccuuugagaucuguaaauuaaaucaccaguagguugaauuacaauacaaaaugaauggcauuguaaccucucagaaaaagcuuuguguuuucuuucuccccacacugauugacucgcuagcuuggcuuggguauuuuuuaaguauaaucuaauaaagcuuacacaauuuugggca

SEQ ID NO: 7263 - RNA, 4421 nt, Mus musculus
guuuggguuugggcggcccccaccuccuuccaccggcaaaaccaucacgauucuucccccuccccccucccucucuucccuccuucccgauucgcaaaccgcucgcacuuucccgaagggagcgcgggcgcuaguugccuccuuuaaaguuugaggggcgguggcggcggccggcaggcgcgggggaacgcaggguccucaacgggagucgcgccgccgcccaugucauuccacuucaagugacuucaugugaugucagcugaauguaaaagacagugaucucacgcggaggggaagauguuugccaucaaaaugugacagaagagacacgcugcauggcucggaacgcaucuccuuggcggugggggaaagagguaaaagcgaggugguucuuccggcccucuuuaacuuugcucuuucagugcccaguucccagcacgcguggcgaaggccuggguccagggaagggcugggaguguuaauuugagacuccuuucuucuaccccuucuccuuuccuuuguacagccucccccuucuucccccuuucauagucccagggcaauagcugguggguuccuuugcgcgccggguuaaugggcgguaauuugguacccuugggugcacuuuguucugcuucuguucauuugaaugcaaaugggugaccgggccgacuaggugcuuauuaaauugcgguuuccccccugccuuuuccggaaugcagacuuagaggagagaggcugugcccuggcccagccuggcccagcuuggcgcgccauggccagcucagcuucccuggagaccauggugcccccggccugcccgcgcgcuggagcgucaccggccacuucuaaaacacuagcuuucucuaucgagcgcaucauggccaagacguccgagccccgagcgccuuucgagccccggccugcugcguuagaggcagacagcagccagagcaagaaacugcucaaccucugcucgccgcugcccuguaugaucccucuccagccucuaggcuacgaggugccguccaagacgcugcucaguuacucggaguucuggaagagcagccuccgggcgggcggcgguggaggaggaggcagcggcgggggggccccagugugcggcgccagcggcuugugcaaaaccaacuguggcgugugcugcaaggccgaacugggccucgcgccuucugcgcugcccgccggcagggucaucaaaccgcaggucaucaaccaggcuguggggcugccugccagcggcucucucuacuacuucaacuaccuggacuccaccgcuuacccaccuucggagcuccucggaggccaccuuuucccauccggccuccucaacgcacaggcccccacuucccuggcugcucaccccaagcuuuuucugcuggagaacgccaaacuggccagccuggcugcggacaaguucccccacccagcuuccuauccccauaaggagcgcuugcaugcgccacuggagcaggugcugaaggagaacucggccuugacagcugaacgagggggagucaagagccacagcaaacuaccggggggcucuacugacagcaaacccaaaaacuucaccugcgaagugugcggcaaggugaggccuacgguucuggggggagggagcuaguagccccugacuuucuugggcugccuuguacaccuuucucucaagcagaggagcuucccaauagcugcgcgcuccguucgaugcucaguugagccucaguuuccuauucuguaaaauggggcuguaaaaucgccacacaguugacaaaaggacuugcuggcuucagaugggaugguugguuaagggagguaaauuguagccuccgggccugauucuaggcccuuggcagacucagccuaaguuccgcucucauccuuccauagguguucaaugcucacuauaaccucacccgccacaugccuguccacaccggagcuagaccguuugugugcaaagucuguggcaaaggcuuccgccaggccagcacucucugcagacacaaaauuauccauacccagguacguggccccuagaucaggcccagucggcgaacaucacugcccuagucugagcgguaguauuggauucuccuuaaccuugguggggggcucuacugucccuugccuaggucucagccuuacuguacgcacgccccucuucgcaggaaaaaccacauaaguguaaccagugcggcaaagccuucaaucgcagcuccacgcucaacacgcacauccgcauccacgcgggcuacaagcccuucgucugcgaguuuuguggcaaaggcuuucaccaaaaagguaagguacuaagcuaggcacucccucaucucaucuuuaggguucagagggucgcaggggagggggagugugcugagaaugaggugagugugguagaggcagcacaaaagccgcaggcuagggcgcagcaauucuuuggaauaggguugugcagacagagguagacgcuuuccuggcuggguugguagaccucgcuggauucaggcuugacucucgggagcacugaauuuuggagcugagaauuaaggaaaggggcaaaaaggaaacauagagaguauggcuucccuuuguaagcacuacuuccuuuuuuuuuuuuuuuuuaaucuaagcaguaucuuccuauaggaagaauuuaagauugagagguuuggggguugggggcaggucaccagugcucccagacccugggacucuacucaauuucaaauguaauuuuguaucuugagauagcaauggggauguggggggggggcggggagggucgguucuaagaacagagcuaccgagccuagauuuuugcggauuucuuggagcgaggcaucagcucuaagaacccacugccuucuuaggcugcacaaaaguuucccagcccgcagagcucggcaggaggaacgcuuugugggccucugcaccggcagagcagggccugugucggcuggguaagaccugguccaccguccuuucaggagcgcuccggccuugaugcagacgaaguuugacaacuucuuaguuuggagaggucaagccugccuagucaagcaucgccuucugagcuacugcagggacugagggcugguggugcaggguuugggggaggucuuauuccacuacaaaccccuacguuuuuguuuuuguuguuguuguuuuugcucuuccguagggaacuacaagaaucacaagcucacccacagcggcgagaagcaguacaaaugcacuaucuguaacaaggccuuccaucaggucuacaaucugaccuuccacaugcacacccacaacgacaagaagccuuucacgugugccacuugcggcaaagguuuuugcagaaacuuugacuuaaagaaacaugugcgcaaacuucaugacagcgugggucccaccgccacccccucagcaaaggaccuagccaggacaguucagagcugagagcuacugccuuguccguucuuccugcccuguaccaacccaagcagaucucacguauaaacuuauuucuaaaauuaaaagaaaaaaaaacuauagcagagaggcuaaaaucuauuuaucgaaaccagcauauuuuuggggaaauguaaacguguccucgaugaccggcacaaacgcguggcucccaccuuuguacauucaggaaacguauuuaaauccagugcgcugaaacauauuuaauuccaggccuccgcuucuccucaggcagccggcuuuuaaucccagccugucaccgugagcgcccagaagagcgugaugccccugccaucuucacucaaccuuguaaucucuccuguacaagcgaacacggaauauuacauauauaugacucaauaaauagaaccauuagugcgcgucuucuuuuccccauccccucgccacgaggucagcucaacaaauccaaagaaggagguggaacuaagcauuuauagcuuuuccuuucccaaauguaacuuucuugggacaccggggccaagcuaagguuaaaccguacuccugguaugcugguauauuaaagcacccaggagcaugggccgaaacacuuccauccggcuccaucaauagcccaagguuugauuuggugacugagcagauacuugggauucuuauuugggugagaaaaaaauuuaagggucaaaaguggcuggaugcuguggaauggccuuuggguaucccgagcguaacagcaugcaauuuaggaaaaaggcugggguuuaaggagcgcaacccugguccuagccuccucugacagagacagcuagaggcuguccagccuaggccgugcuguugagcucuugguguccuuugccugcacuucaggucugggcuggcugaucgguaagcggcacccugccgcgggagggcgcgcccagcucccggagcuggccgaugugucc

SEQ ID NO: 7264 - RNA, 522 nt, Mus musculus
ucucaguuuauauucuuuuuuuuuuuuuacaauagacauuuauuuauagugugacauaggguagaacaaauaauucuuaaauugugauuuggguugaaauaacuuuguaaaaguauggugagaccaggcauacccacagaucuuaaauaaaugaucacuucuuugcccacuccucucucuccuuucuuucccaaauaaccucuuuuagauaggguucaagguagaauuuguccuccucauauuuuguccacugauccuuaggcaagaucugaugccucauagucagguccagggcucucuuaauuugaaacauccugucauuauaaagguccucagaaagccuucuuauggcuucuuuuacaucuucaguuucauguaguguaucauuucgcauuaaccccagauuauugaauccugcagcauuauaauaccacuuucgaaaaccuuccagccacuugcuugaugcugaaacagcagaucggcccaccauuuugaccugagagugaagcgcugccuucuccu

SEQ ID NO: 7265 - RNA, 84843 nt, Mus musculus
aacagcauuucugcagcagccagagcccuugauucaaccaugcuuccuucccagcucuucuuuguacugcuugcugccucagguuaguguuugcaucauuguuacuuaacuacggaagcaauagucggagugucuuccucuggguuccuuuucacuugcucuagaacauuugauggggauagucuuuugaacucaagggcucccggguuguaccucauuggauaaucuaccuccuuaucaagauauuuucacagaugcaguuuauagaugggcaucagagcaaguucucugggagacaguuggccauuucuacugguaucuagaaucuggaaccucgggagacaaacuucuacccguggaagauuuaccuaaugaacugcacaacagugaaagauguuuguggcccauuuguaacuaggggaaauauugccagaaggcaaaauaacucauaugcuaagaauguagcaaggauuacuuuggagauuacaggaagaaaugguagaguuggaaaaauggggaagacuauauagaugauuuaaguuguuuucuauuucauauauuuucuuacugauuaauguaacagauucuacuuugcaugaaaagaacacguaacaugucuuacuaauacuuuauuuaacauguugaaaugauauuuuaaguacuuuggaucaaguaaaaucaucuuuaccaucuuuaaaaaagauucaacaauguucuuaaaacaacaacaacaacaaaguuucacuucguggaccugguaagucuggaauugaauagguaagccaggguggccuugaacucacagacaucuaccugcccccuaccucugcuuccuguagcacacagaaaggauuaaagcugugccugucuguuuugauuuuuuuuuaaacauuuauuuauuacauguaaguacacuguagcugucuucagacacaccagaagaggacgucagaucucguuacagaugguugugagccaccaugugguugcugggguuugaacucuggaccuucggaagaacaaucgggugcucuuacccacugagccaucucaccagcccccuguuuugauuuuuguugaaagauucugacagaauguaaaaggucacagaagcccucaaauuggcaaaauagauuucauuguuagcagaacuagcuucacugauuuagaaaaauagaggugcacaaugcucuggccacuccuagaacccaugugucugccaauguucugaccguuccuugaacccaugugugugcccacugaugaagcccauugccagguguuugugauauugguugcuggggaagaguuagaaaaucuccccagcaaccacagccagggccaauccagaguugcugcagcugcaccagacucuuuccuuguaccccucccauacccauuucuugagaauagacauuguuagaucuggaaaucucccccugccccccgagggccuauaaaaacugggaccccuuuccccucagggccgauuccucuaccccugagugggauaugagucaucuccagagcucuggcuccccccccccccaauaaagccucaugugguuugcaucaagcuuggucucucgugaguucuuggggguccgcuauuauccagagacuugagugggggucucccuucggaggucuuucauugugauggggccucauucuauaguuuagacugcccucuaacccacagucccuggccucagccucuuggcuaggacaauaaacuuuugccacucauuuguauccacauaaaacauucuuaagaugaauggaauacugcggcugagcccaguguucuuguauguacagacguauguaugcaucuacacauaaguuuuauaaacgauuuucauauuuuaaaaauuuguguuucuaaauuugcauaacaguaggacccacuagcuacacagagaaacccugugucaaaaaacaaaacaaaacaaaacaaaaaacccaaaaaaacaaaaaccaaaaucaaaaccaguaggacccauauuccuaugugaguugagaguagccacccugucacauaggaguucacuuucaguuucuuacaauccccaugaguuccugucugacaaggaacaaaguugcuuuucacagcaguuuuauuaugaaaccaaguucuuuggguuuuuuuguuuguuuguuugcuuuguuuuuuuuuuuuuguguguguguguguuuuuuuuuguuguuguuuuuguuuuuuuguuuuuguuguuuuuucaagacaagguuucucuguauaacccuggcuguccuggaacucacucuguagaccaggcuggccuugaacucagaaauccaccugccucugccucccaagugcugggauuaaaggcguacaccaccacugccuggcaaauucuuuguuuuugacaccaaauauacuuuaaaaaagcuaaaucaauuaauuuuucagugcaaugggcagugaggcauuauuagguacauaaauaagcaccuagcuacauggcccaaccuguagaauuggaccguaaaaucugaccuaauuaaauggcacacacuuacaagcuuucaaaugcauucagugucacauaaaaucuacauaacuagcaagaaagaaucucuuuauuuacuccguuacucauucagucaaguauuaacuggguaccuacuaugggucagacacuguucuuggaacugggcauacagcagggaacaaacaagcaauugucucuuauuuuugaagcuuguauuuucgguggaaguagagcagaaaacaaacacuacgugaaauuguaagagaaagugcccacaauguggaaauaucguuuuugugcugaggcaaucucaaguacagugucucuuuaucagagacauaaaggggauaaguggguggugauuuccuggaaggaugcauucugggcuucugugguauguaugaggaauaggaaggcaaacgugguuggaacagacugagcagagucaggggcaucaaauaugaggucagacagauaaagcaaggccuacccugugguauuuaacauucuuauuuuauuuauuuauuuuuauguguacgagugcuugcccacaguaugcuuguggcgggcaggggauaagcucuggugucaaaucccaguuucucccuugcuacaggaggcaggguuucuuugcuguuuucugccacauaugccaggcagcuuggagugcuaguuucuagaauucuucucuuucagccucuguuuaggaaugccgagauuauagacaggagcuaacauggcuggcuuuagguggauucuagagaacagaacucaagucuucauguuugugaagcaagucucacugagugucuuccuagcccuaccagaaaaggcgaggaaagccucuagaggccucuagagugucuguuauaaaagccaucagugauuuaucuuucucaauguuugcauuguuuuucagugucuuuugcuucccucuuccacuuuaagaauccuuacaaugggguggaacagguaauacaagacaacuuccuccuucugcuuaaucccaacuucaagguuuguugugucguaacagcauauuauguacuaugggaguuaggaucuagauauuccugcuagggcaaaggggucauucugucugucgcuagcuccaguguaacaaaauaagccccccuccacacacugccagcauacacauaccuccggaaugcauauuuuaaucauagaaaaaaaauuuaaagcaggcuauuaaauauacagagggaaauccuuggucacaauccgggauggaacuuuccagauaggagcuugagcagacagagugcauguguccuaaagcagguacuugaaagccgaagagauucaggcgggaggaggaugaaucauugauggcugcagagaggucugaaccauuaggauuugugucagaucuuguaagagucaggagaaggucucuuuggagcgcagguguauuaauuuucuagcacuucaaugccagaggacaccaucgagcaacaagguagaggugccagcagauggaaguugugccccugugcacuaaacuaauaaaauccaaaauggaguuugcuuugcacacaucuaccuaaugucucuuuccugagugauccauuuuccagugagccuuaguaacuuggagugggaaugaagaacagaugggagauggaauuccuaacuucccuaacaccugguuuacaucagcaucacacaauggaccaaauaaacugaagugguaaaucuguuuacuuuuaaacucauaagcuuauaccucuguaaguaaggaauucugagugcuuuuccuauuguuuccacuuaaucucuuucccuugucuuaggucuagcucaaacuucaaugacuuuauugaacaggacugggaaacaugaacauuccuguaggauuccuguuuuuagaggaaaugcuuugauguuuuuccuuuagauauugacuaauuguguguugccuucaucguauugagauauguccucuguauuccuagaguuuccugaacuuuuauuaugaaucuuggauuuugacaaaggucuuauuugccucuaaugaagugauuauaugauuucugucuuugaacucauuuuuguggugaauuacauguauugauuugcauuuguugaaacacccugcaucucucuugaugcuuccucgaauuugguuugcaaguauuuuauggaaauuuuuuuugucucuauguucuaauuuuaguuuuugguugggucuuuauguggcuuuacuauuaugauaacacugguuucacaaagagaguauggaaguaauuuuucuguuuuuauuuuauggguuacuugaaaaguagugauguuaguuuuuuuuucuuugagauucugguagaauucugcauuguaucaauuugguccugggaauguguguguauguguguguguguauauauauauauauauauauauauauauauauacauauacauauuauauguacaacuaauauguauguacauauauaguauauauauauuaguuauaguugaaugauguuuaacuauuggcucuaucuacuuggauauguuggucugcuuaaauuaauuacuucaucuugauuucucagggguaggucauauacaucuagaaacuuauccauuucuuuuagauugguaauuuuaguauagauuuaaaaucuauauaaaguauauccuuuguauuuucuaaauuuuucccagugacuguuauaauguuucccuuuucauuucuaguuuuaauaauuugggccuucuccuucuuuugauuaaauuugacgaaaguuuuguuaaucuuguuaauauuuuuaaagaacaaauuucauuuucaccucuauuucauuaauuucagugcuaauuuugauuuucucuuccaguauaaaauuuuuguuuuuuuuuuuauacaaugccuucaggugcaucauuaggcaaucaauuugauauuuguuuaauuuuuuuguguagacauauaauucaguaagcuuucucuuaggaugccuucauuguuucauugauucauaucacagcuuuccauauauuucauuccauucuagaaauuuuuaaaauuuccuucucuuuucuucucagacucaauuaucauucaguagcauguuguuuagucugugcacuuucugucuauucuauuguugauauagcuuuguucauauagaauacucuaaauguuaucucaaguuuucuuuauuuguugagacauacuuugugguugauuuuagaaaaaguuucaugggaugcugagaagaacaaguacucuuuaaugucugaguagaauguuuuauugaugucuacuagguccauuuaauuuaugauaucauaaguacaucuagguuugggaaagcuucuauuauuggauugaaaauauccucuaugccuuugcuauuguauucuucuccuaccucauaacucaaaacuuaggccuuuucauaugcucccaagcucuaccauguggauucauaugcuuacuuagaaauucucauugauuauuaaggcaugauucaauucuuuuacuuuuucuuguagcccacuuucuguuucugacaugaauuguuuuguuggggaggcuuuccaacuaguuuuuaauuugacugacugaguuuuuaauuuccagcaucauuguaguuuggccuuucuuuuuuuuuguuuuuuguuuuuuuuuuuuuuguuuuguuuguuuuuuguuuuuucgagacaggguuucucuguauagcccuggcuguccuggagcucacuuuguagaccaggcuggccucgaacucagaaauccgccugccucugccucccgagugcugggauuaaaggcgugugccaccacgcccggcuuaguuuggccuuucuuuagcaauucuauuucucuuuugaauuuaauuuauauaucuuggguugauucccuuauuuaauucagcucuuuguuggggguuggucagauacugcuaugcauucaaaugcuaaauucuguaccccaagaucugguugcuccaagaugagcaaauuuccauguacaucagccuuuguugugcaaaucuuacuccccaauuuaaaaacauugguuaaauaaaauggcuacaauuaauuauaggggagaauagagagauggagcuuugaguuaugcauucauuaugugugugggggucagaggcagggacaguuggagaaagaaaaaaggagagagaaggagcacagaggaagagaagaaugagagaacaggaugucuccauuagucaugaugaaccagcagcaugguccagaguaaaacgccucccaagaacaccaguguuggggccggccagcagcucgaacauguccggguucgagccgggaaggcaucuuggaaucuggaagaaaagagggagccuaggcgaguugagaaauaauggaaccaagacaugcuagccugcucaagguucaaauuuuuaauggcggacacgcuuuauaaaagaggggggaaaguccauuccugccaauucauccuuggagccuggaaccagcugcaggcgaugacgugcaagauaggacauagucuccagaauagcuccgggggcgggguggggguggggugcgccucucagcagguagcaguaucuugaagaggaaccuuggagguggcagaacaauagagugaucuagguaggaaggcuccacccuagauaaucuccuuaguagcagcagggucaaauucuggcuagccugcuucaggcuuaugggaggcuacacaccagaccacuggagcagaaauaacugggaagauucagaacucaaguauuuggggagcacaauuuaggaagucaucagucuaguguuagaaaauuacuagggguaauccccacuaauugggcagagccuaaugaauaagucauaguuugggucucauucacuugaagcuagauggggauaagccuaguucuuuuccuuugcugggaugaccuuugcaucauuugcucauaguuaccauaauucuuuguaagaucccccaggucauuuucaaucagauuuauuacuaugaaauuaguaacuucugugggugacauacugucauguuuuuguuuacuuuuguuucugugguaggacuugugcaucuggaauaauguguuaguuggguguuucuuuugcucaagucaucuuucuucuuuccggauugaaaaguacaauguucaggauuuugaggguuugaggccuuguuuucuuauguggaacuugugcugaagauuccagguucucuuccuagucuuuugagaguccucuauucucugccugaccagcauucaaagggcagcacauucuucugcugccuucugaugugauucacuaagucuagcugcucuguguagagugagcucuauucaacacaaaggguggggacagcacacauagggaaaauagggaaguucaguguguagucaggaggauugugggagagauguggcuccuuggguggucaggcuucuuaugaaaugauugcagggugggcuguaucacuuguaugaggugcauggcucugaguagucuucagguuguaggagccaguacugaaugcuucauggagcuagcuguaugagguacacagaucaacagaguucucugcuggcggcaagagccuaucugggugggcagguggguagugccaccugugugguauggcuccaugaggucuucaggggguggaccugaaaugguaaugcuaagagggaaggccaaaggguuuuguuuuuagggugccaacauaaucuugucaauuucuaagaaguucugagauucuagccagauucugccuuaguuaaagacaagagucaguugaaauuaggaaagaaaacgaggaaagagggaaaaggaggaguaaagaaggccaguucugugaggugcuuaaugacucuuugcucugaacacauugugauuuugagugauaauuucucaauacugcaggguagaugauauucauagaaaacaaugucacuuggaaagccauuucuaucagccuuucacacagugucuaacaaaauauauagugacuuguaagaugaaaucuacaacugcugugacuagacuaggaaauauauauugagaaugauggccaaugaucuacauuguaguaauggugaucagaugcccaugagguucagacaaagacauuucuaauggaaugacagcaguugcuuuccagcuuuagaaagcauggguagcuagccuaguguuuguaaggcuaguaagagggaagacggggaccugagucaaagugugagauucaaaaauguccccuugaucaguuccccucugucaccuucagagccacagcuaucacuuuguagauaggugcaucucccaaauuugaaauucugagaacuuuugauauucuaacauuuuuacucugauucauaaaauaguuucaaccauuuaagaauaauggauaugaaucugguaaauuugggauuaaaauucuagcucugccauugcauggcugugucacauaaagccauuccuauacuuuuaacuuucuucagcgcaaaacagaacuagcaguacuuuuugcaagcucaccuguaacaaaaggucucagacccucaacaaucauuuuacuauucagaauuccaagaaaaaagguacuaagcggguagugugcuuuuccucuggggcuucacacaugaaaggguuugggaagccuuguaggaauguaaagucuaguuuuguguuuucacuaagguguucaagcugcuccaaauuuuguuguggagaaugcgggcccccuccuggaaaaugccucuuaucauacacgggcugccacggucaccaugucucucucaccucacacuucucugguuggagauccuguuauccucaaugccagccccacagcacauccuuuugugcuguccuacagauccucacaugugugggauguaaguauggaggcagauaauauuagcauaacucaagagauuuaaaugagacuaucuucugucuuacauuuuauugcuuguuuagaugugugugugugugugugugugugugguuuguguuaugcaguuuagguuggccuugaacuccugaugucuuuucuuggccuucaaagugcagagauuauagcauguacuaacaugccuggcccucuugcaugcuuuuaauuaauuuaaccuuuuauucugugagacuuuauggugugucagacauuuuuaaauuccuuaagaauaacaaggagcagcaguuuuacagguaccuauugagggucucaucagaugcaagguaaugccuuacucucaaugcacuuacuuacauauggggaugccuguuaauuaaggaaauacacacagaauaaaauugcaaauaugaucugagcaaggaauuacaaguucucagauagguaggugggugccaggagccauaaugagacaagcaaauaacuaccaggugaucauccagaaauggccugcuucagauuauuauauaaucuguggcaggugugcccuuauucaacaagacuguaagggauucauuuuagaaaagauuccugcuauuaauaugcuuuuucugcuauuauuaaacauauauaacaaucccuaagaauagcacaccccuuuggagcagaucuaugaagagguacugucuaguaguaaugcuauauagacaaauaaaugacuucuuaagucuuaaugaugauccauccuauaagaauuccuaaaauuauauuugugauuauuaagcucuuuuauagugggacugcuauuaguucuuuucugacagucaaaacugcaaugagaacucugccagucucccaagugucaccaguuaauugcucuuagauaguaaccagacuuuuuccuaauaagagcacauuccaagagguuguaaaacaauugaccaaaagucauaaaaagggaaauaacaauuuauuauaggugcuaggacagaagauaaaauauugacuagcuuuaucuauacaaagcuucacuaauaacuuaguuaugguuuuaaaccuuuagugaaccuguggagcugagacaggugauggauguuuagccagauaauuacuccuaauggauaugcauggaaacauucucuguuguaaacuucuauuuugauuuaugauuuaauuuuuugugugaacuugugaugaacuuuguaacaugugaucauguuuucugaaagauguguaagcacugaggacaaagagaggagaggaagauggaggagcagguagaaaagaauuuuuccuuucccuaauuuguuuacuauuccccacuuaagaucuuuccgcuucugcuuucccccugagauagcuuucauagguaacuuuuuaccacucagaaauaaacucuguaaucacuucucuaaguguccccuuuucuuuuuuccccucuguacacugcuauuauuauuuacauaauacaauauagcaucaaugcugaauagcaugauuaugugcaauacguaaauaugaacuaucuguacacaucugcaaaucuaacuuagaacuaagguacauaaaauugaagcaaaacucaauguuuuaauaaaaauaaacuaggacugaacacugcaauaaaucagaaguagugccuuguguacauacuuaacuauuuacagaugaaaacaggcauuaccacaacacuaaucuaacuauacucauuuauauauaaaaaacacaaguuucauacaucacaaaaaaaccuuccauuauaacacagaagugauauuaccagacaagcaucaguggaguauacugacagagcugcuauaugugaaaaccaaacagaguuuaauuucuucuuguaaacaaaucccagugcaguucugugcuacaauuuuaguaaugagaaugcagauaucuucuggugcaggccagcacaauaaccuucaaagauuaucucaggcacccuguuguugacuugaugguuuuacuuagaaccaguugugauguuaccuuucgcagaauguccuaauugacagcuuuuagaagaccaauuuaaccaggcuuacacaugguaccaaauaccaguuuuguagcuuucuuccuccuuccaaaagucauguugaaaucaaggugaaguuugacuaugguaguagacugccaguccuuuucugguguaccauuuuauuuauuuauuuauuuugaaauuuuuuuuaaauuuaauuuuauuucuuuuuuaaguacaggcacauaacacuagccaaagauuauaccuugauuacauucccaaaaggcagauaugcugcaaacaugcagagauuucauucauuuaguuuggcacauggaacuaaauuuuguuccuaguauauguguauuucaauuuguugugcauauuuuuguccaauuuuacugaggggaggcaauucugccuguaacaaacacccaaacauccuaaaauaucaauuauauaacagacaaguauaaagcaaaacucuggagaacaucaaaggaaaauggccaugcaucugcucuuuaauguuuuccuacgauauauuaaaauaaaaacaaaguuucagucucuucacauguaguaauuuuauauucucuggauuuuuugagccacaacaacuagauuuucuuuucugauuuuugcugcagcuucugcuuauaaucauauggccaguugugcuugucagaguaauggugaaguccacaaaacaaauuuccacaucggcagucaaccccuguaaggccaucucucuuucuacaaauagaacaucuguucuucuuugguuugggcaacucaggagcuuuuucuucacuuugagaagaacugggcugagaaacugauggacugagcugagugacaacugacucugacaccucuguuuucgggauaguuaauuuguccucucaugaaaugcucauuucugucauuuguugaguuacaggcaaggcagccacaggcacauuucuugauuuuucagaugugcugccagcagcaccuucacaauuguugaaacuagcaucugcucucuguacagaugcagaaucuguuggaaccacuagauguccccauugggcucauucugccacuauucgucucucaagauguucuucguaggaaacaagaacacguuccauuuguccuaggaccccauaaaagccacauccugaacuacacagcaugggcacuggggucugguuagucuccugaaccauauuuuucugccugcgggggcccggaugcccuagcgagcuggcgcgcgacgccgggcgguaggcagggcugagaccuccgggaaggguuggcuagcggccgccgcgggccagagcggaacgcaggccgagcgcaaguguuccuuuuucuaccugcaacuuccaacuagcagguugaaaguuaaagccacaccguuccugcugagauagaacaaaggccacauugcuuaauccucugcuguuaagauacagguuaggucacuuuuuuuuuuuuuuccuucagacaaagcaagaaaguuuuuaggacuuuuuuagagauuauuaucagcauuucaguacaguaagagaccuagaaagcccugagacucucagacuuuuaaagccaucaccagaguccuacuuugugacuccaccacuacccucuucgggcugggaggcucccggcaggugggaguccaaacaaaggcauaagaucuacuuaguauucucugaaguagcuuuaucugaaaagcauucugcagacugggcaggaauugaauaaaagagggagaaaacaucucaggucaugugcaaaaguccuguagaaagaaggauccugaaaagaggagaccagauuugaacagggaguguggugagaaaucugacugcaauggagauaaaggagagagccuguggaaucugggagauuuguuggaaagagcuacuuacuugcuaguuuuaauaaagcuaauucuccuacugggagaaguucacauaggcgcauugcucuuuauaagauaucuggguuccuuaagacucaaaguacucauacugcaaagcuauugcaugcuugacauucaccuggucuuucugcauuggcucucugagacccaaaagaggacccaauucagugcaauaacaucuuuaacaguugagcugcccuagacugguuuaguuucagguuaugguuagcucuugugucccucaaaucucaaaccucuaaaagcagugacuaguagaagcauauuccaucagaacaaaaagaaaaccagaauauaagcuugagcccauguguacauuuagagacuuaaaucuacucauaagcuauuaguugaagaaagucucaugcacaagccauaggaacugccaagucaaauggcaagcaucagaaacaugggaacugcagaguaugguagaaaagaaacaugaucugcuaaugcuuuaacaagaucacucuagcuacugugggcacauauucuagaaggacaagggagguauuuaauagaaccaagccauggcauugccagcucuucaaacuugcuuccauugugaaucugguauuuaacacugucuuguacuuauucucuguucagcuucuacucuaagcccagcuagcaaaaauucugcugagacucuagcuucugcuccugcacuaagcugacaaggcugcuuuuccucugugcgccuccucuuaugagcacuguaaaccuagggaauggcuuacuuuaaugcauuucuguucuguuuccugaaaaaugagaugaaugguaacuuuauuaccucacuugagcugacaaaacgauucugugaaauaauauaugucaagauccauuuugcuguguaggccacaauaaauaguugauacuuaguauuugucuaugauaaauauguuuauaauucaguauucagcuauguuauaaauauuaaagacacaauaaauguggccacacuauuaaaaugauauccucacuagaugugaaaguacauaccuuuuuuuuuuuuuuuuuuuuuuuuuuuuuuuuuuuuugguuuuucgagacaggguuucucuguagcccuggcuauccuggaacucacugugcagaccaggcuguccucaaacucagaaaucugcccaccucugccuccguagugcugggacuaaaggcgugcaucaccaccacccgguggaaguacauaccuuuaauccuaguacuaagagcugaugguguagaaucaugaguuugaacaagcuuggaguacaugucucaaaacaaaaccaaauugucaggugugguggcucacaguuguaauccuagaacuugagauguugugacagaaggauuguuaugauuguuauauauauauaugaagucaacaauuugguccuccaucauugugcuuuuuuuuuuuuuuaacauuuuagauaauuaucacuggaguacccaagcuggacuuugaggugguagcgcucuauuccuugacaauauaugccaaagacaaccauggggcaacagcgucccagaccauuuuuguccagaucgaagaugugaaugagccuccuguuuucauugggucacuuacacagaaaaaucaagguaccaacggucuguuuugagggaaagcaaguaccaacggucuguuuugagggaaagcaaguccugaggacacagacguagguccugugcucuaugucuuauguguuuucaugguguucgggcuagaagguuaaaggagacugacacuaaacaaacuugggcuuguauaauggcucagcagcuaaacggauuuguaaugcaagcccgauaacuggaguggugaccccuggaaccuacaguaaaaguagaguacuaacuccugaaaguugucccuggaacaccauacauguuaugacauauacaugccccccccgcgcgcgcgcgcgcacacacacacacacacacacacacacacacacacaagcugauauguauagguccugauuauguauaggcaucauccuauaaguggauuguuuauuuaacauucacagcacuggaggggaaguucuuuuguucccuuagucccacuguauagaaaauagacugaaguaauuuucuuaauauugaaaaugauccauguaucuguuuuaucacacuguacuaaaaucgaucucuuaaaugugucuaguuguuaaacuagaagcuucccaagaccugugaugaggcuuuuugccucacucuugacuuucuuucucacucuaugaagucaaauaccuaauuuuuacuuguggaaaaaauccauaguguucagguaaaacaaaauaguucagauguagguauggcuacuaacuggacugaguuacuuguuuugugugaaccucagacccuucauugcuaugucuuagaugggaacgauuccccagggagucaugugcuccagcaauggucccagcuuguggcacugguuuuggaggucaugaaggaccuuugggagguggagccuugcuggaggaggcagaacacuugagggugggccuuaaggcuuacuucccaaccacucucuguuuccuguuaauggcgaagugaggaggugaaguguucucuuugcacacauccauggcaauggagcauccuguucccauccuuucuuuccauaauagacuaugucccaucaaaugaucagcccaaacaaauccauccuccuuauguagcuuguugucagcaauuuagucauagcaaaaagaaaagugacuaacaaaaucaccgauucaacugagaugucagucuuacccugaggcgugucuuaggguuacuauugcugugauaaaacacaaggaacaaaaagcaagauggggaggaaagaauuuauuuggcuuauccuucugcuuuguagucuauugcugaaggaagccuugacaagaucucaagcagggcaggaacuugaaggcaggagcugaugcagaggccauggaggggugcuacuuacuggcuuguuccuaguggcuugcaaguccugcuuucuuauagaaccuacgacaccagcccagggauggaacuaccuacaauggucuggguccucccccaucaaucacuaauuaagaaaguucccuacaucaggacauauggagacauuuucucaauugagguucccuccucaacauaaaguuauacagcacaaugcauacaguguuuagaagugccaaaucaucugugcacacgauccgugcuccauagauguuaaugucucuucuuucuuuuucucaaacauuugaugaagccuugcauagauucaaggucaaaucaugcuccuuggacuucucaaacagcugucagacugcuuguggguaaauucacaaagguuguauuaacauuuaagacuguguggauauauguaguguaucuaggccuugaagaccucuuuuguauccagaaguaccacuuucuucaaaaaauggagcagcaauagguaugauguucccuucuggauucaagggucucacaucucccagcuucauuagauucccccaaagacauagaaguuugaagcuugaaguuacuaugacugucuuaaaacauguagcagcugggaauguggcucagugauaaagcauauucuuagcaugugugaggccgugguuguaguuucuagcauacucucaacaucuaugggacuagggaaaacuugagaaaauguugaaacaauguucauguggugacucuguaagcuuggacuuguuagugauuuuuaaaucucagaagaacuagaaugauaaaaaccaucaaugauguuaagugcuuagcuaucaauaaguauuaaaauuguuuacuauugccauuauuuaacaugauaaaucuccuuccuguaugcaugacugaugauagaugacaacaucguugucuaucaucauuaucgcuacuacuagcuucccugaaaucacuguacaaagcaucuguacugagugaguacaguucuuuaagacauuuauuauaauguguuaauuauauauaauaguggguuuuauuauaagaucucauacauguacaugacauauuuugaucaucucuacccacucuuaugcuuuagucacacauaauugaaugaggugcuuuggguugguauuggugagacccauagacugacauuuauuguacuuuuuugggcaguuacugagauuuacaucacagaggacacugccuauggcaccaucauuuacagagcagcagcugaggacccagagggugcgguguuggagguaauuugucuuuuggaauaaagaauaucagugcuugguaguuuauaugucauuauauuuaaaagcaaaggcauaaaacaaacgaguuauuuauacucuccaaucaaguccaaaauguacuguugccuuaauuauuaggacauuucaggugaaaaugauugaauuuaaacuugaauugaauuucuagguaguuguuuccauucuagugcauccacuucuguguaggcagacagccuaccccuaagguacuuuuaaagaaaaguaucaaucaauaucuuacgauauuugauuucacuuuuuagggaccuuggcugcauauaugguagagaaucaaaucuaggguuuugagauuaagguauaguucagaacauuaggucuuguccucaggaggggaaagggacuuggaaucaaagggcuucaguuuacagucugacgucacuguugggcguuacuuacccgucggcuuugcuauuucagcugcggaagugugcaaaugucacaugacugcuugaucuucucuuguauggcucucccauuauaaucaaacaccacaaaggaugugaaaguaguuuuaaaaugugaaacauuuuguaaauggcaggauuuauaauacuguuuuaauuuuugaagccauaugaaaagauuaugacacuaagccggguugauuuugacuaaugggucuauaggcaagaauaacauauuuuuaaaauuuaauguuguaucacuucuccaaacuggcuaaaaaaaagagaggcuuguucauguugcuacuguauuuuugauauuugugagugacuggauucuuuuucaagcaguugagucuuacaaaauuguauuuauguaguagauggccacucacaccugggauagugucccauggcuuuuaaauuacaaugaaauacuauaguugucgagauugcccaugugcauuugucucuccuccuccgaagcacaaugccaccuccaggaugggacuggaaaggucacaguuuccuuugcaacaugcaauuaagcaaccuaaucaugcauauugcuccaaaugaacacauuccagauuauaguauuaaauccaguaccuagcaacugugccacacagaaaucagacagcacacagcaauugcuuccuuggguuucuucaugauagcccacccacaauguugacauuuuaguauggaaaauaucugacaguucaauagguucuaguugugacucuaacaugcaaucuaaaugucuuacuagccaauuaacacaaguaacucauuucaaaugauggacuacaguagcuugcucauacagauuaaacacuucugguccugucccuauacuuuucucagaagagaauugguuucagggauccauuuggaagaccaauguaauguucuuugugaauuuuaccaaacauggacugacauuucaguagugacauaggcuguggaaacuucuauuuagacacacuccuacacacauccucugacacacuagauuagaccagauguguuauuucaauacuauggcuagauagccccccucaucugcuugaaccuuuauauugacucagagauaaacuggcuuuaauguggagaagaguuuggcacuuuccuuaggccuuaccaauaaugaugaugacauuaauuaacuauaaugauaggcauguauuaauaugaucuaaucccuaugguaucauuaaaagagacacugucauuuucuaugcuauaaccuacugaauuaauaggaaaagcuccaugucuuuaauuuauagucaagggcauuuguuuaaauaggaaguuauagaauuaauucaaauccaugcccaccugucucuaagucuuguuucuuagaccacuaacaguuuccaaaguguguuucuuuuuuuauugguuauuuauuuacauuucaaauguuaucccuuuccugguuucuccucugcaaaccuccuauuccuuccucccuccccuugguucuaugagggugcucccccacccacccacucccacccagcauuccccugugcuggggcauugagccuucacaagaccaugggcccccuccccucccauugauaaggcaauccucugcuacauaugcagcuggagccaugggucucuccauguauacucuggauggugguuuaguccuugggaauuuugggggaagggggucuagcuguuugauauuguuguucuuccuaugguguugcaaaccucuucagcuccuucaguccuucugccaacuucuccauuggaguccccaugcucaguccgauaguuggcuguaagcauccucaucuguauuggugaggcucuggcagagccucucaggagacagcuacaccaggcuccugucagcaagcacuucauauaggaucuggguuuggugucuguauaugggauggauuccccagguggggcagucucuggauggccuuuccuucagucucugcucacaguuuauccauguauuuccuuuagacaggagcaauucuggauuaauuauuuugagaugggugggugguuucaucccucaacugggggcuugccuaaccucuggauauggucucuacaaguucucucuucccuuuguuugguauuucagcuaaugucaucccuguugaauccugggaacucuugcuuuccuggcaucuuugacuuucugguugcuacccccaauuccccaccccccauugcuacacaccucuguucaauuuccugacccucuguacaucucuccucccacaccugauccugccccccuccuuccucccucccaaacuaagccauguucauuauaacaagccauguaagucuugauuucaucauggggugauuaaaaauugccauagaaaucccuccucucuucauguaucacagccacaagaccggggacaacagauggugauggcuauuggcugucaccggagaguaacacuaccccucucugaggagauggagauuauacagcugccucauugguuuuccucagcugcacucugauacucuacaucacacaccuuccucaccacacaaaccucccaccucagcgccucagaccuagucuuuuccagcaaugugauacugguaguuuugguguuugggaucaacauguaccuuuuuugguuauuaaaucuuaguuugaaagucugagcauacugucucaauuccauuccacuuaaacauuuuuuagaacuauaaaaaggcuguggaaugagaagggugagagagaauacccuacuaaauauuuauuggcucuuuggccauuuuaauggugaaauaaauuuaugauccaaaggguaacugucugaguaauguguccugccuuguguguuuauagaaacagucaaugagcuuuggguggaaauagguccgggcucucagaugguaagggcagagauugaguggagggcagaaagaaugaucuuggcaugugauggaacuuuucucauagcaaguuuaaacugauucaaggcacccagguugagggacaaaucucaggacacacacacacacacacacaucuuauacacacacauauauaugauuaaaugauuguauucuauaugcuuucauuuucuuucaaauauuaggaaguagucugcuaagcuugaguucuaauaacuuauuggagagacucuaaagucucaaauaaguaacauuuucuggaaguuucauuacagaccuugaacgucacaccauuaugugguugcuaaaugucuccuucuauagcuuuauuacgugugccucuuuucuaaaugugaugacuuaauguagccugcagauuauaauguggaaauaaacaauauuuucuguucagucaaguguauugacugagagcugacaaugaucagauuuuuauggggaagugauauuugggaauucuaaggggcauaauuagccauagaaucaucaaaagacucaacaauuauacuguagccaagcauuuaauuauggguuugaagauuuuaauuacacacuucuauuuuauaacacagcuguaaaacaaacauuaaaggggagaaaaagaugagucuguugcauuagaaacuagaauauauaaauuuuugcuuuacaauucugcuuuaaauggguuguucuaaaguauaaucauuuuggaaaaagagagggccauauucuuugaauagcaucuacauuucaguuuuucuguuucacuaauaggggaaaacauacauuaagucaaauguagucaacuguuggaagcaugaggccaugucauuuccauucaugaauuucagucaaaauuaauaaaggauuuaauuucuuucuuacauugaccuuagauuuuugaagacuauguuaggauucuuauaguuguaauucacagaaaucuugaaacaaaugagaucugugguugcaguuccuagaauauccagauguacagacuggguuucaggugcaaggaauucaaguuugcauauuaacagauugaugcucacuccagaacauaugaacucugccaagucuucuuuagaaauaguugaugaaugaccauuuguccuaccacauaccuuuaaucucagcacuuuggagacagaggcaggaaaaucugaguucuagacuugccugauuuacagaguacauucuaggucaccuagagcuauacagagaaacccugucuuaaaaaaagaacaaaggaaggaaggaaggaaaugaggaaagcaggaaagaaagauaguugaugaugggaaucaaggcugaaaagugguaauggggauugacucauagaaguuuccuccccaagaucucuguacgucaucaugacuguaauuggcucaugagcucaucccuugcuaauugauuugggaagacagaauacaguauaggaauuggcugaggccuaggccauaugcuuuaccuugagauuuguaggaauucaacuggaaagccaccaggacagaaaacgagggaaguugauuuagcaaagagcucauaugggaaguaguaaaaugaaggcaccuugugcaaccaaaagauucucacuacagggaaguuuucuucacaacuuucaguauuggcagacagucuaagcucaaguuuauucuaaauacucuguuggcucagcacucuguuccacaaaccucuuccugaggucagaauaguuccagauuugucaucuacauuuaccggccugugagucugcaugccucugggcauaucagccccaaguuccuagauuauggucaugaccaaugcaacaagcuguuccacacccugagacaaacuaucauagcacuuuauuagggccggauucuguguugcuagcaauuuucuauuccugugguggacuugugguucaagauagcugcaaccaacugcagguguuacuaguuggaauggaagucugacauacuaagaccauaugucucccauugaguuuggaucuguuuuugaugcucuguuaguagaccugaagauaggcaauuaggaucuucuuaguguuagacuucaccaguccagcaguaaguuccagugucaaauucuguguuuaauucucagucuaacuuuuaggaaaaggggucuugagucauguuaugcugcucaagguuuggguacuguuuggugccagaccuuuguagucuaggacaauguuaagcucugccauaccugagcuucagugucccacagucuuagagaugugguaggguucaugauacaaguagcacuaacuaaaugcaaggccauacaugucugccccacugaggcagaauauuugcuugguuucagggcaguuccagugucuccucugugugucacugagauccaaugauagaugguagacauagucuuuugaccaucguuggaaugggcuuggugcuggauuucaugucuaagcccugggcuucuguuuucugaaaacccuuugccuauacuaacuuguuuguaacaaaggaggggcuaggugaacaagccuugaacuaccuguuuucaguagucuuuuccuuuaacuauacuguaagcaaguaccacggccucugcauuagugucuaugccacuuauacagucuguugugucugugcagaguuuaauagaggagcuuuguggccaucuuguucccuuauguuuucauauugaucaacccaucagcacccaccaaaucuugauuuacuuugcucuguauacacaaacauauuuauaauuuuaaaguuucaaacucuccauuauuuccauguugacaaauguuaaagcuaucuuugagauuugggcauggugccucaagucugugauuucauuguuuuacuuaagaaucuggaauucaaaaugaguaugggcuaucaagguugugccucaaaagagaaaaagaaugaggcacaggaaauccccaaugaaaacaacuccaaacagucauuugcucuuuaggaauuauuauaugaaguagaaacguaaggguucuuuggaaagucaguuggaugguguuuugcuggggcaaacuugugaagaauguuuagcugaaguggacacaggugaaagacuaagguagucucaugaaggaacguuucacugaagcagacacagaaggagauaggauguucugcuaacgcaggcauguggaaggacacgugaugaaggaguuuuugcuaacaacacauguauuuguccaccuuaccuuguguagcuggacuacauuuguuggaaccccauugagagaaaugcucaaaaaacacuucuggugaugugcugaaguuucuugcuucuaugaacuugggcugauuggcagagugauggcagcugagacagacucacgaguugaggcaagaccuguggaggccaugugaugcuuggagggcauauacaaaggacucaauggacaguaacaguggcugagcuuggcuugcuuauagagcuagcugugcaacacuugugggucuugcaucuuuccugaucuuugcuucccugagagagguacagcugagaccuucuccugguguuccuccuguccccuccugcugacucgagcuaagguugaugccucacugauucuucuacguucugcugcugauuuguguuugccaucccaacucugcugaaugaaguguuugcaaguggauugagcugcugcugccugcuaaucugugaauugaagggccgauuuccagacaacacagaugggaguuacuccaaagaaccuuucuaaauaggucuacuuuccccauauucuuucuuccccacuaugucuggugggugguaggcuaaaauggagguuaaagcauuuaagaaccaucaucaaaaguaagguuugaaaaaaauuaaagauacaauuauagaauagaaauuauucaaaacuuuuaccuuuuagucuggaguacugcaucaaaaauaaaucacuuuuuuuaugccucucauagccuuaacuaauauugucaauugaaaaaugccuuucaugaaguuacaagccccauaaaagcagagauuaagugcaucuuauugauaacaguaucuugaugucuaugaacuuaaauaauguaucagaaaaggucuuaaaaagagauauuucccaagugcuucaaguguuuugaaaucaaccaaaacuuucaaacuuuuugaaaaguuauuugauacaaaacacagucaagacauuucugaguucaaguuuuuguuggacagguaggugugaaaaugcuuguucugaauuuauuggucuaggugccaagacugcaugauugaggacaauauuuauaagacauuuaaauccaugaaccucacagacuagggaagaaagcuaacaacaacuaacaacaagucuguuucaucaauagugagugcuauugggagguggccaaagacagagagugguagaaguggagacaaccaugaauguaaauuacuaaugguacaugugugcaccagacauauagcuuggguagaaguacagacaaagauagcaaaagccccaaagacgcagaagcuaagcauggcucagacccuagaaauacaucaauaugacuguaaagugagggcuccagggagggcacaguuaggaaucaguuuacaggagccaguuucuucuguuuggugagguuguuuguuugggggaaugcauacuaugauuuacauaaaauaacaaccagaaagcuucuaugugaauggaaaagaacuguacaauacaaaaauacaauugggggaaccauaugaaaugacagcaguaaaaguaaugaggagagaggaagacuuagucuagaauauugacagaguguuaggaaaugacuugauuuuauauauuuccccaauauucuauuaugaaaaauuugaacuuacagagaaauggaaaaagguuaaaaauugaaggaauuauuaucaacaucuucaccaugcaguauagcccaaccaaucuuaacuuuuuuguuggugugcagggugucuaucugucuaucuuaaaaaacaaaaccuauugcuguccuagacaggucaagucccaggaacaauaaaggacucagcaccaagcuccuuuacuugguguacgucugcaugugugugugugugugugugugcgugugugugugugugugcgugugcgugugcgugugucagcacacaugcugcagugcauguguuggaggugagaagacaacucugaaaguuuuuuauuuauuuauuuuuucauguggguuucagguaucaaacucaggauggcacacuuggugucaaacaucuuuauccauugagccacccgaggagucuuuuuauucagugaaguaccuuccuuauccuuugaauagcacagcuuaaauuuaagguggauauucugauaucaauuaaccuggucuggagacucccuuacauuuauuguuucaugguaauucuaaguucuaaauugauagucaagaguaaccaucucacuaaguaauuuugcucagcaaaguaguaggaggagaagugugauuggagucaugcuaaggggagcagaggagaagaaaguaggaaagccagcagaaacacuuuucaaauacuuuccauaagguaaagagcagagaaaugggacaguaacugaggaaaaauguggagccaagagagaaacauucauuuuggacaaaugcauauuccaugcugaaggaauccgggugucuuaguuaggguuucuaucacuaugaagagacaccauggcauuggcaacucuuagaaggacaucauuuaacuggggcuacuuacagguucagagguucaguccauugucaccaaagcaggaagcauggugcuggagaagcugagaguucuacauacuguucagaagguaaacaggaaaagacuggccuccagacagcuaggaggagggucucaaagcccacacccacagugccacaguuucuccaauaagccacaccuacuuuaauaaggccacucccugggccaagcauguucaaaccaccacacuaggaaaggguagaaaauaauaauaauacaaguaaggauagugauaauugcuagugugagggcuguggcaauggacaaagguuuccaggaagggaggaggagcaguaaacgaacauagccaacguggacagguacaaaaacuucccuaaauauugcuuucuugaccauuaagauuuaguuauuggguacuaacaagugcaaggccaucuccugaaaagaaaauuuacacagugaguuuagaagauaaaaagugccuugucacacagagguaauccagcagcagaaagaaccacucuccuucaguacaucauaugcugccaaguacugcagauggaagaggcuaggcaaucacacagggaauuaucucagagcucuaaaacugguaauaacuauaacuacacaggauuuucuguugauuugggaacucuuacaaaauuccuuccauuucccucaguaaaguuaggaaaaaagccagagacagaagguggagagagagagagagagagaugugaugcuagaaaaugcuggaacuuugaggaugguagagaaaacauuuaaguaagggagagcucuucauggcuacagagaaauggaaagaugacaggaacauccagagaagagggaggucucuggaugaaagacugaauuaccaaggggaacacuggggugggguucugguggacugaacaauuguccuggugaugaggacugaacugugguugaugccugugugaugaaacacaauuugauguacuguguggguggagguacaaaguguauaccaaugccuguguuuugaaugguaucuaggaaaauuuagaacuuucuggcuauugccacugaggaaucagggaagccauguuguugagaacaggaaguguauugagaucuccuucagaacuucuguugucagguuuaagagaaaagauguugggggagggaacaaguaucccaaggguuaccauguaagaauauauaauuuaggguuacucauagaaaaauggagauucagcaaugauuuaccuguacaaaacuaucagccaauaagauaaaagaaaaucaacaaaaauauuuugacauuuacuuggauggugccuaucuauacgaaucugcucacacuuauugaaaagaagcaaucaacaucaugguuuuuuuuuuuuuuuuuuucuguuuuucuguuguugggauaaaacaccauggccaaaagcaacuuaaggaagagggaauuuauugugacucaugguuccagugguuuauaaucuuccaugugagaaaggcauggcagaguggcaggaacaggaagguggcugaucuaauuuuauccacauaagggaaaaagucaaggggcuaagacccuaaaggccucagugaugcuccaccuuguaagguuccaugacuccuuuaagcugugucaacaacuggggaucacguguucaaauacaugaaucuauggaggugcuuaucauuuaaaucauuccauaccuagucaaggaaugacuugcuugugccuuguugaucuguggugcuguaguguaucaauauucuugcaauauugauuggcuguguuuguuuucauuucaaagacaaagucacaggccuuguucuuuauuccugguggacuuucaggaaauguuuacaaagucacugaaaaaaauucauuuuuaaguuguacucaguaccuaauaacaauuuagaacuugguuuucuugugauacgaagauauugagagguaggguggaggcagaauggagacaguuacauaauaaauuauucucagaaagcucugauaugugacgaaauauuuaguuaagauuauuauagccaaaugaauuugagaauggagacaauuaucugaauuauucaagcuaaaacacaauuuugcuugaaauaacuauguguuugggggaaagugauuuuaggaaaagcuuuaauuaucuagaagaaaaucuuuaauucaucacauguaaggcagauguuggaaaaagccauaaucauguucuuaauacauuuuugucucaguguuuacuucacaauugcacaucuuguaacauccuccacaagauagcaguuuguaauguacuauagccagcaguuguaacauugcucaauguaauuuugaaaaaaaaaagcacaaaacaauugcacaauaaauuauuacauuugucuuaucaauugcaaauguauagauucuuaugauguuuccuaugaauuaaagcuuuuaucuuauaauaucuuacaacaguugccugacugugacuauuugcaggcuaugugaagugaaggaaaauaaaaaugugagaacaauuuaccugaaaaugguguaauaauaguuuaagucuauucauacaaggaaaaugaagauccauuaaugauuggccuguuuaaagucaacacuguaaaugagguacaggaagaugagacaagcaaaaacacccagguuugauagaaaauuuugugagacugaaaauuaaaauucaaugauuaccuuugagaggauuuuuuuuuaagguauuacugaagacaauuucugggacaauuagggaauaauaugauaauucaacaguaugguaauugccucgauagguaauugcaaguggaugauguuaacaaaugcagaugccagaucucuuucuuagaccaauggaauauuuggcaguaggcacaggcacuggauagaucucuccaaacauucuaaugucaccuugcacaugacugaucuccucaggaguucuaaaggcaccuugcacaucaucacucccugauuauuuuauaucuuuucacugcuagcaggaagcaucaguaguugaacaugauaauuccuuccaguugggcuaaucuuuuucucuauacaaugcuucagguguccuugucuuaguuguuguuuguuuuugauuuuuguuuuccuguuacuaugacaaaauacucugacaaaagaaacuuaagagagaaagggucuauuuuaguuuaaaauuccaguucaccaucuaucauggcaggcaagucaagaggacaguaggugcaugcaugcuguugccucuguuucccuuucccacuuccauagcucaggacccccugcagagagaauggugucacccacaguugauagauuuuccuacucugauuaacacaaucaaggcaucuuucagaugauucugacaagcugacaauuuacacuaauuauuacaguuacaaacaauuucaaguuaaaacaaagccuuucccccuucacaguuacuacagaacaugggacagaauuaaauauuaauuacauauaaaguuaauuguuucaaaauauaauagcuaacccuacuuccuaguaggauuucugcuucuguaauaaaggaagugccaggguuccuaguggacugggacggugcucuuccuaaucucuuuggagaucuucugccacuuuucuguguuucaaccccacucacugaucacgaugguauuaguuuucauuagucagaagaaagauguuuugagguacuuuauaguuauaacagcagaaaacaaccagaaguuuacaucucccuguguaacucuucaccaugugucuuagccaggguuucuauuccugcacaaacaucaugaccaagaaguaagguggggaggaaaggguuuauucaaguuauauuuccacauugcuguucaucacuaauggaagucaggacuggaacucaagcaggucaggaagcaggagcugaugcagaggccaugagggauguuccuuacuggcuugcuuccccuggcuugcucagccugcucucuuauagagccaagaaccaucccagagauggcaucauccacaaugggcccucccuucuugaucacuaauuuagaaaaugccuuacaucuggaucuuauggagacauuacuacaagggaggcuccuuuuucugugauaacuccagcuugugucaaguugacacacaaaaccagccaguacaccauggaaaaguuucacuuuuuguccuuggauggggacagucccaagcacugugggaaguguccaggcugaaaugcuucugaagcacucugacaugaugcuuugaguucaguuccucucccuucuccugugugucacaguuuucagacaggugcuaaauuacuuagaccuuugcuuaucaggaucugagacacauaccaggucaagauaucaaaccagagaugauuuauaauguagagucuccaauuuagguaguuauuggaauacuaaaugggaaaugcaaagaagcauugagaaggagagucuuauguaauccaguacagacuagaaaagcauugcuauugcuuauaaagugaguguacugcagagggaagaaaaugaugccuaugacuuucaagaguaaacacagagcuccuguuucagauaaugcucagggcagaugggcaaguaggcacacauuuucagcugccauguucaggagacuaaagcaagaguaucaaaaguucaaagccagccuacugaaauauugucuguacguauccuucuccagaaaacacacuccuggguuagucuaccaagggagaggugguacaucagcauaucagcacauucugaauuuacauaguuuauauuagaauuuggaauuucuacuuuuuggccuugugccccuaggcaagucuuccaauuucccugcaguuuaauuucuuuaauuugaaacaauuauuaauacuagcuauuugguuauaaugaggauugaacuugaugauacacaugcaagguuagcuuugugugucucauuugugaccuagcagcugcauggaucccaggauucuugugaaugagguccaacucauuuguagaguacagugccaugucacagugucaaaagguuggaugucacugauugcuugucagcgauugcuccauaaauguuaccuaauauuaacauugaauuaugaaaauagaaaucuugguuuuccuuucucugcccucuuauuucuauuguuugugaaucucacacauacauuuaauguauuuugauccaauccgcucccauccccuuccuucuaauuccucuagggucucaccaccacaauuccuuuucaacaccacguacucuuucuuuuaaugaaaauagaucuuuuucauacaauauauucugauuaggguuucuccuuccccuuucuaguucuuauuaacaaaacaacagaaaacauguaucuaaagaauaauaauaauaauaauguaaaaugagauaaaucaaaaaacaagcuaauugaacuauaacaaaacaaccaacaaaaaagagcuuccccaaaaaccccaaaccaggaaguacauauagauucaaacacacacauaugcccacacaagaagcccuuaaaaguccaaaacugaacaucauaauauauacucaaagaaacucuaaguuagaaacaacaacagaagccuggacuuaaugcuaugagacaguguuagguggaaaacuucaaucuaaagaggauaaccacacccaagaaaaaaaggaaugaaccauuucagaugagcaagucaaagaagaggggaaaaaaauccacaccacaauagcaaaauaguguaaaucaguagacauugcuaauuaauaacucuuaccaucaaugguuacauuuuuguaggguugauaggguccugcgucugugcugccaaagggcuuaggccacuggggaggcaggacucaggaauuuugacugcacuuaccccauaggagcgccaggcaggugugggccuagggcaauccaagggacacugcuccagggguggaggagugcagucugaguucccagggacagcuggagcuggcucggggguccccaggcuuucagggaggcuggggcuggcugacucucaggcucuugggcacccaggcucagcuggaugcugcagaagaagaacugagaaaggaguggguguggaagcccucagguguguguguguguguguguguguguguguguaucuaugagugaccugcuugggaagcauugaaaccuguaacuguucugaacuuugggucugauauuucuaauucccaggcuaccucaagaacaaacagucacaagucagcuucuccuaccuacaguggucagucuauguggcuuacagaagucuuuaauguuuguuguccuuuuccacaaccacuccuuuacugucccuuuucacucccaccacaauuaacucuuucucugcuuccucauuugccucuuccucuuauuacuacccgugucugaccuacccacaguuauuguuaucauuucuuugacugauacucagggaacaaaaauauccaucuugugacccugaucuggaagcauugaagcauuuaauucuuucugaacuuugugucucacauuucuaauucccaagccacuuugagaacaaauagucaugagccucuuaagaagagaauaaaguggauucugaguaagucuguuuagguagacugaaggcucgcuccccugugcugcauauccucugggccuauaaucuguccucaugccuuggaaucugagaauggggagcugaguauuacuuuuauggccaaaugauuauccacaaauuuacggcaagcacagacaaauuauugauaaggaaaagcccaagggcaaugaauauaaucuaccuagccccagagaauuaauuuuucaucccuuaggaugauuuccuguuccagacauucuuuauuuagguggcuaccuagugauugcucuugcugcuuagcaaucaccauuuccagccuucccugaacaucaggaggaguugcucauaucagcaccaucaagauauuauuuuugaagaauacuuuauuuuguggaaaaucaaccauguaaaacacaacuuuccaauguauauugucugaaaaacauugacaccaguguaacacuuaaauuugaaauugcagauuucgaguagcuugaaacagaaaugugggugucuuuaaaaacucauguguauuuguauauaggcagacaguauuggugagcucuuaggucauuuaauuuccagucauccucuugucauucccuugugacucaggccucauuauuccucgguuugcccuaacaguauguaugugaugaauuucccugccauuccagcauguuaauauucuauaucauucuacagaagcagcaacaaucagcucaaucuuauuucgauggagaggcaugggagguaugaauugaaauuagaauauggcgauucauuagaaaaucagucaauguaaaggucacuaauuucaacaaaugauuauuagucugcuuugcagucguauggguuuaauuuucucuauuaaauuauccuggguaugcacaugauuaaaucaguagcacuugguauaauuaauuccugguauuaaggcuuuuguagauuuuucuuuuaugcaccuggccuuuucuauaaauugauucucaccuauauuaggaacccuugccuuaccuguuccauugggcagaaacuuuucuuagggaugcuggucaaggcaagccccuggaauuuuccaagccuuggauuuccuguuugugaagugggauaacaccaacacucauugugacuuuaauuuuuucaaauccuauuuuuaaugauaguucuuacaagcuuuaacaucccuucuagcccaucaccuuccagagguaguggaaaagaaaggauaucggggaagugccccuguuuagaaauguugguuuuuggaguaacuccugucuguguuaugaggaaaucggcaguucaguucacaggucggccagcaguggcagcucaguccacucacaaccacuucacagauccaccagcaguccaggucgguugaguugggacagcaaacacaaauuagcaguggugguacuaccuagcagagacagccaggagucugcaggaggaccagggccaacaagaaugccaggaaacauucucagcugugccucucucagcucagcgaagacaagugcugccuaacuagcucuauaaggaaacccaucccagcuucuaucacuguccuuugagaccuuuuguuuauuagauauuuuauuuacauuccaaauguuauccccuuuccuaguuuccuguccaaaaauccccuacccuuuccccccucccccuguucuccaacccacccacuccugcuucuuggcccaggcauuccccuauacugggauauagaaccuucacaggaccaagggccucuccucccauugaugaccgacuaggccauccucugcuacauaugcagcuagagccaugagucccaccauguguuuucuuugguuggugguuuaguccaagggagcuguaggguuccugguuaguucauauuguucuuccuagggucugcaaaacccuucagcuucuuggguccuuucucuaaccccuucauugaggacccugugcucaguccaauggaugacaaugagcauccacuucuguauuagucaggcacuggcaaagccucucaggagacagcuauaucaggcuccugucagcaagcucuuguuggcaucugcaauauugucuggguuuggugguuguuuaugggauggauccccagguggggcagucucuggauggucaugccuucagucucugcuccuaacgaugucucuguaacucauuccaugaguauuuugcucccccuucuaagaaggaccaaaguauccacacuuugguuuuucuuauucuagaguuucaugugguuugcaaauuguaucuuggguauucugaguuucugggcuaauauccacuuaucaaugagugcauaugaucuguguccuucugugauuggcuuaccucagucaggauaaaauccucuagcuccauccauuugccuaagaauuucaugaauucauuguuuuuaacagcugaguaguacuccauuguguaaauguaccacauuuucuguauccauuccucugcugagagacaggugguucuuuccagcuccuggcuauuauaaauaaggcugcuaugaacauaguggaguauguguccuucuuaccgguugggacaucuucuggauauaugcccaggagagguauugcgggauccuccagaagaacuauguccaauuuucugaggaacugccagacugauuuccagagugguuguacaagcuugcaaucccaccaacaguggaggaguuuuccucuuucuccacauacucgccagcaucugcugucaccugaauuuuugaucuuagccauucugacuagugugagguggaaucucaggguugcuuugauuugcauuuuccugaugauuaaggauguugaauguuuuuucaggugcuucucagcccuucaguauuccucaguugagaauucucuguuuaguucuguaccccauuuuuaauaggguuauuuuuuccucuggaaucuaacuucuugaguucuuuauauauauuugauauuagccucauaucagauuuaggauuaguaaagaucuuuucccaaucuguuggcugccuuuuugucuucuugacaguuuccuuugucuuacagaagcuuuguaauuuuaugaggucccauuugucgauucuugaucuuacagcacaagccauuggaguucuguucaggaauuuuuccccagugcccauaucuucagggcuuucccccacuuucucuucuauaaguuucagugucucugguuuuauguggaguuccuugauccacuuagauugagauuuguacaaggagauaagaauggaucaauucacauucuucuacaugauaacugccauuugagccagcaccauaugcugaaaaugcuauuuucuuuccacuggauugcuuuagcuccuuuguaaaagaucaagugaccauagguguggggguucauuucugggucuuugauucuauuccauugaucuaucugucugucauuguaccaauaccaugcaguuuuuaucagaauugcucuguaauacaacuugaugucaggaauggugauuacaccagaaguucuuuuauuuuugagaauaguauuagcuaucguagguuuuuuguuauuccagaugaauuugcaaauugcccuuucuaacuaggugaagaauugaguugggauuuugauggggauugcauucaauccguagaaugcuuugggcaagauagccauuuuuacuauauugauccugccaauucaugagcaugggagaucuuuccaucuucugagaucuucuucaauuucuuucuucagagacuugaaguucuuaucauagagaucuuucacuuccuuaauuagagucacaccaagguauuuuaaauuauuugugacuauuuuuaaggguguuguuucccuauuuucuuucucagccuguuuauccuuuuuguagagaaaggccacuaauuuguuugaauuaauuuuauauccagcuacuuuacugaaguuguuaucaggguuagaaguucucugucugguguaauuuuuuuggucacuuauauauacuaccguaucaucugcaaauagugauauuuuugacuucuuccuuuccaauuuguauuccuuucaccuccuuuuuuuuuuuuuuuuuuuugagacaggguuucucuguauagcccuggcuguccuggaaugcacuuuguagaccgaacucagaaauccaccugccucugccucccuagugcugggauuaaaggcaugugccaccacacauggcuuugaccuccuuuuguugucuaauuguucuugcuaggacuucaaguacuauauugaauagguagcaagagacugggcagccuugucuagucccugauuuuagugagauugcuucaaguuucuuuccauuuuguuugauguugauuacauguuugcuguauauugcuuuuauuauguuuagguaugggccuugaauuccugaucuuuccaagucuuuuaucaugaauggagguuggucuuuguccaaugcuuucucagcaucuaaugagaggauaauguggauuuugucuuuggguuuguuuauauaguggauuacuugauugauuucuguauauuaaaccauccccacaucccugggaugcagccuugaucaugauguuugauuguuuugauguguucuuggauucaguuggccagaauuuuauugaguauuuuugcaucaauauucauaagggaaauuggucugaauuucucuuucucuguuggguuuuugugugguuuagguaucagaguaauuguggcuucauagaaugaauuggguagaauaccaucuguuucuauuuuguggaacaguuagaggaguauuggagugagguccucuuugaagaucugauauaacucugcacuaaacccaucagguccugggauuuuuugguuugggcgacuguuucuauuccuuuagagaauaugggaauauuuagaucauuaaucugaucccaguuaaacuuuggaaccugguaucugucuagaaaauugucauuucaucuagguuuucuaguuguguugaguauagcuuuuuguaguaggcucugaugauuuuuuggauuuccucaguuucuauuguuauguuucucuuuucauuucugauuuuguuaauuaggauacugcccgugugccggcuaguaagucuggcuaaagguuuaucuaucuaucuuguugauuuucucaaagaccagcuccugguuugguugauuuuuuuuuucuuguauaguucuuuuguuucuauuuguuugauuuuaacccugaguuugauuauuuccugcccucucuacuccucuuggaugaauuagcuuccuuguguucuagagcuuuuaggugugcugucaagcugcuccuguauggucucuccagauucuuuuuggaggcacucagagcuaugaguuuuccucucaggacugcuuucauugugucccauaaguuuggauauguuguggguucauuuucauuagacucuaaaaacucuuuaauaucuuuuguuucuuccuugaccaaauuaucauugaguagaguguuguccagcuuccacauguaugugaguuuucuauuauuaauguuguaauugaagaucaaccuuagucuguagugaucugauaggauguaugggaauauuucaauauuuuuugaaucuauugaggccuguuuugugacagauuauauggucaauuuuugagaagguaccaugaggugcugagaaaaagguauauccuuuuguuuuaggauaaaauguuguauagguaucaguuaaguccauuuguuccauaacuucuguuaguuucaguguaucucuguuuaguuucugcuuccacgaucuguccauugaugagagugggauguugaagacucacacuauuauugugugugaugcaauauguguuuugaucuuuacuaaaguuucuuuaaugaauguguaugcccuugcauuuggagcauagauguucagaauugagaguucaucuuuguaaaauuuaccuuugaugaguaugaagugucccuccuuaucuuuuuugauaacuuuagguugaaagucuauuuuauucgauauuagaauggcuacuccggcuuuuuucuugggaccauuugcuuugaaaauuguuuucuaaacuuuuauucugugguagggucugucuuugucccugaggaagguuuccugugugcaucaaaaaguuguguccuguuuacauacccagucuguuagucugugucuuuuuauuugagaauugagucuauugauguuaagaguuauuaaggaaaagucguuguugcuaccuguuauuuuuguuguuagaguuggaaguuugaucaugugguuaucuucuuuuagguuuguugaaggauuacuuucuugcuuuuuguagagcauaguuuucccuccuuguguuggaguuuucccuuuauuauccuuugaagggcuggauuuguggaaagguauugugugaauuugguuuugucaugaaauaccuugguuucucccucuaugguaauugagaguuuugcuggguauaguagccugggcuggcauuugugcucucuuaggaucuguaugacauuugcccaagaucuucuggcuuucauagucucugaggagaagucugguguaauucugauagaccugucuuuauauguuacuugaccuuuuccccuuuuugcuuuuaauauucauucuuuguuuugugcauuuagucuuuugauuauuaugugacggaaggaauuucuuuucugguccaaacuauuuguaguucucuaggcuucuuguauguucaugggcaucucuuucuuuagguugggguaguuuucuucuauaauuuuguugaagauauuuacuggcccuuuaaguuggaaaucuuccuucucaucuauaucuauuaucuuuggucuucucauuauauccuggauuuccuggauguuuugggucagaaguuuuuuacauuucacauuuucuuugauuguuuugucaauguuuucuaugguaucuucuauaccugagauuaucucuucuaucccuuguauucuguuuguuaugcuugcaucuauggcuccugauuucuuuccucgguuuucuauuuccagaguugucucccuuugugauuucuuuauugauucuacuuccauuuucagauucuggaugguuuuguucaauucuuucaccuguuugaauguguccucuuguauuucuuuaagggaguuauuuguguccuucuuauaguccuccaucaucaucaugagaagugacuuuagauucauaucuugcuuuucuggugugaugguauaucuagcacuugcuaugguaggagaguuggguucugaugaugccaaguaaccuugguuucuguuacuccuguucuuaugcuugucucccaccaucugauuaucucaauuguuccuuccccucugauuggagccuguccauccuguucccaguagagucagaacuucucagaguccagcuuccucugagauccugugauuuugggauccugugaugcugagauucugggugugucagaguucuugacagucaaauuuccuuugagccccugagauccuaguguuaccaagcucaugugcuccugggauccugggugugucagaugccuggaaguguugccuccuuugggaacuguggguuguucacugcguuugaaaccaagguagaccaguucccacuggaaggaacccaagccacuggucaggcaguguuuuuuuguccauguuccagcuggccucaggaaccccggguucuguuggaacagauuggguguuccacucaccagugauccuacgaucgugagaguguuaggguaccugugggguggagaguccucuggagacaguggaacugucugccaaguuuggacccgagguggccuggcacugguaccaaaaggaaggaacuccuuuuuauacucccuccaaacaucacauguccuccaugguucuugccucagcaugugucuugucucaggaugugaguuugucucaguugacaucacucugccaaucagccuauguccuaagaagugacaagaagcugcaguacaccaccagaagauuuuuuuuuuuuuuuuuggugcauuucucucuauggagugccaacaaauggaguucuacuacgcaguguaaggcagaugaauacaugagugacaugagugucauuaguguguccuuucacauguuugcuuuagcagaacauccuuuuaucugugucugcuucagugaaacauuccuuuguguauuuaccuuagcaaaacaccauccaacacaacugacuuuccaaagaacccuuaaguuuccacuucaaccugugucccaggaugcuaagacuccaaugacuguaccugaaacacuuuaaugaaauggcugaaagguagaugaagucaaaagucaacaaagccugggaagacuugggaaaguguugucuguaucuccacaggugaaaucaaauaagcagaugaugaggauuucaaauuuccuucuucucauagcucuuugauucacccccagcuuccaaagccuauagucaccaucuguacagaucaucucaguguucauuaaacaaugaaauuccuuucucuuuauguuuagcucugaguggggcauucuaagaaauacucugguaauaugaaaaauguagagauuagaaaaguuugauuuguucuuuuuaguuuuuaagaguaugugucugaucugaagucaguugaauagaauaguaucgucaucaucaucaucaucacauccaucgcugcuaacauuuucugaaauuuuaggguugguucuuuagguguugaagaaccucaccagggaaucaguuguaccucugcaauauuauguuuuucucuuuuuuauccaacaaacaguacuccauuuccccagagagcucuggcuucaccaucgacagcacuggggcaauuuccacagcaagagauuuggauuuugagagcggcaugagaagguaaugcuguccuggguuuucucuggagauacucguccuuugguuggaauguccccuuuugaaaaauauuugccguuaacgugcuccucacauaaaggugcucuugguacugucuuagaauuagaauuagcacccacuuauaauugugccauugcugcuuuggugucuuggggaugcucgcugugccacuugcuuucaucacagugaagcaugaagauuauuuugguaguugugcuuguacccugccagguaagugggcaaguugccucuucagauaccuguaaugcagaauugcuuuuuaauguaauaaucaguauuuuaaaaaguuaacacacugcuccuuuuuuauccaucugcaucagcuaagcaggucaccauggguugaaguuaacauuuuuauuuuuauaaugauuuaaugcuuacccuuuucaauuauauaauucguaucaaagugcuucguaggaaaaggaaguggacucugaagucauuccaauaaaauuacuccagccuuucauaagugagucuuugcuauaaugaaaggugaaaaugaaaaauauccaaagcaguuuccuggauaacagagacccagcacaaacuggcuguccacacaucauauaggucagguuccauugcaggagauucagaguccacaaacagaucaucgagacaaucaucagguuggugcuggggauguaacccaugugguagauuguuucccuaacauacauggggucuuggguuuuuaucacuagcacugcaucaaccaggaauccuacucuucacccauauucucagcaucaaagaagaacaucuuugaguacauagugaguucaaggcuagccuaagcuacaugaucuuaaaccaaaaucaacauacccuagauauuuauaaguccuaagauuuguuagcaaaugaaaauuuauuaaaguuuggaaaaauaaauuuuuuuucugaguucuagugaaagcuuucuuuuuuuguuugccuucucuuauuaccucugaaaucagaggaaagaagacuaaaaacugggaacaccaguugcagaaugggaguacuaauggcugcauggacaauaugacaguuuauuuccuguccauagggcauguccuuccuuccaucucucuugcugcagaguuaguugccugaguuguugaguugauguuuacagaaauaaggaaaauuuuggauaagaacugacauucaucaauucucuuucuuguuagcaaucuuucuuuuguggauacuguguggcagggcauaccugcaaagaugcacuuguggaggccugagaaccacacuguaaacugauuauccccuucccuuguugcuuggguucuauggauccagcucggguagaugcaagcaacugcccauaaaacuauuucauuagccuugauuuaauucuuuuaauuuuugauuuuuaaauuaaaaaauuucaaaauccucuccuuuccuuuuuuccuucuacgcccggauucaaaauccuuuucuugaaaggaggaauagggcuaugaaaucacuugcuugaauacugacgacgaugcuaggaaggaucacaaugguccuguccucuuuucaucauccagccacuccaaagcgaauacugaguuugaguuaucacgcuaugaauauugcuucugucauuuaccuauaaguuaagacuucucagauuuuuauuauuuugagaugggaucucacucugugguccuagcuggucugaaacucacuauguacaccagcuagacuuuaacuccagagaucaacuugccccucaagugcuggaauuaagggcgugagccaccaugcuuggcuauaauuauuucuugaaaugucuucauucuuuuaaauagauuggcuuuuuuuugccaauaauuuuccuauaaaccaucaauuucuuguaggagaaauuuugaaauaagaaguugagaagugguuacacauuggucuggagagaaggaagaugcucauuuuggugucaauuacugguauauuucaaguuuaagaaaguauaucucucaauuuuccuagagcuggaguuuguugagauaaaauaugagcagcaaugggaaaauuaggagucaugacugcagggaucaccaucuaagggacgagagucaccaaagaaggacauuuucauuuucucuccuccccucaccucugugaaagaaaacuucauuaacuguguaaucauccugauguuucuuacagugacuauuuuauuuugaaggcuucuuccuguuuuacuuuauuauuuuuuuaaagucucuuauagccuuguaaucucuacccuccugcuucagccuccuggauggcgagacagcaaguguguccuaccaaacuggaccacuccuaagacuuuguccuuggcaccgauuaguuuuuuuuuuuuucucuucugauuccuuauuuuguuuguuuuuuguuuuuauuaaacuaauaaaaauuuauuuuaaaauauaaaauucaauauugacauuuuaagucaucaaaauaauuuauaauaguuaagugccucuuaaauauacagauuaucuacugaagcuaaaaguaguaugcacucaaccaguuuuuaaaaucuauuugggagaauacacaauguaaguguggcuucauagaaugaauuggguaauguuccuucuguuucuauuuuguggaguaguuugaagaguauugguauuaggucuucuuugaaggucugauagaauucugcacuaacacccccucccccuuuuuuuugaaugacaguuucuguuucuuuagggguuauggaaugguuuagaugguguacugucuggcuuugugggucaacuugacacaggcuggaguuaucacagagaaaggagcuucaggugaggaaaugccucccugagauccagcuguaaggcauuuucucaauuagugaucaaggguaggagggcccacucugggugaugccaucucugggcugguagucuuggguucuauaagaaagcugaucaagccaggggaagcaagccaguaaggaacaucccuccauggccucugcaucagcuccugcuuccugaccugcuugaguuccaguccugacuuccauuagugaugaacagcaaugugggaaguguaagcugaauaaacccuuuccuccccaacuugcaucuuuuucaugauguuuguguaggaauagaaacccugacuaagggaggucauuuauuuuccaguucuguuaaauauaggcuuuuguaguaggaucuuauaauuuuuugaguuuccucaguuucuguuguuuuauuucccuuucauuucugauuuuguuaauuuggcuacugucucuguguuaccaucaagaagggcauuguucagcuuccauguuuaugugggcuuucuguuguuuuuguugcuguugaagaucagccguaguccauggugauuugauaggaugcaugggauuauuugagucuucuuauaucuguugaggccuguuuugugaccgauuauauggucaauuuuggaggagguaccaugaggugcugagaagaaacuaucuuccuuguuuuaggaugaaauguucuauagauauuuguuaaauugauuugguccauaacuucuguuaguuucaaugugucucuguuuaguuguguuuccaugaugugucuccauugaugagagugggguguugaagucucccacuauuauugugugaggaugaagguugagagaagucucccacuauuauuguguguguguucuuugagcuuuacuaaaauuuuuacuuugaaugugggaucuauuaguuuuuaauaaaagaaaucacugucuaaaggauagaaacccacaaccauuagugacuuuuguacagaaaaugcuaaggaauuuccauauccuuccaucccccuuuuauaggaauuaacaaaauucaaaugaaaaauuuaaacacuucaggaauuugugugucaucuuuaugcaggggccaugcuaaucuucacuuaagucugaugugauacugcuuugguggaagccugcuguuugucaggaagucuuaguugucuuuuuugugccugugccuuuaguuuuucacugauuauuaaagugguugauccuggaggccuguuugcuacuggaaaucuaaagauuuuccucgucaaugucaacaauaaggacccuauucuugcuugcagguaagcaacauauuacuugauaugaccuugaaaaguuagucuuuccuuccuguuuuuucuuuuuagcugagaaugaagcaauuuagcaagcauuguauaaauaaccaacacaggaaaagaguccaaaaaaggcuuucuuuuuuuuuauuuuuguuuuuauuagauauuuucuuuauuuacauuucaaaugcuauucccuuuccuaguuuccccuccaacuccccccagcccuucccaccuucuucugcucaccaauacacccacuccugcuuccugucccuggcauuccccuacacuggagcauagagccuucacagaaccaagggccucucuucccacuaaugaccaauuaggccaucaucugcuacauaugcagcuggagucaugagucccaccauguuuacucuuugguuggugguuuagcuccugggagcucugggggugcugguuaguucauauuguuguuccuccuaugaggcuguaaaccccuucagcuccuugggucucuucucuaucucuuucauuggggauccugugcucaguccaauggauggcugugaguauccauuccuguauuagucaggcacugguauaccucucaggagacagcuuuaucaggcuccugucagcaagcacuuguuggcauccacaauagugucuagguuuggugauuguauaugggauguaacucaaggugaggcagucucuagaugguuaguccuucagucucugguccacauuuugucucuguaacuccuuccaugaguauuuuguucccccuucuaggaaggaccgaaguauccacacuuuggucuuccuuauucuucaauuucauguggugugcaaauuguaucuuggguauucugaguuucugggcuaauauccacuuaucagugagugcauaugauguguguccuucugugauuggguuaccucagucaggaugaaauccuccagcuccauccacuugccuaaggauuucaugaauucauuguuuuuaacagcugaguaguacuccauuguguaaauguaccacauuuucuguaucuauuccucuguugugggacaucuggguucuuuccagcuccuggcuauuauaaauaaggaugcuaugaacaaaguggagcauguguccuuauuacaaguuggagcaucuucuggguauagcccaggagugguauugcuggaugcucagguaguaguauguccaaucaaaaaaaugauuucuuaaaccugaaacuaaagauaauuuuaaaguauaaaaauauauugaaauugcaagaaaauaagguguuauucaugcaaugcauccuuaaccucugaguugugguuuagcuauuauuucucuuaagggagauucuagucaguguuguaaucagaguuuacagaagcacauugaggucagcaucucgguaaagucagcacuuaugcagaagcauuaagagcacagugaucaugcauacaaguucuagagcaaagagguuugugaucaacccucucuggaccaccucgguauuuacuucuggaauuucuuuaauuuauugagcuaucaguguucacaucuaucaaauggagaugaacaugguccugacuuucuaggggagugucuucaggggagaaugaguaacccauaauaagucuuaggauuuuauguaaaccuaucagugugugguugagacacuucugucaugaauacggucuccauugugccccuacaccauucagucuuuauaccuucagcaccauaaggauagaaaacagagcuuguaccaugccaauaacauuuucuuucaaaacaagcuuguucaauauugaaaacggggucuugagaguuaccuucacaaauucaacucugcaccgcaaagucaacaucacacuggaugaagaaauuccaguugggaagaugauugcaaugugccaggcaacugaugaagauaaccugggagguuuaaccuuuggacuagauacaguggaugauuauuuugcaguggacaaagguagguuuaagaaacuguauaucugucuccccgacacaugugguuucuagagggguaugagggagacuuuggaaaugucugaugaguaauucugcagggucagcaucuuacuuauucuucugcuaauacaugucucgucacagcuguuauggauauuauuaccuccucaauuuacaugccauuuuaacacauuuucuuagaccuaacucaacucuauucuaccucaggaccaaauguuugugagggagagccugguuugacuuaggagaguugucuuucauuccgucuguggugaggcagugcaauaccugcucaguguaguaagcuugguucccacagccugucuuggaaucugacugcuucauuacuuuuuuuuucuuuacaagucccaggcuggacaugaagaaaguguccauucaugacuugguguacaaauccucuagcaauuuuccuugcuauagaccaauucccuauaugauuuauacuggcucacaggguucuucagugaugugaggcucuugcugcuacaagugggcacuggcuugaugaugagcuuuuauugggaguguuuuuccccugccuuucuuccccaugucacacugcccuggauuggcucccaaacaaucugcuuauacucauguucugauuuguauggaucucuuagauuggcugccuguuuuauaguuuguugcucugcauuuuuacagagccacuagugaguuuuugauuacucaaauugggccauauuucuucucuguucaaaaaauccuuucaauuugcuguuugcacuugaaguucggcccagacaucuuauguuaccacugagaaccugcuucucuggcccuuaccuuguucucaacgcugcugcccucccugagaaccgccauguugccuugauucuuucuucguucaauuguuauucugaaccaguacauaggcugucagccuugagacccugcccuuguguuuucuaagugccugaucacuaaacauuauuaccuguaaaaaaaaucacauuauagagcucauuuccauuauaauuuuuguuuuucuacacauauugaggucuguauccaagcuuagaauauaaauucgauaaauauggagauuuucugucauaauacugaaucuaguagcuacaaugcauaccugcuacauagauguagucaauauuuuuuggauuuaagugauugaugaauaagaacaacuuaaguucuagcagcacuuuuaucugugguucucucugcagggaaucaucccucauuuacuaauauuuucuuuugcuauguaaccuucaagucauagaaugaggaucucuucuagagagucuucuuuauucuuuaagugaaaauaaccuuguuuuccuacccauuaacauaauaugaugaauagcacauuucagcaagaaguaacuuagcacuguucauucacuuugaauucuccccguaagucuagagaauagggcauacuuuuuacuuuuuuuucuguaguauuacauguaacaaagucauuuuuaaaaugagagucuggacuuacugagcaggaugugcuguuucguuacagagaaggggaccgugguuacgacuaaccaucuagauguggagaaaacuggcuuugcaagugcucuguccuucucuauuaaggcaugugauggugaucagagguguacagugauuccaguggcuaccuacauucguggcauuaaugacaacucuccuuucugugaucaguaucucauucggugagcggacaauagacagaagcaagaacucagauugggcagagagaaggaaggacuguuguaucuaucagcucacuaugacauguggcugaucaaguuuaaucuugguuacucagaaauguuccucacaaauagccuggugguccuucugugauugaaaguugaguuuccaagaucugaaagugagaucugggguuuuaaugguucuacuucugucauuaacagaagcccuacuguuuugcuuuguaaaauggcaugucaguagaucuuuuugaaaauugguugugaagaauuaauggacuaauuuuggggacuguuucagcauagugcugagcagcugcuaugacauaauuucccuuauuaugaaucugcaauuaucaccagaaauccuuaccacugaauagauuucugguuaaagauuuuguuccugucucaguaaaauauuugccuuauaagaacaaggaucugacuucaguacccaugacacagauuaaaaaaaacaaaaacaaaaacaaaaaacaaaaaaaaaacccggugugguagcaagcuuuuggauacuuagcccuugaggauggaguggaggagacaggcaggucacugggacccacuggccaggcagacaagcuuacuuagaaaccagugcagaaagucugucccaaaccaaaccaaaccaaaccaaaccaaaccaaaccaaaccaaaccaaaccaaacccccaccaccaaacaaaauaguggacagugucuucuagcuuuuaccuacauguguacauguguacaugugcacacucauguaccuguacacccaugugcaccugcacacacagcacaaacauauagacuuugcccuugauuuaaaaaaaaaauaaccugguucaugcaccauacauuguauaacucucuaagugagaacauaauaaauauccauauuuauaucucugacaauggaaggaaaaugaucugacaguguggcuaaaguuuugaugcaaaaugcagggauaggauuugaugcuaaguaagugaugaagaauuccaaguuucagaauuguuggcuuuugcgguauggagaagaggugugcacacuuuuucaugugauuauucugcucuuccuucucuucuccuacacccuggucaucugccugagaacucaucuuugcuguuucuccuauuaucucucuccuuccuuaagaccuucuguugccccuaaccucccucucuauucauggccuauaccuacaucacucccccauauaaaaagcuaggagauacacauaagagagaacuuuuucuuucugagacugggcuaccucacuuaauacaauaauuuccacaucaaucuauuuuccauaaauuuacauaauuuuauuuuuacuuccaacuaaauaaaauuccaccagauauauccacacuuuauuacucacucauuaguggauggacaucgaggcugcuuuuauuuccuagcuauugugauaagaugagaugugcacauaucucugugguaggauauaggaaucuuugcucagagguagcugagucacauagucauucuauuugaaauuuuuugagggguuuccauacuuauuuaucuaguagcgauaucagauuacacuacuaggaaauaguuuucuaaaugaugcucuaaggaagaccugucugcuccaggauuaucaaggcccauacauagaccuuaucaaaagugauguuuaagggggaaugcauugcauuauaagagaaugcuuauauacauugauuuuucuucuugaacaauuaaacagguacauaggcaaggaggagauugcaaaagacacaguuguugcuaagcucucaugccaugaccuugacaaaccuccugauacaauucauuaugcuccaaguucuggcccuguagguucuggacaacuauuugagcaagugccagauaccaaaaauuucauucagguaagucccaguggcuguuauuccagggucuuucccaagaaaauggagucaggucauggcaaauuggaucggugcuaguagguuccaaaggaggagaagaguagaggagaauucugggcucuucugcugucauaccagaaggcacuuggaaugcuuuuguuucuaccaccaguuucuccuuuuauaauuaucacaaaacaaugaacuuucuacuuagcuggggaaagcagaagcuaagaacacaugcugauuuccuuagaggucagucuguaugacagcauguuugacaaugcucuccuagcauuggaagucagugaagucagcuccucuucaagagagacauacuuucuacuggcagaguauaaagacugcagguucuuuucuuucucuacucaugauuuugacgaaauuccuuuuccuaagucccaauuuccauuuccagggcauuuauuucauuguguuauucugugauagcuuccauagcuccuuaccccaugccucaguaucaccaacuacccucauguaauuccuccuguuaaccagaaaauaugguugagaaacccacaggugaacucuuucuuucucuuguucucaccccacauuuuuuuuugacaaagucuauagcuauaaggcaaguucuuacaugacugugaaguuuugacauuugggcacagaaccagguacauacugugucaauacucauuuuguaauuuuguaauacaaaccugaagugucauuauuuaggcaugucuuuccacacacuguucauucaaaauauuucaaugauuugccuauggcaacacaauuagcaugcaauguagguuaugagcuauauagucuucaaugcuggaaugauccaucuaaaauuaagcuccuccagaagggagugugguguccuguugcuccacccaaauguucauuuauauaucuuagcugcugcugaacucacacauucugaaaugucauccuaggaaaugaaaauggccaaaacacucaguguuuucagacugacuucuuaaagcauguacauuagaaauuuuggcucugagccaguggauaaaggcaccugcuuagcuauuuauguuccaucccagguaucugcaaugugaaaagaacagacuccugaaaguucuccucugacugccauacacaaaucauagccucucucucucucucucucucucucucucucucucucucucucucucucucucucucuccucuuucucacacauguaaaagagauuaaaaauucauuuuucugaaauaaugaaauaauguuguucuauaagguuaccaaagaucuggauuaugaaaacccagaggugguugcagcagggcacauguaugaaaugaugauuucaguauuugaugaccuacauccaucucauacagguaaucauuauaaacuguucaaggcugguccgugugcuauaaacauucaucacauuaggaaugagauagacugaugguggaaguuuccaucacugggaagacuuuauaucucuuagcagcaucuuaaauaauauauaauucuuaugucauggucuggcuagagaucuuagcauuaaaaaaugcaagagaguauggguucuuguuaagauucuucuguauauuuguaaauauauaaauauuuauauuguauaugauauauaauauauuucuuuauacuaucaauugaucauauauauauauuugauucuuuaugcuaaauaauaccaaauacaucugacuugauaucaggcaaucugaagugcacacauauagguaauuguugccuuaaauauauuuuacuugaaugauauuguaagauguaauguuguuauuaaagcaagcaaugagcuacuugacaauuucuacaguuccugagcccaaagaaugugccgggcaugguuacugcuuucucacauaauguugugucaagacuuuuccaccauuuugugccagccuaugauaaauaagccuuugaugcagugagauucaguuugcuaagacugcaugauuauaaaauucuuggcacuuagagauuuaauaguugcaauuuugcugacugugaauuacuauucuuuugacauauuugaaucaggugcuaaggauccggagcaaaaugauuaggaguuggugugcuaaguaaucucccugauucguacuuuugguaaaaugaaaguauauacugaguuuccuaagggguugguacuuguucaacaauuacacaucaggaguuuuagacuauuuuggagggaauugggcuacagagaacauacucagaguuuucagguuacaagcaccucuccauuacugguaaaucaaaagucacuggaggaacuuuaaguuuaaucauagaaagguacugucugguaauaaagaaccuggaauaagggcacaguuggguuuuguucucuugugagaacucugaaucauugcuggugguugccuugaucauuggguugagugggauuugaagcaaauaagaaagaguauauugucuuucaucgaugcagaaggguggaauaagucugaauuggaaucaauacaccuaggaugcuuucaaucucuccugaaucaaugauguaaaaaucuuaguugaguuguugugauuggauauaaaaugauacccacaggauuguguuugaauacuuuauccccagaugguaacacuguuuugggaggcuguggaucuucgggaaagugcuugucacuggggucacuggcagugugucaugggaguuauaucuugacccuacuuucugcugucuuucuguuuccugaucugcugagacaugagcaagcauccuccacuuccuccuaccacacauucucaacuguaaccaagagucaaaauccuuucucauuaauuugcuucuuuugaguaucuuuauugcagugauuaggaaaguagcuaacaugguggcuaaguuaaaauggugguuuguagacuuacccagcuaccaagagaaaaugcuauuuuggaggcaggaaucaaagcaugacaucuugcccagaaauauucuugaauuuuugaagcuauugguagaacaucaugaagaagucuaucauauaggccaaagugaccuuuuaggauggauuuuuuuuuucuuguagcuagauaacuugcccauuucaccagauuugaaccuuucuugaacagggcagagaaaaaaaaaaaacaaaaaacaaaaaacaucuuuuucaguaagauauauucucuggucuucacuugucaacauauucacaguaauugcucauaaaauaugcuuacaacauugcacauuucacuccuguucuauagguccacuuauucacacaauuugaagucuuuaugguugcaauaaaaaaaucauaguaccguagaguuguaaagagcacaacuauuauugaaacauauacauuuuuguuuuugauuuacuugauuuauugaaagaaauauaugggucuaaaguaaauuauuugcauuuguagagcaaaaugcuuuaaacauuuuagggaucauuuuuacuguugagauugugaugaaaacuguagaggcaauccuugaaagugaauauaguagcauauguuagaagcuaaagcaugccauuaacuuucugaaauaaaggucauauagaucucagacugaauuuuacuauuugucguaugucacacagacuuuaggggaggcaauauaccagaauucuuuugaacaugagugcuauagauagaugcuagaggagaacuucauggucaaacaagucugagaagaaugcuugccuggagauucaaaauaaacacuagcauagcggaaacccaaagaagucuugccauaaaagccucuuuaauuuuuauuuaauugaggacuucguauuuggcacauucauaucucaaagauguuaguggccauuauagcuuguucuggcaucuacuccuuuguaauauuagaauuuucacuuuuguaauauuagaccaugaacaguucuguucaucucauucuuuuucuuuuucuuuuuucucauuuuuuaaaauauuuauuuauuuauuuauuuauuuauuuauuuauuuauuuauuuauuauaugcguguauuguagcugucuucagacacuccagaagagggcaucagauuuuuguuauggauggcugugagccaccaugugguugcugggauuugaacucaggaccuuuggaagagcagucggcgcucuuaacugcugaaucaucucaccagccccucagucuuuuucuugugaaacuguggcaguuauaccaauguuccuguuuuugucuugcauacuauauucuaauuuuacucuaaaauauuuuccuacuuucaaguugcuucauuuuauguuuuaauaucaaaauauuucuuuucaacaucucucuaauaggcuaccuuagcuuguuacccaaagcacagaguuccuucuuuuacuggcagugcacaaaaauuguaacaaaucuuuaauuuauuuuuacuacacuuaaugauauaauuguaugugugugugcagagggguaggacaugccauagugugcauguggagguuagaaaacaacuugcugguguacagucucuccuuccaccaugugagucuugagauugaauuuaagucuucaggcuucggaucaugcaucuuucuuacugagcaaccuggcuggccagagauaccuccuucugugguaaccuaguauccuuugaaaaaauuuuugaucauaauuuucuuugucuuauauuuauacuauuuauacuauuguguaggagauggacaguggcuugauugauugauugauugauugauugaugagaaaacugaguuuccuagaaguggaugauggcuuaaagacacagaauuuauguuaauucugaacauuaaacaugggauuucugagacaagcuuuaaaagcauaauguaggacaucacagacugauuggagugucaccucagcuaacuaauggaagaauuguuccaaagaaauuuguaauaaacucucuuguagaaaauaugcuacaauauuaugcauaaauauauuauuauacauguauauguguuaauaaaauaaaauauaaaacauaauaccguagacauuuuugcuaaacuguuuuggcuagccaaggaauucauuuggauauugucuuauguuccuuguugcugucacagauauuugauaagaaguaacaggagggaugauuggcucaugguuugaaaagauauagaacacuaggagauaguaaggguggcaguaagaauugaaugaagcaaauuacauugcauccucaaccacauagcagagacuaaacaggaagaggagcccuguuauaaaaccucaaccccccuucccuuuuguccaaggacaauccucuuucuaaggauccuacagccuucucuaauggcaccaucacuuaggaaccaaguguuuuaauacaugaguguggaaacaccaaucauuuggagguagaaagacuccugcuguaguuucauaauucuucucuaauucugauacuggggacauguuucaauaguuuguagaguaaauugacaaaagguauuaauuuguuguucaauuuuacagugacggugacaauccuuguggagauugccccugagaaugauuucagccccaaauuucaagccuugcacuauguauuuucaguuccagaaacaucagaagguaaaaauauucuaagguauuuaacauuaaagcauacacaaggaaacacauaccagaugucugccgaggagcugauggaaaaggaacaugagcauuuauagaacauaagcagguauaggagugugguuggacauaacaccuucagaggaguuucucuuuacuggcaaugcucuugaacaucaugcucaugaacucccaaaggcuaauuugauauuugaugucaguuuuaggauuugcuuuuguuguggacaaaugcacauuacugacuuuacuucauuucuuauccuuugucuccaaacuaugacuaagugucaagaaauaggaauagugugguuauuauccauauaauccaaauaucaugcccaacuaggguaaagguuuuaagucuaagguucuaucucuguuuuuaauuagauauguguuaggacauagugguuaaccucauuuuauuuggaagacacaacaaugguaauaguuguaguucugucaucuaagauggaaaaauaucccuuccucagaaucucuggauaguaaguccuccaggcuugaccugaauacuucaaguuacaggacugacugugaccugagaucaaguaaaacugcuuuguaagcauaucauguuguagcagagagaccaugaguacauaugucaaaggaaacuggcuucaaacaugucucugcuaucagaaguuaaugaucucagcaacucacauaucuauauaucuuugaugguuuuguuuucuuauaaacucauaagaacauuuuuuauaguauauaauauuuggaguaguaaaauuuucucauuucuuaauaaauaaauuuauuucuuaaaauggaagcauucaaaguaaagucuccauacuauuuugcuauguugaaaccaguaauuuacugaauagaugagguaucccuugauauauuuagggguaaaguuuucauuuguuuuaaaguacuucagcaaaauaaaugggccauuauucuuuuuguuuguuuguuuguuuuguuuuuuuuguuuuuuuuguuucuagcccuggcuguccuggaacucacuuuguagaacaggcuggccuugaacucauaaauccaccugccucugcuuccugagugcccauuauucuuugaaaacuucacuccuucaagggcagggagaaauuguguaauuauaagaaauaaaaggagggaaauaauucaagccugugaaacaaaacaaaccaauaaaagaucccaaugcacccugauauagcugucuuguaugaggcuaugcaagugccuggcaaacacagaaguggaugcucacagucaucuauaagauggaacacagggcccccaauggagaagcuagagaaagcaccuaaggagcugaaggggucugcaaaccuauagguggaacaacaauaugaacuaaucgguauccccagagcucauaucucuagcugcauauguagcaaaagauggccuaguuggccaucacugggaagagaggcuccuugguauugcaaacuuuauaugccccaguacagggcaaugccagggccaagaugcagaaguggguggguaggggaacagggcagggagaggguauagggaacuuucgggauaacauuugaaauguauauaaagaaaauaucuauuaaaaaaaaauaaggagacaagucccuucugguuggcaccagcaccaggucaccuaggcgcagagucugcagacacccccaaaguuccuagaggacucuccacgugaucuuaggaccucuggugaguggaacacaaccucuguuccaauccaaucacacgggaccugagacagcauuagggaagcauaaaaccuggccuggccagggucacaagucccuacagaucagcgccaguacugggucaccuuaggcacauaguuggcggacacccccaaggucccuagaggacagcuucugaggcagaccccaauucgggcuccagacauccgggcacauucucugccagaggagaggugucugccccgccugggagggcuuuguuggagcaccugggggauccaccuugguucccagaucccuccaagacuagucugugcaggugaaaguguggaacacaagagcuaacagcuucugggacaggcccuguuucaggccuuccucuucugccaggaggcagguccaaacaccagauaucugugcaacuugccugcaagaggcgagcuuggcugcagagagugcucugaccacugaaacucaggagagaucuagucuccaaggucugcugauagaggcuaacagaaucacgagaggaacaagcucuaaccagagacaacuauaacaacuaacuccagagauuaccagauggugaaaggcaaacauaagaaucuuaccaacagaaaccaagaccacucaccaucaucaaaacgcagcacucccaacucaccaguccuggacaacccaacacaccugaaaaccuagaccccguuuuaaaagcauaucucaugaugaugguagaggacaucaagaaggacuuuaauaacuaacuaaaagaaauacaggagaacacugcuaaagagguauaaguccuuaaagaaaaacaggaaaacacaaccaaacagguagaaguccuuaaagaaaaacaggagaacacauccaaacaagugacggaaaugaacaaaaccauacuagaaauaaaaauggaaguagacacaauaaagaaaacccaaagugaggcaacacugaagacagaaacgcuagggaagaaaucuggacccauagaugcgagcagcagcaacagaauacaagagauagaagagagaaucucagcugcagaagauuccauagagaacaucggcacaacagucaaagaaaaugccaaaugcaaaaagauccuaacucaaaacauccaggaaauucaggacacaaugagaagaccaaaccuacggauaauagguauagaugagaaugaagauuuucaacuuauagggacagcaaauaucuucaacaaaauuauagaagaaaacuucccaaaccuaaagaaagaaaugcccauccaugaacauacaagaagccuacagaacuccaaauagacuggaccagaaaagaaauugcucccgacacauaaauaaucagaacaacauacacacuaaauaaagauagaauauuaaaagcaguaagggaaaaaggucgaguaacauauaagggcaggccuauuagaauuacaccagacuuaucacuagagacuaugaaagccagaagauucuggacagauguuauacagacacuaagagaacacaaaugcuagcccagguuacuauacccagccaaacuuucaauuaccauagauggagaaaccaaaguauuccacaacaaaaccaaauucacacauuaucuuuccaugaauccagcccuacaaaggauaauaauagaaaaaaaaaauacaaggauggaaaucaagcccuagaaaaagcaagaaaguaauccaucaacaaaccuaaaagaagacagccucaagaacagaaugccaacucuaacaacaaaauaauaggaagcaaauauuacuuuuucuuaauaucucuaauaucaauggacucaauucaccaauaaaaaaacauaggccaacagacuagcuacacaaacaggacccaauauuuugcugcuaacaggaaaccauucucagggauaaagacagacauuaccucagaaugaaaggcuggaaaacaaauuuccaagcaaauggucugaagaaacaagcuggaguagccauucuaauauugaauaaaaucgacuuccaacccaaaguuaucaaaaaagacaaggagggauauuucauacucaucaaagguaaaaucuucaaagaggaacucucaauuacgaauaucuaugcuccaaaugcaagggcagccacauucauuaaagaaacuuuaguaaagcuaaaagcacacauugcaccucacauaaugauagugggagacuucaacauaccacuuucaucaauggacagauuguggaaacagaaacuaaacagggacacauugaaacuaacaaaaguuaugaaacaaauggauuuaacagauaucgacagaauauuuuguccuaaaacaaaaggauauaccuucuucucagcaccucaugguaccuucuccaaaacugaccauauaauuggucacaaaacaggcuucaacagauacaaaaauauugaaauugucccaugcauccuaucagaucaccauggacuaagggugauccucaauaagcauauaaauaauagaaagccaacauucacauggaaacugaacaacacucuucucaaugauaccuuguacaaggaaggaauaaagaaagaaauuaaagacauuuuagaguuuaaugaaaaugaagccacaacauacccacacuuaugggacacaaugaaagcauuuuuaagaggaaaccucauagcucugagugccuccaaaaagaaacuagagagagcacacacuagcagcuuuacaacacaccuaaaagcucuagaacaaaaggaagcaaauucacccaagaggaguagaaggcaggaaauaaucaaacucaggggcaaaaucaaccaaguggaaaaaagaagaacuauucaaagaaucaaugaaaggaggagcugguucuuugagaaaaucaacaagauagauuaacccuuagcuagacucacuagagggcacagggaaagcauccuaauuaacaaaaucagaaaugaaaagggagacauaacaacagauccugaagaaauccaaaacaccaucagauccuucuacaaaaggcuauccucaacaaaacugaaaaaccuggaugaaaugaacuaauucuuagacagauaccugguaccaaaguuaaaucaggaacagguuaacaaucuaacagucccauauccccuaaagaaauagaaucagucauuaauaaucucccaaccaaaaaagcccaggaccagauggguuuagugcagaguuuuauuagaccuucaaagaagaucuaauuccaguucuucacaagcuauuccacaaaauagaagcagaagguccucuacccaauucauucuaugaagccacaauuacucugauaccuaaaccacagaaagacccaacaaagauaucgaacuucagaccauuuucccuuaugaauaucgaugcaaaaaauacucaauaaaauucuugcuaaccgaauccaagaacacaucaaaacaaucauccauccugaccaaguagguuuuguuccagagaugcagggaugguuuaauauauggaaauccaucaacauaauccacuauauagacaaacucaaagacaaaaaccccaugaucaucucauuagaugcauagaaagcauuugaaaaauucuaauacccauucaugauaaaagucuuggaaauaugaggaauucgaggcccauaccuaaacaugauaaaagcauuacagcgaaccaguagccaacaucaaacuaaauggucagaagcuggaagcaaucccacuaaaaucagggacuagacaaggcugcucacuuucuccauaucuauucaacauaguauuugaagucuuagccagagcaagucaacaacaaaaguagaucaaggggauacaaauuggaaaggaagaagucaaaauaucacuuuuugcagaugauauguuaguauauauaagugacccuaaaaauuccaccagauaacuccuaaaccugauaaacagcuucagugaaguagcuggauaugaaauuaacucaaacaagucaauggcugaaaaagaaauuagggcaacaacccccuucacaacaacccccuucacaauagucacaaauaguauaaaauaccuuugcgugacuaacuacagaagugaaagaucuguaugauaagaacuuuaggucucugaagaaagaaauuaaagaagaucucagaagauggaaagaucucccauguucauggauuggcaggaucaauauaguaaaaauggcuaucuugcgaaaagcagucuacagauucaaugcaauccccaucaaaauuucaacucaauucuucaacgaauuagaaagggcaaucugcaaauucauuuggaauaacaaaaaaccuaggauagcaaaaacucuucucaaggauaaaagaaccucugguggaaucaccaugccugaccuaaagcuguacuacagagcaauugugauaaaaacagcauggugcugguauagugacagacaaguagaccaauggaauagaaaugaagacccagaaaugaacccacacaccuauggucacuugaucuuugacaagggagcaaaaaccauccaguggaaaaaagacagcauuuucaacaaauggugcuggcacaacuggugauuaucauguagaagacugcgaauuaaucuauuccuaucuccuuguacuaaggucaaaucuaaguggaucaaggaacuccacauaaaaccagagacacugaaacuuauagaggauaaaguggggaaaagccucgaagauauggguauaguggaaaaauuccugaauagaacagcaauggcuugugcuguaagauugagaaucgacaaaugggaccucaugaaacugcaaagcuuuuguaaggcaaaagauacugucaauaagacaaaaagaccaccaacagauugggaaaggauuuuuaccaauccuaaaucugauaggggacuaauaaccaauauauacaaagaucucaagaagcuggacuccagaaauaaaauaaccccauuaaaaaauggggucagagcuaaacaaagaauucucaccugaggaauaccaaauggcugagaagcaccugaaaaaauguucaacauacuuaaucaucagagaaaugcaaaucaaaacaacccugagauuccaucuuacaccagucagaauggcuaagaucaaaaauucaggugacaacagaaccuguccaggauaaggagaaagaggaacacuucuccauuguuggugggauugcaagcuuguacaaccacucuggaaaucugucugguuguuccucagaaaauuggacauaguacuaccggaggauccugcaauaccucuccugggcauauauccagaagauguuccaacugguaagaaggacacaugcucuacuauguucauagcagccuuauuuuuaguagucagaaguuggaaagaacacagaugucccucaacagaggaauggauacagaaaaugugauacauuuacacaauggaauacuacucagcuauuaaaaagaaugaauuuaugaaauuccuaggcaaauggauggaccuggaaugcauuauccugaaugaguuagcuuaaucacaaaagaacgcacaugauauguacucucugauaaguggauauuagcucagaaacuuagcauacccaggauacaagauacaauugcaaaacacaugaaacucaaaaagaacaaagaccaaaguguggacacuuugccccuucuuagaauugagaacaaaacacccauggaaggaguuacagagacaaaguuugguggugagaugaaaggauggaccaucuagagacugccauacccuugguuccaucccauaaucagccuccaaaugcugacaccauugcacacagucaaaaaauuuuucugaaaggacccagauaaagcugucucuuguaaggcuaugccaggucuuggcaaacacagaaguggaugcucacagucagguauuggauggaucacagggcccccaauggugugugugugugugugggagugcuagagaaaauacccaaggagcuaaagggaucugcaacccuauagguggaacaacaauaugaacuagccaguacccccuggagcucgugucucuaccuucauauguaucagaugauggccuagucggccaucauuggaaauagaggcucauuggucuucuaaacuucauaugccucaguacaggggaaugacagguccaagagguaggaguggguggguaggggaguggggggaggguaugggggacuuuugggauagcauuagaaauguaaauuaagaaaauaccuaauuaauaaaaaaagaaguugaacugggggggggggggauaaggaaaaaaaaucccaaugcuuuaauuccauucagcuuauauguccuaauaaggaaaaauaaggggugauuuuguugcuuuuccaaaaauaaaaaaguaaaaauucuagcacgcugaaaacugccaucacucaggagacaucagcaguauaacucauuggcagugggacgaaaaguguuugacaucaagaauccagcuacuggcuuagaaagaugacuuagcagcuaagagcacauacuguuuuugcagagggccuaaauuccauuccaauaauccucgguuguuggcuuacaacugccuuuaacucuagcucuaggagaccuagaaccucuggcuucuguuaucaccuagacucauguguaggugauacucccacagagacacauaauuaaagauauaaauauauaugcaauuauauauauauauauaauuaguaaauacauaaauauuuuaaaagaauccucauaugugacaacuugcaaguauacugagguacugugcaggggaugcuagacaugcacagaagccucaucucagcucuaugaucuaguuauuaucuugauuuuaccgaugagaagucaaaaguacaggacucggacuauaguucauuuccacaaagcuccuauaaguauaucaaacauugggucuauagaccuugagaguauuuaaaaacuacauuaaggagcugggaauggugggacuugagaggcagaggcagguggaucucugaguuugaggccagccuggauuucauagugaacuccaggccagcuuaaaacagaacaaaacacuacauuaauagaaaagguguuuccccauacugaauuaauuagcauagaucauucaaaugcauccaguagauuacaugacaauuauaauuauggagaucuauaguacuuaaaguaaaaacuaaugaucugugauaagcuggcagaaaucuauggaaggaaguagauguagguaaagaacuccuuuaucaguagugacuuugagaaaacauggcuaguaaaugaacugaguugcaggucaccagggaaaauguacuccauuuccaguauguuuugaugagguucggcagcauucagagucccaucauuacucuauuuaaaauucagcuaaagguacucaagauaaccuuuagaguuuauugcaagguuaauuuuacaccuucaggagagcaugcuucccguuguaauuuaccagguguuaaguguggaaaugaucccaucacucuucaggucuguaagacagagcuuaguguuacugguuaugucuucuccaugaccauguauccauuguaggacccuuuauaaauaugaagcugucucucaagcaauagauuaguucucuucugggacugccagaagaagaaaguuucuuucuuuccaugacagcucuucucguguuguuaauaucauaaucugugcucagugccuacuuaauaguucacuacaagagaugaaucuugauuaaaagaacaugccagauaaggaaauauucuuugagguugaaagugaugaggauggcacaugcucuuucuucuucaucacugcucaguggaaacacccagacaggucaugguaagcuacauaucaucaucuaucagaucuuaugauuuaaguauaaaaugauugaagaguaaccuaucauagcuguaaucuauugucauaaagaugcuaugugcuaaaucucauacagauuagaguaacauagcaauaaauauuucuagcuuagacauccaagaauugcauuaucuuuccggucuugcucaagcuugugagagucagcucauuuuuagugcucuguccugguguggucuugcucaagcuugugagagucagcucauuuuuagugcucuguccugguguggucuugcucaagcuugugagagucagcucauuuuuagugcucuguccugguguggucuugcucaagcuugugagagucagcucauuuuuagugcucuguccugguguggucuugcucaagcuugugagagucagcucauuuuuagugcucuguccuggugugguugggaugacugaagugcuuuggcuuuucccccauccucuucuucucaggauaaacugaguauguucuuagagugaaggaagauguacagucauaacuagagugacuuucuuagguauagucagcaaagcaugugugugugugugugugugugugugugcgcgcgcgcgcacgcgugugcacgcaugugugguaauguggcaaaagaaagucaaucuaaccucacaaauacuucucauaccuuugccugcaucagguugacuuaauaucucauuaaucaaagcaaaucacaagccggagugcuaagguucucugcauggcuaguaguggggacacauggaggguaaagaacuugggcauaggaauuuaaccaauguacuguaguuaucauuuuucugaaagauuccuggugaauauuauuaaccagaaguauugugaagcaauuuuaaaauuggauuguagaauuagcaggcacaggcuugagauagacuccuucacaauuaguuguguggccuugggcaaauuaacaucacagggucucaguuucuuauguauaaaauagaggaaguaguacuacugucaucagacugucaggaaggcucagugagagaacuaugcaaaugagaaauaauucuuacuuagcauuuacuguacauuaggauuucuauuauuguaagugcuucauguauuuuaauucacccagucuucacaacucgguaugguagauacuguaauugcacuuaguuuacaaagaaagaaaaaaaaagaaggggccuauagaauuguccguuguucugcuaguuagagacugagauuugcaaacugaaacuuccagguucugaguacggccuuugaacauuauaugccacucagcauaauacuaagaugaagcugauuauuuauauuauagagguguuuuagaauuguuucauuugaacgaauacaguggucuaugauagcuagacauucccuguaaaucuaccugauauuaugugaaguuuuagucaucaaacacucauuauuaccuaaaaguauuuauauucucaucacuuggaaaaauacagauuaucauuugaaaaauuauagauauuguaagccuuuauguacaugagaaaaauaaacuguaaaacguugccagcuuucuacaaaguuggacaagugacugcuauugaugaggaccacccaccagacugucugacauacaagauaaucaagggacacagccaggcuguacaaauguuuuggauucaccccuucucuggagugaucgaacucaccacucagccagacuaugagucagugaggcaauauaaccucacaguugaagcuguggauugugacagagaccauccacgcacugcaguggccacagugaguaaagagacacagguuuuguguccaugugacugaccaauguauuaaguucuaauuuaucacaauaguggcagauaauagagaaaacuugugaauuucuucuacuugucaaguguuucauaauguuuguaucaacuuagauuuggaagucuggaugacguaauuuuagaguuuuaaaauccuacauuaauaagugaucuuaaaagcuuuaaccuccuuuuagcccaccgcccaccagagguagugguaaggagaguuuaauaugacauaggaggauguagaccuguuuagaaauaguucuuugggacaauuucaaucuuuguugucagaauauuugcaguucaguucacacaaaucagaagugguugcuugauccacuuggaagcacuauuuacaaaucaguaacagcaauucaguccagaagaaaccgaggcuccaucaauaggccuggguccccauucugcagaaguggcaagaagcugagggaacaccaccagaaguucuuugguggauuucucucuacaaagucaggguagaaaggcaaaucaaugccacagaguuuucagugaagaccagaaucagcaaagccuacagaagaccagcaaauguagcaaggagaaccaaugccacaguacuguccacugucuguuggguuaugcuuauacucuuucuaaacaucacauguccucugaagugucugcuauggcaaaacaucacaugcucccuuuguaggcuuuuuauuuccagaaaaacaccaugagucuuuucucggcaaaacaucuuuucauaagagaguuuccagaaaaacaucacaugacacaacugaaucuccaaagaaaccagaaauuuccacuucagaauggggaaggaggaacuggcuaccuucuuucucuugcauauauggguucucaaaaggauaacaugaauauuuuuggauaagauaugagguaguugauacucacuuuaacuuaugaaguaggcaguauuacucacauucaccauacaaaagaggacgcugagguacaggguuuaggaaauauaccuaggauuaauaaaauauucacagaccaagcauugccuugaaguacaaggcaaccuggauaucucuacaucuuuuuuuuuuuuuuuuuuugguagcaaagcuaaaguaaugccuguugaaagauaucaagaauauaugauguauuuauuuauuuauuuauuuauuuacuuuaaaggcuagcauuuauauauauuaucaguuccuuuuuucuuuuuacuggauauuuucuuuauuuucaaauguuaucccguuuccugguucaacccccccccuggaaaccaccuaucccaucuucccuaccccugcuucuaugaggguguuccuccacccaccuccccacuucugccuccccacccuugauuuuccuacacuagggcaucacugagccuucauaagaccaaggaccucucuaccacugaugcaugacaaggccauccucugcuacauaugcagcuggagccauguguacucuuuguugauguugucccuaggagcucugggggcucugguugguugauuauguuguucuuccuauggggucacaaacucguucaacuccuucaguccuuucucuaacuucucuaauggggaacccaugcucaguccagugguuggcugcuagcauccaccuuuguaucucucaggcucuggaagggccucuuaggagccauaucaggcuccuaucaguaaggacuuugugguauccacaauaguaucuguauaugggaugaauccucaggugugacagucucuggauggccuuuucuuuagucucugcucuauauuuuaucucccuauuuacuccugugaguauuuuguucuccuuuuaagaaggaccgaagcacacuuugcucuuccuucuuuuugagcuucaugcagucugugaauuguaucuugguuauuuggagcuuuggggcuaauauccacuuaucagugagugcauaccauguguguucuuuugugcuuguguuaccucacugaggaugauauuuucuagugcuauccauuugcuaagaauuccaugaauucaucauuuuuaauagcugaguaguacuccauuguauaaauguaccacauuuucuguauccacuacucuguugaaggacaucuggguucuuuccagcuccuggcuauuguaaauaaggcugcuaugaacauaguggagcauguguccuuauuacauguuggagcaucuucuggauauaugcccuggagugauauagcuggguccucagguaguauuuuauccaauuuucugaggaaccaccaaacugauuuccagagugguugucccagcuuacaaucugaccagcaauggaggaguguuccucuuucacuacauccucaccagaaugugcugucaccugacuuucugauuuuagucauucugccuggugugagguggaaucucaggguuguuuugauuugcauuucccugaugacuaaggauacugaacauuuuuuuaggggcuucucagacauuugauauuccucaguugaaaauucguuguuuagcucuguaccccauuuuuuaauaggguuauuuaauucucuggagucuaacuucuugaguucuuuguauauauuggauauuagcccucuguaggauauagguuugguaaagaacuuuucccaaucuguugguugccuuuuuguccuauugacaguguccuuugccuuaaagaacuuuguaauuuuaugaguucccauuuaucaauucuugaucuuagagcauaagccauugguguucuauucaggaauuuuuccccugugcccauaucuucgaggcuuuccucaacuuucuccucuauaaguuucagugucucugguuuuauguggagguccuugauccacuuagauuugagcuuuguacaaagaaauaagaaugggucgauuugcauuuuucuacaugcugaacaccaguugaaucagcaccauuuguuaaaaauaaugucuuuuuuuccacuggaugguuuuagcuccuuuaucaaauaucuagugaccauagguacauuuccgguucuucauuucuauuccauuaauuuuccugccugucucuguaccaauaccaugcaguaauauuuuuuuaaucacuauugcucuguaguacagcuugaggucagggauggugauucucccagaaguucuuuuauuguugagaauaguuuucacuauccuggguuuuuuguuaugccaaauucauuugcaaguugcucuuucuaauucuaugaagaauagauuuggaauuuugauggggaucacauugaaucuguagauugccuucagcaagauggccauauuuacuauauuaauccugccaauccaugagcauauuagaucuuuccauuuuccuuccuuccuuccuuccuuccuuccuuccuuccuuccuuccuuccuuccuuccuuccuuccuuccucccucccucccucccucccucccucccucccucccucccucccucccucccucccuccuuccuuccuuccuuccuuccuuccuuucucucucucucuuugcuuccuucucuccucucucucucucucucucucucucucuauuuauuuauauuagauuuuuccuuuguauacauuucaaaugcuaucccaaaaguucccuauaccauuccuccgcccugcucuccuacccaccuauucccgcuucuuggcccuggcauuuccuguacuggagaauauaaaguuugcaauaccaaggagccucucuucccagugauggccaacuaggacaucuucugcuacauaugcagcuagagauucgagcucuggggguacuguuuaguucauauuguuguuccaccuauaguguugcagaccgcuucagcuccuuggguucauucucuagcuucuccauaggggcccuguguuguaucucauagaugacugugagcauccacuucuguauuugccaggcacuggcauagccucauacgagaaagcuauaacagggucccuucagcaaaaucuuucuggcauaugcaauagugucuggguuugguggcugauuaugggauggauccucggguaggguaguuucuggacaguccauccuuucaucuuacauccaaacuuugucucuguaacuccuuucauggguauuugguucccuauucuaaggagggaugaaguauccacccauuggucuucccucuucuugauuuucuuguauuuugcaaauuguaucuuggguguucuauguuucugggcuaauauccacuuaucagugagugcauaucuaaugacuucuuuugugauuggguuaccucacuaaggaugauaucauccagauacauccauuuuuucaagaauuucaugaauccauuauuuuuaauaucugaguaauacuccauuguauaaauguaccacauuuucuguauccauucuuuuguuaagggacaucuggguucuuuccagcuccuggcuauuauaauuaaggcugcuaugaacauaguggagcauguguucuuauuaccaguuggaacuucuucuggauauaugcccaggagaaguauugcuggaucuuccagugguacuauguccaauuuucugaguaaccuccagacugacuuccagagugauuguacaagcuugcaaucccaccagcaguggaggaguguuccuuuuuuuccucauccucaccagcaucugcugucaccugaauuuuugaucuuagccauucugacuggugugagguggaaucucaagauuguuuugauuugcauuucccugaugauuaaggauguugagcauuuuuuucaggugcuucucagccauucaguauuccucaggugagaauucuuuguuuagcucugagccccauauuuaaugggguuauuugaauuucuggaguccagcuucuugagcucuuuguagauauuggauauuaguccccuaucagauguaggauugguaaaaauccuuucccaaucuguugguggccuuuuugucuuauugagggugucuuuugccuuacagaagcuuugcaaguuuaugaggucccauuuuucaauucuugaucuuacaaucacaagcccuugcuguucuguuuaggaaauuuuccccuguacccauaucuucaaggcuuuucccuacuuccuccuguauuaauuucagugucucuggucuuauguggaauucuuugagccacuuagacuugaccuuaguacaaggagauaggaauggauuaaugcacauucuuauacaugauaaccgccaauuuugccagcaccauuuguugaaaaugcugucuuuuuuccacuggaugguuuuagcucccuugucaaagaucaagugaccauagauguguggauucauuucugggucuucaauucuaucucauugaucuacuuaucugucacuauaccaguacuguguaguuuuuaucccauuugcucuguaguaaagcuuuaggucagguauggugauuccaccagaggcucuuuuagccuugagaagaguuuuugcuauccuagguuuuuuguuauuccagaugauuuugcagauugcucuuucuaauucguugaagaauugaguuggaauuuugaugggaauuucauugaaucuguagauugcuuuugguaggauauccauuuuuacuauauuaauccugccaauccaugagcacgggagaucuucucaucuucugagaucuucaauuucuuucuucagagacuugaaguucuuaucauacagaucuuucacuuccuuaguuagagucacaccaagguauuuuauauuauuugugacuauugugaaggguguuguuucccuaauuucuuucucaguucauuuauccuuuguguagaggaaggccauugauuuauuugaguuaauuuuauaccaggcuacugcacugaagcuguuuaucagguuuaggaguucucugguaaaauuuugggaucacuuauauauacuaacauaucaucugcaaauagugauauuuugaccuauucuuuuccaauuccccaugauguucuuuuguugucgaauugcucuguauagaacuucaaguacuauauugcauagguagggagaaagugggcagccuugucuauuccuucauuuuagugggauugcuucaaguuucucuucauuuaguuugauauuggguauugguuugcuguauauugcuuguauuauguuuagguaugggccuugaauuccuuaucuuuccaaaacuuuuaucaugaagggguguugauuuugucaagugcuuucucagcaucuauugagaugaucaugugguuuuugucuuugaguuuguuuauauaguggauuacauugauggauuuccauauauuaaaccaucccugcauccuugagaugaagccuacuuggacaugauggaucuucguuuugauguguucuuggauucgcuuugcgaggauuuuauugaguauuuuugcaucaauauucauaagggaaauuggucuuaaguucucuuucucuguuggguuuuuguguguuuuagguauaagagaaauuguggcuucauagaaugaauucgguagaguaucuucuguuucuauuuuguggaauaguuugagaagaguuggaauuaggucuucuuugaaggucuaauagaacuuugcacuaaacccaucugguccugggcuuuuuuuguuuuggagacuauugaugacugcuucuauuucuuuaggggaaaugggacuguuuagaucguuaaucagguccuccuuuaaauuuggaaccugguaucugucuaggaaguuguccauuucauccagguuuucuaguauuguugaguauagccuuuuguaguaggaucugaugauauuuuggauuuccucagguucuguuguuaugucuucuuuuucauuuuugauuuuguuaauuaggauucugucccugugcccucuaguuauucuugcuaaggguuuaucuaucuuguugauuuucucaaagaaccagcuccucguuugguugauucuuugaauagaucuuuuuguuuccacuugguugauuucagcccuguguuuauuuccuguugucuacuccucuuuggugaauuugcuuccuuuaguucuagagcuucuaacugugcugucagucugcuagcguaugguuucucuaguuucuuuuuggaggcacucagggcuaugaguuuuccucuuaggacugccuucauuguguccuauaaguuuggguauguuguggcuuuauuuucuuuaaacucuaacaagucuuuaauuucuuucuuuauuucauccuugaccaaggaauuguugaguagaguguuguucaguuuccacgugaauguuggguuucuauuauuuauguuguuauugaagaucagccuuaguccguggugaucagggagaaugcacgggauaauuucaauauuuuugugucuaucgagugccguuuuguggccaauuauauggccaguuuuggugcagguaccauguggcacugagaagaagguauacccuuuuguuucaggauaaaauguucuguagaugugaauuaaauccauuuguuucauaauuucuguuagucuccaugugucucuguuuaguuucuguuuccaggaucuguccacuggugagagugggguguugaagucuccuacuauuauugugugaggugcaaugugugcuuugagcuuacuaaaguuucuuuaaugaauguugcuguccuuguauuuggagcauagauauucagaauugagaguucaucuugguagauuuuaccuuugaugaguaugaagugccccucccuuucuuuuuugauaacuuuggguuggacgucaauuuuauucgacauaagaauugcuacuccagcuuguuucuucagaccauuugauuggaaauuuuuuucccagccuuucacucugagguacugucuguccuuuucccugagguagguuuccuguaagcaacaaaauguuggguccucuuuguguagccaguuuauucaucucuaucuuuuuauuagggaauugagucuauugacauuaagagaaauuaaagaaaaguaauuguugcuuccuguuauuuuuguuguuaaaguugggauucuguucuuguggcugucuucuuuuagguuuguugauggauuacuuucuugcuuuuucuagggcuugauuuccauccuuguauugguguuuuucuguuauuauccuuugaagggcuggauucguggaaagauaaugugugaauuugguucugucauggaauacuuugguuucuccaucuaugcuaacugaaaguuuggcuggguauaguaucuuuggcuggcauuuguguucucuuagggucugcauaacaccuguccagggucuucuggcuuccauagucucuggugagaagucuggagugauuuuaauaggcuugccuuuauauguuacuugaccuuuuucccuuacugcuuuuaauauucuaucuuuauuuagugcauuuguuguucugauuauuaugugucuggaggaauuucuuuucugguccagucuauuuuggaguucuguaggcuucuuguauguucaugggcaucucuuucuuuagauuuggggaauuuucuucuauaauuuuguugaagauauuugcuggcccuuuaaguugaaaaucuucauucucaucuacaccuauuauccauagguuuggucuucucauuguguccuagauuuccuggauguuuugaguuaguaucuuuuuugcauuuugcauuuucuuugauuguugugcccauguuugcuauggcauguuaugcaccugagauucucuauuccaucuguuguauucuguugcugaugcucacaucuaugguuccaauuuucuuucauauuguuucuaucuccagcguugucucacuuuggguuuuguuuauugugccuacuuccuuuuuuagguuuuguaugguucuguucaauuccaugaccuguuuggucguguuuuccuguauuucuuuaagaacuucuaccuuuuuagcaguguuccccuguauuucuuuaagugaguuauuuaagugcugcuugauguccucuaccagcaacaagagauaugauuuuaaaucugagucuugcuuuuuggguguguuuggguauccaggacuggcugaggugggagugcuggguucugaugauggugaguggucuugguuucuguuaguaagauucuuauauuuggcuuuugcuaucugguaaucucuggaguuaguuguuauagcuguuucugguuggaacuuguuccuccugugauucuguuagccucugucaauagaccugggcguguagcucuguccugaguuucagugaucagaguacucucuguaggcaagcucuccucuugcagggaauguacacagauaucuggaguuuggaccugccuccuggcugaagauaaaggcccaaaacagggccugucccagaagccgugucacuucuguaguccgcacucucaccugggcagacuagucucucagggguccaggacccaagauggcucccaagggugcucuggcagagcccuccaggccggggcggacaccucuccucuggcagggaaggugccugcaugucuggacccagaaacagggucugucccugaagcuguguagcuucuguagucugcacauucaccugugcagacuagucacugaggcaucugggacccaagauggcucucccaggugcuccgaggccaaucuuuccauuuucugcgaguuuugauuucuuuuuucaaaaauuugaaguucuuauuauacagaucuuuuucuugcuugguuagagucacaucaaggaauuuuaugauuugugaguacugugaaggguguuguuuaccuaauuucuuucucagccuguuuauucuuugaguagaggaaggccacuaauuuauuugaguuaauuuuauaugcugccacuuugcugaaguuguuuaucagcuuuaggaguucucugguggaauuuugcaggucauguaauuauaagaucauaucaucuucaaguagugauauuuugaguucuuccuuuucaauuuguaucccuuugaccuccuuuuguuauauaaaugcuuuagcuagaaccucaaguacuauauugaauagauagggagagaaugggcagucuucucuagucccugauuuuagugggguuucuucaaguuuuucuucauuuugcuugauguuggcuacugguuugcugcauaaugcuuuuacuauguuuagguaaaggacuugaauuccugaccuucccaagacuuucuaacaugaaagaaugcugaauuuugucaagugcuuuuucagcaucuaauaaaaugaacauguggguuuuuuuugaguuuguuuauguaguggauuacaaugauggauuuaugcauaucugcauccauggguuaaaacccucuugcucauuauggaugaucauuuugauauguucuuggauccaguuggcaagaguuuuauugaguauuuuugcaucaauguucauaagggagauuggucugaaguucucuuuguuuggucuuuguguuguuuuguuauaagaugauguuguauuuauuauggaacauuuuuuacuaaugaaucuaaggauuauuguuguccagcaaccuucuggaguccagacuucuugauuuguaaaacugccaccugauuaucaguguacuuuugccuuuuaugugugguuacuggauuuugucuuuugugucuuuugagugaaugucacugucaggucauaagaccuaucugcauuaaugauuagaaugacuuucacagagcugagaggcuggaauuaugaggcuuggaagguuucggaugauacucaugagagugguuuuuaauguaagguacuuuggccaguuuucuuauagacacuuaugacauuucgaaauaguaucguugcaugauguucaaucacacucugaaccccaaaauuguguuguuuacuggagaagccuguuucuauuucugguguggcucagccuuuagcaccuuuaauaccucuggcuggaauacagacacuccauuaguacacaccuuuaaccccaaccaaugacgauaaaguuaguuuauagaaggaagaacccauguuugaaaaugauguuuaauugaauggcagagaaagugaugaaucagagaaagauuugaaagaauauauaugacucuuaugagaauagauggagggaagugacucaaaagagggcaucucagaaggaggaggcuuugacacuauauagccuauugagguuacucaguucaaagagacaaguugagaucuggguacacauucccugucaugugcccuaaauccucucuucaauccuucagguauucuauuuucuacuuuucacccaucucuuauuaacauccuggcugugccucauugccuguacuugguuugauuaagcagacugcuuucuagaaccacaucucugguuguggacuccugaaaaaauaucaacuccucacuacucucaauuaggcuauagcaucauucucaggauccacagugcuugaauggucuggauuaccuuuucaucccuagcuuuguucuuauucuaauucaaccacucaauuuucuuucugucucuucaauacaucaagaguaaugcuuauccuucagggcucacauuaacaaccuaauaacauagauggcugcuaguggguaaaugguccaagaaggaaggagaaauuaauucuacagacacuaacacagacaugggguaugggauacacuaugaaaaaacuaggaaaccaggaaggcuggcagcagagaaucccaucaauagaagaggucauaaacuugagagggaagaguuacagugguaaauggagggguggaaauuaugaaaauauaguauacuguugugguaaaucucuucaacccaaauuuccccuggcaaugaaaacacaacacaauuaauaugauuacaugcugugcaccuagacugggcagaucuacggcuacacuaucaucuuccacagcuuaugagaccccuuaaaacuugcaguuucuccaggccaugugcuucugcucugcuuuucuccuuauuccuccuccucugccuccuuucccucuuccauuuucuccuucucucucucucucaccuucuguuccaccuucucuuuaucugcccaaucaucagcucuccuuuauuuuacaaauuaaggugggaagcagguuuacaggaaaucagcugagugcugacucauuccuaguucacaacccuucacaggauuacagauuuaacaucaaauauaauuagccccagugcuaucuacaacaguauacauauauaaauuaucaaaaaaccaaaaguaauuaaauuaagauuaaauaauaauaaaaacaugucucaggcuuguaaaaauggcucagcagguuaagccaccugacauggagccugccagucugguuugauccucuggacccacauggugaaagaagaaagccaacucuugacaauugaccucugacaucacaauacugccuugugaauauguguaugcacacaaauaagcauaugcacagaaaauaaaauauccagcugguaguggcacauauguuuaauccuagaauuugugaggcagagucacguggaucucugugaacaaggacagccuggucuacagagugaguuccaugacagccaaggcuauguagaacaacccuaucuuaaaaaacaaacaauaauaaacaaauuaauuaaauacaaauuuaaaaaucgcacauacuacauacuauaucuuguuuuauucagucuauagagaaguaacacaagaaauucacaauuuccuccagaacuuaacuauguuauugaagcacucauuaaaacuuuuagaacaagauaauucuugcagauauagacacaccagggauucuucugcuaaugucauugggaaaauuauuagucauuggagaggugggcagacaaucuuucuaagcugacugggauuugaucacugacauuuuuuaaacccuugauauuuugaucuuuuccuauguaaaucacagcuuucugacuuauauuuaauuacaaaaauguugauaauaccccuaauuaaggucagacauacauugcacuucgggaaaugguacagaagaguccuuaguuaaguuagaagagccuccuucuagguguguuugcuacugaauguaggcaauucagagaguucaggguacuuuaucuucagagacagcauucuucaguguuacuuuugcuauaauuuacaugacuguacuuuccacagaguucaucuaaugagcccaaaaauucucccuaaaggggacaaagaaugucacagcugacccaagaauaauaaaccaccgacuagugauugacacccagacucuccaagcauguucuacaaacucagaaaguuuuagacuuuuuacuuaauaauucuggaugaucuguccauccagaugcucauuucugauuuuguguauaaauagucucaugcuguggaugugacguuucuuuccccuucaucacugacagguuacuguugacauugaagaugagaaugaugaagcaccugucugcacacccuaucuauauacagcaaucaucccugacaauguuauugcugggacaaaugucaauggccucaaacuaaacugucaugacagagauucacaagauuuugaaaugcgcuuugaaauggcuucugguacauacuuuaguuauuucuuuuaaucacaaacauaugucaaguugacauuagcuauacaaugucaagcaugauauguaacccuagaagugacuguuuauaagaguuacacuaacucauaacguacaacucaauuacuccugugacuucaaagagacucagaacuugaggaaaugcuauaguuuuuaacacaaggauuuacauuuguuauccauggagccagcugaaaaacagaugacaucuucccaucugaugauauuguuucaaguucacaaggcgacaugauguugacucuauuauugcugguucuauacagauucacauaaauguuauagucaccaauuugucuuuuauaggauaucuuucuuuauuugagaccaaccauauauuagacaccuagaaauuguuacauagaaccaucuaagguagauguagaacauauucguggcacuagcuauuuauuuaacucugaauaacaucaacacauaaaaucauaaaccaaaagaaagucuacacaggugucuuggucaggguuucuauuccugcacaaacaucaagaccaagaagcaaguuggggaggaaaggguuuauucagcuuauacuuccacauugcuguucaucaccaaaggaagucaggauuggaacucaagcaggucagaaagcaggagcagaugcagaagccauggagggauguucuuuacuggcuugcuuccccuggcuugcucagcuugcucucuuauagaaccaagacuaccagcccagagauggucccacccacaaggggccuuucccccuugaucacuaauugagaaaaugccuuacaguuggaucucaugaaggcauuuccucaacugaagcuccuuucucugugauaacuccagcugugucaaguugacacaaaacuagccaguacaccaggaaaacaggguccuugaauuccucuugaucauaacaauaagaccuuuucaugaggcucauacugcugcugcucaucugaaaaagggagaguguagauagcagaaaacacauagcuaauaaacuaugaagacuguuugguguuauaccuacugcuaaaugauaagcuccacgaagaaaggagaaaugcucaucuuguuuacaauaaugucaucuacaaggcccuggguuugucuacaaggacuuuacuucuuaaggacauuauuuguacuguggauugucuagcucaauagguauuagucuagacuaaguugaaugugacaaucaaauaaaggaagaggaaaaaaaucaggcagaauaaacagauaguagcauuaagauuuguugguuacauguggggguuagacaauuuuucuuuuugugauagcaucuuuuguagcccagguuggccuugaacucuucauguagccaaggauggcuuugauccucuugccucuccugcccaagugcugagauuuuaggguuaaccguaacauuccuaguuuaaaaacauuuuccccuuauaaguauuucuuauuuuauuuuaacuuuauuuuaagcaauuuuuagauauggacauuuuuaguguacauagauauuaauuuauauacacauucuggguuuugacauaauuuuaagguaucuugagaccauuugauguauucuaaaauaauuuuacuuucucauuauuccuuuuaaaggaaaugaaaaucuucauuuccaauuagacccaacucgggguucaaauacuccaaaauuaguugugaagaauccuuuccacuuugagucuggaacugaacugcagcugcaauaucaucuugugguacaugucaucgaugacaaccugcaauauggcaaagcugucaaguccaagacaggaacugcugucauagauaucaaugugaugagaaccagcacaccaauuccuccaaccaguucugaaguaaagaguuaga

SEQ ID NO: 7266 - RNA, 16667 nt, Mus musculus
uaaucaggcuaagaccuagauuuuaguucuuugguuuuaaugaaaucuaucacacaaauuauaugcucuuaauaauauguaaaaauaaucaacuauaacaauuacguuguggggguugcgcaggggcugcauacauaaccauauuugcuaaugcaaaauaaaacuucucaugcauuacuaggcacaaaauguaggugacauggaguaagguucugugucuucuuaacuacagaugaugacaagcugucagagguggaugaagcucaagaaagcaccauggaagcagacccuaagccauagauggacugaccgucgccauuuacagggacagcgaauagcugcaugggcuuccuggguucaguguguuguacuuuugggauauuucaacuucagcauugaaguacuuugcuuucaaguauucaugugucguucauauuucuucacagaacggaaauguaucccauauauauguauuuuuuaaauacauuuuuauccuuaaacauagaaaucagcaucugaaaauauuuaauaaaaugucucaagguggaucuuugugcucauucaaaacucuagguaacugcuaacacuugccuuagcgaaccagguaaggauuaucuaagauggcguuugggauacacaugagaaaaugaauagauuucuagaagauguuaguaaaacuugagaaaauggaguccaugaguaggccuuagagggccaugaugaguacuuauggcgugggucuauuguaggggaagcuuucacacuguuaagaauggcugucguaugaaaucaguccaucuguguugcuuuucuacagcucucucuuaguccuugaggaaugugguugguaaaugcuucuucuaucauuuuguuuuaaagaaucuuuuuaaaaaauacuucuuugggagcaugcauacaugguacauauguuugcaugcuuaugugugagggcgugcaccugcuguagcauguggcuagauucagaugguagcguuggcugcugcuugucuacccuguuugaggcagggucccuccccuugguagcugagcuguguacugggaacucagcagcagcagcagcaggugcaugggaagcaugcucgucgcagcuuauacuuccucgugguucucuuggaaagccuuuggaauugcuucgaagacugaaggaucucagccccuagaaacucacacugcuuaagcucagcgugccuuuguuccagaagcuucauggauuugucagucacuguuucuaugaggucauccaccuaugauagacacaaagagacaaagaaaugaaacugcugaaagcaaagaugugcuuguuuuuucugagagugccaaaggagaauucuaauucagcuuauagcaaacagagcuugaaaacagauuuaccacacagggguuaagacgaccucauuucugcucaagccugugugugccuuguguuaauggaauucguuuaauaugacucagugucauccuaguucuccuuagcagucccuuccccacucucagacaccccccacugacauuaaguaucucuuaaugguacuuguuaauuagguaccacgccuugcugucuugcagggcaagauguucaguuaagccuggccuugggagcuucugagacagaaaaggcgagucugcccacuaccugcauuugaagcuugccuacggucagcucugauuucuggagaauggcuuccaugcuccgcuucuucuuuuuaagugcugggaaguguggucucuuuuuugaugaauauugugccuauugucaaaaugcaaaacaugccauuaagauaugugucaguucugcacuagcaaccaguagccccccucggacauucucuugauaagucauuguuugccagguaacaguugaaauucauauucauauucucugcacacccuguauuuccuuugugcccagaguacucuuuaaagaguucuauaggaugcagagaaaugagauuauuugguucauaaggauagacagugucagggaaaaaagcaagucauuggaaaagacaacaguuuguucagccugcagaacacauugcacacuggguugacacgggccauugccacaaaaaaacucauuacacugaauccaguuuucaguuuuucuugugucucuggguuuucuuaccuccauggcaguccagaaauaaagaagccuugccuggauucuucuugaccaugcuuggcacuuuaccccugucccugguuuacugauuacaaguaccugccccaauaacaucacugugggaacucauuccugggugcugaaaccugcuggccccucucuccauuccccuuguacuugaucagcugugcagaaagugguucugaggucauguuuaggcccuacacuuugaaagccucagagccaucauugagugccugcuaguugacccacacugaacuugcccugauccaucuaaagaucccauuugggucuuuggguuuuuauuuugacuccagauuuugccauauaagcccaagcaagccuggaacuuaccaugugccccagucuggguacacaugcacacacacacacacacacacacacgucuccugagugccaggaguagagguaugcaccgcaucaugcuaaguacgauucuaaagcaucuacgguaauuggugguuacuaaguguugcugugcuuucccaggauaauuauugcaaaguuaggugcugagucaaccagguugagugaggaugaguggcccgaacagaacaggccuucuguagagagcaucucuacaacccuacaaguuucuguuucugaagcuuccuguuuuccaaaggaaguuucaaaaggaacauuuuuauuugaaauguccgacuuuuaaaaucugggcaagugauucauacauaauuuugggagcauucugagggcuaguuaaaacccuauauaaccaagugcuaaccucugauaaaauacaaaaccaagcuggguguuacuuuugguaccuagaaauccuuaauuauagcgaaaaauuuucaucuuccugccacugccauuuauacaaugagaagacuccccuguaaucuguaaacccaggaauagccuagaacauagaggcaccugauaacucagaagcaaaauucaaaacuacuauuguguacuaagagugacagucaagaguauuugauggaaacuucugccccucugcaaggguagaacuguuuaucugugguuuacuguacaaaacgacacuagcuacaugugguuauugguacuucaguggcuauuguaacugagaaacuagaacuuuugggcuuuuugauaucauuuuucugugaagcccuggcuguccuggaacucucuguagaccaggcuggccuccaacucagaaaucugccagccucucccuccugggauuaaagguguguguugccaucaccaccccaucugagaaacuacauauuuaauuccauccauucaaauuaguauugucacagguggcuaucacacuguacacuuaauacacaguauuuaacaauggagcugggagggaggaggaguuuggcucauugauccaguaugugaucguuauguguuaggcaugaauucaauucccagaaccacaaaaaagaaaaaagaaagaaagaaagaaaacaaaaaugggagaaacuaugaaugggagcacucagccuuuauuggaagccugacucucccccucacuuucaucaauuaauaaagucccagagucauccauaaagugaggcaguaugacugccugccuuagagaacugcagccauuuucugaguugaauuuuuuaagcaauuagaacacccugggccugguagugauggugcacaccuuuaaucccagcacucuggaggcagaggcagguggauuucugaguucaaggucagccugguauacacagugaguuccaggacaaccagggcuauacagagaaacccugucuaaaaaaaaauaaaauaaaguacaaaaccaaguuggguguaaugucauacacuuuuucugugaauuugagaccagccuugucugcauaaugaguucagaaccagccaggacuguauagugagacccugucuagaaauaaauaauaacaugagaaaaauacuaggccuuaaucugaacaccuuggucucauauucuccaaagauaagggucagccguauggaucuguggggacagguaccccgaagccugaggaccuaaguuagagcccccaagacucaugguaaaaggagagagacagauaaggaaaacuuuucacauguuguacaaagccccgucacaaauaaacauguaauaaaaauaaaauaccuggguguggugguaccugggaggcagaggcaggcagaccacugaguuugagcccacucuggucaacagaaugaguuccaagcuagccaggaacucaagaaaacccuauccuaaaggaaagaaaaacaaaacaacaacaaaaaacaaaacaaaaagauauccuucguuuagauuccggcucauccaauuuuuaaaaauuuuuuauuuuauguccauugcugugccugcauauauggcugugugaaggugucagauacgcugggacuggcacaguuaugagcugccuuguggguguaauugggcaacaccaccaugcacauagcaucuaggucagccacauuccuacugugugaccucaacuuuugaacaauucauugaguauucacaaagguccaaauuaauguagggcagacuggaagagcugaauaauuugaacucagaaguagaaagaucugaucuggaaauuacccuuauuguaccuuaaauucuuggaagcacaagcagagggugcacgggguuacucugggugaaugaaguuagaaaaugguuuugucaagacacaguguggugguguaauauccaaaauaaguucaagaccaccuagccccuuccccuccuaagggacuuucagaaacauaacagucaaaaugacugagucuacagcugccaaaacaaaaugaacuguucucagaaaaauaaccauaacaagauagcagcucccagagaaaucaccuuaccucgccccacacugaauucugagaaacaaaaaccacaagccaccuugaccuugucgauaguugugacguuaauagcugacccauaaguucaaaauguacuauuacuuugcugaccaagucauaauaaccuaccaugggggcaaacaaagugagucacuaggccaaagguagucacuaugcaaaccaaccaaugccugaaaaggcuacuugcuacaccaauuagaaugaaccagcuauguuguuucccaaaucugccccuuacaagguauauaaaguguguucuuucuuuguucugggucucuccucuggcaugugugcugagaggaggguccccaacauguuggaucaauaaaaauccucaugcaguuugcaucaaugauggucucugugguuuuugugugugagggucuuuugacaaacuccaacagugguuuaaauagguuuggcccccauagacuccuauauuuaaaugcuuggcucacagggagugacauuauuagguguguccuuguuggaauggguguggccuucuuaggggaaguccgucacuguggguaugggcugugagauccaauguucaagcuccggccaaugcagaggagauccuggcugccuuuggaucaauauguagaauucucaguuccuucuccagcacuuucucugccaugcuuccugccaugauaauggacugaaccucuaaaacuauaagcuagccccaauuaaaugcuguccuuuauaagaguugcuuuggucauggugucucuucacagcaaugaagacacccagagaaaccaauuuauguaggucuuucgaagcaaguugaugcuagcaccuuaccuucugcagcccugaaggaagugaugucacagauaaucgcuuggugguucucuuggcgcggagaagcccauuuccuccaguuaccucuucugucucugcuucuacaacaucaagcuguauuguugcuuaaagaggaggaagaagaggagaaaagacuaugucaagaucacaguugcaaacagucuuccuaagcaaaauaguuaggaagcugcauauaacaccgcuguggacagaugguguuauaugcagcucuacugccuuggaaacuuuauuccuuggauugaaaauaaaaaacagauuugcuuuucugguguuaggauuucugcucuacauaguugucacauguaauggccauagucuugacauagugauuucuucuuuagacacauaacuuuguccugccugguucucacuuuggccaugagggauuaggaaaaggaaccuucaacuaugaggguugagucagugucaugaagcagacuuuacauuuguucuccugaaaugcuaccaagacucagucacucacacaccauaguauggaugucucauaucuaggagccuuuucuuaaacauuuuuuaaagauuuauucauuuuauguaugagugcaucaaguguauagugcuugcugaggccuguagauggcaucagauugccuguaacuggaguuacagacuguuaugagcccccauguggguacuaagaaauguuccuggguccuuuaaaaguagcaaaugcaggggcuggagagauggcucagugguuaagaguacugacagcucuuccaaagguccugaggucaaaucccaaccacacaguggcuuacaaucauccuuaauaacaucugacacccucuccuggugugucugaagacagcuacaguguacuuacauauaaaaauaaaaaaaucucuuuuuuuuuugggggggggguugagacaggguuucucuguguagcccuggcuguccuggaacucacuuuguagaccaggcuggccucgaacucagaaacccgccugccucugccucccgagugcugggauuaaaggcgugugccaccacacccagcuaaaauaaaucuuaaaaaaaaaaaaaaaaguagcaagugcucucaugagccagccucuccgucuccaaguagaaagcauucuuuaguauuuccuuguguaaguucaaucucaacucaguagacauaaaggcaaauucaaaugcuaccauaggucuagugagauggcucaguggguaaagccacuugccaccaagccuaaguucaauccccaggccccaugugguagaaagagagaagcaacuuucguaaguuguccucugaccuccccagguacacgaauauacacacagagacacacacaguauauugacguauauguaggcaaaacauccauuugcauuaaauagaaaauacaaauacuaaauaauuuaauaaagcaagauaauaaagugauaccauagcuguguaaguaagauggccaauuagaagcugccuccaugugaccaguaaagaaaaagaacuagaauaugaaaaaguauguuguauuucaaagacagagaagagcauuuaagaaauccacaaaagacagccaaaacgugcacugaaaauggcugguaauauaccaaaaggauuaagcuaagcugaacacagguuccagugccaggugucccauugagcuggggaggagcaaaagcucauguaggcaacccuggagagaagagaugggcaggucguccucaagguaggccugcaguccucacaugcaucagaaauguagguuuuauugagacauauuuccuuuaucaccaagucaguggcugagaggaauucuacuucuugucaaucuauaugacuccaaggguaguggugaagaaccauagcuuacaacuuagcuaaugugggacucugagaagaaccuaaguuuaaccugccacacacauccucgagaguuugaggcaccucuaggggacauuuguggcaagcaagaggacaugauguugacaaacugaaaagugcugguaguggagagcuuggcucaggcacaggaaaagggagccucacucuuggcaauagcccuacaccuaaggucagcaggcagaucaacuucuggacucacauaucugccauacucagcauuuaaacccaguuuagacucugucucaaaaguaaauacacagacaaaaauuuaaaaaucaguagcuaaaugucugauuauauagaccaauagcagaauugcaucaccucaaacuaaaacauauaugucuaacuaagcaacacauaguuaggauucgaauaccgcucuugucuggcugaagacaaggaugagaguauaccgguuacuaggugaacaucagaacugaugcugagaaucagaacuuggcuuuccaaauuugacaauuauuuaagagauaugggaagcucauuuuucaagagagaggaucauuuuaaaacuucgucuuauuuugauuugugucuuuauaaaaacacauugcacauuugacaugacaacacuuugacuagcauucccaacauugugguaugaucacuaaguaccacucuguagguaauuggcugucgggagacgaucauuuagcuuuaucaaacuucugcacuuggcccuuuccugugcccuuuaauauuccuuugccccuaauuucuguugacccuaagaaaucaguaagacggugaauguauccuuggauuauggagucugugacacacaacucaguuaucguuaaaauaggcauguguuuucugaugcuaacuucauucagaguaaauuuauugaacacuuacucuucugugccaugcauacauauauuucuuaccauauccauugguugaauugacuuaagauuggguuaacagaacaauggccuaugagccaaagcaguuuacugcuuguaccuauaaauacauuuuuaucagaauguugucacacuaaaaaaauaaaaaaguguugggugguggugcgucaugccauuaaucccagcucuuagaaagcaggggcaggcagaucucugauuuuguaaagugaguuucagcacagacagggcuacacaaagaaaccaugccuagauagauagauagauagauagauagauagauagauagauagauagauagauagauagaauuaaaaucuuacugacaauguaggaaucaauuagaaagaugaagagauggcccacagaaugggaagaaauauuugccagcuacacaucagacaauauuguauacaauaauauaauacaauauuaauauaauauugaaauaacuucuauaaagaccuuuaauaauuauagggaaugucgguacaugccuuucuuuaguccuuguauucaagagccagaagcaggugaauuucugugagguuaaagcuagcugguguuacauagugaguuucaggccagccauggcuauauagugagacuguccagggggagacuccaaaauuaaacauuagauaugcaaaucauucaaucaacaagagugcuaaagaauggcauaaauaguccucaaaagaaaagaauguccaauaaauauuggaaaagguauucaacauccuuagccauuggggaaauguacucaucucacugcaauaaauaaauaaauaaauaaacaaacaaaacaaaaacaaaggacgagugauugugaagacauagagaaaaaggaacaguauucacaacuggugggauguaaacuguuauaaccacuguagcaaucaggauggaaagaggauggaaggagagaguacugaaagagauaauuggaauggggaugagggggugcaucucuggaugaccuagaaaccuuggacaaugaaacuccaaggaaucgaugagggugacacuagauaagauuccuagcaauggggggauauggaaccugaaauggccaucuucuguaaccaggcaagacuuaagaaaaaaaaaaaaaagauguacuuauuuaugucauguaugugguuacacugucgcugucugcagacauacagcagaagaggucaucagauacucacuacagaugguugugagccaccaugugguuacugggaauugaacucgggaccuuuggaagagcagccagugcucuuaaccacugugcuauuucucuagcccccaggcaagacuuuuaauggagggaugaggacaccaacccagccacaaaaccuucaaccuucaauuuguccugccuacaagauaugcaggggugaagauggagcagaaauugagggaauggcccagguugagaaacauaccaggagagagaauccaucccugacccuacuaaugauauucugucauacuugcagacaggagccuagcauaacugucaucugaggggauucacacaacugauggaaacagaugcagagaccuacagauaaacauuaggaggagcuuggagaaucuuggggaagauaggaaagaaggauuugaaagaacuagagggaucaaggacaccacagcaaaaccaacagaaucaacuaaccugggcacauaggggcucacagagacugaacuaccaaccagaaagcaugcauggaaugggugauuuccuuugcccuucgugcauauuauauguguguaaaacuaauacauauauaaaauaguucaucaugugggacuccuaaauccuaacagcaggaccaggaguugucuggcucugcugccugccuuugaaucccuuuuccuagcuaggcugccuugucuugccacaauaggagauguaucuagucuucuggccuccccuuuucugaagagaaaggcaaagggaauagauguauagauguagagguggugacagggagggacugggaggagaggagggaggggaagcugugauccagauguaaagaaauuaauuaauuuucaaaaaauguuauuugaaacucaaagaaaaggaaucaggaugaagauuucuccaaaaacuaacacuagaaucauguuauguuccagcuuuaucauuccuguauacauuccauagggaugcuuguaaugaaaaaguauaacgcaaaagcaaaaucuaggccuuuaggcccaggcuagagaauaugaccucugugacucaaugcuccaaguuaugcuaaucauaaaacagauagcgacauuccuccacccaccugcuuccuggguucaaggaguguucauucaaagaaagucacccugacccacccugaccauugcuggaacccgcuaugcaaaugugcuauuguuaggggcucuuagaaauugucuugagaaauaacuggcacaauuaccagguauuccuugugacucuuaugacuuugcacuuccuugugacucuuaacugguauuuuugguauuuuccaacaaugcccucccuaccuccuugaguugugguuucuuccuuuaaauacccccuuacacagcuacucagggugccacgguccucuaccccugugugauguaugacugugggcccgagagcgcucuugaauaaaaguccucgugcaguuugcaguaagaccauuucucgugagugauuugggguguugcuucuccugagucagaaugugggggaguccucacguugugggucuuucaguacauccuuguuuauuggugcaguauucauaauagccgauagauggaauaagaauagaugucuaccaacagaucaauggauaaacaaaauggggcacaaaacauauuguucagucacaaagaagaaugacauucacaggaaaaugaaugaaacuggaaaccacaauguuaaaugaaauaagacauauuuggaaagacaagcaaugcacauuuuucuucauauguaaaauaugaguggaaacacacagagaugccugcaugccugugcauacacagacaugcagagagagagagagagagagagagagagagagagagagagagagagagagagagaaucagagggggagacuauaucuaaagggagggaaaugagaaacaagagagaacagcgggauauacauguuuuggaaacaagaaacauuucauagcauaaugccaaggugaguggugggggaggcacaacacaggugagugcuccuggugcuggccacacugggaucuguccacaacggauuuauuuucugcuccauuaaucuguaggcacuccaccuaacaccagcaauggugaccuugguagggacagaaugacauguuuccugccccugagauaaggccaacaggcauggaccuccaccaaggucgaugccuacuaugggcauaagguuugcuuguguaacaauguacauguuuguacauuccucugaggaaugucuucccuguuaacauuaaugacuccaugauaaucagacagcaugagucagggaggcaaagguguggcuaaugucucagcaaaaugguaaaugcugggaccuucaggauaccccuuuaaggcuguggaaaagaacucuaaacacauuaauuagaaaagaauauauaauuucucaacuaugcaaaaauagaaggcugugauaugaauuguaugaggaccugaaagaaccuaguggggaaacccccacucaugucucgagucggcgagcacccagggaaucacgagagaccgucuugaugcaaacacacgaggaaguuuaaugauggagcucugggccuacauguaucucacacaggagauagcaauugucgaccacaaggcucgaaagcuagagguuuuuaaagaaacaggucuggggcuggggaggaauuggcgcgguuucacaugauugguucauuuaaucaucagcaaacuguacgugcagaucaagguaacagcagagcaucugguuaacauuuaacacaugucagaugggcgagagauagggaggcaccaggccagucuggacaugucuuugcauucucuuuaucuuuauggcuaaguagccucaggaaugucuuaaugacggaccugccugggcauguccugaccuguucugcuauguucucagucccaggcuucaaagcucacaaacaacucuuugggcuauuacaugaaucacagaucucaaguuuaauuuuauuucauuccccucuucuucuacuaaauaauucuaaucuuagaauuucacaagucuauauuucuauguggagaauagaaauaauacucuucuuuuaucuuaacuauagguugguauugacgcuggaggaccauaagcuguacugcauuuacucuaucuuuaacaugggaacaaaaacagaauaagaagggauaguaaacaggcuugagggucugggcaugaugcaggugcacauagaucuccgacuggaacuggugagaugucuuugggguacccagcucguuugcuguagccaguugugaccagacuucuuucuauaccaccugcaagccuuuuaacuuagcauacagauuauuauuauaagaacauguagguuuaaacacaucauuuaagacagugaugggcaugggagccccauaaaggaucucaaaaagaguaaggcugaaucaagagggaguauuuucagcucuaaauagggccuggggaaggagaagugagucuuugccagucucuaugguuaauuuugucaagguuucuuuuagaguuguauuuauccucuaccugucccaagcuuuggggccuguaugcacaauguaacuuuuaaucagucucuaauaucuuagccagucccugacuuaccuuggcaacaaaggcaggucuguuaaccacaccuuuuaauuucuuggcccccaagugggucaaguaauguaaguugguaacauauuugcguccuucuucccaugggaggacuaguuuuucuucuucuguuucuacuacuccauacaggguuucuuuuaccaguccauaacuugauaguccucagacugucaggaucauugcucuuugggucgccuguuuggcgguuagaucugccaucugauuucuuuuagccacagcaucuuaggucuuucucugcauaugucaacagcccucuuugucuguauauugcuccguacaguggcaaaagcauaccugcugucaguguagacuuucuuuuugccauucauagagcuuguaucaaagccacaaguucagcuuucugggccgacgucccuucagggaggcugcuggccuagaucacuugcuuucugucuaccugcugucccugccuuccacuuaccuuugaccaugaagcuacugccaucccuguauccgcucuaacucucaggccaaggcugaucugauccuucagaucauuuugaguaccaguuucuucugccagaacgucagugcggugaugaguaugugaagucucaggcaguaggauagcaggauugaggacagcagggggaucgaaggucacucguuuagucaacagaaagcucugauaaugugucugucggucaugggaacgguuggcuaaugcuuucaagaguguggggugccauuacaguuauuugcugucccagagugagcuuaucagcauccuugacaagcagugcuauggcagcaauagcuuucagacaagaaaaaccaccugcuggcaacagggucuaacuucuuggauagguaagccacuggccuuuuucaaggucccaaagucugaguaacgacuccucugucaaccccugcugucucuuccacauaaagagugaaaaggcuugguuaagucaggcaaggccauggcuggccaucagcagagccuuuuuaauuucuuuaaagguuuucuggugaucugggguccacacaaacaccucuccuuccuugguuaggggguauaacggacagcuaagguugccaacccagguauccagagucugcagaagccagagaugcccaagaauucucuuacuugccuuaguguaguugggguggggaucugaguuagucuuuuuuucuggcuuucuuuagccacuacuuuccaucucgaagcauguaucccaaauaaguaacuucaguuugacacagcugagccuuuuuagcugaggcuugguacucuaacucacuuaauuuuauucuucuaggaucuucuguugcacagauucucugucuagauccuggcuuuucuuucucuccuaucacugcagccaagauucuagucaaauuucucucuugucuaugaucccuccuguuuucucuuucuuuugccucuugccucucucucucucucuuucucucucucuuacuguuuuucacuguuaaccucucuauuugccacugucaucuaucuccccugagucugcagaagcuuugcuuugcucuucccuacagucuaagcucacuucuuucuagaccucuauauacaucugucuucuuuauccucucucucuuuuuuuuucuccucugcacuuucuuaccgacuuacccugucuuuuuuucuaacuuuugugacaaaacccucauuagagccuggcgauuagacuuauagguguucuuuaccuugggcagaugucucucuagcuggaguuuggaacagucucacuguuaguagcuuagggcggggcugcccuagaagagaaaacacguggggcagggaagggagugcagcucucauauuuggcugcucugggccacugauaucucaaagugaaagcacuuuuucuguuaacaagaggcacucugguacugucaaagcaugaagaccggcaggugggauguaggggaaaggagaacauaauuaggcagguauaagaagcagccagggaacucguagugauccuggcccaccacucucacagucucuuucucuucuuccugucuauccaucccacagcggugggagggugggggaggucggcgcacgugggcucuggggagcggaggaaucagcaggcccccaguggggggaggcccagacacuugggggcggcgggagagguggcaacucuggaugcuagucggcccuuccccagcuguggcaggcaucacggcagcucuagggagcccagggggcuggcuuggggcccugcgggccucaccccucuuccacuuugucugucuugugggcaguaaagugcgugguggugguggggcgggcgucccagggaaaccucccugucgguguucuccccaccuggucugccccccucccgggccgugguuuucuacgcagcaccucgccuuggccagcgccugcacucuuuuuuaggcugugacuucagcgucucguuaacuaucagaugcaacucacuugcgggcacagccagccucugcugccauggugccugcagaacccagaagugaacagcaggcaaucagaagguuugugugcugcucugcaccgagcccuagccacacaccaccgcgccaccacagcacugaagccgggagcccccagcccggcccuacucaggcagccaggcucagggaugaggccacgucccaaagcgcugccaggucugugcagcccggggcacacaggggagcaggcccgccccgcgggaaagcagcaccaaguuguuuuucuuaacuaucacugauaaauucuguccuaauaucaguccaaguccacagucagagacaaagggguugacacugucugucccauaacaaaaaucagaaaaaaacaggagcaaaacaaagacagaagacacuaguacaucuaaacacauacaucugcguguggacuuacaagccagccaaaacgaggggaugagguucuauauccacccacuuccugaugggggucggauuccacauugaccccccuucacccauggaaugucuuccaugguugcagccugcaggccuuaggaugucucucucccgcagucacuagguccuuacgggccacaguggcagcugccagaaaacug

SEQ ID NO: 7267 - RNA, 9221 nt, Mus musculus
caaucgcggucauccucccgccucagcuccguccaucccucccgcgugacucccgaggccccgccccgcccccacuaucucaggaaguugcucaaucucgggaccaugggcgcggucggggcggggcggggccucuggggucacgggcagggucgcaguccucugcccuguaagcaguuccgacccccagacccccgaggacaggaacggacgccgccagcgccgugggcgccacucagguccgguccgcggggugggcgggggugggcggggucagggggcggggccucggcggucaucccccugccuccguccuuccuucugcucacugccaucauuccuggccucagauccucacucacaggcauuccccagccgucgcucccucccucucugcuuuucuguguccaucgugauuaucccccugccucagaaacuaacucguggucaucccccugccucacacuguuuacucgcgggcgucucccugacuccgucccuccuuccgcucacuugccagcauccuccagccuccguuucugcuuccggucaccgcugccaucccucugccuugucaucugcacugauggacaugcuccugccucaugcuguucacuccugggcauacccauaccccugccucgcgaugugacacuggggacagugaagcugaggcagggggauaaccgcgagugagcagcugaggcaggggaaugaccgcaauggaccaugacaggaaccagaagcaucgugaaggggucgggaucaggagguggaguccgcuugcgccccggccccgccccucacgccccggccccgcccccaggccuccgaggcuccagccccgcccuccuaucauggccgccaaccuguggcucauccuggggcuccuggcaucccacucuucagaucuggguaggugucuucauggggcagggccuaugcucgggccacgccccccacuuccugucggucggggccccacccccgggugucucacaagacucaggcccagcccccuggcgaaggauggugucaccugucagucacccaaugccccauccacccgguuccuguccuguucugugacuucauccaggugucaaucagagcucuggucccaccccuuugcuuccucucccaaaccuuacuuccugucacgaaggaugaugucauucucacccccagaugucaaucaaaacccaaaucccgcccccuaagcucuucccuucuuguuggccugucccagcuccgggugucaaucucagcucaagcccugcccacuaacuuccugucauggcgaaugaagucaucucugcacccccccuugucaaucaaggcucaggccacgcccacugaugguggaugccaucaucauccuggucgaagacaucacuaagagaggccccgccccaucgcuuucugucauaggggaccaaugaugucaccuagggacaugucacuugccucucaugucaucugggugucaaucaaagccuaagucccgcccacuuccuuucuuuuccacccccucacuuccugucacggagaauggugucaaucaaagcccaggcaccucccacaacuguggaugaugucaccugucacucaagccccaccccaccuccccuugacaacagcugcgguccgugaggcuccacccacugcugugaccacgcccauccagaaccugcauaucgaccccgcccacuacacacugagcugggaccccgcccccggcgcugacaucacgacaggggcuuuuugcaggaagggcagggacaucuuugucugggugaggggcaagcccugguuggugggcggaguuggcugucagucauccaggguguggggcuuggguggguagggaucuccacacuguccgucauccuggccaugcccacuuucugcugugagucacucuaggccccacccaccagucacuuccugccacgcccaccagcauuccaugccuugccaugcccacuuccagucuuauuccugcccccagcacaaacuucucaccaugccaaucauuccagacuccgccccuaccacccauccggcccugcccucugcuuccucuucugccugucagucacuucaggcucugcccagucacuucuugugcaaauuuaugcagagaugagcagggggagaaaaccuaugaugucaucuggguguaugcaaauuugguccagcagagcugagacuucaggacccacccaccccagguggaguuaggcaaauuuaugaaggcuagaacaugaugucaucuggguuuaugcaaauaaacucagauggaaccaugauguuaugcaaauccaugcagauuuaugcaaagcccaugaucagggccuguggauauuuauucaaaugaaauucaaauuuaugcaaguucauacaaauuaaugcaaauuagugcuggcccuaccacucaccccaaguaugggugaccccugcugacgccgacaugcagguugaccccaggugaccccgccccucacacugacccugcccugcccccugaccucugugaccccgcaggcugaccccgggcuugcccgcugcucauuccagucgcucucccucugccaugugaccaacuucaccgucuuccuggggaaggacagggcuguggcaggauccauccaguuccccccagaugauggugggugaggccccgccuccgugacccccacgugacccaugacaccuggguuggcccccccaagaaccaacugugaccccuaacccuagcugugacccuaugaugccaggugugaccucugaucccaugugugaccagggguccuacccuggccccagcccaugacccuugaccccagggugcgaccccugcucccaaaucuuacaccugaccccaacaugggaccccaaccccgugugugaccccugacccuguccccuccaucaugaccgcagugaccccaucccaacccccacagauggcgaccacgaggccgcagcccaggaccugcgcugcugggugcaugaggggcagcugagcugccaaugggagcgggguccgaaagcaacgggugacgugcacuaccggauguucuggcgugaugugcgguggguguuaggggucacgggggucaaggguggggucgggaggucacuucuuguccucacuuccuguucugugaggccucugacgucacuuccuguucucacuucccagguggugcaggguuggggagguguucuggccacaucuugggugggcggggccauggcuuaaaagggcagggucgugaggucaccuuugaugaugucacuuccuguguucauuuccaggugggcagggccucuugugucacuuccuguccuuauuuuucgggaggcggagccuaugacaucacuuccugugcucuagucuuuuugguuggagccucagaucauuucugaaugagcauggucuaugacaucacuuucuuacugacuucauguucuccauggccucugaggucacuuccuguccuuacuuccuguugggggucuuuauggagcugugacaucauuuccuguacuuuuuuuccccugguagguggagccucuccaagaacugaugacaucacuuccugugcuugcuuccucuuuggggcuuaaugucacuuccugucaucauauuucggugggcguggccucugggugugacuucacuuccugugucacuuccugugcccgccucugggccucugacuucucuucccgaccccugucccugccaccaggcucgguccugcccacaaccgcgaguguccacacuaccacagccuugaugucaacaccgcuggccccgccccucaugguggccaugaaggcugcacccuugaccucgacacuguccuuggcuccacccccaacagcccugaccuugucccccaggucaccaucaccgucaacggcaguggccgcgcuggccccgugcccugcauggacaacacuguggaccugcagcgcgcaggugagggccuacuguacaugugcuggggggaccuggaacgggugggcccacugagugcccggggcucagucaggccuacuaugcacccauugaacccgcugugcaccuggcccagccuccugcaugggguuguggguaaacucagugugcacgcagacaacaugcuugcagggagcaugguuggacccacugugugcagcgcagcgccccauacaagccuugguaacaacuggaucuacgcugucuguggguuguguucagggcacagguagacuuacugugcacaacaguggaucuagugugugcacccagcaucccuucaugcuugggguggcaggcagaugcacuaugcacuaacaugcgucgcccuacugugugcacacccugcccugacugcccaacccugguccccgcccccagagguccuggccccgcccacguugacaguggagugcaacggcucugaggcccaugcccgaugggucgcgcggaacagauuccaccauggccuccuuggguacacccugcaggucaaccaggugcggggugaagcagaggggaugaccgcgggagugaggcaggggaaugaccacaagugagugugagugugagucagggggaugaccgcaaguguucgaugcuaagcccugcccucuuccccugcccccagagcucccgcucagagccacaggaauacaaugugaguuggggucuguggugggcggggcuugugguauggguguggcaguggcaaugacaucacagaggcccugcccacccaggucuccaucccccacuucuggguccccaacgcuggugccaucuccuuccgggucaagucgaggucagagguuuacccucggaagcucagcagcuggagcgaagccuggggccucggugaguggguagggcggggccuggcugucagucauuucuggcccugcccaccugagcuaagcccugcccacucaagcuaagccccgccaauccugagcuaagccuugcccaacauugaugucacacuaaagccccacccacagugaggcugagccacucccccacaggaaguccuaacccaacccgggggucacaugugcagggggccugggcgcccaauuucccuacgccauguccagcauugaccaaagccccacccaaggugaccuaagccacacccacuggugaugcaaugcaaaagccccacccauaggaaaucuaaccuggucccucccacuugagcucagcccacccaccuguuacuuggucccgccuucuugaaacuggccacacccauccucagguucagcucuaccuuugggucaggccaugcccaccacuuccuguccugccagucacuuccaguucucccuguuaucccacuuccuguccccacuuccaguccugcccaucacuuucuguuuccccgaugacaucacuuuccuuuccacugaccaugccugccacuuccugucccguccaucacuuucugcuuccacugaugacaucacuuacuuccuuuucugaccacacccaucacuucccauuuccacuuucugccccgcccaucacuuuuuguuuccugagugacauuauuuccugcuuccccugugaugucacuuccuauccacugacccugccccuucccgcagucugccccccagaggugaugccugugaagacagccuuggugacuucaguggcuacggugcugggggcagggcucguggcagcugggcuccugcugugguggagguaauguuaaugaugucaucguggaggcggagccugcacugugcauggccaugcccuucugcuuccuguuaacccagggucugacugauuugcaaaauuaugcaaaguaaccugggauuaugcaaaugagggauggugauuuuacuaccuccccacugugaguaacaguucugggcuuuucaaaauuuaugcaaauucuugcaaauuuuagaaagugaaaauuauguugucaugcagauuuauucaaauuuaugcaaaaaccgcucugccuaggcuauaucauaaaacguaugcaaaucuaugcuaaggagacugagagcucacaaauuuaugcaaauuuauuccagugaaagugaugucauauggccauaugcaaauucauucugggagcagccaguuaugucaauuuaugcaaaucaguacauuuucauucaaauauauucagacauaugcaaaugggauuugccaaaacuaugauauuaugcaaacuuuugcaaauuuauguaaauuucugacagugguggaaguugugaagucaugugaauuuaugcaaauucagcuaugaggucauguacuuuuauacaaauuugccuggaggaaaccaaggccacuaugcaugcaaauguaugcaagugauugcagacacguuuuacuuaaaccaugacaucaugugaauuuaugcaaauuuaugcugaugcaaaacgugaugucaugcuaaauuaugcaaauuuuggcugacauaagcugacaucauuccagcucaugcaaaugugaagacugacaucacaggagcuuaugcaaauugaccccggugaagcugugacaucacaaauucagucaggucaaacuauuaugucauggaacauucaaccgugauaucauuuauguaaauucauguaaauucacgcuacagaaccuaugaggucaggcuaauguaugcaaaugugugcugacagagugauuacgucaugugaccucauacaaaugugugaugucaucuugguucaugcaaauuugcucaugcaauauuauucaaauguauucaugacauaaugaaaguuuaugcaaauuuuucuguugaaaaugacaugcaaaucuuugcaaauuuuuucaaaccuacucuaccuggacuguaaugucaugcaaauguuuccaaaucuaugcaaauuuacuccagugaaacugacaucauacgguuguuugcaaauuuaugcuggaaucaggcaggcauguaaauuuaugcaaaccaggacauuaaucugccaaaacaaugacaucaugcaaacuuauacaaauuauuguggucguggugaaacuaugauaucaugugaauuuaugcaaauucuaugcugugagaaugaugaguucauacaaauuuaugcgaaguuucucaaacuuaugcaaaucgaagcagauaaagcuauggcaucauccugacccaugcaaauuugggcagaggaaaacugugaugucacaaggacuuaugcaaacuuauucagaugaaucgaugaggucaggcaaacauaugcaaaugugugcugauggagugaugacaucaugcugacucaugcaaaugugugaggaggaaaaaugugaugucacccaaaaucaagcaauuuuauucaaauuuaugcaaauuuacacaacauacccgccugcccagcacaaccaacguugucauacaaaucuaugcaaacucauacaauguaaaacuaaaacaucacucugguucaugcaaauuuaugcaauucuguaaaggaaagccucaacaucaagcgagcuuaugcaaauuuaccccagugaaaugaacauauaaguuaaugcaaguucauguuacuuguacuaugaggucacuugauguuaugcaaauugguguggaugaaaucaugcaaauuuauguucacaucucccgcugaguugguugacaugcaauuguauacaaauuugugaacccauguccugccuacacuggcgucaugcaaauuuaugcaaaugcaugcagaggaaaaccaugacaccaugcaaauucacacccagaucugcuagcgggguaaauuuaugcaaauuuguguggaaggaaaauggugaugucaccagugcucaugcaaacugguucuggugaaaccacaauaucaugcgggcuucaugcagauuuaugcagauuuguugaugcacccaugacaucaugucaugucccacccucgcgaugugacuuacaucccacugcaugaugccaccccaugaggguuugugcaaaucaaugcaguguggcucuaugaugucauuuggcucuaugcaaauuuauucagaugaagguaugacaucaugaaaacaugcaaauuuguacugagaaaaccuugaucucaugcaaauucauuccuuccaaugacacugaaaugcaaauuuaugcaaauucacguuacaggguuuaugaggaauuuaugcaaauuugagcaaauggaagccaagucacuaugcaaguuuauucaaauuuaugcauaacuucccaaacaugggaugugaugcaaauuuauguaaauuuauuucagugaaacugaccucacagguuguaugcaaauuuaugcccaggucagucagugacguaguuauuuuaugcaaauuuaggaugaucagguuuaugauaucauguaaauguaugcaaauucacauagaguaaaaccaugacaucauccggguucauucaaauguauuuaaguuuaguaaugacgucacgugaguuuaugcaaauuuauuccaaugaaaccgacaugaaaauuuaugcacauuacuggucagaggauaucgaggcugugggggcucaugcaaauuuaugcaaauuuaugcaaauugcugccccaaaccuauggugggaugcaaauuuauguacauuuauguaaauugauucauuucuggugacaucguugccugcccaacccaggugacugaugccucuaccccugucccugccccucucucuguccccacaggaagucgcugcucuaccgccugugcccacccauuccacgccugcgccugcccuuggcaggggagauggugagggggcagugccuggcaugugggggcagugcccagggugugggggugggcccggggguggggcaucaggggagggaucugggccucagaggggacaggaagugacacugggggucaggaaaugacuguggaagaggaagugaccacagagggacaggaagugacuuugaggggacaggaagagaugucauugauacaugaaguaacucuggugggacagaaagugaccauggggggacaggaaguaacacuagguggaaugacugacaggugggcguauccccucucugcaggucgugugggaaccagcucuugaagacugcgaggugacgccugugacagacgccugagaacugugugggggcuggggcauagggagcggugggcggggucaauaaagugcguggauuccugggac

SEQ ID NO: 7268 - RNA, 876 nt, Mus musculus
cucaagggagagagucuauccucacagggaaacacacagcaggguugugggcaguggggcgugggcagaaggggguaggcagaggggacaugggcagugggggcauuggcagugggggcaugggcagugggggcaugggcaguggggcaugggcugugggggcaugggcuauggggcaugggcuauggggcaugggcagugggggcauuggcagugggggcaugggcagagggggcaugggcagugggggcaugggcagugggggcaugggcagugggggcaugggcuauggggcaugggcagugggggcaugggcaguggggcaugggcugugggggcaugggcagugggggcaugggcagugggggcaugggcagugggggcaugggcagugggggcagugggggcaugggcagugggggcaugggcagugggggcaugggcuauggggcaugggcagugggggcaugggcagagggggcaugggcagugggggcaugggcaaugggggcagugggggcaugggcagugggggcaugggcagagggggcaugggcagugggggcaugggcagagggggcaugggcaguaggggcaugggcaguggggguaggcagaggggacaugggcagugggggcaugggcagagggggcaugggcagugggggcaugggcagugggggcaugggcaguggggacaugggcagugggggcaugggcaguggggacaugggcagugggggcaugggcaguggggacaugcgcagugggggcaugggcagugggggcaugggcagugggggcaugggcagugggggcaugggcagugggggcacugggggcaugggcagugggggcauuggcagugggggcaug

SEQ ID NO: 7269 - RNA, 1911 nt, Mus musculus
cgguguggcagaggaagcauugcuggaacaagguucauucacccauugacuagcagauaaacauacggcuccuagaaggcaccagaagcagccauggacccucucucagagcugcacgaugaccugacccuggaugacaccagccaagcucugaaccaguugaagcuggccuccacugauaagaagaacuggccuucugaugaaaugccagacuuccccaagucagaugacuccaaaagcagcucuccagaaccugugacacaccugaagugggaugacccuuacuaugacauugcccggcaccagauuuuggaaguagugggugaugauaaguauggguggaagaucauuguauucagugcuugcaggaugccccccuagccaccagcuggaccacagcaagcucuugggauacuugaaacacacacuggaccaguauguggagagugacuacacacuccuguaccugcaccauagccugaccagugacaacaaucccucccucagcuggcuaugggaugccuacagagaguuugaccgcaaguacaagaagaacaucaaggcucuguacauagugcacccaaccauguuuaucaaaacucugcuuauccucuuuaagccucucaucaguuucaaguuuggauggaagaucuucuacgugaauuaccugagugaguugagcaagcacgugaagcuggaacaguuggggaucccuugccaagugcucaaguaugaugacuuccucaaauccacacagaagaguccugcaacagcucccaagcccauggcaccauggcacauccugcccaaucagcaguuuggagucuccuuacuguggguagccgcccucacauucgccguuacaagauggcgcugacauccuguguucuaagugguaaacaaauaaucugcgcaugugccaaggguaguucuccacuccaugugcucugccuuccccgugaugacaacucggccgaugggcugcagccaaucagggagugacacguccuaggcggaggauaauucuccuuaaaagggacgggguuuugccauucucucuauugcucuugcuccugaagauguaagcaauaaagcuuuugccgcagaagauuccgguuuguugcguucuuccuggccggucgcaaacgcguguaagaccuuacagcaccuccaggagaaaagcccaggccaggagcccauucccaucgugcucaggaagacuguugccuacuugcaggcucacgcucucaccaccgagggcaucuuccagaggucugccaacacccaggcuguaugggaagugcagcagaaaugcaauauggggcugccgguggacuuugaccagcacaacgagcugcaccugccugcugucauccucaagacauuccuuugguagcuuccugaauucuugcuaaccuuugaccuauacccccacguugugggcuuccucaauauugaugaaagccagagacuggaggugacacagccgguucuccaaacucugccagaggacaacuaccaggugcuucauuuccugacugccuuccugguucagauaucugcccacugugaccagaacaagaugacuaacacuaaccuggcuguagucuucggcccuaaccugcucugggcuaaagaugcugccaucacccucaaggccaucaaucccaccaacaccuucccuaagcuccuccuggaucaucaaggggaauuguuccccagcacagaugcccagggggucugagcucaccaccuccagccccuucucuggcagcccgaguuggacuuguccuccuggcauuaaccuuacuggaguccggggcuccugccucggaaggggcucugaagccccagaagauggaaguuggagcccacuaacugggcagccccuccuaucccucugcccaaccc

SEQ ID NO: 7270 - RNA, 67564 nt, Mus musculus
ugggauuggucgaaguacuguagugacaaggcugugauuggacgauccaugguugacugacagccggugaccaccgcacccucccccucccggagcgcgccugugugugccguguuaugccggacuaaagggaggccaccacggcggcucuguuuauugucccucuuggacugugcuccggaggaccgguucagacgccgcuugggcgguuuugaggcaguggcggccuuugaggcugcggcgaccgcggcgaggacucugcggcuucgguggcuugaggagaagcagcggcucauuccugucagggcucuggcucgcgaguccuagccggcccgcuucaaccucgucccucauccgcgaucccaaucgcccgcgugggucccggaaggccgcgccgcaucgccagcccuuccuaguccucgaccacucuguaggcccgggcgccgcgcucgaguuugagggcggcgggcagcgcggccuccucagcggcucgggcccgcgauggggcgcggcuaggagugcugcgcgcagcggucagugcgagcggcgggcccggcguccccggagcgcgagcagccccuggccugcacgggaggcgcugccauggccaaguccagccucgcgggcucugacggggcgcugaccuggguggugagugcggcgcgggcgggcgcauuguucgugggccgcgggcgacgcgggcggggugagagcguggugcggcgggcgcccugucaggcugcagucggggccuagccccgugugcccuuucucucugcuuucgccuccaccaaggcucaggcugcugaacaaugcucaccggaaacuucagggugcacaccgagaguggggggaccgcgauaaugcgagccuccgggccaacccuccauaagugcagcaccagaaaauagugcccgguaugcuacggcuuccggcggccugucccagaggaaugugcacuugaauggucacugcggguugcgccuccccagaaaaggcucauuccgcagagaggguauuugggacgacuuugacagcaggcuagagaccgcccgcgggauuaaaagaagaguuuacuuacgucagccucccguguacaccgugugggggcccaggggugucccucggaggugagggggugcuuaagccugaacuuggaggauugcagagcucaguuccuggagggagguggacuuagcaagugcagcgggagcaguuggaacgcggcucccaggacagaucgauaacuccagcauuucacuuacucagcacugaguucagaccagggucauuucccaaacaaaacaccggacuuaguagaugaggccagcagcuuggacagaaaauuuacacauuucagggacuuuaacacaucccuuccagaggauccuaguuccccgccuuuugaacacacuaaggaacuuugguauugguuggcauuuuuguuccuuguuuucuuuguuugguugagguuucgaugaggcugggguagcagucguuucuaucgacaaguguuguuuauaaaaaggauguuucuaugaagagcagaaaaacaguuucagcauuugcagggccucgagaagauacuuuacaguguaacuugccagguacuuaucuucaaaucuccagacauacguacuucuagacaguauagaaggcgagcguggagaagaaaaguuagauaguaagguaguggauaaguguccaugaaaagaaugauugaaauuacugucccuuaucggauacuaaaacuaaacaucugaacaugugugaucauaugccagugucacugguaauugugaagcacugacaucugagaaguuugucuguaacuugguuccacaauggcaaauauuucuuuuuaagauuuauuuauguauaugagugcuuuugucuacauguacuucacacaccagaagacagcaucagaaaauugugaccguccauaugggugcugggaauugaacucaggaccuuuagaagugcagugagugcucuuaaccacugaacuaucucucuaguucccccuccccucuuuuggcaaauauuuuuacguuguuauuuuauguguauggguguuuugccugcuugugcaacacuuaagugucuggugccuaggcaaggaagaccagaagagggcaucuauauuguggaacugcagccacccagauccucuggaacccaguuccucuggaagagcagcuagugcaucucucaaauucugucaccauagcaaacauuuugugacacaguuggauuguuuuuaauucaugguagcaauauuuuaauuugcuguuauuaacuuuauaaacaauuuaaugggcaccuuuccuuuuaagaucaauggggaaacuuuaauuuacauacaaaauugagcaaaauuuguagaguuucauucaaaauuagaaaaaaucuauuugaaacuaaaauagucacauugacuaaaucuacuauaaacuagauuaugggaauuacaguaaaauagaauuugaucuuaaauaauauuucuuguugaauuagguuauugaaaagacaaucacauuagaaguccucuuucagguuugugcuugcuuuauguuucuagagcgagcaucuuuaugucuguaauaaagcuuacagguugcuuuaaauucuugugcauuuguguaugagaggagagaguguauauaugcacauuuuccuaccuagauggguuuugaacuuaugauccuccuuccuuagcuucaugagugcuaagauuacacaugugagccaucacacagggccuggcugguuuucuuuacuggaagauguuacagugaguugaugugggcuuugacauaggcucauauucugucugcaauacauauugcaggugagacuuuuuuucagagagcuuaaaucuuuuuuuuuauuuuuuuauuuuuuuuugauuuuacauaagauuauuuagcuaggugaaaaguuagauuuucauugugggaguuugggggcuuacugcgacagugaagcuagucucauguugccaucuguuugugaauaguaauacaaaacuggaguuaauccaccuaccuuauguuagccaaggaguugcuguacuaccuucagucuguguguugauacucucuugugaugaaagauuaccuuuuagugucagacacaaugcaauagagggguucuuaacacuacuuuuugcuuauaaugauuaauuugauuugauuuugguuuuuaguauccuaacugaaauuagaaaaauguaguguaacuauuuaaaauuaaauacacacuaaauuuaaagcagucaaguuucuugaauuuuuagcuuguaagacuugguuaguagaagauacuaauuuuuuaaucagguuguagcaaauuuuugagaaaacacuaggcuauaaauuaaugacauauuuuuucaaaugaauacucuggauuguagauuaauauagugggagaacaugguauggguuagaggaagaaaaagaaagggaggaaacaauguaauucuauuuuaacuaaaaauaaaauaagcuauauaaagugacaaaauauuuaaaaacaugauagccagaauuguauacuuuuuuaucuauuaucaggcuucaguaaaauucaucucaggguuaccuaccuuuacuuuacaauguuuuuaugugaaaguuuuugucuuuaaacgauauagucacaacauuauaguuucuuuaaaaaauauauaauaguauaucacauauuuauauuuuugccaugaauuuuuuaaaaaagauuuauuuguuguaugugaguacacugccacugccuucagacacaccagaagagggcauccauuacagauggcauccauuacagaugguugugagccacuaugugguugcugggaauugagcucaggaugucuggaagagcagucagugcccuuaccugcugagccccugcuguggauauuuuaaacauauauuuaaaacauaauugagauuauaauugcaucauuucuccuuuccuuuuccucccaccaaacuuucccauguacuaccccuggcucuauuucaaauccauagucguuuuucuuuaauuguuguuacauauauauguguguguauuaguauuccuaaauauauaaauacaaccugcucaauccauauaaugcuacuuguguauauauguuuucagggcuguugggcauuggcuaucugguuggugugcucuucccuugggaaaacuauuuccacuauccucagcauucuugaguugccuguaguuguuucucuagggcggaggcuuccugaucucgccaucuucacaauuagcuaacaugucuauucaugucagccucguucaggucauguuuaggcagcccgguugguaggacuucauggagauagcuucugagaguccuaggagacacaauaucacagcaaguuucuuguuucucuggcucuuaacagucuuucuguccucccuuuuacagugauuccugagccauagguuuaggaguuguguuguagaugaaucaguuuuaacugagcuccacaauccuacacuuugcucaguuaugguuuucugucugcauuuuucuuuaaaaaugauugcauuuauugauuguauguguuugugcauguguauaggugcacaaaucacagugaauauauggacggcagaggucagcuuugggcauguuuuuuuuuuccuucugccuucaugggaagugcuuuuaacuacugggcuaucuuguuggccuguauuguggauauuaguaauuuuuuuaaaaagucacugucuuagucaggguuucuauuccugcacaaacaucuugaccaagaagccauuggggaggaaaggguuuauucagcuuacauuucuacacugcuguuaucaccaaagaaagucaggacuagaacucaagcaggucaggaagcaggagcugaugaagagccauggagggauguuccuuacuggcuugcuuuucuuggcuugcucagccugcucucuuauagaaccaagacuaccagcccagagaugguuccacccaccacccacgaggggccuuucccccuugaucacuaauugagaaaaugccuuacagcuggaucuuguggcggcaucuccccagcugaagcuccuuucucugugauaacuccagccugugucaaguugacaccaaaaaccagccaguacaauugaccccuugucaacuuuacauacaaacacaucacuaauaagccucaacccuuacguucuuauucauccccaagaucuuaaauacuuuaaaagucccacagucuuuacauauuaaaaguucaauccuuuuaaaauguccgauaucuuuuaaaauucaaagucucuuaacugugggcuccacuaaaauacuuucuucuucaagagggaaaaauaucagggcacagucacaaucaaaagcaaaaaucaaucucuaaccauccaaugucugggaucuaacucacgaucuucugggcuccgccaagggcuuggaucacuucuccagccaugcccuuuguagcacaaacguugucuucuaggcuccagccgccuguacuccacugcuguuguuguucuugguagucaucucaugguacuggcaucuccaaaaugcugcugucuuucacuguaacuuggcuucaacaauagccucucauaggcucucuucauggugccaagccucaacuccuuugcgugaccccuucaguccugggccaucaauugcaacugaggcugcacuuucaccaauggccuucugugaccucucacagugcugagccucagcuguucugcaugaccccuucaugccuucaaaaccaguaccaccuggguaacucuuacacauuacuaaguccagccacagcacaagguacaaccauggcuaucucuggaacauagccucugugcucucagaaaacacuucccagaagaugucaccucaaugaugcuggucucucuuaaucacugcuaauuucuaagcuccagcuaaccagcaucaauagucccaguaauagaaaaguuucacuuuacuaguucugguaucuuguuaaucacagcugauucuucagccccagcuaaccagaaccacagaaucuucacaaucaaaguaacaauggcccugaaaagaggcuuuaauuuuuccucugaaauuucacaagccaggccuccaucuucugcacuguucucaacauuaucuuccaagcuccuauacaucaucccacagagcucuuaacaccaauuuucuagcccaaaguuccaaaguccuuucacaacccuccccaaaacauggucagguugucacaggaauaccccacuucugguaccaauuugucuuagucaggguuuuuauuccuguacaaacaucaugaccaagaagccauuggggaggaaaggguuuauucagcuuacauuucuacacugcuguuaucaccaaagaaagucaggacuggaacucaagcaggucaggaagcaggagcugaugaagaaccauggagggauguuccuuacuggcuugcuuuucuuggcuugcucagccugcucucuuauagaacccaagacuaccagcccagagaugguuccacccaccacccacgaggggcccuuuccccuugaucacuaauugagaaaaugccuuacagcuggaucuuguggcggcaucuccccagcugaagcuccuuucucugugauaacucuaccuuuugucaaguugacacccaaaaccagccaguacagucacuauauuuaaacacuuuaaauuuuuguuuuaaaaacuugaguuuagugggccuuuaagucuauguucauaaucuguguguccucuccauugagguuaguuaccuauaguuuccauacuugaugaucccuuuacauuucaucaggaaugccucuuuccucuugccuaguagucuauugauuuagacuguuucuuuguguagccuugucugucuuagaacuagcucuguagaucagacuagccucaaacucacagagauccaccugccucuucagaucaaaaaagcaccaggaccaccuggcaccugguuagcagucuaaaucaaucaaucaaucaaucaaucaaucauucaaucaaucaaucugucugucugucugacuaauguaugagugcucugucugcauguauacaugugugccagagagggcauuggaucuuauuauagaugguuauaagcuaccaugugguugcugggaauugaacucaggaccucuggaagagcagccagggcucuuaaccacugagccaucucgagccccagcagucuaaaucuuaagugcuuuuauggcuaccuuaagagucucacuaaacuuauuuuucagauuaugcucuuuuuauuuauauuuuugguuuaugcuguuuuuaaaucaaacuuuuguuacucuaucuaaaacauaugcccuucuagggaauauuuauguaugauaguuuugucuuaacaauaacauaaacuuaucaauucagagaccauaucuuuuccuuuuuuauaucuuuuguuauguuuagcaaaagucugguuauauauuccaccuucaguuaugguugaugaacuggguauucaaauccuuccuucuguggcaaucauucaucacuuguagauagcacuaaauucuccaguaagguaaugucacaguauuuagaaguacuuuuuguaaauugaauagaaguaugcuuggucaccuguagucucaagucuguuaaacacuuagauggugagaguuccauucuaaguacacuuuuaaaagcaacccucuugugcaucuuuguaaaaccucacuacaaauggaaccccuguuuuaaacaaacacuuuuauuuuuccuaguuaucauuagggaaacaggaaguagaaaauagaucaguagggcauguggcagagacaguugugggcugugaauuggguuaagucuuaaccaucauucuuuaccacagucuuccucuaaaacauuaaaagcaaaacaacuucuuuuguacccuaaucagaguaugagauaagccugucucuuucugucuacugaucuuuuuacuuugacauaaaaaagggaaggauuuuaucuccuuuucagaguguguguaccuagcuaguauuauagcaugauaaucauacuauaauagcaugauggaaaguaugggcugugaacuaagaucacauaguuucauaauuuggcuuuguuaaauguuaaguuuucuucagaccucauuccacauacauuagggaaucauaauggcagcauuuacuugguggagcucuuauguaaguauuggaauauuccagauaccucccaucaugcuggagcacagcaggugucagauaagugagggcacauacaucucuaacccugugauaagugucugcaugcuuuuuaucuuagggaaagcuugauuugggaggauguuucugaagaaaauguguagauaguuuacaguuugugcuaguugaaacuaauuuucuguauucuuaaugcuaucagcaacaauguuaaaacuggcuaagcuauuggcacaucuucuuauaaagauagaguuauuguuaauaacaagggcagaagucuuucuuguuucuccuguaccuguucucaguacagccaggguguuuguacuuuuagcuuuuccugggcacaaagccauuccacuaauuaacuaagggacaguuuuuuucccuuucuccauaccuccagauuuugauuuucagugcccugaccagaguaaucucuagaguuaaguucugcuaauauccauaaacugaaugagaccuuccuugcauauuucugcuagaaaagcuuguauggugggaagcuuuuauguuggggcuagcaagccauuggauaaauaaucaaacauuugcugagaccaggaacauaaaagacaauuugaaugaaaugcuaauuucugcuuucaacuuugcuaaggcuaccaguauuauuuguguauuuugguuuuacuuuuauccagacaguaaugaggaaguuuaggcugcagaaguaauagcuaaguaaaaacagugcuuuuagucaaacauucaguuuuauucuagucuaauuauaucuucacaugcaugaguuaauaagcuuuaaacacccuuugugauuucauuauaggaaguuagaaaauguaucaaaaguaaaaauaaaaugacccacauuuauauuuucuauagaaaguuuuauuggcauucucuuggguauauaugcauucauagucugugcugugcauguauauauuuauauaauuuuucuaaaaaauggacuuuuuuuguaacuuugcucaauagacauuguaguuauuuguauuuuauguccauguguuggugcuuuuacauacaccugugaguguagugucugggagacuaauagagguuaucagaucuucugggacuagauuuacaaguaguuguacuauggaugccaggaacugaacuccuuuuuaagaacagcaauuuuucuuaaccauugagccauucuaguuggaacuugcuuuguaaccuaguuggccucaacuuuguggcaguucuccugcuucugcuucccaaguucugggaauucaaguauauaauacuaugcucaguuaaauacuguaguuugguaagccauuaaacaauuuaacaauacucaguucucuuaagguuauauaaaaucuauggccauuggaacuuuuuccuaagauuuauuauuuuuguuuuauuuacauguaugucucuaagugaguaucuaccacauguaugugacugucuguagagagagcagugguucucaauguucuuaaugcugagacucauuaauacaguuccucauguuguggugacccccaaccauaaaauuauuuuuguugcuaauuuguaaccguaauuuugcugcuauuuugaaucauaauggaaauaucugauauauaggauaucagagaugagaccccaaugaaaaggucauuuggcccucaaagaggucauugcccacaaauugagaacuacugcuauagagacuagaagaggagaugucagauccguuggaacuggaguuucaggugguugugaaccaccugacauggaaucucaacuuggggcccuuuaaaagcagcauauauucccccccccccuuuuaucuaucagauuacccucugccucucucuccagcuuuacccccacccuaccuuccuucuuucucagauccagucucccuucauuuucucuuuagaaaagagcaggccuuuaagaagugacagucacacaggacaaaacaagauauaauaagacaagucaaaagcccucauacacaggcugggccaggcaacccaguaggagaaaaagagucagagacacaccuucuccugcuguuuggagucacacaaaacaccaagcuaacagguauaacauguaugcugauggucuggugcagacucacacaggccuugugcuugccauuuuaguuucgaugagcccauucauaugugcccugcuugauuugguggaccauggucaccauagcauacauucuuaacuucuuaguuaucucucccuucuuguuuagauuuauuucauucuguauaauuaagcaaggauaaauuuguuuaucuugaaauucaucaauuuccucuagguuauuuaauuggcauauaguuuuacccaucucuuagaaaaccugcuuucuguaaguuauacugucucucuuuuguuucaauucuaguuacacuuuuuuuuuaagaacuuucuagcuaaacuguauuugucucuuuuguguugcugugcugagauaccugauggaaaaagggagaaaagacuuauuuuggaguagugacaaaagcauguaguguuuacuguucauauuauguuagaucaggacgcagaguacagcaggaguugggaccagguagcuuucaaagacucaaccuuuagugacagauuuucuauagcuaggccucauacauaaaacuuccacugucuuucaaaguaacacuaccaagcauucaaaauugauccugugugggacauuucagauucaaaucauggcaacccccuguuuuucuuagacuuauggcuaucuaacagugcaaaguguauucaaucuaacuugacauugcucaaaaguguaggugucucuacuuagacacaaaccaaucccuuuuugauucuuuauaagauaaaaauagugugaacaucaauauacuauagcaugagguugauauuacuguuccaaaaaugaagaacagaagaguaccaagggaagaacaagccaaacacagaacacuguucaguaggacaaacacugaguccuguagacccacaugcagcaucaaagacaugcauuugcaugauguuagcuucagugaacuugaauguacccacccuauguccuagccauuugaaacccacaugugaccucuuggucugaaucuacuuagugccuaguuuucuuggggucuccauuucaaaugaagcauuauucucauaguuugaaggcucucuuauaggugaccuucugucaggcuuugcuguuuuauaggcguuucucaaauucuugaugggauauucuaugauucuguagccccuacauucugaauauuuguaaaaacagaaucauaguuuuagauguagcuuggccauuuuggaccacagcuguaguggccuuugaguuccuagacagcuaagccugcgaaacacuuucuagagggcccaaguaagcacagcaugcuggagccugugauggguggaguuuuuuguuuguuuguuuuuguuuuuguuuuuuuguuuuguuuuguuuuuugagacaggguuucucuguauagcccuggcuguccugggacucacuuuguagaugaggcuggccucgaacucagaaauccgccugucucugccucccaagugcugggacuaaaggcaugcaccaccgcccagcugauggguagaguuuugccaacaauuguuaucguccugguguguaaauugcuuaguuucauuuaacacuucuaaucucucuucuuaacucuuaugagcucuugguuuugcuaaugcuccuuuucuggacaaaucacauuuuuuuccuccuuugaaaggcuggcuaauauuaauuugcuagcaacaaccaugccacaucccaaauauuucugccuuuuugaaaauugcucugcuaaauuauuaguccauuaaauuaagccuccuucagauuuucagaauguagcguguaauuauuaaaaaaauaaauuccaugcuaaugccgucuucacagucuccccuccccaauugggagcugcaagccgagguuuucccaggcuucugaggcuagccuaccucugaaccccuugaauuucccauuuccaagucaucuauccccuguggcuagcugucacaaaucccaguaauccaguaaaugaaaacccuagaggcuuguaauuuaucauucugauuuauaacaguaacucuuaaaaccccaaaauacccacauaaagaacucaaaacucaauugauauaaauacaugcuacacacuuaguagauggggcaaauguacccuaugucacucaguuguccugcuaugguauccauuacuaucuguggcucuuuaggccacuuagaucugguucaucuucuuuagguuccaucuugucuccaucuuccuccucucugucucucuguccccucucuaaaacuuucagcuccaccuucccuuccacugcccaauuacaggcucaagccuuaucugacuaauuaagauuucaccugacuacaccugaauaugggcacuccugagggagcauaacaaacaagcagcagucuacaacaccaggaugcugcaaaauaugcagaaauucuuugccaguuguaacaggaaugguuacaauuuccaacagaguccuuguuugcaccugaaacuuugguuucagacuucacugucuacuuuucuauuaucauucugaucuuuuugaacuucuacuugaaguauccauuaagcucugcuuauagcauuuugggauuucucuaguuuacauagcaaaccucuugcaauuugcucccauaaaucagcucaacaagacuaagccagauucagguuuaaacacagcagugacugugcuucucugguuccaguuucagagugaguuacuuuugcauugcugugaccaaaauaccugacagaaacggcuucacggaggagauuuacuuugguucacgguuuuaagaaauuucagucuuuuauagcagggaggcgcacagaguaugugacagaaucauucucagggcugagguuaguaccaauaaguguagccuuuaguggccugcuucuacugaccuguuuaugcaggcuaguacccaccuccucaagguucuacauccucccaauauaauacuaguagcuugagaacugucauuugaaacaugagccugugugagauaauugcacacuuaaaccauaaaaaacauuuguguauuuuguugauuuuaaaaaacaaaaaaccacaacucuugcuuucauugacuuuaagcaucuaaaaaaaaucuuuccucugagaugucaaaaugacaugauuuauuguacauauguuacacuuggcugcaacugaggacaaaccuaguuuaaguugccucagguccagguagaacgaacagggaccauuuugguuacaaaugaggcaagucucucagaaguggucuuggugauuagaugguaaugaaguccuagauaaaguaugauagguagcauacagucuaacuacuuguaugaacacuucagucacuggcauuccucauuucugcuccuacagccaucauguguacacucuacaugacuaguuacuuggccuuugguugaucuuucuccucuggaauuuuaggcaguguauuaauuguauauaguguauauuauuugaugacucuuuuuuuuuuuuuuuuuuaguaagcauucucuuuuccaauuuauucucaugccaaaggaacuucuguaagggaggcaacaguaaggcugagggacuugaaucuuaauagacuccugucuauuaauuuuagauuuaguucuaugcauaguuucuuaauguaugcuauugguucagcaucuucauuuuaaaaauuuaaaugugguaccacuuugucuugauccuguaaguuuugacgucuuuuuuuuuuuuuuuugcuuuuauuuauccccauauauuuccuaaguuauuuuaugauuucuucuuugauucuuaaauaguuuacaaaaaacguuuuagucuguaucugugcaguaacugaugggaaacuaauagaacuccuuaguauaugagaauuguuuucuuguauugcugucaggauucucucccucgugacuuuuuuuuuuaugagauugggaauugaacucauugcccccuggaugggccuauggcuuauccauggcguuggcaguuugauuauguaucuuaguacagguuccuuagguuugugcuugcuugacugugaacuucuuaaauuugucaauuucucuccucauauuuggaaaguucuuccuauuuuuaucuucuccuuuagacauuguguaacauucuguuugacugaugauagccugugagucaaguucuuuuaauuuuucuuaauucuuucuuuggugguuccuuugucauugucauuucuuucuucauaguuacuauuuuuucuugugauuggccaaguugagucuucauauauuuuaaguuauucuucaguuuuaguaacaauguuugagucuuuucauuuauuuucuguuuaucucauuuuguuuacuauuuugcugauuuucugguuuuguuguguaucuggacaguucccugagcugcuucuuaccuccaucucucccuuuccuuuaucuucuuguuaccauuauuuuuuccuuuucucuuucucuccugucuucuccuguccccuccccuccuuucccuccacucuucuccccuccccucaacaucuucucuaagccuagucuaaacuuuauuuauagcaguccuucugccuuaauuucucaaguucuaggauuacagaugggagcacccacagcccauggagauuuaagucuaucccuuggaagguuuugugugugugugugugugugugugugugugugugugugugugugcuuccccuuuuauuuauuuguguugcuuucucucaggguuagcucuucuuaacagucugguucuagucugggugguuucugcagcuaguuaguccauucagagagucacgagacuuugcaagccauuucuagggguguagcgucucugggcuuguucauggaagagcauugucuguaucuuuauuuagggaacagucugggcaacuccucugcccuacuguguccucucacacacacuguaauaagccaugguacuagagcuccaccuaaugucuauccuuagaacuacagacucugggugcuggacuaaaucauuuugauuuccuuuguucucaguucagcuacuguugccagugcuagauucaagaaagacagcaaacagucccugugguagcacuucuacuuucccuuugaagggaaaacucugggaaagaaguugcauuuccucccguccugccuugcagagagggcuccugggcguggaugugguuuuguauuuuucacucaagagacaggaccucuuaagcagucucuggauuucuuacaaggacgagugauucauuuauuacaguuuagucuguguuucaguagggaaggggguuugggguuuccuaaacuucagucuuguugacauuaaacuauguguucugauuuuuaagguuuaauucuuugaacuugauagguuagauucucaccucuuuuucucuuauauccauuugggaguagauagaagguagggugguggugguggcaaccauuuguuaagaaggugcaggaaugugguuaacuuguugaaaauguuuugagaugcuguccaucuccaguuaucagugcaguuuagcaaaaacuccuaaggcaaauuucaaaaucuaaauuauguagacacugacuucagguugacuuaauauugaaaauauuuucauuuugauguauguuuuagaguuauaaacuugaugagaaaguuuuuuuucccuaugugcuuguuauagguuugcaaccuuuaugccaauagucacaugcauugagacgccuuucuaaguuauugauagaaaauuaccuuccuuugaauuaauaugucucacauuuuaaaguaauuagagaaugauuuuagugauuaugaucuuugugcuaacuauucugaggaccuguauagguuauuacuucucucuuugcugugauaaaauaccugagaacaaagcuugaagaggacagagauuagaguggaggguccaguucauuugauuacaacagacaauaauuaccuuguaaacaauggaccaccaaaaugguagcugcagcuacaugaaaauguucccaguugggagauguuaguuaaauccaggacaaaauggggguaacucugggcaguucagaggggaagacaggugugagaguggcucuaacugugggaccaggccauacugcaagcugauugaucauauuacaugugcauucaggaagcauagugcuggugauguccuuguuuucuccuaguguauuuacuuuacauaagcugcucacagucaggguagcuuuuuuccauuuuuguuaaacuguucuugaaacauccucacagauacauccacaaauuuugucuucuagguuauucuacauuucauuagauugacaaucccaucacaguaugcauuuuacaaauaguuuauugcuauaaacaucguaagccgggcgugguagugcacgccuuuaauucuaacacuggggaggcagaggcagaggcaggcagauuucugaguucaaggucagccugguauacaaagugaguuccaggacagccagggcuauacagagaaaccaugucucaaaaaccaaaaaaaaaaaaaaaaaaaaaaccaaaaaaacaacccccccccaaaaaaaacaaaaaccaaacaaacaaacaaacaaaaaaaccauuguaauaguucaucuuuuuggccauuuaguuuaucaucaaacucuugacagaaauagaguauggaaaccuuauggaauuauuuucuuuuguacaaagcuauuuuuaagugaauuagcacuauuaauagauaaguauauaaaugaaagaaaauaugacuauagcaaaauucaguaaaauuaguauuuuaaacauuauuaagugccuauauauauauauauaaauaaauucaugaccuuaagaaauuacaguuaauauuugaauucccuaagguuuuucuguuacaaguccuauuuugguauguuuguuuagauuacucaaaaggcauagauuuuuauuuugcaacauauauagugacauuuuaaagauuuaauuuaugacaugauauuauguuuauauuaagaaacugaaaauaggccauccuaauuuccuuuauuaauaagaugccauauuagucagcauuccccaaagcugacuaaucuaagaaggaaaugcucuguugcugugaagaaaagggggagucuuuagacuuagaaguuugguuugguucucagauguuguagaaauaguuaccauuacuuagcucuauaucauuggaacuggcagaggaaugaaucuauagaugcuuuaguauuaggucaaccucaacugaaacuggcaugaucuacuaagaugagcaaccugagcacuuucuaaccaugauaaucuuggccauauuguauuuauuaacuacaucgacuauuuugugugacccucagagccauucaguuuuuauucugauucuguaaccugacagcaacgugaauccuuugggaaguuuuggggaacacaaaacauuaccuugauaucuuagagagcugggaccugcucuacuaauucugaucaguauaagguugucuaagugcuagugauagguaacauuaguaagacugaaagauggaucccaggucaugucuccauauacauuuuuguuugccccuugguuuaggauauuuaaauuuaauuuagaugauuuuucuaacagaacaaugcuacaaaaaaggaagaguuggagacagcaaacaaaaaugacucuacuaagaaguugucuguugagagaguguaccagaagaagacccaacuggagcacauucuccuucguccugauacauacauuggaucaguggagccacugacacagguaauuacuugcuaaaauugauugagauuagaggauaugcauaucuucuuuuuaaauauuuuaauaaaggcaugguuauguaguuuguaagucugcgacuuuaugucuguuuaugaucaugauuaagaaggacagaggagcuaagacaaugcgcgagacucugggccugaaacucacaaacaagaaaaccaaacaaaccuaaccaagaugaacccugagagagaccuaggagaacuggaaaucuguucauugcuuauggagauaaggacaucagaauauaaaaguguagaauaaaauggugccauaagaauugguuaaaaguuuaacauagugugugcugugguuuacuucaauagugauaccuucuagagcugauuuauuuauguuuacuguggcuuuggcuuacauauauuauucugcuugauuuaacauuuuugggaaguccaaaguuagacuuuuauuguuuuacucugcuauauuuuucuauagaauauagauaaauuuugaagugaaaguagaaaguaaauaaauguucuucauuauuuuaaacauuauguagguauuauuucuagggauccauaguuguugacagagaacagaaauuucuaggccuuaagaauuugauuugggguucccaucugcuguagaaugguuagaauuaggacucuuaacucuuuaugaaacgagcagagaaacugaaguuagagguguuuuguuggacacuggggauugagcccagcgccuuauacuuggcucagcacaaacuguuacugaguuacagacuuauauuacagcugaccuacaugugaauaaaauacaagcaaugcaacuugaacaacuuuucaauuuuaguuauuuaaguuuauugugagacuacaggacuugacuucagguuuacuuugaaugccuguuuuaaauagaguaacugacaauauggauuuuuaguuuucuuuguuuguauuugauuuuguuuuguuuuacugguuuuuuuuuuguuguuguuguuuuguuuuguuuuugagacuggguuuuacuuuguaguucugacuagcauugauuugcauguagcccagauuagcaucaaauugugguaguugucuuuccucagcuuucucugaguguugagauuauagauguguaucaacguaacuuguugaguguguggguuuaugguauauaaacuuggaguuaagaauuugugguguaauaaaacuguuuugaaucauucuccugacacagcuaauguggguguaugaugaagauguagggaugaacugcagggaggucaccuuuguuccaggcuuauacaagaucuuugaugaaauuuugggugaguacuuauuuaggauguaaugcauguauuucugucuguguauuccccauguacugcaagucuugcaguauaauuuauaaaguauuuugcugguuuuuauuuuaaaauauaggcaaauauguaaaaaaccaauaauguaugauauauaaaaaguaacauuaggauaaauaauauuaauugauaauaaguauguauguuaaauauguuuuucagaaaaaaugauaugcaacuauaaugguuuuguauuucuuugcuucuuaauguuuuucugauuuuuuucaugugugaaguuaguguguugcauucauauuccauagagagccuguacucugcccuuaucuggguuuuauuaguaucaugguuauuucagaagcauguuacauagggagaaugcaaggccuuaucuugguagagugugugaguuggagauaggacguguaaauguaguuuucucaccaacugauuagguguuucuguuggguagcuuagucaccucugguuccuucccaaucuaugauuaauauaauugcagucaguggcuaugccaccugacucaggcaaugcuuaugcuuuauaaaugcuuuuagccuugggcuuucucugcucaccucacuaauauaguuugagguuucuuagacugauuucguuaauuucugagcuuucuccuguauaaguccuucagaaaaguaauggaguaaacccaguuauccuuugcauuuaugcuggccucuacuauuuaggccuauuacauagucuuaaaaucuggaaacugagggucuuuguaagguuuugagaaacuaauuauauaaagaaaaguauuuuuacaaugaguuuaagauuuagaauuuugaaucauaagggcauuaaagacuucaguuaaaaaaagacuucgguuaaaaaaaacuaguuuaauauguauguauauaaaaucauuaguuuauuaaaggagacuaagacaugguaacugucacuaagauauaaaguaaacccuauguuuuacuuuuaaguagauuuacuuuuguucuuuuuuguauauuuguagguccauaaacacccccugccuuguguguguuugcacacacacaucuuuuuguguguuugcuguaauauaauaguaauuuagaauuacugaguaaaacuuaguuuuauuuagcaaacaauauuuuuauaguugaaguuaacagugaucgacuguuaccacuuauagauauugcuacuaaguuggaauguacauagaauguguccauaaguugauaugacccuguaugcuuuuuuuucuuucaaaaauuaguuuuuauuaauggguuauuuauuuauuuuccuuuccaaucacagcuuucucucccuccucuccuccuagucccuccaucucacuacccucccuccaccugcccuccuccuuuucuucucagaaaaggggaggccucccauggauuucaaccacucuuggcauaucaaguuuuaguaagacuagagggaccuggaaggaaaaguggacccuauaugcuuuaucauucauugugauauuuucaucuuguaguuaaugcugcugacaacaagcagagggacaagaacaugaccuguauuaagguuucuauugauccguaaguauaaguuuaauuucuuuuaugcuaaguuguuuuauuuaggcaauucccaauuuguauuauauaugcuucuacugccuuguugucuuccugcuguguuggacuuggcuauuuucuuucucuucuguccuuugugcccauuuucucagagaguacuugcuugaccauuuuucuuggauacuguugguuuuaguuguuaagagaacuuauccaucuuuucuuauuuuucuuuuucuuacauccuuguaagguguucaggaccuuagugcuauucugggcuuauucugaaauagauuuauuuuucaugcguagaauuuggcucuuuccauuuuauaugaccuaguuaauauauugacuauugcuggguauuuuagaaugccuaccacauguuuggcuaauuagcuuuuuaaggcaauuuuuaguauucaguuugaauuugugucuuugaaaaucuuacucauauaccagugaauguuuaucucacuucuaaaagcaagauaguagguaaaauuuuuuuaucuaagcuacugccuauaucaagauuuuggugcuaauuaguggcuucuguccaguaucauucaugguagaaacuaaugguuuuaugauagaaaauuucaaagacuuagaauaggaaauaguuguguauuuaaaaaccuuuaaaguuaauuuauggcagugauuugcaacauacaaaauauaaguugagaaugggauacauuuuaggcugcuugugccuuuuuugcauugauuguauagcucuaacagagaguugggaaauuaaaaugguaguagucacuggcuauguuuggucugcuaaaaugcagcagagagaaucaugccuaauggcuucuuuuauaacugugccuccuucuuacucuuaucuuggagauggagaaagguuuauucuaagaaauguugcagaucuuacugauccuaacaugauuuaugucucuaauacugaaauauguguuuucaucaagcuaugccauuguuuuccaguugacacugacuuacaucuugcuguaaccauucaaguuuauucuauaguucaauucucuuuuuguaaauuaauauacuuaauuauuaaguuuuaaauuuugcuuauguauuugcagugaaucuaauauuauaagcauuuggaauaaugggaaaggcauuccaguaguagaacacaaaguagagaaaguuuauguuccugcuuuaauuuuuggacagcuuuuaacaucgaguaauuaugacgaugaugagaaaaaaguuacagguaaagucugaauggagcuuugauugauaaguaucacuuuucuuaacauauaauuacuaaauuaccauuuccuaaaacaucucauguaaaguuuuauugugagaaaauccucuaaaguuaauauuuuuaaaaaaucuaucuguuuugauuauguagucuuaauaguaugauaaaauugcuggaauuaaaaaaauaauugcuggaauucuaaucuaacugacaguuugcguucugauuuagguaauaauccuaugguaccugacuguuauauacacacauauucuucaaauucuuacuauuuuauucucuauguauggguauuuugccuacauguauguuugugcaccaugugugugccugguuccugcagaggccagaagagcuugucaguuguacuggaacuggaaugucagaugacugugagcuucuguguggugcugggaauggaaccugaaugaucuuaacaaccgagccuuuucuguagcuccugcuacagagcuuuugauaauaaaagacuuuaacucuuuuccuuaaaugggucaagagauuuuuaaaaaggacuuuguauauaaggaacuuugggaaaauauguugccccaauagguugauaaugucuuuuaaguccagagcucugagaaguugauguaaaugaggcgacuuugucagaaaauuuagauuucaugcucacauggacuuacuguguuauaaggcuuauuuuucuuaaaucaugaaaguaaucacaaaugcuuuaaugauucuauauuguauguaauguaguaucuauacuauauugcuaaacucuaauauuuuuaauguaaaauuguuaagcauaggacuauucagccaggacuugagagaaugauacaacaaauagagcuguuuugugucaaacuugcucuaggauagguaaguuaaaaaguuccauuauaguaacucuaaacuaaaauuuucauauuuaacuuguuuuacaggaggccguaaugguuauggugcaaagcuuuguaauauuuuuaguacaaaguuuacaguagaaacggcuugcaaagaauacaaacauaguuuuaaacagguaugaaaagacguccauuuuuaacauuucuuuuauuuauuuauuuauuuauuuauuuauuuauuauuagguauuuuccucguuuacauuuucaaugcuaucccaaaggucccccauaccccccccccaauccccuacccacccacugccccuuuuuggcccuggcguucccuguacuggggcauauacaguuugcguguccaaugggccucucuuuccagugauggccgacuaggccaucuuuugauacauaugcagcuaaagacaagagcuccuggguacugguuaguucauauuguuguucuaccuauaggguugcaguucccuuuagcuccuuggguaauuucucuagcuccuccauuaggggccaugugacccauccaauagcugacugugagcauccacuucuguguuugcuaggccccggcauagucucacaagagagagcuauaucuggguccuuucagcaaaaucuuacuaguguaugcaauggugucagcauuuggaagcugauuaugggauggaucccugcauauggcaaucacuagaugguccguccuuucgucacagcuccaaauuuugucucuguaacuccuucuauggguguuuuguucccauuucuaagaaaggguaaaguguccacacuuuggucuucguucuucuugaauuucaugcguuuggcaaguuguaucuuauaucuuggguauccuaaguuucugggcuaauauccacuuaucagugaguacauauugugcgaguuccuuugugauuggguuacuucacucaggaugauacccuccagguccauccauugcacauuuuaaaauuucuuuaaaaauguuuuauuguuuugcuuagauaauagaaguuuaaguguaacuuuuuuuguuugauuaaaauauuaaucaaguugccaaagagaagcuagaaugacuaggaaauuuuacauagccucuuuauaauucuucuaaggcagaguacuuuauuuagcagaugcaaccgcuuauguauacuggaaaaauuccucccugagucauuagguucauauguaagaaauguuggcaggccuuuggaaaguauucugaauucuacauaugcucaaauaauuuuaucagauaaaugugucuguuuauuuuuauaaaaauccauggacauguuaaaugugaaagaugcuucacuguaaaaauguugugguaaaugaauuuuuuucugugagcugauucuuuguuacaaaaguuagaaacauuaaagaaauacuuguguauauuuucuuuuaaagacauggaugaauaauaugaugaagacuucugaagccaaaauuaaacauuuugauggugaagauuauacaugcauaacauuccagccagaucuauccaaauuuaagauggaaaaacuugacaaggacauuguggcccucaugaccagaagagcauaugauuuagcuggguccuguaaaggagucaaggucauguuuaaugggaagaaguugccuguaagugucuuggaaaauauuuuaauaguguuauuauuuuguagacuuguuucaucuugcuuuuuaaaucuugucugaucuuuuuuaacugguguguuuaaaugauugcuauuuuaaugugauuauugauuuauuuguucuauuaucuugcuagcuaauuucuguuucuugcauauguucuucucuucuguccuuugaucauuaaaaaaaaaaaccugucuauuucaaauuauacuuugaaaaaucuuuuuaguaauuuccauaggguuugugguaacauuucacuuaauauuucacauauagcuaagggaauucauaagacuguaaccccaggcccccucuuccacuccuuguguuacuagacauuucguguguguguguguguguguguguuuaaguguacauacaugugccauacuaugaauuugaagguuaaaaguuagaggauauuucugcuguugguucucaccuuccagcuuguuugagacagguucuuucgcuguccucacugcuguacugugcaacaugugccaggcaugcuggcugucaguuucuggggguucgccugccucuacuccaguuuugcuguaggagcacugggauugcacaugugugcugcuacuccugacuuuauacugguucugggaaauuugacucagcgccuccugcguuuacuccaaguguuuuaaaacucacugaauugucucccaagcccaagacagugugcccuaucauuuccauaugauuguaaucaucauauggaaaagaaaaggaggcagaagaaauagaguacaguuuuuaguuucugagauguauacagucaugugugcuugcaguuaugauuuuguuuguuuguugcugucuuguuuuggugguauagcgauguuguccuggcugaccugugacuccuaggcucaaacaauccucuugcauuagccuccugagaacuugcaguuaauuacacacaugugccauuugucucaguuuuaaguuuuaauuuaaucuuacauuucugcuugaggauuuucuuuaacuugucuugugcaacaccaagcaauuuauucccuguuauuguauaagaaaaguccugauuuuuuucuucucuuucaaaggauauauucaguagaauuguggguugacaguguuaagcauguaaagauacuacugaauucuuucuuggcauggauuaugauuagaagucugcugugauuuguuucucuguguucucuugguaagguuaacauaguucuuuuuccuuugucaugaggauguuauacauguaauaugugcuugugugugugguggcuuuguuugugauuucauuuauccugugagaugucuuugagcaccuggacucuguuguuucaucuauuaaaaauauuuaauuuauuuuauguaugaugcucuaucugaauaugcaccugcaugccaaaagagggcaccagaagugguugcuggggacugaacuccggaugucuggaagagcagacaguguucuuaaccacuaagccaucucucccucucccuuguguuauuucauuuuugucacgaauuccgaaagcuuuuaggccugauugugucaacugacaguggcauuuaugucuucugugcuuucaauuuuuagcauuuucauuuuguucuuuauuauuugaauuccaucucuuuacugaaguggcaugucuuuucuacuagacuguacuguacuaacuaacaauagugauucuaagugccuguuacaacaucugagauguuuuguuuuaaauuuggauuuauuuuuauaugcauuaauaaaauacacauaaaauacagucuugugccuauguguguauuuguacaccaugguugugagcuuuuauauagucugggaauugaaccugggcucucuguccucugggaaagcagaaguacuccaaaccaaugaggaaucuaucuagcuccauuugagcuguuucugaugauaauuauauuucgauuuuuaaaauuuauuuugguauuccuaaaaguauuauggaacaguuuguguuguguauaguggcagacacugggguaaauggacuuuguuauuggccuuauguuaaucucuccaaguguuuaaaguuuguuucuuucuaguuuucauuguuuguuucuuccagcucccuggcagagaugguuugugucuugugcucuauuggcugaaauuuccuguuacuauuagagccuuauuagucuggggguagcaugcaagagauucuuuaguaucugauuaaaucucagucuugaauugcacauugagccuauuccauacagauugguuucagagugcacaugcacgucuuuccaugaguagagacuuuucauuugcucuuaagucuuuuucuuagcugugguagcuuuccaccaguguucuacauagucugcuucuugagcuccacugaacuacagaauaagacagacuccuuauuucauuuuuauaagagaauggaggcuggguggauuguucacugccugcugcugucuucuagccagcacauggcaaauguaucucucuugauccaugugaaagcuugauguggucccuagacagacaacuuccugcgaugggagccuuucccaaccauggccagaaguuuccuaugcuuguauucuuccaguacugacuaguuacuaguuacuaguuacuuccaguacugacuaguuacugcaucuaguuuaagguguuuaaaucuuauuaaacuuaugcucugguuaaacaaaugcugagagauucugugauuuucuuuagcaugugucucucuacagacuucagaauggcaguuauuuuagucuaaguuguuuugggggguugugaaaauuuguuaauuuauuuggauagcuguuuuccauacgauacagaugucuuuugcuuuaguuuuucucaugucugaacucguauuagaaaguuaacauuugucauuuacaaaauaacaguuuucugaaaacuaaauauaauguacccaaauagacaugcuuucucaucuuuaucaagcacaccgcacaaaugaaugcucuaagaacaggugucaagaagggaaugcuugauggcuuccaucauaggugaaagcugcuguaaaugagaauggaagucagagaaguaacuuacgacauguuuuuaugcuguuguccuaugcauaauugcucauuguuuuuuaaauuaauagguaaauggauuucgcagcuauguagaccuuuaugugaaagacaaauuggaugaaacugggguggcucucaaaguuauucaugaacuugcaaaugaaagaugggauguuugucuaaccuugagugaaaaagguuuccagcagaucagcuuugugaauaguauugcaacuacaaaaguaagugcccagauucuucuuguuccaagccauugguaaaauaguaccuuaaacaaugaaauaaaaacaaaaccaacaaaaauaaguggcuaguguuuauuauugaauauguuguaugaaauuuagguugauaagauucauuauuuuguaucugaguuuugaguaugguagagaauaauaggaaaugagcuccuugaggagucagguuguggaacauguuauuugcuauuuuaaggagcuuuaaccuucuucuguagguuuuggacuucaaagucacaaagaguucuuauccaaaauuauuuauugacuguggguguagucuagagguagagugcuuacuuagcaugucugaagcucugacuuuuaaucuagacucugcaaagugaaggaaugaauggaugaaugaaugaaugaaugaaugaauaaguugaaaguugaugauaauaaaguagugaguaaugcaaguaaauaauguugacuaguuuaaaacaaugauuugugauucuuuuuuaaguuuuguuuuauaauguuuuaacauuuuuucuuuuccuucuuuuuaccucaauaauauggucuccccagucuuuuccuuggacaacagaaauuuacccuagugaugauuguauucuguuggacagggacuuaaagcuuuauuuuuuaaaauauuuaaucuuuugauuuaaagguuuuacuucuuucucucauuucucucagcaacuagagauaauuucuucuaaaagaugggcaguuuuagacugcugcuauguguaguaccauaaugccaccaggagccucuguuuuucccgacuuucuuuucuaccaccuauggcauguggcuuuguuucccguccucaaacgcaauugcguuucuauaacucaguuccaaguucuacggagaggaaaaugguagcaagccaaauugccaucuuuuggucaggaauauaauaguuuuccuagaauaaccacccaaccaguaauugcuaaaaucucacugguuggagcugaguuacauggcuuguguuucuuuuuuuaaaaaaacuggggggauguagcacaaacuugcauacaaccaaaaauacccuaagcagugguguucagagauaucauagguuaaauaacaugguaguauugggaaagagggcaguauugcuggagaaaguuaagaacuucucuuucccuguauauuaucuuauacaugucauccauuuggcuuuuuaugaguucuuuuguuguuguuauuguuauuuuucuuuuuaaauugucuaauuacugguucuccuccccaccuccucccagauccucucacuuucucuuccacccuaauccacaucccuuucuuccucuaaaaaaauaaagauaaaauaaaauaugauagaaauguacaaacuggaauagaaugaaacaaacagaaaagguagcugaagaaaaagcacaugaaacauagauagaugcacagacacacacuuaaacagagauuuccauaaaaacacaaaauuguaaaccaaaauauauauguaaaauaccuuuuaagguaaaaauaaaaaauaagaaccuccaaaaaugccauuguuuuguuuuguguuggccaucauugcugggcauaggaccugcccuaagaaugguuuauauaucuagugagacagcuaucuuuuuauuauuaauaaacuguuaaggaaaaugaaauauaaauaucuucuuauguuuuguaacccaucuuaucaaauuguuaaaucugagugggacauggauagguaguucaucaggggaauuugaaaguugaagacaauccgagggaaugagccauuaaucaaugccucugccaacucugagugaugucacuuacauuguugaccauuuccuuggugcucagaucaccugagaacugaucuugaguauuaggaaaugccauagaugugguagugaaugaggagauugagagaagauaacuuggcacuaugaccuaaaggguccuuuuagacccuugcuaucauuuucaguuucauauuccucuacaaaauaauauugcacuacuaaauuguuugacauauuguguucuguacucucuccuguacagggugggcggcauguggauuauguaguagaucaaguuguuaguaaacugauugaaguaguuaagaaaaagaacaaagcugguguaucagugaaaccauuucagguaagugaugcuuuuauguguuccacuauauugccacaucaugccuguuuuaauguugaccauuuuuauuguauuuuucacagguuaaaaaccauauauggguuuuuauuaauugucuuauugaaaauccaaccuuugauucucaaacuaaggaaaacaugacucugcagcccaaaaguuuuggguccaaaugccaacugucagaaaaauuuuuuaaagcaguaaguuaaacuuguauuauuuuuuggguuauugagaacacaguaaaugguuuuucuuuuuuaaauuuuauuuuauuuguaccuaaauucucucuuuuaucauaguaauugugaccauaggcaugcuuauacuuuaaguuaauauguuucauucugcuaauuuuaaaaguguggaacacauuguuucacuaaacuauuuuuuuuuaaagauuuauuuuauauaugugaguaugcugucugugucuucagacacaccugaagagggcauuggaucccauuacagaugguugugagccaccaugugguugcugggaauugaacucagaaccucuggaagaguagucauugcucuuaacugcugagccaucuuucuagcccaucacuaaacuauuaacuguuuuaucaaguaccauaguagggaguuacauaacuaaguguguuagcuuugaguuggccauugcaaaguuucaguuuuccauugacagauauucagagccucacagccuuuucuuuucaucuuucuccucuuuuguucaaauuauucuacauguguauacacacacacacacacacacacauauauauacauauauauauguguguguguguauaugcguauguguguauauauauauacacauaugcauauacagcuauauaugcacauuuauaaugugcauauaaacauauccuacauauauauacauguauguacauauauauacacauacagacacauauauguguauguauguauaaaauguccuauacaaaauguagcauuuucuacauuauugagcauugcauuugaauuugaacauuauuuaaacuuuuuuaaaaaugaggguacaaguaaauaauaaaucgugauuuuuguaauugaauuuuguagcaaugggcuauauguauuuuauuggcuccuauaaucuguuguacaccacucaggauuucaauggcuuccuuguuaguaguaccaccaguuaaacauuuaguaaauaucuauaaggcaccuuuuaaaguuguugggcaguggggaugaaaucauguaaucaguuagccaaaguuaucuucauucuguccaucugugugucucuguguaucauucccaguccccucugcccccucucguuugaaaguucauaguguggugggaauagaguauaguugucauggagaauguauuuuuuuaaaucccaauauuagguuuucaaagguagggaguauaagaagcauaagcaaaugugcuuuuuuagguacuugcuuuucaaacuguagaauauuuauaaugaauucugagcucacauuauauuauagcugucauuguaacaauugcucuuacagagugauuugguuauagauacuguauuguuuuauuuaggugaaucaagucuagauuuggcacagauuaccuuuuuuucucauuaaauugccuagaaaacuauugugccuaaaaaaaaaaaaaaaaaaaaaaaaaacccacaucacuaaggaugauuuaaaaaagguuuaagaauuggaauugaagaucuuucacacaccaauucauucugaaucauaaacaauguguuaaguaaagucucuguuagcaaaaugaggguuuuguaugaauuucucaguuauccuaaugugaucuucauaaucaguauuuuuucucauaagauuuuaggcuucacauuuuaaauugaaggauauugaagaugucaaugucuggauuuuccaauuaauaaauuaaugcgucuuuaagcuuuuacuauuguuaacuugcaauaagaguccuacaagagccuucauauucaugaaguuuacaagauuuuucucauauuugucuuaguacuuuaggucauuguauguauaguugucugaguuaguuugacuaacuagcuauaacuguaguuuuauugucauucaguaaaauuuacuagaaugucuuauaaucauuauaauuuugucuuucaaagugccugaauucucauugucauagacaauuguauacauuuuagguuaacuuaugagcuauuuuauauacugcugaccuuugauuucuuuuuuuaaggccucuaauuguggcauuguagaaagcauauugaacugggugaaauuuaaggcucagacucaacugaauaagaaguguucaucaguaaaguacaguaaaaucaaaggcauucccaaacuggaugaugccaaugaugcugguaagaaucaaaucaaguuuaaaauuuuaaguuuacccuuuauuuaguuauggaaaauuucauuuaugcuaugauuuccuguuaagaguauaauugaaauugaaucauguaggguuaggaggaugcuucuauggguaggagugcuggcaguauaagcauugaagaccuaaguuugaauucccagcgcccauguacaaagcugggcaugguugucugugccuucagcucuagcacugagacggggguuguguagagaugccagugcauucugauagcuugcuggccagucagccuugcugaaacagggugcuucugguucagugaaagauucugucucaagguuauucaucagauaaagagcaauagaggacaacagcuaauguccugcuguggucucugaauggguacauauauaccauagagaaaaaaggaaggaaguacaggagggagaaauugcuucauguacuauuuauuacuaucuuaagagguugaaaaucuaguacaauguauuuaaaauuuacaguuuacacuuauaauuauaaauuacaguuuaccuuuuaaacuucauuaaguguaauauaaagugacugauagucuuccauuauuauugugauaauuuuucuggcuucauuuuccuuaaugaaauaagguacucaaaauguguuuaauuuaaaauauuuuucagguggcaaacauucccuggaguguacauuaauauuaacagagggggacuccgccaaaucucuagcuguaucuggauuaggugugauugguagggacagauauggagucuucccacucagggguaaaauucucaauguacgagaagccucucauaaacagguuuguauuuauucacauagguauccaugacaguucuaacauauugcucaaauugaauuuuuucaaauguagauucagacucauauauacuuucauauacuucagcaauuuaaaaauaauuucaauauuuuucuuuuuguauagauuauggaaaaugcagagauaaauaauauuauuaaaauaguugguuugcaauacaagaaaaguuaugaugaugcagaaucucugaaaacuuuacguuauggaaagauuaugauuaugacugaucagguuggucugaaaguuauuacauauuuacaguucauaucuucagauugucuuauucauguauauauguauguaugaaugcaugcuggaugcaggacagauguuuuaccacugagcuacauaucuaacucugagacuguuguuugguaauugucucgggaaguaguauaggguaauugucucagaaaguauaguauagauugugauugugugcuucuagaggacacauuauuguauggaaaccugcacaugaagcccguuuuauauuauuuaauuuuuuggcaguuauuaaucucauugguuauuuuuaaaugucuugaaaugcagcaauuaggaaaagaacaggacacaguauuauaucacaguaacuaagccuaugugggaauaggaaugaaguauuggcaucuguaagagaaaaacagugaccuaguaguuugcuaguuacuauuggcacauguuggccuaaguuaagaugaacaaaaccaaggaggacuuuaacauagcaguaaucaagaaagaacuagaauauugaaaauggauaacuuuauauguaaccaacaguaucucuuaaaauguaaaagcauuugugaaauauucaccagaaaaagcugcaauauacuuuuauguuucgcagcuuucaugucgugagaagacauguaaauaacugcacccaauggccuuccucuucuauugcccagggaagugcgcuuauaaccgugugugaaguuuuccaccuuuaaacaucugguacaccauauaacaugaauaaugauaacauguucauuaugcaaggacaaguauauucagucuguuguuaauugaacuuguaguuuaagugauagucuucuaaucuauaauguuucauuaaauacuuaucuacauuugaaugagauuuugccuugccuucacucauacauuuuaaaacuuguuuaaaaguaguuauagucuauaaaauuauggaacuuuuuacuuuauauuuauuuaggaucaagaugguucucacaucaaaggccugcuaaucaauuuuauucaucacaauuggccaucacuuuugaagcaugguuuucuugaagaauucauuacucccauuguaaagguacaacuugcauucuuuuaauuuugcauuuuguuuuguuuuguuuuuuguuuguuuguuuuuugagacaggguuucucuguauagcccuggcucuccuggaacucacucuguagaccaggcugaccucgaacucagaaauccaccugccucugccucccagaugcugggauuaagggcaugcgccaccacugccugacuuguaauguuuucauaagucuuagcagaauaacuaauuucuuucuuuucucugauuaauuuaaggcaagcaaaaauaagcaggaacuuuccuuuuauaguauuccugaauuugaugaguggaaaaaacauauagaaaaccagaaagccuggaaaauaaaguacuacaaagguuuguaauuuaauauuuauguuuauaaagugacugccuagguaaucuauuuuaugagaguaauaaaauaccuugaaaguuugucuuuuagauuuuaccaccaguuuauuuuugacuggaaggguuuuaucccuaaaauuuuuuuuauuggacauuuuguuuauuuacauuucaaauguuaucaccuuuccugaugacucccccaggaacuccauaucccauccccccuccccauguucaaggcucuuccucaauuucucuucuuuuaguuucaguguaacugguuuuaugucaagguccuugauccacuuggacuugagcuuugggcaaggagauaauaauggguugauuugcauuuuucuacaugaucuacugccauuugaaccagcaccauuuguugaaaaugcugccuuuuuuccacuggaugguauuagcuccuuugucaaagaacaagugaccauagguguguggguccauuuuggggucuucaguucuaguccauugauuuuccugccuguuucuauaccaauaccaugcaguuuuuaucacaauugcucuguagcacagcuugaggucagggaugguaauucccccagaaguucuuuuauuguugagaauaguuuucacuaucuuggguuuuuuguuauuccaaauuaauuugcaaauugcucuuucuaacucuaugaagaauugauucggaauuuugauggggauugcauuuaauuuguagauugcuuuuggcaagauggccguuuuuacuauauuaauccugcaaauccgugaguaucggaggucuuuucaucuucugagaucuucuuuaauuucuuucuucaaagacuugaauuucuuaucauacagaucuuucacuugcuuaguuagagucacgccaagguauuuuauauuauuugugauuauugugaaggguguuguuucccuaaugucuuucucagccuguuuauccuuugaguagaggacggccacugauuuguuugaguuaguuuuauauacagucacuuugcugaaguuguuuaucagcuguaggaguucucugguggaauuuuuggggucacuuaauuaacuaucauaucugcaaauagugauauuuugacuucuuacuuuccaauuugguucuuuuugaccucguuuuguugucuaauuucucuggcuaggacuuugaguaugauacugaauaguuaagggagagggugggcagccuugucuagucccugauuuuaguggauugcuucaauuuucucuccauucaguuuuauguugacuacugguuugcuguauauagcuuuuacuauguuuagguaugggcuuuggauuccucaucuuuccaagacuuuuaccaugaaggggugugaaauuuugucaaaugcuuucucagcaucuaaugagaugaucauguguuuguuuuuuuccuuucaguuuguuuauauagugaauuacguugauagauuucuuuauauugaaccaucccugcauuccuggaauaaagccuacuugaucaugauggaugaucauuuugauguguuuuuggauugaguuugugagaauuuuauugcauauuuuugcacugauauucauaagggaaauuggucugaaguucuguuucuuugcucuuucuuuguugggucuuuguguaguuuagguauaagcauaauuuuggcuucauagaaugaauugaguaguguuucuucuguuucuauuuguggaauaguuugaagagaauugguauuaggucuucuuugaaggucugaucgaacucugcaguaaacccaucuggugcugggcuuucuuuucuuggaagacuuuuaaugacugcugcuauuucuuuagggguuaugggacuguuuagaugguuuaucugaucccgauuuaacuuuggcaucuaguaucugucuagaaaauuauccacuucauauagauuuucaaguuuuuugaguauaggcuauuguaguaggaucugaugauuuuuuuuuugaauuucuucaguuucuguuguuaugucucacuuuucauuucugauuuuaauuuugauacugucccugugcccuuuggucagucuggcuaaggguuuaucuaucuuguugauuuuucucaaagaaccagcuccugauuuuguuguuucuaugugguugauuucacccgugaguuugauuauuuccugcugucuacuccucuuggguguauuugcuucuuuuucuccuagagcuuucagguguucugucaagcugcuaguguauguucucuccacuuucuuuuuuguaggcacucagagcuaugagauuuuuacuuagcacugcuuucauuuuguccuauaaguuuugguaugaggugggugccuucauuuucauuaaauucuaaaaagucuuuccuuucccucccucccucccucccucccucccucccucccucccucccucccucccucccucccucccucccucccucccucccucccucccuuccuuccuucuccaaguuauugaguagugcguuguucaguuuccauguguaugugggcuauuuauuuauuuauuuauuuauuuugauguuauugaagacuagcuuuaguccauggugaucugaaaggaugcaugggauuauuucagucuuguaucuguugaggucuguuuuugaggcucaguuuuggagaagguaccgugaggugcugagaagguauauucuuuuguuuuaggauaaaauauucuauagauaucuguuagauccauuugguucauaacuucuguuaguuucagugugucucuguuuaguuucuguuuccaugaucuguccauugaugagaacgggguguuaaagucucccgcuauuauuguguaaggugcaaugugugcuuugagaguuaauaaaguuacuuuaugaagauggguacccuuucauuuugagcauagauguucagaaucgagaguucuucuugguagauuuuuccuucaacaaguaugaaguggccuucuuuaucuuuuuugauaacuuuagguugaaagucgauuguauucaauauuagaauggcuacuccagcuuguuucuugggaucauuugcuuggcaaauuguuuuccagaguuuuacucugaaauagugucuuuccuugucacugaggugcauuuccuguaugcagcaagauauuggguccuuuuuauguauccaggccgcuaguccaugucuuuuuauuggggaauugaguccauugauguuaagagauaguagggaaagugauuguugcuuccuguuauuuuuauuguuagagguugaauuauguuuguguugcuaucuucuuuuggguuuguuggaagaagauuacuuucuugcuuuuucuagggugaaguuucccuccuuguguuggcauuuucuaucuguuauccuuuguagggauggauuuguggaaauuuauuguguaaauuuaguuuugucauggaauaucuugguuucuccaucuaugcuaauugagaguuuugcuggguauaguagccugggcuggcauuuguguuuucuuagggucuuuauguugucuguccaggaucuucugacuuuuaugaucucuggugagaagucugcuguaguucugauaggucugccuuuauauguuacuugaccuuuuuccccuuauugcuuuuaauauucuuucuguguuuugugcauuugguguuuugauuaucaugugacaggagggauuucuuuuuggucuagucuauuuggaguucuguaugcuucuuguauguucaugggcaucucuuuguuuagguuagggaaguuuucuucuauaauuuuguuguagauauuuauuggcccuuuaaguugggaaucuucacucucuuauauagcuacuaucauuagguuuggugaucucauuguguccugaauuuucuggauguuuuggguuaggagcuuuuugccuuuugccuuuucuuugacuguugugucaguguuuucuaugguaucuucugcaccugauauucucucuucuauaucuuguagccuauugaugaugcuugcaucuaugacuccuguucucuuuucuagauuuucuaucuccacaguagucucccuuugugauuucuuuauuguuucuucuuccaguuuuagauccuggauggguuuuuuuuucccccuuuucaccucuuagguuguguuuucuuuaagggauuuuuguguuuccucuuuaaaggcuuccaccuguuuacuuguguuccccuguuuuucuuuaaggaagauauucauguccuucuuaaagucuucuccuaucauaaugaaaagugauuuuaaaaucugaguuuuccuuuuccagugugauggaguauucagaccuugcuauggaacaagaacuggguucugaugaugccaaguaaccuugguuuuuguugcuuauguucuugugcuugccucucaccaucugguuaucucuauuccuaccuucacucacugucucugacuggagccuuucccuccuguuaucuugguugugucagaauuccuuagauuucagcuaucucugugaucgugugauccugagauacugaguguaagagcuccugcgagucaagcugcuucugggguccugaaauccugguguuuuuaagcuccugagauucuaugaucaugggcauauuagagcuccugggaguccggcuuccucuauuuccuucuauuguaggauugggugcagagcuagugcccaaggucagcucagggcacaggcucagaccugugucccuggauccucggcagaucccaguuacuccugguuugcaguggguguuuugacuuccuuaccuaugauccugggcgaguuagaccuccugggaguuuuaaaaccccugggagucuaccuucuccuggguauuaugugauugggugcagaccuaguacccauggucugcucagggcacuagcucagaccggaagaugaagguuuucuuuuuuaauagaaaauucugagggacccuuauauagccgucucauaugaggcuaugccagugccuggcaaauacagaaguggaugcucacaguaaucuauuggauggaacacagggcccccaguggaggagcuagagaaaguacccaagagcugaaggggucugcaaccuuauaggaggaacaacaauaugaacuaaccaguacccccagagcucgugucucuagcugcguacguagcagaagauggccuagucggccaucauugggaagagaggccccuuggucuuaugaagaucauaugccccaguacaggggaaugccagggccaagaagugggaguggguagguagggaagcaggguggggaaggguauaaggaacuuucgagauagcauuugaaauguaaauaaagaaaauaucuaacaauaaagaguauugauauaaaaaaaagaaaguucuguaagcaaaauuuuaaacucccacaaauaguaguaguaguaguaguaguaguaguaguagugguggugguggugguggugguggugguggugguggugguaguaguaguaguaguaguaguaguaaucuuacagaauuucuucuuagcacuugaacuuuaucuuaugcaugcacacacacaaauauuguauaagaauacagcuacuuauucauuuuaacaaucaugguuuugugccacauagccuuucuuaacuaaguguuaaucugaaauuacuguuagaccuuauaguauuucaaccgucacuacuuuaaugugcuucuaacaaauacccauauucuuuuguaacauuuaaaaucuagcuaaguuaaauuucucaagauuauauuaauguauauuuaauauuuuaaauuaagauucaaacaguuagcaaucugauuuaugggucucuuaaaucucugaaugaaaccuuuucauguuucaugaauauuuucucauuuuaauucauuaaaaaagcugcucuguguaaauuucccacaucuuaaaauuuucccauugugcuccuucccuuucauuuaauguguaacaacuuucuuuuucauuauuuucuguuacaugauacuuaaaucagaaugugaucauauuugaguuggauuuguuugccagaaacaauuauuaauauguauuauuguauauuuaagucaugaggcauauauuugguuugucugucuuaagauugaucaauuaguaacaauuuaaugacuuucccuauaaguuuuucaugugaugguuuugaacagccauuauuugugacccuguuuuauauuaaauuauacaggauuagguaccaguaccgcuaaagaagcaaaggaauauuuugcugauauggaaaggcaucgcauuuuguuuagauaugcuggaccugaagaugaugcugccaucaccuugguaaguauauugugaauaaaaaaaaauucuuucgcuauccucuuccugcuguauguuuccuucucgaguuuugugugagaaguaagucuuucuugaaaguauaguaccuaaaguagugaauuuugauuuuauuauuucuuuaauaaaaagccucagcucaaauauaauuuugcuucaauguuauuaggaaaaccacuuuaguucauuuauaaauucaaguuuuauaaugaaauuaauuuuaauauauggcauuauuacuuggacuucuucaggcauuuaguaagaagaagauugaugacagaaaagagugguuaaccaacuuuauggaggaucggagacagcguagguuacauggccuaccagagguuagucaugaagaugaucugggggaaagguaagacuaagauuuaugcagcgagagugacaucauugcuauguaacuuucuccuagcaauuuuuauaugguacagcaacaaagcauuugacauacaaugauuucaucaacaaggaauugauucucuucucaaacucggacaaugagagaucuaucccaucucuuguggauggugaguaaucaaaguuucucauccuugcauacucuguaugguuuaauuauguguacuuuaggcugcccuuaugggccucuuuaaauucuuauuuaaaauaccaaagucuauaguccauuuaaauucuuauuugaaaucuuagaaaacaugaagaauugauucaaaagggcuuaagcuuuugagguaaaagagcugauguuuuuauuauuucuuugaguuuuucaggaaaaaucuuuaaaggacuuuuuuuuuuuuguuguuauuaaaguaauuucaaaaauugaaauuucaaaaguuaaauaaaauagaacuuugucuaaauauuuaugaaagacuuaaguuuuuaaaaugccuuuauaucucaauaacaaaacccaaucuaaauaauuuauauaauuuauaauaaucuaacuuacaaaauuuagaaacuuucuauuaggacugauuuucuuauuuggaaugacucuacccucaauuuuauaagucauagcaaauuuguucacauuuguguugcuuguuuuauuaauuuaauaacaguucugcccaucuauuaugucuagccugagauugugucccuucuaugaaauauuccuucagucuaaauuacaugaacuucuaugcuacuucuaugcaccuccuauuguuuaagcuaauuuuguuuccucaguuaaauuaugaaauuuucaaagaaguagccauauuucauuauauuccuucuuugaugcucuggccucacaaugauagaugcaacugucagcauauauggauaagguuauugcuguguucauuggucucaagcaaggaggagaaaacagcauauauucuugacugagguuauuagaaaguuucuauuucaauugcuuuuaggacacugagacugguuuaguaauuugcucauucacauggcuugaguauccagauuauaaagauucuaaagucuacaugaguucuuaacuacugcaguaaacauuuauaaguguucaugucuauagauaugcuaauagaaacuaccaagcuuuuguuuguuaauacuucacauuacugcuggcauaagucacaugcaauaaagacucuuguggaagagguauggcacucucgauagcucuuuaaguccaggagaucuuuaauuggcacucuuuuggaacuguaaauaucucauuuuuuucccaaacauguaauguugccacuaaaagaguugauauuuugaaguauuuuauuuauaacauauaaaaaugauagauaaggaugguuaacaaacuuuauggagaggaucagagaguguagguugcauggccuaucagagguuagucaugaaggugaucuggggaaagaggugagacugaugagauucaugcagugaugguauuuuaaaaauaguucuaaaacuauuuuaaaaggaggguuguucuuuuuaaaaauaggcuucaagccaggucaacgaaaaguuuuguuuaccuguuucaagaggaaugauaaacgugaagugaaaguagcgcagcuggcuggaucuguugcugagaugucugcuuaccaccauggagaaguaagcacugaagaugggaucaacugagaacuguaauuuuuugggaugcuaaaugauaauuauucauaauagaggaauuuucuuuuuaugaggucuuagaaagugcaauagaauuuugaguuuuguuuucaauacaaacugaggcauaguucuaaaaaacuuaggcuguuaaccuucugguuuuuuuuguuuguuuguuuucuguuuuucuauuucauagcaagcauugaugaugacuauugugaauuuggcucagaauuuugugggcaguaauaacauuaacuugcuucagcccauuggucaguuuggaacucggcuucaugguggcaaagaugcugcaagcccucguuauauuuucacaauguugagguaaauaauuuucuaacuuauugacauaaaguucaauuuaaguuuguuauaucaaguaaaaguuuaguagaaugauaauggugggaaaaaaggaucauuuaguuuuucugcucagggagaguacuucaaauuauuugaucauaaauuuuuaugcauuccugguaaaaauucagugcuaauaaaaauaaaccuuuauucugcaccuaaugcuauuuuuuuagacugaaaggaaggguuagguauuuuauucagaauaauuggaaauucuuacaaaguuauguaauaauauuaaagcacuuaagaaauuaaguaaauaucaaaguacauaaagacucauacuggcuugugcuugggagaaauaugccuuuuguacuaauauuagguggauuuuauuauguguagucaaaauuauuaaaaucuagguccuuauaaaguuucauuucucagaguaauauucuucuauuucuuuuugauagcucucuggcaagacuucuuuuuccagcuguggaugauaacuugcuuaaguuccuuuaugaugauaaucaacguguagagccagagugguauaucccuauaauccccaugguuuugauuaauggugcugaggguauugggacuggaugggcuuguaaacugcccaacuaugaugcuagagaaauugugaacaaugucaggcggaugcuagaagguuuggauccucaucccaugguaaguuuuuauagcuuagauuguuuacuuaaauaacggacaaaauuaauuucuccuagaaaaauauggaaucuucauuuuagugcuguuguagauaggauccuauuaagauuuaaauuuauauuugauuaccugaaauauauaaaugaaugagucugaagauaaguuuuauggggugaaacuguuuauugaaauuuuaaaauaaccuuguaccuuaucaggguuuaaaaucuccgaauuguauaaagaaugguguucuugguacacucacauguuaaaguaucaagcugugaaaaguuuccauacauacacacacacauauacauacacauacauacauauauauaauacauacacacacacacacacacacacacacacacacauauacauacacauacauacauguauauaauacauacacacacacauauauauacacacacauacauagacacacacacguacauguacauuuauauaguacagaagccagaagagggcauugagugccuuccccuuucacugucuuaaugcuuugagaccaggugucucacugaacuggacgcagccauuucagcuaggcuggcaagccagugagcuccugguauuuacuugucuuuucaucucauuggugggguuacugcuuuaugcagccaugccuugcuuuuuauguagauucuggggauaugaacuuagguccuacaugcauucacagcaaacaauucccaagcuccaaauuacuuucuaugauaguauuuuauuuaagguguuuuagauccauuugagaauaaugagcuaguuauucuauuaguauauacuucuuauauuccuuguaucacauggcccuguacuaagaggugagugaaaaaguuagggucuuuuguuuuccauaguuaauaucuugucagaagaagauauuagggcuugaaauuuauagugagcaaagauauuuaauauauacaaaauguccccuacuauauguucaacuucuuagagauagcaauaaaguauagauuuuugaagaggaaauaagugaugugauuaggaaugaguaaaguuauguuggugaauaaaguggggagcugaguaugugucagagguaguagauggucuuuuugcuaucacaaagaacugccuguggcagguuauuuuuugugugggaaagaggcauauuguauuucagaauucugggcuuugggggccuagaggccucaucuaaugcugccuuucaugcugaccaaauccucuggcaguacagggcuucaaauggugagaaacaaggaggaagcacacacacacacacacacacacacacacacacacacacacacagacacacacacacacacagacacacacacacacacacacacacacacacacagacagacacacacacaugcugucuugcuggccucaccucuguccuucaugcaagguucuaggauuuagucauggggcuuuaccuuuuguuuaauccuaaccacuuaccaaagccuuacuucuaaaauucucucucagauuucuugcagugguaacuauauuuucauaugaaaccuuggcagaacauucacacauuuuaagugauaguaaauaguuguaagcauucaacaucuucaaacagaccaugggagaagaguaguaguucuacaggaaagaaaaaucacuagaauaaaauuagaaaguucaguuggauccagaaaaacucuacaagccauucauugugaagcaaaaggaguuuggauuuaaaggauauuaagcuaacauggaaggaauuuggucaguagacugaggaagagacuaauuuaggaagccugugaaaaguguugggaagauuaagugguauucagauucuauuaacagaagcuauaaauacaagauuaaggagcuuagugagcagcaagugaggccuagaaguuguaguccuguuagccugcugugucaguagccauuugcuaagggcuauuuagaggugguacugcucucaggagcaaagucaaaucaagucauuucuauuucccuggcagcuuccaaacuauaagaacuucaaaggcaccauccaggaacuuggucagaaccaguaugcuguuaguggugagauauuugugguggacagaaacacaguagagauuacagaacuuccaguuagaacauggacacagguuaguauaaccaaaugagaagugcauugcauuucaaagaaugaauucuuuguggcacaaauaauucaccucuuuguuuauucugugucuauauaaagguuugauuccauauuauuuuuauccuuauauuugaauuuucaaguuuuuaaguauauguaaaaaauaguauguuuuauauuagcuuagugauucucacgugagucacauccccuauggaguugaacaacccuuucacaggggucaccuaagaccaucggaaaacacagauaguuauacuauaauccauaauagcagcaacauuacaauuaugaaguagcaacaaaauaacuuuaugagugggguucgcugcagcguugugaagguggagaaccauugcauuaguuggugcuuccuuuaauucauuuuuaaaaagagacuuuguguuuguuuuaaaacaaaaggcaugcaauguauauuguaggccaauauaacuaauaugcucaguaaauucagaucaguuucaguugcuauaaaucaauccacucuacuaggucuagcaaugucauccuccuuacacccaugaacuuagaguaucugugguguguaaguaguucagaaccagaaccugcauauuguauggcuuuucucaccaucaaggauucccucagaauuuuaaaaagauuaugugacuaaugauaacaugauaauguauuguaacaagauuuauuaucuuuuuaaauguuuccuagguauacaaggagcagguccuagaaccuaugcuuaauggaacagauaaaacaccggcacugauuucugauuacaaagaauaucauacugacacaacugugaaguuuguggugaaaaugacagaagagaaacuagcgcaagcagaagcugcuggccugcauaaaguuuuuaaacuucaaacuacucuuacuugcaauuccaugguaauauaaucuuuuuuaaauggucauacauuggauuauuauaauaagagccacaacaaugaacuugaaugcuaaagaaucuagcaauuaauuucuuuccucugaugcuagguaccaaacucaggucuucugcaagaauaguauguacuuuuaacugcaagccaccacuccagccuccuaagaaauccucuaaaaaauagucuuuuacaauuuuuacuauuuuaaacuuucccauaguuuaugguaauugcauuuaucaaauuucugucacuaaagaaauauuuauagaaauguuuuuaauaauuuugguuuauuuuuaagugguuucagggguaguacauauucauauuagaguuauuuuaaguacuauacauauuauauaaauuaaaauaccaguacagauuuauuggauuuaaagcaaaaucuuuguauuuuauguagguacucuuugaucauauggguugucugaagaaguaugaaacugugcaagacauuuugaaagaauucuuugauuuacgguuaaguuauuaugguuuacggaaggaauggcuuguaggaaugcugggagcagaaucuacaaagcuuaauaaucaagcccguuucauuuuagagaagauacaggggaaaauuacuauagguaaggcauaaccauuaaagauuugaacauuaguuaaaauggaaaaaaaucuuuauuaauagaagacauuuuuuuaucaguagaauauaagcaaauacaaauugaucucuuuucuugauccuaauuuuauuuuucccucacauagagaauaggucaaagaaagauuugauucaaauguuaguccagagagguuaugaaucugacccagugaaagcguggaaagaagcacaagaaaagguaaucaccugcagaaagcagacacucagagaagcucugaaaccaaacaauccccaccccaaagucugaauuuagaacggauaaaggcgcuaagcuguuuggugacugaaggcuucugcuaacccacagagcagacacaguuuaggaguucacagugcauaccuaccacaaagcacccaucuccaccagggcuuuuagaaauggcuccaugcugagaauguggcucaguguccuugcaagagucugccaugaagaggugguuuauguaaaguacaugcauacucuuugagagacagacugguggcccucaaaaucauuccauuguccagucugugaugacaguguggcaucugcuuggucuaguugugggugggguccggaagaugagagacaaacgugcuuugucgucacuaacaccaagcaugugcucugccuguguuuagacuuuugguccgaaauuuaaacacuauaauuaaguaauuaaguuguccauuuuagacaauacuuguauuuauucaaugaaugaaauauugaaagcuuaagaguucccuagaguuaauuucuuaguauuugugaugauaaaaaggcaauuuuaaaaggcaguacaacauagagauugagaacuuuuuuauauagagauugaguuaaaaaacagcaauaauuaauauuuuuagauacuaaaauagauuuguauacacacacacauauauaugauagcaauguuaacauuguuuaagagaguuaaaacugugugauauacugugagcugauauuuuugcaguuuaguuuucaaccauaauuuuuuuuuuaauuuucaucaaaguauauugaaauacugcucuuguucaaauuaagcuuuucucaaauuugaagucaauauaauacguuaaaaagugaguaaaaucagaacaaauucuguagugucaagcuaaaaggcuuauuuacuauuuuaauaaaaguaggacaugacaaugcggugaaagcacauucuuuucaucuuuuauuguguugcugaacuccaaauuaugcuuuauaucuuucuugaacagugucguuguugguuuaaacuacagaucuuuuaaaaauugccaaauaagcuaaugaauucagugcuugcucaguuuuaaaauauaaggguguucugguuuuggaacgcccuucugguggaagcagaauucauggauaaaagcuaguugcucuuaguacuugcauuaacaccaugaaaguuuugcagcauuguugccaaguguacacuuaagggaguaaggaguucaggcaccacaaggagugguagagucuguaguguugggagagagagaguuauaaaauaccuacuuaaagauuauuucuuguacugcaaauucuaucauuaaacauggaaaagcucacuuauuaaucaauuucuaaaaguguccucagcuauaggcuuguuaauaguaaacacacacacauauucuuagagugcuucuggugucaugaaaaccuagacacaaaaugcacucugcaguuugcguuuuaggcagaauuguacugugcucuaguaccucguggaaggcuaauaaacccagcuuucuauagcuccauggcagcucacuguggaacaugaucuaaaccuuaucuaguacuugcuaaucaccuagcaacuguucacuaaucgaguguauaguuuuauucaugucaugaagcauccugauuuguacuuuuaauuuuuaucacuuuauuuccaaaguauacucagaccuaauuuuguagguauacauuaauuuauuucaacauucuuaaugguaaagcuucuuuguucauaaacuuuuggcuuguuagaguaucuuucauuuuuaacugucugagugucuuaaacaacuuuaauuucauuuaauaccuuuguuuuuaagccuucgaaugcaaugacacaaaauuacuuguauugauucauuguaauuugaaacauaguguuaggauaagaggcuucuuuaaagugcaauugcuuuucugaguaaaauuuuagaaaaaucucuccuccuuaaaucaucaacuuagucuucagucaucuuauuuucugaguucaaauuugaauaauccuuauaguaauagggaauuuuuauuaaaauauauccauaguaaauaaauguagccuauuuaugcucuuacaacuauuaaaacuuuuuauaagugauuuuuuucuguguguuuucauguccacuaacuaaccaguauaaaagucugacaauaugcaaugacaaaaauuuuacguaauaauuuuaagauacaaugucuuuucaguuugggacuuaggaaagcaauuaacauuucaucaaauucuugaguaaauacaauauacuauuucuucugaagauuuuauuauauagcuuaagaaaaucuuaagcuuuuuuuuuuaacauaagaaauaggguuuauaggcaaucuugaugguaaucuuaaaaaacuccuaccacccugaaggaguagcauuaacaguacagcauuuaagcccaauauuaaugaaauuaaaaugcugaucugguauuauaauggaccuuaauauaaagcuuauuauuuuuuacaggcugcagaagaggaagauucacaaaaccaacaugaugacaguuccucugauucaggaacuccuucaggcccugauuuuaauuauauuuuaaauaugucucuauggucucuuacuaaagaaaaaguugaagaacucauuaaacagagagauacgaaaguaugaacauuuguggguuacauaauuuggaacuauuucaguauuauccauaucuuugauuuucuuuguccgaaacuuaguuauuuugauuuauccuuuacacauuuaaaaacuauuaaauguuaaacuguacccccucucucccucccuccuuccucccucccucuccuccuccuccuccuccuccuucuucuuucucucucucuuucucucucucucucucucucuuucaauuguaggggcgagagguuaaugaucucaagaggaagucuccuucagaucuuuggaaagaagacuuagcagcauuuguugaagaauuggauguauguuaaaucucuauuaaauauauguauuucagacuggcaauauagcuuaguguaaggccccacgccugcuaaaugaauaaauaauuuuuaaaacgaacaaacuauauuuagaaaaauaauguuuuugagauaguaaugaaaaaucuucuuuaauuaucucagaauuuuucuuuaacuuuguauuaguauauuuauaauccaaguuaaauucaagcauucuuuaaagucaugauauuaucaauugaaccuaccuuguaugcugguacugcauugcauguaguucucaaaugaaagaagucaucuuuucuauaaaacaaauaaggauuugagggccauuccuaaaauagauaugauaggacuuuauaaagccuuccacaugguuggugcccugccaacugucaguuacucguuaagaauauauaauuaguaaguaaaaauaucaacauugaauaucacuguguuuguuuucaaaacuucauacuuauaaacauuuauuuaaaauguauuuaaaugucuuucaagagauggcacuuuccuuugcaucuuucuagacuuguuaguuauuaugaagaguaguuuuguacaauuuagaauuugucacauuaauugugguuauauauuuauuuauuuugauaacacaccccauaagcucaaugucuugagacuucuuucuuacuuuaaaauugugaaucauuauuaugauuaaagcaauugaaaagaauaacuucauacuuuuuaaaagauguauuuauuuuuaccuuauuaugcauauagauguuuuucugcauaugucuguauaccaccuguaugacuggugcugaagaagucaugagagggaguagaaugcccugaaauuggaauuaaaauggaaaugaaccaccaugugggugcugaaaacugagcucauggucuuuguaagagccacagugcugugcauagcugagcuaucuguccagccccacaucauacuuuuuaacagaauugucuuugucuguaauuugccaggucucagaugauagcaaguggucccaucccguccucucauaggacuauaaagaaccacuuagguuauugcaguugcuacauucuaugaagaguaggaagcuacguucaugaauuggaauuaagacucagcuguucuggcuuagaaguuuucucuucccuucccauuauuuugucucugauuagaucagcuggaaagaaaccuuuguuucuuaccauguggauaauuuauuucagguucuuaugcaauagugauuguuuuuuaaauauccccuucccuuuuaaucauauuucagaaaguggaagcacaagagcgggaagauauucuggcaggaaugucugggaaagcaauaaaagguaaagucggcaaacccaaaguaaagaaacuucagcuggaggagacaaugcccucgccuuacgggagaagaauuguuccagagauuacugcuaugaaggcagaugccagcagaaaauugcugaagaagaaaaagguaucacacaugccugugucagcucauuuacgucuacuugaagcuugugcuucauccugcuuuaugauuuauaaugcauucugaugugguaggacauacucucccaugagagcaaacgcacggaggaagacaccuccacacagcacuuagagcugcuuauuuaguucagguuguugccacccuucuguccccucucaaacucagggucuuaacucauuucuugccucagccuccugaguugauugggacuacaggggccuaaauucuguuuuuagaaugagaaauacucucugcugaacaucuuucuagccuuagcgaaaaccaaccgaaaaccauacaaauuguuaacuuaauaaauuuaaauuuuacauuauaauaacuaagggaguuuuaagcagaaaauaaacuuuauuuggcuuucaaaguaacuuaucacuuucuaugaucucuaugauuuuuguuaaacacuauuaagcacaucuagcauuauuggcauugauaguuacuaucaagaacuuaaaaaaauguauaugaaauuuacccuugagcaggaugugccaggauuagccagauauaaaggcuuccgugaauguucagagccaaaaaagcaggaauugugauggucuuauaaagucuaaaggucuagacagguuuguuuuauaguccaaggaauauguaugcauauauauucaacacauaaccgagaguacagguucuuuaugauuagugaauaagccuaaguuggaguuacaggucagagaaauuuuuuaauuuuaauuuuuuggcugagagcuaguauuugaagcaauuugagacauaggagcauuuugacacuagagcaaguauucuuuuuggucugauaacugacugggcuauauuccucuagucugggccuucaccucacucagcuuuaaccuuagcucagugaccucuguccuuuggugucagguucauuucuuaucauuuuuuuuuccugcuuuagguagugucaauaaacuuaucccugccugcccugagcuuugcccacuuaaaacagucacucuuaaauguuugucuccgaucuacaauguaauacccaaaccccucgaacuaagcaugacugaaacugggccaguuauccugauuguggaccugcuuuguuucucaucuugcugcuuuuaccacuuuucuacccacguggcaaaacuagaugauucuuucagaacuugguaggaaagacuccuuugcgauguuuucucugacccuuccuaaccauuuccuucagcugcugcugucauucacucuuguuuugacugguguuguauuaacaguguaccuaccaaccaguucuccuacccuuaccaauaauuaugggcuagauucagccuuauaguaccucaaaaaauacaucuguuguuauuuuuguucagaaauuugaaaauguuuuccuaguaggcacugauaguguaagguuuuuuuuguauguuuguuuguuuguuuuugguuuuuugcuuuguuuuuguuuuuguuuugaguacguacauagcuuuuggucucauagcucuuugcuaaccaagauccuggcuuauucuuuaagguuuuucuaaguggcuauuaucuuagugaauauaucagaauguuaggcuuauaagcaguguuauuugaaacaggaaaugaaauaaaguaaaauauaucucaaguggaauacauuaaaaacucuuaccuguuaugaagaaacuuuugagugaaacuguaucucuaaaauaagcauuguuaauuucauuuuuacuuuuacucaugauuggauuuggugugauuuuuaacacauagggugauccugauaccacaguagugaaaguagaauuugaugaagaauuuaguggaacaccagcagaagguacaggagaggagacauugaccccaucugcuccuguaaauaaaggccccaaacccaaaagagagaagaaggagccugguaaggcauuagaaugcuuuuguagauguuuguguguaagagacaaaagaauuauagggcacguuuagagucuacugcuuuauuucuuuuuaguaguucaaguaauaucuuuaguuuuuauauacguuucuauuuuauaaugaaccuuucauagaacagcuucacuaguaacuuugaguaaguauuaauaagcaaauuaccauugucuugcuuuuagguaccaggguuagaaaaacaccuacaucaacugguaaaacuaaugcgaagaaagugaagaaacggaauccuuggucagaugaugaguccaaaucagagagugacuuggaagaagcagaaccugugguuaucccaagagauucuuugcuuaggagagcagcugguauugugauacauuuuauauuuauuuuauuguauaugaucauugaccuguccauuugguucaguagcauuaacagugucaauaaaguauuaaaucaucacuccaaagaaagacaaaguuaauacuguuuuuuaagaacagauuuauuuuauauauaaaaauguuuuauacacaugcaugucugugcaaugugaguaugucuggugccuucugagaucagauccucuggaucuggaguuaugaauggauguaagcugccauuugggugcuaggaaacaagccugggucuuccucaagaacaauuauucuuaccauugagcaaucucuccagcccaaaucaaguuuucuacuucauuuuauuauuaaagcuuagauaaugcuuccuccauggcuuugggauauuuguuaauaaagaacaaaccccaaaccaaagaacauaaagauuguuuugucacgguaucggcagcugugauagcucuguuggaaguucucuguguaaauauucuaccacuuuuaucaugagaggucuccucccuguaacugauucuuuguacucaguucucuaaauauaaugcuaugguuagaccauagcaccuugucuucuaguauauugcuauuaagaauaugauuugaucuuucuuaaauauucauuaauugagcuuacucagauaguuauaaaaucugauuaguuuguuuuaugauucccuuacauuuucuuaagcuuuaauuuauuaaaaugagcaauacaacuuuauaguuagcucuggcaaauacauuuuuaauugcaugccaggcuuuaaauuguucgauucucuuaucaaguggguaaguuucuuuuccuaauggguauagguauagaugauaauggugaauaauuuauaugguuagauuaagguacaugaaaauuaguuaagacuaguuaaugcuucaaaaauuaugcuuacauuuuucuauacauggaaaguaaaauaugaaauugaauguccaaauaguuuaaaaauucuccucuaagauguaugcuagaauuuaaaauaaaacuuacuuguauuaugccagaaugcauaauucuucucuauaguuguuuccuaucuuacaggcauguuccagcaugcucagugucuugacucagugggacuugaauccagagauuuuugcauacuaggcagcauuugccaacugagcugauccuuacauuguuauuuuacagugcagcuaaucuuaaagggaaauuauguuuucacuuagauaagcuaaaagaaacuuuaucauuuuuaaaagaauguaaauucuguuauuuguaauuaaagaaaugggaaaucuuauauuaauaguccuuuauacagggcacacauggcacaaggacauaugaugugggacauaccaauuauguuuuuguguuuuuggauaauauuuaaaugcagugagaaacauccuaaacaaguagucccuucaguuuaugaugugcuaacaaacacaguacguacuagugucauagccuccuggaaagugugaagggaggccauagguuuuuauucucuaaaaauuuaucuuuuucugaauauauuuuaaagaaauauuuuaggugguaaaucuuggauuuugaguuucacauucuuugcuuuugagcaagucccuauguuacccaggguggcuucaagcuccuuggcacaaaugauucucccuuagucucuuaauuauuuggaacuguagcaacaugucacugcguccugcuauauucauuucuguuuucuucuuagcugaaagaccuaaguacacuuuugauuucucagaagaggaggaugaugaugcugcugcugcugaugacaguaaugauuuagaagaacugaaaguuaaagcaucucccauaacaaaugauggggaagaugaauuuguuccuucagauggcuuagauaaagaugaguaugcuuuuucuucaggcaaauccaaagcuacuccagaguaaguaaagcagcagucauuauccaguaagcucaugagcaccaagaagugaucaguuggaguuaaagguuucuucaugaaauaauuaguuuguuaauacugcagcucuuccuuuaagucaaagacuggcaagcuuuuucauuaagggcuugaaaauaacuauuuuauauguccauguuauauggcuuuguaacagcucuuuauaacuacccuuguagcaagaaaguaaccucaaaaagcaugcaaauaaaugaaucuaauuugucccaguaaaauguuuacaaaaauuucaucuacauggaguguauuuggacagcuccuggcuugggaaauguuucuagauguuuagaauuagaaaauuguuuuucuaguagaucuguccuugguuacuuuuauuacuuuugaugaaugccagcauuaacaugaagaauggaagauuuuugaauuaaguaguuuuuuuuuuuaaagacaauuuaacucaauauaaccagccuugacuaguuucuaaaguaacugccuaccuguggucuguggccaguaaugguauggccaccugcuaugauaaggaguccaccuuucucuuugaagcuuugcuuauaauguuugaguuagugucacuuugaauaauuucaaaccauugccugguuuccauucuuauuuuaaauuaaaucaguauuuuuuuuaaucauauaucuguguucauguauuugcuuauauaaguuugugaggaaaugggcaggguguggguguugucuuaucuuuuaauaaagaaaaaaaggagaaagaacuaaaguuuugauaauuauaauccuaaaguguauauuauauuggauauuuuaauuauagcucuuugugcuauuuuuuuuuucuaacagaaaaucuucaaaugacaaaaaaagucaggauuuuggaaaucuuuuuucauuuccuucauauucucagaagucagaagaugguauguucuguuacucuuuucauuaguuaauuaguacauuauugcuguacuugauauagagaaaaguugaaaaaucauaugccagaaguuaauugcagaguuuuucauuagugaaagacuacacuuugcccaauauaauaagacguacuuauugacugguuagaauagguauuauggaagcauauagacaaaugcuaauucaguagguguagugucuacauauaugacuuauaaugagaaaaauauaaaaauaauuggaagauugaaauuugauuuucauggugauguuaauauauuuuugacuauaaaaguacugguauaagugcagauucaucuuaccaaguucuuauagcugagaaaguaaagcuuauuggaacaaauauaauuaggguauauuuuuuagcacauacaucugugugugagugugugugugugugaaguuuucaggguuacuuaauugauuugcuguuuuuauuuuguguguaucgugugugagagggugugcacgugugcuugugaggcccaagguugaugucaguuaucaucuuccacguucuccacuuuauauauugacacagggucucuucuugagcuugaaguuuuccauuucaguuaacauagcuggucagucuuuugguguaggagaaaucuccuuucucuuccuccuguggucuggaaucucaggcaggacacugugcccccuuugcuuuuauguggguuuuacuugcagaacaaaggcauuaauggcugagccaacuccuaaacccuuguuuaggaguuuguuugggauuuguaaauauauacauacagacacaccuagacuugguacauuuucuauaaguuuggauagacauucauuggugacacaacuugucaaagcugucauguaaaacuauuaaguguaagaggccauuuuaaaauuucuugcuaugguuugagcaagaaaagacuugauugguaaauuaaacuaaauuguggacagaaauaagcuaaagcugggcauggagguacaugccuaucuuagcacuuggaagauugaggcaggaggauuguaaguuuaaagccaaucugggcuacauugcaagacucugucuccucuccccccaaaaguaaauuaaagguaagcuuggcuuuaaaauuugucuucagugauuuguugauuuaaaaauaggagugcuuacugcucguuuagauuugggcauuaguacugauuuucuugaauugacuaauaguguuuguauaauauacugaaauuaucacagcagagccuucucacgugaaaacaaaucauuaaauacugcugaacaugccaauuaucuuuuaaauaauuagcuuuugauacaguucaauuucacugccauguacauuugaauauuguuucacaacaguuaacauuuuugagguauaacauuggucuguuuucuauuuucagcuguuuguguauuguggauuauauggucaaaauagaaacaagaucuuauuagaucuauuagcuaaagagaagucaucaaagaaucaguuuacuaagaggucuuuauagagucucuuuacuaaaaaacagcuuugaaauuuuuagauucagcuaaauuugacaguaaugaagaagauaccgcuucuguuuuugcuccaucauuuggucugaagcaaacagauaaacuuccaaguaaaacaguugcugcuaaaaaggguacguacuuuauacaugcuuguguuauugcauaagcuauauaggaauaauugaugugaaagagaaucuaauauauuuuuaaacuauuugcaugaguacuucacuaugaaacuuaagaauugcuaagauaucuauuagaccauauuuuaagucccccauaccuccuacuuucaaauguuuguuuuuaaguuuguauuugagguaaaacaugcuaaaauugcaguuuaacaggcuggugaugguacacuucuuuaauaccagcacuggggaggcaggggcaggccucugugaguuugacgccagccuggucuagaaggugaguucaggauagccugggcuaaacagagagucccugucuagaacacucuaccacccccuaaagaaaaagaauugaguuuaaagauugcccaccuuaagagcucuuggcagcugaugacuucauagggaggggugucauucuuugaaggcaauuccacuaguaggauuccugugcucauaggaguguuaauuggauuuaguggguuauaaaaacugaaguuggaagagggacauguggaggcagauaugagagagauugaagaagguaaauaggguggauauuaguauguuucauuguauaaguaugugaaauuaucaacauuaaauaauuguaggaaaagauaguuuuccuauaaagcuccuuugguagauuggguagaaaauaugcauuuaucuugauucaauauuauguuaguucuccuuccuacaguuagcauauuccuuuucuuuuuuaauuauaguuucucccuccccaccauagacuuuguucaugaaaugcugcguugcuucauuaauaguauacaguuguaaacuauguaacuuguucuuuuuuaaguucaguauuagugcuuuacauuuaaaaauaauauuuacuuuaaaaauacauaucuagguaagauauuaagccauauggacugcuuccuaaaagcaaggagaucuauaguauacaccauuagagacauguguauuggauguagcagaacugauaaucauaagagucucuucuaucugaaugcacuagaacuguggggacauuaugcagaggaguaucuaggcagcauucuaggggccaccccuaacagacucacuucaucuucaagacauguuggccuguguauacauuucuuuuuuuguuuuuuuauccaacguaauauuuuuauuuauuaugugggaauuucacauaaugcaucccuauggcacucacuuuucagucaguccuccuagugucuacauuucuuauuaacucucuccucaccuagcuaccuuuaagcagugauugaaagaagcagguauagaagucucucagguucugagucuggguuguuguauuggcucuccaaaguucuucaagaggauuaauuaagcuucaagacuaugcacuggcuugauaacuuaccccuugacugacuuuugcucuucaaugucuaaauucuguacuuucucucaucaccuacuaaguaaauauuuaugcuugaauccauauccuggggucaguuagguucugaacucaaacuaagacagauucuauaauuucuuuucaagacaucauuuuuggggcuggagagaugggucagugguuaagagcacuugcuaugguugcagugcuuaagagcaaaaacauuuaaaaauauuuuaagagauuuuuuucuuuaagucuucauaugagcaucuuauaaaauacugugggacauauaucccuucuugaaaucugucaccauguuucuuucauuaagcuaaugagcucaaguuuaauauuaacuaaaagacuagaccauuuuccaccuagccuauuuaguuguuucucugcuaguuggauggagcuagcaagaucuuucucuaccuucuugaaauacaauuagcagauaguaccucaaagaaaagacacacuacagcccugucuccuaagaacugaacugccugugcuaaucugaguuacagauauuauuauucacauuauauucugcaguuccaauauuuugcagcaaaaggcaaccuauauugauuagauaacugacccguaucuggugggagguguugaacgugccauauaacuucugcaaacuugaaaaugugaccagagaaaacuguuuucuauugccccguugugaugaacaugcauuccugcuagaagcugccuuuggauuccuguaguagauuuagucaugaguaaucagaaggaguaaaggccauagucuucggcucccucuucaugcacaguuccuucugcuguucaccagugaggggcacuauguuuuaucucagcuggagacucaguucugcuuuucaguguauuagcaacguuuuucaguuucuaauaggaaccucugccacucauuucagucagucuaauacauuuguuuuccggucucauuuuuauugcacaaguacaaagugauuauaguguuuauaugaaccauaaacacaagguuucuuuuguaaacauaauaguaauaaagugguccuuguaucuauggaucuaggauuugcauguuucuuuccagauaaaaaugccaagucuugauuuuaacuacuggagggaaaugaguugcuuuguauuuguucuauuugaggacaagagaaccaauaaaauuuuucccucuacuaaauuauauuuauaagcuacaacuuagugugugcuuguacauggguuauauaauuagugugucaaauauaauuuuuugucaugaauauauauuuaaaagaugcgguauaauuuccuuuaauauucuuugcuuaaacuaucucaauugaauuaccuaaaaauuaaaguaugccaaauugaauaauacuuguuuuaucaucuaugggaugauauuuaucuuuauauuggcaucaagcagagagaaaacauuucuugguuuaaugacuacucauaucaguaauaauauccacugcuauagaauucacaccagcuugguuuguugguaaguacauugcaaugaccaacuaaaaggauguuugcuuaauagguaaaccaccuucagauacagccccuaaagcuaagagagccccuaaacagaagaagauaguagagacuauaaacucugacucagacucugaauuuggcauuccaaagaagacuacaacaccaaaaggugaggacuggcuuuguauaacucuuaaauauaagauauaaagaaaauauuucuuucuucaauuuuauugaguuuagugacaggguaccuacuuuauuuuaaauuggcucacauacacauuguaccauacugcauucuaaugaaugacauagagcaguuuaguacaauuaguugugaguuaaaacauugaccagauuaaauaaauauacugaaaauaagaaaugaaaauaagaaaaaaaaauaacacagugagcuuccuugggucuguccaaccucugucucucacuuccugugugugguuuauugaggaaagcuuaaaaaaaaaagcaagcaaauaaacaaaaaacaaaaaccuaucagagaacuuauggaggucaauauauaggcaggcauggugugaagccuuguaaguguaucgauuuuugacagguaacuuacucacucuuguaagaaguuugguaccuaaauucaguaguuguauuucuacaaugcuugucuuuuaucagaacuuaaucauugaaacuuauuuccaggauuuucuuacuuguuuuaaguauauuuuuaaaauacucuuuagucaacauauauuccaugcuguccaagucucuguaugucauuuauaguaugcagguaggguugcaggucccacuguuggggacgccaaagaaagaauuguaacgcuugggcauuucucuuauuuaccuuugggaagaaaaagguuuuucauguguuuuuuagguaaaggccgaggggcaaagaaaaggaaagcaucaggcucagaaaaugaaggugauuauaacccuggaaggaaaccaucuaaaacagccagcaagguaagcagaagcgccccaaagccuggcucaggaucugcacugcaugugguagcucccugaugcagcugcccugucagagcaacaacaggagacaucauuauuuguauaaguagucuaauucuuaugcaaagagagcaccauaagucaacuuagucagaaccuucuguuucaucuauugaacuauuguacuugcauaguagaauauucuuaugaacuuggauuaauuugauuuuuaaaaaaaugaauuuguuugacuaugccuaguauuucuaauuaaucugacccuuuagaaaccucauuucuuuugagugaccuuagcugcacucucuuugccacuuauuuuaucuuccucauaaaacuuacaaauacacgucuagaugguuauagcuuuagagauccguccucuccaucaccucccuucucuauuucuuaccuacucugugacuuuuuaaauacucuuaucaauacuugugcuagugugugcuauauacugugcauagucuuguucugcucccauaaauucugaauauguucuuaaaaauaggguaacucaauauuuucugauguggauauguauacacuuguuuaauaauaaaguguuggauuaguaauguugcacugaugagaguuuaacugggcucuugauaacaaaagagcccaagguaggcaauuaccguagcuaaucugucuuuucuuccauaauucauuuuagucuaaaguuagcaugucaauuauaauauuaaaacuauggcuauugguaauaugccauaaauguaaguauaaggaauaauaguucuuaacacuguguuuuccuuacuuugagauuuuuaaccuucucuuuuuuauuguuuuuggugggugguuagaaaccgaagaaaacaucuuuugaucaggauucagauguagacaucuuccccucagacuucacuucugaaccaccggcucucccacggacuggucgggcuaggaaagaaguaaaauauuuugcagagucugaugaagaagaagauguugauuuugcaauguuuaauuaagugcccaaagagcacgaacauuuuucaaaaauaccuuguguuguccuuugucuuuucugucucagaauuuuguacaucuggcuuauuuuaaugugaugauguaauugaugguuuuuuauuauugugguaggccuuuuaacauuuuguucuuacacauacaguuuuaugcucuuuuuuacucauugaaaugucauguguugucugauuggcuuguagaauuguuauagauuaccgugcauuagcacagauuuuaauugucaugauugcagacuacagaucugcuuuuugaaaugaaauuuaaacauuaaaaauggaacuguguucuuagacucuuuacugaaggugaaaccguagugaaagcucccacacaccuuuaaaauaaauauauuuauucuuugccaggagacuccauggaaaaagguaaacaguauaugaacauagaaagcacuguuaaaccaucucaauguacaaacagagcuagugguacaucacagacuuuugcuaauauaucaaaaacgaacaaacaaaaauuccacuagugcuuacaugagaacucagaagccgacacuugagucugucaaccacucauucucccagagcugucagucugcaucauggugauugaacaaggccagaggaggccacuugcccauaccuucaagcaucaagacugggggaaaucccaggaucaggccugagucagcaaggacacugggcuacuagaguccagacggcagacuaacuugcugauuauccugugauauuucuccaauggcuugugaacagguaaacaaacuuauuaacacuggacaguguuuuugccuuggaggcuaucaugacuguaaaaaugcuucauuuuuuuuuucauucgguaguugugucauuaaggaacaaaccacuuuuaauuuaaagugacaucauuaacaauugaacaaugauguuggauuaacugaacuggcaguuucagugauacagaauucugcuagugcagugaagugguguacucuaucugggcaacauaagggaaagaaugaagcuugagagcaucaaaaagcaaggagaagcuuccacacuacuuaaaccagagugucuuuagugucaucuuguacuguacagaggcccugguuccuuaccgugaggccugguuauucaugaaagcaggacguacaguggauguacagugguuuacuccacaaccucggugucuugguuauugaguaugcaagacaaaagaaagcaccaacauacaguauagaaagaacagagccguacuucuauauguacaaagucuucagaaacuuaaccagggcuaaaucaucucaacugggucuuugccaugcaucuugacuauucagagaggaaaguagaagcuuuaaacuagauucugguggcaugaaauggcugauuuucagaauuugaaaaguuuguauuucuagggaaguuauacaguaaggaauauauauugauacauaugaaaacuucuugguccuuuuugaguuuaacauauuucaguucaaaaacuaagcagcaguaaaaauguuuuccuugcauuuucaaucuggaacugaagguccuggggaaugucugcaacagcuggaaaugucucacugcagcaguggugacugacugacuccacuguucuccacugagcugggggacacgcugggacugugcucugcuauauucccacuugaacuuggggucaaggguucauguccuucagaauucuccagcauuuccugaaugagagguggcauugauccaggaauuuccauuuucaagguaauuacacguucggcaccuuuuucaagagauaauagaacaccugucagauaagggcucagcuagauacuaagaaaccaacauucaccuucagguguguaaaaguuguguaauacauguaucaagucacaugugucuuuguugagaagaaccaacuuauuggaagaaaaaacuauaagguguuuacugugggaaugucagccaccagaaugucaagugugcuucgagaucccaguuagauugguucucaggcacaggcugauccaccacugccuuugaaaacagaauaaguacuaauagggcacacuagagguucucagucuuuaagaaaaagaaguggagaugugugaugugcauauuugauaguugcagugcuucaaucaaauucgga

SEQ ID NO: 7271 - RNA, 6662 nt, Mus musculus
gcuauaccuugaacaaugcuggguaaucaaugcaaaucaccuuugauagauauaccagauucucaauggagguauuugugggcauuugaaaggacugugcacuccagucuuccgugaggaacugcuggaugggcacagagggaaccugcacacccucagaccagucagccacaucaggcugagcagcagugaacucaggagcuggugcgguccauucacccuggaauuccuccuuggucacagccuucucagcagcagccugcuccuccuucucaaucuccucugggucucuguagagguaaagaucaggcauaaccucccaugggugcucaugggagauaguaccgaauucggaguacuucccuggccagcauccaccacaucagacccacugagugagcucccuuguuguugcauggaauggcaauguccacauagcacaggggagaaucuguguuacacagagcaauggugugcagguugacauaagaggccucugugaguggcugauggucagcccugggauuggucaccacuagaagccauggcucccugaaggcugcuuggaucugguuagugaaggucccuggugugaaguggccagcgauuggaguagcuccuguggcagcagcaaacuucagcacugcucacuggccauuguuccuggaggagaugaugcugauguuucauuauaaagauuugcuuuuuguaguucuuaagaaaugcuuauaauuguguuggcauuuccaggacagucauaugaaauuguaaaucuugugauaauagccaacuaaguuucucuagucaaagacaauaacuuagauuucuuuacucuuuaucugacuguucugcuucaucuauccaugcuuuuaaaguuuuaaaggauuaggaaaauguauuucaguuugauucuucuuagaagguagaacaaaauacccauggguggaguuaaagagacaaaguucagagaagagacuaaaggaaugaccauccagagacugccucaccuggggauccaucccauaaagaaccacccaaaccagacacucuggcagaugcccacaggagcuugcugucaggauccugauauagcugucucuugagaggcucugccagugccugacaaauagagaagugggugcucacagccaucuauuggauggaacgcggggucccccacggaggagcuagagaaaguacccaaggagcugaagggguuugcagccccauaggaggaacaacaauaugaacuaacucccugggacuaaaucaccaaucaaagaaagcacauggugggacucauggcuccagcuacauauguagcagagguaggcgaggcccuugguccugugaagguucuaugucccaguauaagcgaaugccagggccaggaagugggaguggguggguuggugagcugggggagggggagggaagaggggauuuucagaggggaaacuaggaaggggaauaacauuugaaauguaaauaaagaaaauauguaauuaaaaauaaaagaaagaaagaagauaaggcugguuuaaaacuuuuguucauugaagauauaacuguccccaguacagaauggaugagccauuccuuucaaaaugugaagucuugaaggucaggcaagaagugaaugguggagcccuuuagggguaccauggcagaacugaaguagaagaaaguaguagagaguuagcagguacaggagaacuaaauaaagguccucggaggcauaaucaaaucuagaaacacccuagaauuuauggaacuuugaucaagguuucuaagaaauucaguguugaauccaacagaguguguucacauugggcuggccacuuauauaggcuggcacaccacuuuagcauccuuuuuccagcugagguucuuuucuggagagaugcuagaagucugucaaugaggccaugaguuuauuauggccauaugagcacucuucaugugauacucuuuagauggcauguuggaacaaugguggaagaauggagccuuagagauuccuucccacugucucucauggucaugcuguggaccugggucaggaaggcgcucguuuacacaguuggguguaccugcuucugagugcucaagacacagacuauuuggucaucuugaaaugauuuguaucuuacaccaagauaacucucagugaggaacccauggcuaguuauucaaguuaaaccuuacuuacuggguagagauacagggcaaugccagagugcuugccuagcuugcaugaagucauaauuucaguacuuauugccaggaagcaaaacaaaacaacaacaaaaacacuaaaacuaucuuuaaaauauuuugaaacaacauuaugaacuaaccaguaccccggagcucuuggcucuagcugcauaucuaucaaaagauggccuagucggccaucacuggaaagugaggcccauuggacuuacaaacuuuauaugccccaguacaggggaacgccagggccaaaaagugggaguggguggguaggggaguggggguggggaguguaauggggacuuuuuggguagcauuggaaauguaauugaggaaaauaccuaauuaaaaaauauuuugaaaagcuaaaauuaugucuauaacacuaaaaugaaacgauuuguuuuagagaaauguauugcuucuaugugagucacuuuguaucacugugaccauguauauggcaaauaacuugaaggaagagacuuguucaggcucaagaugaacaggauucaguccauagucuguuagcauaagaucuugugggagaaagaaucauggugguaggggcccaugugagaagaaccuguucaccucaugauggacagaaaacugagcaauaagcgacuaggucugggaauaguccucaaggccugcacauauugaucuacaucuaccaggacagccccaccgccuaaaggaucuacugugucccaaggauccccacaaacugguaaccaaccagucaagcaugagcagcagucauguuucacauucuaaucauaaaguugggcaccauucuagaacacaagcacagaaacuccaugcugugccccaccccagcaaggcaccaaugucagcauucagggaugucugaguccccuucccagcauuuuuaagugaugugcuuauucaguucagcuugucauguuagacauuauuugcugauuuggagcuauaagugagagaguuuagcccuucagcaucacauuucucuguccauuuucuucccuucauuugccaguauauuuauguugcaauucucaaucgauuuuucauauuuacauauaugauaacucacaugugaagggaucauguacuaggauauuucuuucuuggguacauuagcuugguucucagaaaccauuucaacuucuacauacauagcuucuuugauuccuuaagugccuaccuguaggagaugggaaaccuagaguauuuguaauaaaaacaaaccuuuggcuuagugaaugcuugauugucgacagagcuuuguuuugucccuuaugaaguuuaauguuuuaauucucuccacuuuaaauuuucucuuacacuucccagcuauuaaaacaacuuuguuggaaucuuucacuuacugcugucuccucuuccuagcaaucuauccuuguagauuuauaccuuuuauuggcuuagguagagauaaauguguauuccuagacauauuguguuuaacaaaguugaguaggacuuucuguguggggccaugggaaaggaaggaguuggguucuaagaaagaaugauugcuuauccagaggaaaagcagguguugagauaagacagcgcuuacacuacuugccaaggcucuuaauaaacaaauaaaguauagagguggaaugggaggcuguaaccgcuaugguaaguauucuauuugugaaugugggagaaaagagaucuuucuggcaauaaaguaagacuugaccuguucgccuugaguaccaugacgcuuguuacaacuuucaaagaacugucugaaaacauuuuguaucuaaaagcuaugaguuuagcuucuuugaguccuaagugcuuaccuguaggagaugggaaagcuagaguauuguaauaaaaacaaaccuuuagcuuagugaauguuugauugucaauagagcuuuguuuugucacuuacugccuaacaaaacgcuauaucauaccccauaaauaugugcagcucuugacuaauaaaggggugcugugaacugagccuggggcuuugugcucuaauauugagugcuauauccaaccccguaaaaaaaauuaaauaggaacuucgggaagcaguaauaccaauuuguuguuauauacauauauguaucaaauugucaccaucuaccccacagauuugugugauuacauaaugcugcauguucaccucagucaacauuguuaaauauguuauguuuaugagaacaauaagaaccagaacaauucugggcuauuguaaugauugcugcgccaucagucauauuucuucacuauggauggucaauguuuugcuuagaaguuagacucacaagcagauuaaauugcuagcauaguguguguggugugugugugugugugugugugugugugugugugugugcacauacauacaccaggagaugaguuagacuuccuaagcuuuguucaucuguucucaaggagcaugcagacaucauucaacugcaucuaucuaugggaccauucuuaugcuaaaccuguugucuuggaauaagugaguacuugagcugcucucuuacaggauaagaaacauuuuugcagugugaaugugauuugcccucuucuguacagcuauuaccagguacuugaggugaagaaucuguggggcccacuguacacagacagucaucacaaacuugguugugggauauuagggcagaauugccauguaggauguaaaauggacugcuacaggcacacaaguauagaaaaggauggaaguucagggagagugagaaaguggaugcugagaucaugaaaauaaaaggaagaagggaacccuaaagugacugugagcauggagagauggagaauaugagagaacacacagggaaaccauggggcacuuacaagaggaacaggacacuguggacaucacgguucauguaugcaugcccacauugauggugauccauugggagcuagugggaagaaaaagcacucaucuguagacaugggcaggguaaguuaacuauaggcuagaaguaggaaagcagacaggggaauauuggcaguguaggucuagacuaaagaaagaauaacagggcuggaaaagagucugcaauggaaaaagaacauuggccaguaaccaauuacucacaagugguucaguucacuuggcaccacaccaccaagagugauuucgaacuuuaucaacagaagaugaagugauuuauacucagucuuaugacuccugucauggguccuaaguaguaguuguuucuuguccuguucucauugggcccuaguagcaacccuuaaaucauuaccaagccuuuauagugaagagagucauacaguuaaagauaacauugagauaaaaauagcuccuacucugaagggugcugaggauucagggaauuuaguauuuugggucauuuaggaagucucugggaccucacaaguucagugaaauuucugcaacucauuagggguuuggggguugcuuuacuuuuuguuuuuauauucuccuuuaaaucaucaaauuugguauuuuaaaagaugcccagaaaguguucaccgaagugagaaccacuaacaucuguccuguggagcagcuagguacacauccagaagcuagugaguggagaguugcuaagauuuaagaguagauccuaucauauaaggcccugugcgcuuuuccuucaaaucuauucauuccacagauuuuacuagcugcucucucuccuuuccuacacugaauauaccugcuucucauaccacaguccuccucucagaguccuggcuuacugaagacacuuaggaaucaaggccaauaaugguuccuugcaucugacuacaugcucacugaagagaaaagaacaaacuuccuuccacaccauuucacugaccaaucuuaucaaacacuuaucuuaaaguaggcaggguaugugaaauuguacauugcuagauaaguaagggaacacaaaauaugugugcauuaaaaaagaaaauccaaacagaagcaaucuaugcucuugaccauuguaguaaacuaucucccaaauucuuuuuuuuuuuuuccuuuuaggcccagguguuuauuuuccuuacauguaggaugauucacaaacacaauacaagggcuuuggcacugugggggaggggcauaucccaggccucucagaguaagaggaucuuggucuucuuguauacugaaauucagacccaaaggcucugaauuucugcaucagacauucaguagggcuugggaguaaagcuagagccaaggcuaccuaaguaacaagccaaagugacaugaagcccaauuccugugcuccaaccaugaguuuccaucucaaaccaauggaaggcuauuucacuuguuagagcccaaagggacagugaguucuacuccuuccccucaccaggaagccaccucgaugacauacuugauucuacccauu

SEQ ID NO: 7272 - RNA, 35150 nt, Mus musculus
gggcggagccaaggguaggagcgggagagucgaggagaggaggagcgggcggccugaggaggaggagcgggcggagucaccgcaccgccggcggcggcggaggaggggggugugcgcggaucacauggucgaggagcccuccaggucagcugccgugcccgcugccgagcccugccacaggaaacugcugugccgcgcuugugccgugcggcccccaggagccgcccgcacccggugcucaugaugugggcccgcgagcgccaccgccugcagucccgggcggcgcggugagggccgcacccuguccagcgccauggagcugaacgcagguaaauguaggagggaggcucgggggucagggaugcgugucugugcguccaucucgcgugggguugcugggaucccgcacucgggcuccccgcgcgccggacgccccccucacauggcccugccgcacuggccacgugcacgguguguuuacguucggcggcgcgggcgcugguuggcugcgcgggcgagugacgcagcauuacauaaugcgagcugggugguggcgggcggagacacgugaggccgcggggcgacccacauuacccggggccggaggaacacgugggggcggugccgcggggggagcccauagucugcgcgaggccccgcccccggggccuccgccgugacguggccucggucccgggucucccgcuguugcccacugcggggcccgcugcgcaugcgcauccgccgcaaguucggcgcuggucccgccgcagugcgcgcggcagccugcgcguccccgggugaccccggcagggcugaccuugcuagacagggagugcguaggucguucucgcucagagucuugcgggagucgcgcagcaccuuccggauggacagcguguacagagcaauucgcuuccagggggacuuagccuagaaguccuuuuaagcauggaggggaggggaggggcuuuucugcucgcagcucgcucugaucugaggacuggugaucuaggauuucagaaccuuacguaaaacuuuuauuuacguuaaaaacguuuuagcuucgcgcccaagaguuugaggcagauggcggcagaaaguagcaagcaugggcuacugugugagauccucacucaaaaugcccaaagaacaaaauaaccccuuuuguuuucaggacugacuuugaacccccaaaagacauggucauauaauaccuaaccuuccucgcuucgcuuuagucgaccgcagugaugacccuuauaccugaagcaaaugaaguuuucauuuugaauauuuugaguucuuugcacuuuuaaaaaccaucgcaguucuaacauauguuuuaugaauuuuuagaccaguggucaaauuaguuucaggacuauuuugauuaccuauaguccuucuuagucauugccgcauaugaaauauucagucacauggaggugaaccuuuuuuucauucgaaauuuagagguugauagauugagccuguuccaacccugcccuucgcauggauucuucagcuggcuuagguuucucugauuugaguuuuuggaggacaugguuauuaauguuagucuugauuuuuggagcuacaaaaugugaacauuuucuuggguggcuguugacugcuucuuuccccugcccauuuucaguucuuucuugggccuugcuuuguguuuuucuaauccuguuuaaccccuguugcccucugggauggcaaagugaguagacuauuguggaaguggcucggcauuuccgugguuuagguugguucuuugcuuuggauccuguugcaaauuaauauccccccccucccccguuaaccccccuucccccacacaugcauauacacacacacaccacacuuucucuuuggaauauugcucugcugacucauaguaaccauggaggcagcuaggaacuuuuucaugggaaguauuugaaguuaagauuucauccaucauucagaaauugccugaucugaaacacauaaauuugcaguuuagucuugaguuuccucuuguucauaugacaaugaguuuaggccugucaucugauauguuacaguuucugcaaccuaccuuucaggugaagcugauagcauuccuuuuaccuuccuuuugaggguuguaaacauuaccuuauugccaaauucagcgguaucaguugacacuuugaaccagaggucauucaucauacugccuuaugauucauggcaugcagucuuuccuugcuugucucacagaugagaaauugacucugcaauuuuuuuuuuuuuuuuuuuuuugguuuuucgagaaaggguguacuggcuaguuuugugucaacuugacacaggcuggaguuaucacagagaaagcagcuucaguuggggaaaugccuccaugagauucagcuguaaggcauuuuuuucaacuagugaucaacaggggagguccccuuguggguggugccaucucugggcugguagucuugguucuaugagagcaugcugagcaagccaggggaagcaagccaguaaagaacauuccuccauggccucugcaucagcuccugcuuccugaccugcuugaguuccaguccugacuuccuccagugaugaacagcaauguggaaguguaagcugaauaaacccuuuccuccccaacugcuucuuggucaugauguuugugcaggaauagaaacccugacuaagauacaggguuuuucuguauaaccccgaguguccuggaacuuacucuuuagacccggcuggccuggaacugagaaauccgccugccucugccucccaagccugggauuaaaggugugcgccaccacugcccggcucuugacugcauuuuuaucacacgauugugaucguguauacuaaauucuccagaguauuauaaaagagagcucauugcagccauuucacaaucacagcuuuggcucacauuuuaaaaauacuguacauggggcuggugagauggcucaguggguaagagcagucgggugcucuuccgaagguccggaguucaaaucccagcaaccacaugguggcucacaaccauccguaaggagaucugacucccucuucuggagugucugaagacagcuacaguguacuuucauauaaucaauaaauaaaucuuaaaaaaaaaacuuuaaaaaaaauacuguacauuguauucuuagguuucaguuugauggcaaaaaacagagacugcuguuuguuuuuuuaaaagaucuguuuauuauauguaaauacacuauagaugucuucagacacuccagaagagagagucaaaucuuguuacagauaguugugagucaucaugugguugcugggauuugaacucaggaccuucgggagagcagucagagcucuuaaccgccaagccaucucuccagcuggagacugcuguuuggagagaagcugcagaacaguggcaacugguaguggguggaguagagcaauuaguggggugagugggcucagaagauaguuuggaaauaacaucuguagagaaaagcccugggccuguauugaagaaggaaggacagcaaaaggcucggaagaggagagggguaguguccuuuucaguacucugauaacuugcuccuagcauaaagaugacagaguaguguuaguaauuucccugugucagguuauauuuccuucauguuaauucaugaaagaagguacuguugucaucauccuaaaaaugaagggauauauaaauugaaguuaaguaacuuacgcaguaagaaguugaaucuacaaaggcugcuucacugcuguguuguaaggaauguugccaguucucaauguguggguuuuguugaaagacccuuuugcaaggaucguauaucagauauccugcauauuauauuuacauuacaauucauaauaguagcaagauuauaguuacguaguagcaacaaauaauuuuaugguugggaucaccacaacaugaguaacucuauuaaaagaucacagcauuggcaagguugugaaccacuggcuuagggcaucuugaaaguauagggaucuuuccuccuggugagguugaagacaaugugcagauccacuaaauacaugaauaggcuuguggcugagaaaagggucaggugccccugucagagucucugaugucagcauucugcugguucucucuuuuaacacuguuguuagugaagcuggcuuacucuccagcuccagauuagcucuugacuucccuccucuaguguuuuauguagaaaacaaaauacugcuaguuuaacauaucuagaccuccuuuuuguaaucuuacuuaaaaauaucucucacaggauacaucauuuagcaguggauguguucuuugacccucuugaccucugcccuguucaaugcucgugugugacccucagccuucugcccccugcucacaguuuuccacuucuuuaaagcuuuuuaggaaggagaccaaacuguucuggagcuccagauccacaggcacaccuguaaggaggaauaacuaauaaauuaggcaugaaacuggaaaguauaguugugacuugguaguaagccuccuucccaggaggguaaaaaaucccagaagagaagaaagcagacccagccugcaggggcauugauuccugguuuacaugaaguugaggccuggguaaguugagccugacugguaaccuggcccagcuccacuccccuuccagcuaaaaauagagaggacugcugccugaguuaauuuuagcucaaggcucuaagacgugcauucugcuuguuucuggaaguguugggauuugcuggaucagggauuuuacauuucuugcuuugucauuagagacuguguacacaaaaaauaauaacuucuuuuauguauacuuucguuucagucuugcaguuacuggcagauauuccuguuuuaugggugaugacucaggguuggugagauggaaagaaacuugcuuguucaggucuucucaguaagagugaucuuguguaucgacucacucauuggguggcuugaugacuuuuguaucggauucugcugcuuacuagaguucugccuccuuacucaguguuuuucaacuccagcuuccucauuugcaaaugggcuaaaggaaguuggaaggcugaagugugaucuagagauugaauaauuuuaugguuggcuuuaguacugccugaggacuuaagacuuucacucuccuuucuucacaagaggagcugcugaguaagcuuuaccuucuaggaaguuuacuuuuagcuuucacuuugcuaaccaucccauuaguagauaggugucuagaagagaagaggacaagaaaaucaauauugaaggucuuaccaguagaagcagcugcuuccggaugugucacaguggcuucaagguguugaauacaagcacuuaaaccuccugaagacuagagauagauaugagcuggaaugguaauguuuuauuuuggagcuuuuguaaggaaguuuuaaaacuuaucauagcccaagcagugcuuuuggcuaguuuuaaauaaucuggauuagcucuauuucuuauagacacagagcugugagauacuccacuggcaaaguauuuuucuugguauccuuuucugaacagagacacuuguaaaccuaguagcaauuuguuaacccuggaauuuaugaagugcacuucagaucucuuaaacuuucuaaagacagcugaucuagcgauuuuucucuggacagaauaggcuucaagguucucuuugaguucacauggcauuucagauaauugggcaguuguguuuauuccaaucuuuguaacuggccaauuaaugccccugccccucccccuucuuguuuuguuuuaguuuugagguagacuugucauguguaacucaggaucccuccuugccuugccucuugagaauugggacuuagggacaugcccuaccaugcucagcucuccaguuuguguuugaauuuucugauuguauucauuuuuacauuucuauauacaaagagccuaugaaagugcccauuucugaggcuacuuucuccuguuugggcauguguuacauaaagacgacaggguaguuuagugaugaaaagaaacucaaguuggaaagcuuuucuucuuaugauacauaccugggugcuuaaaaaauauuuguuuguuuauauguaugguguuuuggcugcaccaugggcuggaggaagccagaagaggguguccaacucuguuagaaucuuugucagugcugggaaucaaucaagucucaauccucuuagcagccaauguucuuaacugaugugccaucucuugggccuuaaaaaaaaauuaagagcaugugaauaugaguguccacagaggccagaagaggacuuagauuccucuggaauuggaguuagagguaguuggaaucugcuggugugguugcugggaacuagacuccugucuucuacaagaacaguauaugcacuugaccacuuagcauuuuuuucaguuucuaacugaagucacugcuuuuaaagucaggaauagcgagagccagguuggccgcugccuuccagaucaagagguugcagugcucacuuuagcuucuacauguuuuuggugcaguagagcucaggugggcuugagaauguguauuaauagcaaguucccagccagaugcugaugcuguugguccagaaugauuggccagggaaccacauuacaagaaaaacacaaguuguggggugcuaggugcccuuugggcagaugagaggaacacaccaaauagcauguggguagugggcuugacccggaagagcacauuuacaccuacagccuuaacagaugucaugaaagaaccuaguggggaaacccucacucaacucccgauucagcgugcacccaagaaucacgaacagaacacaacaccuugauguaacaacacgagguauuuuaauggcagagcuccggguugaaacguaucucacacaggagacaguggauuggaccacuuggaagccagggguuuuuauauaaaaggaguggggcugggggaggaauuggcacgguuucacaugauugguccauuuaaacaucagcagccuguuaacauuuaacuuaggucagagggguggggaguuagggaggcgacgggcauguccgggucuguucugcuauguucucagccccagguuucaaagcucaaaaacaacucuuugggcuauuugacauacauuacaugaaucacaggucucaaguuuuauuuccuuuuauuccccucuucuucuguuuagacuaauucuaaucauagaauuuuagagauugguguccccuaacucuucaucuaccugaacuauagguugauauugccuuugaagaaccaugaguuuuacuguaucaguucuacucuggaugaaagccauuccuuuauuuauuauacaagggccgaaaacuaaagcuaagcauaucauaaggauugguccggcuacaguggaaaucaaagaaguuauccaagauggucgugacucaaaucacgacucaaaccacccccguugagcaucccguuucuguuuccuucgcucuaaucuuucaguuucugcauagagucucuaacuauuccuguaugaucugcguagaagcagcacucuucuuuaagggcagcacacaguccuccuuccuuuaggaacaacaaaucaagaccuuuccuguucugcaaaacuaccucagacagggaggucaaagauuuuucuaaagcaucaauggacuucucuauugccgcuaggucuucauugacagcaucccucaaagacugaauucccugucuuccuucuaucaaagcugacacucccgucccgacucuuaaugccauaccuauucccaugaaugcagccaggguuaaaguaauugguucucuuuuugaccgccggccagcauagcuuucuucuaaacuggaugcagggugauaauauaugcgggguaacagcuggaucaugacacaaaaaucaugaggugaauuaaaaaccuuaguagauacacagggaguaaguccuguauugcaagcccaccagccaacuggagaagguauaauauaguaauuagcuuccguucuagacacggacugaauuuguccacauagguguuuguggguggaagguggggugccuauacagagaccuggacuccucgcggguacuucagucagggucaguuuuuguccuguuccccaagagcaggaaguauggcugcugguucuguugaaaucuccauugaaggcaauuccuucauaauagguggacccgaggacaggcauagccagcaguccucaguagcacuuggaucaguucuauuaagggcauaaaaggcuccucucacuagguuaaacauccucugucuuguugaaggaauuucgggggguaauaguuagagauaccugaggagugggaggaugggugauagcggccauauuaagggggucugcaaucacuggaguaggcugaguaauaguaugggugagggguguugacuugguuggggggccuaaaggauuguagggggggccucuauuuuuaaucugauagugaacaauaaucucucaucauaucuuuccuuguaaauccuaagaccccaaguauacccuuuuguccaucccagagcucuuuucccugguucagugaagguggcacggagcagauggcaccagucaguacacucgucuaggugaaauccuucagguacguaagacacuaaggaauaauuggcuguuacucuaauauagucccagcucgaggagggcuuccagcgggcuguaccugaagucucgcaaccccagcucuuacaaaagaagucagccuuaccuccacacguuggauugagggacugacuuugguggggccuggggcagacauagaagggauggguuugaagcaugcuucuauuccuuugguuagagcaaccaccccaugggucucuugaauguuuuucuacguacggaguggguguuaaaggugcccucugaaugccagaguaccccuccaagucccauccaggaggggcuccuauagccaacuuacagaugucagggaaaagaucaggccaccaaguccacaggggguguaccucggcgauuguccauacagcccuaccccccucauugaguaccuuucacguuuguugaacuuugacuuuggggguugaaguccuuugggaucgcuccugcaaagcaggcgcaacuuaagaggguuaguagucuucuccaaaguccacucaucauggcugacuccagggggugcucucuugaugugggaugcguggacccaaguggggauugcuuccacuuugaccgcugugggcguugucaguagcaccaaguagggucccuuccaccucggcucuagguucccuucucggugucuccucaccaggacugcgucuccuacuucaaacugguguggcaccugugugucaccagcaacauagguuucuuuuagcuguucccagaccucuuuucuuacuauuucgagagcuuuuaaucgagccaaaagacuagaaggagagaaagacacauccaggcgauucuuauccccuauggucauaaaaaugggcuggggcgccccauaaauuaauucagauggaguuaggccaagggguccagguguauuccgaacccugaacaaggcauaagggagaacggcuguccaaucgcuuccacuggacucuaaggcuauuuuagucagagucucuuuuagcguucuauuuauccuuucuaccuguccugaacucuggggucuguaugcacaauguaauuuccaauuuguccccaguugccuggccaauccccgacuuaccugggagacgaaggcagguccguugucugaccccauuaccuuagguaucccagagcggggaaggauuucuucaaguaucuuuuugaccacuacauuagcuguuucuuucuugguggggaacgcuucgccccauccugagaaggugucuauaaaaacuaggagauauuuauuuccauaccuagccgguuucaccucagagaaguugguuucccaguaggcuccaggccugucuccucgcagucguuuuccuuccuggagccugcuagacccagcguugguaagugcacaagcacggcagguuuuuacuaucucuuccacaauucuuuuuacuccaggaauguaauagagggaauuacuaaccaauuuuaguaauuuuuuaguuccuaaaugagucagaugguguauguuagcuaaguaaucucgccccucuucuucugugaggguucuuuuauuuauuuccucagcagcgggcuguuggguucucaccaccagagucauuggcccuugggcugcucuuuuagcuucuuggucugccauuugauuucccuuuucaacgggcccaauucccuucugguguucugggcaauggauaauugucacccuauggggcagaugaacagcuucuaauaagcugagaauuucuucuuuauuuuugauaucuuugccagcagacgucagcaguccacggugucgguauauugcuccgugaacaugagccauggcaaaagcguacuggcugucgguauagacauuaagagcucuuccuucugccagccuuaagacuugaauuagugugauuaguuccgcuuuuugagcugauguacccuccggcaggcugcuggcccauaugccagacuuuaaauccacuacugcugccccagcccuccgcuuaccuucuaccacaaaacugcuucugucggugaaccaggccaucgccccuggccaagguuggucugugagguccggauuccagucucuucugccaguauuucuucacacuuaugugcaggggccucgucagcuucagguagcaggguugagaauggcugggggugcaaaacuuacucgcucugucagcaauaggcucugguagugggucauuugggcguuggucauccagcgguccggugguugccugacgaugcucucuagagaguguggggccacuaugguaacauucuggcccauagucaguuugucagcaucucuuacuagcacagccguggcuccuaucgcuugcaggcaggagggccauccacuggccacaggguccaguuucuuugauacguaggcuaccaggcacuuccaugguuccaaaaccuggguaaggacuucccuugccacuccauuucuuucaucaauguauauagggugaaagguuuguuuaaaucuggcagggccaaugccagagccugcagcagugccuuuuugagaguuucaaaggcuagcugauguucucugguccaggugaauucuccuuucucacuggucccugguuuuuuuacuggaaguagaggaguguucuaaggggauuugcaugggaccaaaaucccuuguuggagcaguuuguugauuuuggggcguauacccucuugagcuucucugcucaugggauauugucggaccccugacuuaaguucagucaccacggggggggggggaacaccaguuuugccauccccacuccucccgucucugcccacgccugaggguaucgauuuaaccaguccuauaaucccucagggggcuuuacuuuauuuugguaaagucgauauuccuccccuaguuguaaagacagcucuagagucuggggcgcuuuuauucuccagaaaaccuccggucgaugagaggugaaaguuauuugugcuuuuaacuugguuaguaagucucucaccaauagaggcauaggacacucuggaaugacuagaaacgaaugaguuacucgauuucacccuaugucuacuacuugggaugugguccauguggauuuuuguccuguggacccgaucaccaagguuuuuucauuuuucuucacuuuuccuagagguguuuugaguacugaaaauucggcucccaugucgacuagaaaguccacggagguccccuccacuucuaagguuacccuaggcuuggggagggggaccgagccccuuucccccuaaucuucaucuucuccaagagaaagcaccuucaccucuuguuuuuuuuuuuuuuuuuccggacagucgcucuuccaguggccuauuuccuugcaauaugugcauugguuccucuccaggcgcugcccgccuucucugggucuccuuggucccugcugucuuuugucuuccagguucccugacugucuaccucuucuuccguuaucucuuucuccuacugcggccaggauccuagucaaaaccuuuucuugccuccugucuuuccuauccucauccucucuuuucucucucucuaacuuuucaucuucuguuucucuccuaugauacacuuuuuucugccucucuaacuacaucccuuaugguguaauccugcaagcccucaauucgcuguaacuucuuccuaaugucaggagccgacuggccaaugaaggccauaaucucugaggcccuuugacccucagagguggggucgaaugggguauaucuccucuaagccuccaugagccuuucgaggaagacugaggggggcucaguugcucccugcauaaucucucuuaccuuggccagauucgugggcugccgagcagcaccucugagaccuaccacuagggcccgacgguaauugggcagucguucccuaccuggugccguauuauaaucccauuggggcuggguuagcaggaauccuucaucuaucucagcuggaguuuuuccgagccucggggagaauccucucucucuccucgguugugaauagagucugcagaagcugcuggcagucaucccaggucagcuggugugaauacauuaaugauucagccaacccagugaguccugcaggguucucugaaaaaggggggugauuagcuuuccaguuauagaggucagaagaggaaaaaggccaauacuguaggggcuguccccuacacucgucugcgucuggacuuauacaaccggccaaacgcuaccucugacaggaguggaauucugcguccacuccucuggcaggaagagcacucacucuucuucacucugccaggcaacagccagguccuccugacuguuccuuaccccgggcacuccagggucucccucggaauaucuuccaggggugcagccuguggggaaauagaccguugucuucccacagccacuaggguccuuacgguccacaguggcagcugccagaauacagaauaccagaacugguaacacagguggggcucaaacccacaaucucagaacugaaaaacuaagacacaaauucagcggugccauacuuugacacuuagacaacagacaacauacaagacucacacaaacaaacgcaccuccaagggguccuucgggguuccugggugucacgcagaucucagugggaccuccaaaugaaagaaccuaguggggaaacccccacucaacccccgauucggcgugcacccaagaaucacaaacagaacacaacaccuugauguaacaacacgagguauuuuaauggcagagcuccggguugaaacguaucucacacaggagacaguggauucgaccacuuggaagcuagggguuuuuauauaaaaggaguggggcugggggaggaauuggcacaguuucacaugauugguccauuuaaacaucagcagccuguaacauuuaacuuagguuagaagagugggagauagggaggcgaugggccugcccgggcauguccuggucuguucugcuauguucucagccccaguuucaaagcucacaaacaacucuuugggcuauuugacauacauuacaugaaucacaggucucaaguuguauuuucuuucagucagacauggguuuaagggugauggaauugccuacauuaauugugugcuuauaugcauuugcaauauauaauguauguaauuuguuuguuugagagagguucucaugaagcucauccggcuucaauuugauaugugccuggaugaccuugaacuacucaucuuaacuuucgaaguacugggaauacaagcaugugccauuaugccuggccuaguagauuauuacuuuugcuuuuaaaagugaaguguagaggcuggagagguggcucaguaguuaagagcacauccuguuguacuuagaggaccagauuuuguucccaguacccacauugggcuguucauaacugccaugaacuccagcugaucuaugccuucuucuggacucugugggcacccacauuuaugaacacaaacucaggaacauaaauaaaaaaaaaucuugugaaaugugugcuuuuuuauuuuauuauuuuauuuuuuuuugguuuuucgagacaggguuucucucuguagcccugacuguccuggagcucacucuguagaacagacuggccucgacugccugcugcugccucccaagugcugggauuaaaggcgugugccaccacugcccagcugugcaauuuuauauacugagaaguucccuagccaaggagacgcuguuuccucccccuaagagcugugguugcgccuuauuccucaagagguuuccaaccuggcugugagugauuggugcuugaauacacauccacuaauugauuucaacacaauagaacaacaugguugcaauucugaugccuuuuuuuauucuugucuguaaaugaaaauaucuggauuuagaaggauuauuugaaccucaauuuuuugcugugugguuuguuuguuuuuauuauauuauuacaacuacuauuguguauguaugugcaguguguguuucuguauguauauguguugacaugugcacagguacacauguauguggaggcuggaggcugauguucaauauauuccuugauugcugucuacauuguuaaggcaggugggucuucuuucugaacugugugggcuauucugacuccagggauuugcugucuccucucaugcacagggauugcaggcaggcuaccaugcugcccaccuggcauugguuuuaaaauuaugugugugugugugugugugugugugugcgcgugugugcacacuugcacacuuacaguauucauccaucccugugaagccccagaagagaguguuggauuuccugaaacugaaguuaaaggugauugugagcagucuaaauaggaguguuggggacugaauucagguccucagcaagagggaggaaagugcucuuaaugacuaagcaucucucuagcuuuuuuuuuguuuuguuuuguuuuuuguuuuuuugagacaggguuucucuguauagcccuggcuguccuggaacucacuuuguagaccaggcuggccucgaacucagaaauccaccugccucugccucccaagugcugggauuaaaggcgugugccaccacgcucggccccagcuuuuucuaccugucuucuuaucuggguucuggagaucugaacucugguccucacauguggcacaagccugugccuaugaagccuucuucuaccucuuauauuuuuaaacacagaucccaucuuuacaaaaauugggccaaagaguuauuaucuuuaagacauuuuuuuccuuuuuuauuaguauugaggauugaacccagggucucauccauucuagugcacuaucacugagccauaucuuuaucuccuacaauuuuuauuuucaaguuaauacucucauugcauugcgcuugauauucuccagcuccuuauguucaccaucaucuagacuguugucuggagcccccaggcuuccugcuuauauuucacagugcuuggaaucuguuagucaauguguauuucacaaaggcagaaauagauguuaaaaguaugugguggggguaggcuucaucccuauaaagugugcugagaauugcaguauugccguuugcuuguggcuaguggaaaaauugguggaugcaggcagaugguaggugccuauagugcuggagaaaggugaccauugucucuugugucugcuguucaucgaggaaccagugaguguuugaugaugggggcagaagcacagcggaccuuggcagaggagagaaaaauaacuuauuuggucugggaaauaagaauuacuuauuugggaaaauuauaaguuuggccuugguguuagucuuguagcauuuuaucucuuuaaggcaagaagcuuaaaauuauacucuuaacaacgauuuuaaacacuauuucucauccagagaagaauacagcuuugcagaggccaggcgaguuugcauagggguuguggagguuacuucaguuaacuuacuguuguguuuugggccucugguagauaggguuaucuucuaccuuaauguuguucuuguacaguuguaugucuucugccacucuuuaauguggccuguaacuauguuaggaagacacauagugugucugcacagagauggguguacaagugcugugauggguggguccuagaaggaagugggcucuggacucacugcagaguccugucuucagggagugucagagcagcaagcuugggagaauuugucugcuguuccaaaugaaaucccuguuccccguuagcaugugucucagcucagugccaaggaagccagcucuggaauaauggggaggcugaggaccagugcagguuuuguguguguaguuugcuggugugagccaggaauguacucaaguuagaaaauggaaagacuuaggucuguguguucuuaugacagacaaauuacugaagguuuuaucauugugauaucagugggauauaacauaacuuugaacuuuguagagggaguaauaugacacauaaagaaucuuuugguguaaacaaaaguagugucaaucacuuuuuguuucugaaauuagugacauuucuaacaauucaguaaaguaguauauuuaucugaguaaaaucagauacaugcaucauuuuguauaugucuacuugcacuauuuucuaggaggugugauugccuacaucaguuccucuagcucugccuccagcccugccucuugucacagugaggguucugagaauagcuuccaguccucguccucgucuguuccaucuucuccaaauagcucuaacugugaugccaacggcaaucccaagaacgcugauaucucuagcaucgaugguguucugaagagugaccgcacagauuguccugugaaaacaggcaaaaccagugcuccuggcaugacuaagagucacaguggaaugacaaguaaguccauuaguauuuuauauuauugucacuaaugcagauggccuuuaugucccaggcuuguuacuuggugucauacuacuauauucucccucugguaaccauggucagucaugaggcaaaguaucagugaugccuuuagaaguuucugucaggggcuggcuguuaugugguccuauguuaggguuuuacugcugugagcagacaccaugaccaaggcaagucuuauaaaggacaacauuuaauugggguuggcuuauagguucagagguucaguucaguaucaucaaggugggaacauggcagcaugcaggcagguauggugcaagaggaucugagaguucuacaucuucaucugaaggcugguagcagauuacuggcuuccaggcaguuugaacuaggguauuaaagcccacgcccacagugacaacaccuauuccaacaaggccauaccuccuauuaguguuacucccuggcccaagcauauucaaaccaucacaguggcccaacuguguuucaucuucccuuuaccacacacuuacagaggggccuuucuaccagacuccuaguacugagcauagucucugugguaguguuugcugguugugggauggguuuacuuucaugaagcaggaguugggaacauuugggauuaggaaacccaagcaggauggcacugaucagugaagcaguuuaucugagcaaguguggguggaacagguuuaguggggcagguaaaaaaggcauggaccuuguccaucucuuguugauuugaagcagcacagcucaaaaccuuugcaccauuuuucuuugugaugcuggggauugagcucaggccucauguucacuacgcaagcacucuucaauaauuauaccuaaagccuucuuuacauuuuccuuuccuuuccuuuccuuuccuuuccuuuccuuuccuuuccuuuccuuuccuuuccuuuccuuuccuuuccuuuccuuuccuuucccuucccuucccuucccuucccuucccuucccuucccuucccuucccuucccuucccuucccuucccuucccuucccuucccuucccuucccuucccuucccuucccuucccuucccuucccuucccuucccuucccuucccuucccuuuccuuuccuuuccuuuccuuucuuuucuuuuuuagauuuauuuauuuauuuuaucuauaugaguacacuguagcugucuucagacacuccagaagagggcaucagauccuauuacagaugguugugagcuaccauauaguugcugggaauugaacucaggaccuccggaagagcagucaguguucuuaaucgcucagucaucgcuccagucuccuacauuucuuucucuuuucauuuuuuuuuggaaaagauuuauuuacuuacuugcuuuuuuaaauuuauguguaugugugugagccuggaagaauauaugugaaccauguguguagguguucuuggagaccugauuaggugggacugaguuccaugcuguuguuagcuaucacaugggugcugggaacuaaacccuggucuucugaaaauauucuuaaucguugagcuaucucuucagccaucaccauuccugcauuuucuauugauuucucugcuugaauucuuaauuuuuuaucuagauuuuuuuuuuuuaaguucuuguugcaugucugguaucagguaacuacagauuuacaaaaauuugcuuaaaauugucaaaaaaugaaaaggcugcaguuuggugcacuugccuggugugggcaagggucucugugggaguggggggagaaaggaagagauuauuuucuucuguguguaaguguauuguuucaaagcacuugcaaauugaaugagauaaaagauucaauuggaaaaagcacuugagugauuaucccagcuuuuuauuuucugucuccuuaugcccuagaauuuaguggcaugguucuacuguguaaagucuguggggauguggcaucaggauuccacuauggaguucaugcuugugaaggcuguaagguaaaaaaagcuuuuauuucuuacuacuuaucuaauucugggaguaaagaaaguggguuagguuugugaguguccacagcuuauuuagaagggggcggggcaggaaucagcuguuucucuucagcuuuaagagucuagucaaaauaauuuuucugucucagguuagucacucaggguauggagcagucaguucuaguucauucacucuccagucagguacaggccuugauggucaggaaacagguaugagccagagagauagggcagugcacuaccuuguuggagcacuuccuuuuucuuccuuuuggaacagagucugagguagucuaugacuggcccagaacuugcuguguaugacaguggaggaugaccuaguacuugcuauguauagcaguggaagaugaccuagcguuuuugauccugcuuccugccaagggcugggauuauaggcauaggcacugugcauguaaaccaagauuugaguuaaguuuuugucuguuugcucaagcugaucacaccacagguggagaaauuugaaaguuaauuugcuucagcaguuugaagacuaggggcugcaucuugggaggccuuucuguuggaggauggaaggcauugaauagaaacaucaugcucauguguaagaaugugaacauaaguguguauagaaaugagcccagcccacauuuuuuguuuuguuuuaggcaggguuuuucuguguagccaugguacuauguagcuauguagagcaaccaggcuggccucaaacucacagaggucuaccugccucugcugggauuaaaggcaugcaccaucaugccugacuccuaauguauucauaacaaauucauuuucauauuaacauuagccaauucaagaaagcagaccaccuaugacacaugcagcacugugucauagguggguguuaguuucuagaacaugauccuuggggaacauagaccacauuagcucuuauccuguuagguacuguggacucggaauaacugcuaaguguuuauuuaaauguagugugcugagaaauaaugcuugaggcaagaggauuguugaugcuaagcuagccugagcuacuuagcaagaucuuaucucaaacacaaaacaaacaaaaauaauagcaacaaacaguagaauacaaaugagucagaucauuaaguagaacacacaggaaagaguuaauuucuagugauugcaaccagaaucuuagguaagcucuuugagguggccccgccuccucacguacauccagaaucucucuuaaaucugacacaacucuuuuuuucuguaaccaaacaagaucaacauguguucuuguuuucucacuguaggcuagaguaggaauccaguuuggcaggauguggcagggugaauaagauaagaaaaaauaagucucuccugggacaaaucugaaugaguugagucugggaguuuuuaaugacuaguaaguguuuuuuucuguagacguagcucuuuucuauugucuuagagaauuguauauauauuuuaaagaaaauguaaaguauuuuaaaguuaaauucaugcucaguuugcaguuagauaauauaacaacaauuugaaugaaauguauuauauauucucuuuuaaaaaguaucuuuuaaauguguauuacugguuugccuggaugugugucuauguaccacuugaguuccuggugcccauggagucuagaagagggcgucagaucuacuacagcaagagcuacaaaugguuguaagcugccaugugggugcuggagagcagcuggugcuuucaaccacugagccaucucucaucacuauauugauaaauacaaauaauugaucaauaucuugguaguauuuguuugagacagggucuucugaaguagcccaggcuggcuuagacucaaaaucugccuuagcuuuccaaguuacugugauuacuuggaaaucaaguaauguaaaccaugcuaaaugcauacuuuugggguagugcugugcugggaaugagacccaaggucuaacaaguuuaggcaaauacuuuaccuugauccaccucauagauucuaguacccucuuuuuacuuguuuuguuuuguuuugcuuguuuguuuauuuuuuaguccggguuucuuuggguggugcuggcuauccuggaacucgcucuauagcccaggcuggcagaacucacagagauccaccuaccucugccuccagagugcugggauucaaggcauaugccaccaccaccaaguccucaguaccuucuuaaaaaaugcauuuuucuuagcucuugcauaauuuaaaacaaguauauaguaucauaacaguaaaaugcaaaaguguuauaucuggucaauauuuaauaagauguaucguguagucaguuauaauauuaaggggauaugcaguuugaagugaauuuuuaguuguuuuucuugaguuuuguguuuuuuccuaggaaaauugagcuugggguagaugaagaucuggcauagagcauaugcuaaugauuuauguagucaagauaguuguuuauauucaucagucugggaacccucuuuuccuggaugugggcauguguuauaacaugugcugcuuacauguggccagggaugucuggcaugugugucuagauuuaguuggugacaacagagaauguuccagaaaugaccgagcucagcuauuguaacauaagguucuagugauagaauccagcuaucaaacugucagcuuuuaugucucaaaaguuuugaaagcugcauauaguggcacagcacuugggagguagggguaugaggaucaguaguucaaggcuacccugggcuaauugagauccauccaccccaccucaccccccccccccaaaaaaaaaaaaaacagaaaacaaguuuugaaacuugcuuucaagauugaacuuguagcugcugcugagguauagcacaggaaugccuauaaaaaagguacuuugggccagcacaaggaaucuuccacaggaagagaaauuuuguuuguuaaguguuguaucuacugauagauaccaguaaggagccaguuaacuuuuuugucaagaauuucuuucuuugacauaggucuagcuccacauauacuagcuugauaugggaauaguucuugugaggauuucacguuuuuacauggauagauaaaucuuccuuuacuuuaggguuucuuucggaggagcauucagcaaaacauccaguauaagaagugccugaagaaugagaacuguuccaucaugaggaugaacaggaaccggugccagcagugccgcuuuaagaagugucugucuguggggaugucacgagaugguacgugcccagugcagaguguugacagagugugagcuugcucauugagcugucagcacuuaccagggccucuuugguugguauguacagauucagaaagcacguugcaaccuccuguggguuuaaacucacuaugguggaaugaguacuauuaucucagaggcagcuauuugcaugguugccuuuuauguagcuucauguaaauugacucagauuuuuccuaaaugauuuuuuuuuuguuuucaggacaggguuucucuguguagcccugucuguacugcaacuaacuuuguagacuaggcuggcccccaacuuggagauccaccugccucugccuacugggauuaaaagguguaugccaccauucacacaacuuuucuuaagagauuuuaaguuuucuuuuucuggggaugaagggcaggauuuauuugacauagaaagauggcucauugauuaaaagcacacacugcucuuacagagaauucagauucaguuccuaguauuuacaaagugacucacaaaugccuguaacuccauacuaggggacccugaugcauucuucuccaucugugcaucuguggcacaauaugugaugugagauauaucuauaucuauaucuauaucuauaucuauaucuauaucuauaucuauacacacacacacacuugcaggcaaaacauugauacacauaaaauaauauacauauauuuauuauguacuauauuaucaucaccuugggucaggcuuucuuagcugucuuagucuuuuuaaaaaaauuuuuuugagguagggucucacuguguaguccugguuggcuuggagcucacagagauuguccagagugcugugugguugcccggcuuuaguaaggggcugguaugcuuuauauugcgguucuuauauuuuuauguuucuuagauuuuugcuuaggaaaaaacucaacgucuuuuucuuacccuuguuuuggaaaguuuucucuucuuucucauuuccuuuacugaaucaguacccaaguuuagaaaaacuuaagcugagacauguagauauucuugacuuguaugacaagagccaaggguuucagagcuaguuuugugucauuguuuuauguaagcagagcuuauuagaauauagacgcuaacuugcuuucucuucauagcuguucgauuuggccgaauuccuaagcgugaaaaacagagaaugcuaauugaaaugcaaagugcaaugaagaccaugaugaacacccaguucaguggccaccugcagaaugacaccuuagcagaacagcaugaucagucagcacuaccagcucaggaacagcugcggcccaagucccagcuggagcaagaaaacaucaaaaacacuccuucugauuuugcaaaggaggaagugauugguauggugaccagagcccacaaggauaccuuucuguauaaucaggaacaucgagaaaacucaucugagagcaugccaccucagagaggagaacggauucccaggaacauggagcaauauaauuuaaaucaagaccaucguggcagugggauucacaaccacuuccccuguagugagaggcagcaacaucucaguggacaguacaaagggaggaacauaaugcauuacccaaacggccaugccguuuguauugcaaauggacacuguaugaacuucuccagugcuuauacucaaagagucugugauagaauuccaguagguggauguucucagacugagaacagaaauaguuaccugugcaacacuggagggaggaugcaucugguacagugaaaucgauucuuugcucgccuuguaucaaggaaagcuuggaagguuuucuuuuggggggcauguugaguugggaggugggugagaaagcccaagagauuucuagaagccucuuuguguaguauuuuagugaaauguuaauaagcagugcauaaggauuaacuuaauuuuacauaacaguagguaugagcuugugcuuuaauugcuacugugggguuaggauuuguauaaaauaugauugguacagaauugauccuauaauuccuagaaauaucuuuggaaauuuagguguuccgaucaguuaguaguucauuaacauuggaaucuuuugcaaaagaguugaucuuuuagcuucuuugauuucuucggagagagauuuuguugcuuuuguggggauggucuugggauguugcuuugagcuccuggguucaagcaaucuuguggaucauugggacuucagggugcaucacugccaaacagagguugguuuuuuguuuuuguuuuuguuuuuguuuuugggauuuugagacagaguuucuccguacagcccugacuguccuggaacucauuuuuuagacaaggcuggccucgaacucagaaaucugucugccucuuccucccgagugcugggauuaaaggugugcaccaccacgccuggcuccaaacagagguuuuaaaagccauacugauguaguaagaguuuuggagauagauauuuuacgguuugagaaaaaaauauauacauauauaauuuauuuuucuuuuccaagauagcauuucuuuguauagcucucacugcccuggaacucaaucuagaucaggcuggccuugaacucagagauuucgagucucugccucugccuccugaguccugggaagaaauauaguagccugauuucuaagauuuuauccugagaucaguuaauauucauaucauucaaauucauuucaucaaauucaacauucuacacaaaaauacaguguuuauggucagccagaauuucaucagaacaacaguacuccguaugucauuuccaguuuaaaccaugaggucuuuugguguagugcuugcuuucagcugccagguaauuaucuuuuuuucuuuuuuaaauccuaaaacuaguugauucuauuacagucuucauguucagcuuuccuuuugucuuuugccagugucugaggucugaggguagucuagaagaugccuuaaacuuagugcucuccugguacuucaggugcuaagguucuucucuaggcacuuguaggcuuuguagaugcugguuucauagcugucuccaggcuuaggaauccucucauuccuugauuccuauggguuuaaugaaaauuuaaaggcuguuuuuaguaauagaccaugcuucauaccguuuuaguggucuugcagcuucuuuggcuuccucagcucauguuuagaagguguaccucauauccacagucaguuaguuuccuggcugcacagauggaggucacuggucucagcauuguuaaggagcuaaaggaucagugaugcuuuuuccccucaauuauuuauuuauuuucauucacuuuauauucugaucacagcuccaguuccuucucucuucccagcucugcccuuacaaauuccuccuucuaucacccucccccuuuucauagaaggggaagcccacccugggacauguagucccagcagugacccucuuaaauugaggugccuuauacuuuuggaacuugcaguguuuuuguuuacugagaauaaauaagcccugaaaugggaaguaaagagauuuguggccuuacucuguuuggauaaggcaccgagucuuucagaggaucauguacucaacuaagaaaggguaauuauggacuaaggugcagcuuuuguaguggagcucuuguuuugcuugugccaaaagacuauggauuucaucuacuagcagagaaaagacaaagauuauugauuauaauugaccauaauaaccagggugagaaagagaucuguuuucaaaagucaaggcccugcacaugcauguaagguggucaagacccugcacauguguguaagguggcagcuguugcccauuuaagaggguucucaaguucuuguuuaugcaguguuugccuagguuaccucuuacaguagguccauagcuguuucaauuaacuugucauaaggcuuuuaaaagcacauuggagacagggucucauguacucaugccuggccugguacucacagagaucuuucugucucugcuucccuaguacugggauuaaagcuuuacaaggucauuuaaguguauaggauauguguuucuauuuuauuuuaaauuuuauuauuguugcuuuuuguuuugagauagggucuuacuacauacuucuguugaucuuaaacuaaaugugaguaccaguugguuuugaacucagagauccucaugccuuuuccucccuugugcugagauuaaacucaugugccaccacaucuggcuauuuuaauuuuaauuaugugcaugugugaguguggguguguacacaugugugaaggugcugaaggaggccccugaaacugcaguuaauaggccacugaugagugugcugggaacugaacuacaagagcuaagccaucucuaugguugaauaugugauuuguaaagccuccauuuuaaaauauuuacccacuucauuggugagaacucacacauuuucuuauguacauugaagauaaucuaauuguauuuacuauggugagaauuccuguuuugagguaagauguauuuacagaaagugauggaaggccuuacuugaguuaggaguuauuucauguugugguuucucauaaucgaggugacacuuuggaauuuuuugccacucuucaaaauuuaagaguuuuucuauuucuuguaaauuagguguguccuaugagcaagucuccauauguggacccucagaagucuggacaugaaaucugggaagaauuuucaaugaguuuuaccccagcaguaaaagaggugguggaauuugcaaagaggauuccuggcuuccgagaucugucucagcaugaucaggucaaucuguuaaaagcugggacuuuugagguaaguuuuauuuauccugauuguugaugcaaagccauguacuuaauucuuuuuucuuuucuaaauaaauguugaugguucagagucucuaacaaaacaguaacuaucacagaauuccaagaagggagggacagguacauugagcuacuugcgacuagaguguucaauucugugaccccagcauguaaguuacagguucugccgguaguuucagguguagauguauugguuuuugcuuaguguuagauacccaaaagcugagucuaauguuuacuauauugaauacagaauaaauaaggagaguggguuguguguggcaugguggugcaugccuuuaggccuagcuuuuaggagguagaggcaggugaaucugaguuccaggcaagccagggcuacauagugaaauccuguguuuccaaaacaagcaaaaguaaguacccccaaaacccaagaaaggagacuggcaaaugguuuuuacuuuacgagaauauagaauauucagcgacucaguagacaucucuaugcugcccuuucuccucagauccuuggcagcuuguccucagucacugcuuuuaagauaagguuuugaguaguccagauugccucaauuccaaguucucucccaguugaugaguuugggguguguugcuguguccuccugaguuuggggugugccacugugucauccuucugccacugcuuuuucccuuuuuucaucccagcuucucuugaagagaugcuuugugccugugcuuggacugccauggcugccccuuguauaggugggcuggucaauugcugccucccaguggugacuuagaggucacuuacacacagcucugaaauuugaggggacaguaauaggugaacaucuuguggccagaccuuuaaacucugagcaguuugagaaggaaucaaacguauuaggcucuuucccccgaugagucguacagauuuaaacuaucagguacucuugguguuaagugcuggccuucauagaaugugccuggcuagagaaaccucuagucuuugugcauucuccuaggucucauuucuucuuccuuacccaauuuucacaugugccacagaagccucugcuaccuggacuaucugaacuagaacagagaaguacuauuuuaguaauaaaccaucccuagaauaauugagcaacagcugggccuuucaguuuaaaggaauacaaugaaacuuagcuuuucacgucugcggguucaagucagaggcugaugcaguccaucuguuuugggaaagguaauucuugcccagaggugacugguauguuaugucuaggauguucuuuccacccugugauugugcuucaaaggaauuugcaccauuaucagaggagauucacuuccuuuuggguugucugggcaggccacuuuuguuugaggcauuguagaagaucguguugcccagugcaguuucagauguaagagaggcauccagacaacauugaugucacagauagaguguggacgcaugcugcaguccugugguacgaucaguuaaaacugauguggacugagcagcagucuugugcugugaugcgauacaaucuuggauguggccugagcaacagucugcguugugaugacugaaauagaacuugucuuacaccauagacaccuaaaauaugcuuuucaugaauuucuuuggcuagacccauuuuucccccaauaauauucuuuuuauaucuugaucacagcacacugcccucuucccagucccucccuaacaaaucagucuccccauugccccgaaggggaaucacccuugcauaucacuccuuccugccccccacucccaacaacuacuuccagcaggacugggcacacauccucuucuagugggcccaaccaggcaguucagguugguggaagggaauccaguggcagggaacagagaucaagacagccccuacuccacuaguuagggaacucacaugaagaccaagcugcacauuugcuacaaauguguagagggucuagguucagcuccugcaugcucccuugguugauggcccaggcuuuaugaguccccacggucccagguuaauuaauucugugggucucucugugguguccuugaccccucugacuugcucaguucuuucucuuacucuuccacaagacucccagaacuuugcuuuauguuugacugugggucucugcauuugucuuccuuugcugcugaagaaagccucucaggagacaguuaugcuagguuccucucuguaagcauagcaaaguaucaugaauagugucggguuggcucucuuacaugggaugggucucgaguugggguagucauuaacuauucaaguuaacuguuccuucagucucugcuccauuuuuaucccuguacauuuuaaauagaagauaaauuugggguugaagguuuuauggguagauugauguccccuucccuccuuuggaagguccugccuggcuacagaaggggguuauuucagucucuauauuccccucugguaggagucucagcuaggguucaucucauagauucccuauaccuccccuucucauccagacauccagcuagucaccagagaugccccccaccccgauugccagucuuacucucagcccucuccugccccuugucuccccacacccugauugccaucccuguuccccuccuuaacccaucuccuacccuguucccucucuccauccaccucuguugauuauuuaguuuccccuucugaaugauucucccuugggccuuauuuguuacuuagcuucuuugggucuguagauuguagcaucaugaucuugcacuuauggcuaauguacacuuaaaagugaauacauaccauacauaucuuucuguaggccacauuuuuaaacucagugacauuauugcucacuuuaaauuuuuuaaaaauuuauuuauuuauuuauuuauuuauuuuuuauuagauaguuucuuuauauacauuucaaaugcuaucccgaaaguucccuauacucucccucugcccugcuccccuacccacccacucccgcuucuuggcccuggcauucccccguacugggccauauaaaguuugcaauaccaagggggccucucuucccagugauggccaacuaggccaucuucuccuacauaugcagcuagagauauaagcucuggggcuacugguuaguucauauuguuguuccacccauaggguugcagaccucuagcuucuccauugggggcccuguguuccauguuauagaugacuaugagcauacacuucuguauuugccaaacacuggcauagccucauaugagacagcuauaacagggucccuucagcaaaaucuuccuggcauaugcaauagugucugggugcucacuuuaauuuuauacuuucauuucugaaucuuuguuuauaggauuuaagagucauuaacaucuugccauugcaaacuggacugcuguuugauguugggauauuuauugcuuucauggagaauuugccuuaaaguguucuagaucuaaauucaguuuccuuuucuauaaaauuucuuuuauauauaggauguuucuuaacugacuucaauaguuacaucuuaguuuucucaaugaacuuuuucaaaaauuugaauuuucugccuuucagguuuuaaugguacgauuugcuucauuauuugaugcaaaggaacggacugucaccuuucuaagugguaagaaguacaguguggaugaccugcacucaaugggagcaggggaucugcucagcucuauguuugaguucagugagaagcugaaugcccuccagcucagugaugaggaaaugagcuuguucacagcaguuguucugguaucugcagguaagcaagcaggcugcugcaaaaucugguuaugcugacugauaauuucauccuucuguucuucagauuccacauucuguuaggggaaaggguugcccauguaaaccuaguaugggguuacuugcucuuuggaugagugaccaggguauuucaguccauacaugguguuuccucaggaguuacaauguugaucccaguuucuuguauuuagguuguagcaacuuacucuggagguaucucauucagauagaagccauuauggugcagauuucuccucucaauggucaaauuuuauucauuagauagaagucagucuagcccuuuuaagaggaggggacacaagguaugaauacuaggauagcgaaucuacugugcaugggaguggaaauguaguuuguaugugguaaagauaccauuucugcauuacauuauuuuaucuugccaauuagaagcaguugaaguuagcaucaaauuuaaagaaauaagaaacucuggauuggaaagauggcucagcaguuaagaguaauggcugauuuuccagagaacuaggguuugauuccuagcaccaguuccagagaaucccacuugguaucaggcauccaagugguacauggacauacuuguaaguaaaacacccaaacauguuggaagaaaagaaaccccaggcuagccuugaacucugagaucugccugcuucugccucccaaaaucaaaggcauguucuccaugccuagcugagaauuacccuccccccaaagcaggguuuuucuuuguagccuuggcagucauggaacuugcucuguagaccaggcuggucucaagagauccaccugccccugccuccugagggcugggauuaaaggcaugugcuaccauccccggcucauuuguuguuguguuauugauguuacuuuagcugagaauuuuuacagcuuguauauauugcucuauuucaaauuugguaguggucagugaguaaguaaucauuuauugcuaaugucuucccuucauauuucuuucuucucuacuuucauuagaucgaucuggaauugaaaaugucaacucaguggaggcuuugcaggaaacacucauccgugcacuaaggaccuuaauaaugaaaaaccauccaaaugaggccuccauuuuuacaaaauuacuucuaaaguugccagaucuucgaucuuuaaacaacaugcacucugaggaacucuuggccuuuaaaguucauccuuaaggccuuugaacaugaacugaugcuaauguacauuuuaugcugagauguuuauuuauauguguauacuauauuguggaaauagaaaagaacuuagcgccagguccugggcugucucuguagucagucaccaguagcuguugggauaagaacucguugucuuguuagacauuggcccacccuccccuguagaccaaucagcuguguugcacuuagacuggagaaguuacacugaauuauaaucacacugaauguuagacuuuuucaucugccaaagccaaaauaccauuugaucuccccaugguauaaaucuagcgcacauugccgauauaggaggacuuagacauuaacccuuugugcugggaauucuguuguaccacaagacugaaaugugguaagggagacugagagccaagaggucuuuauguacuuggauuuugcucugccacugucaaaguacguggugguggcagucucugaguuuuggaaaaugauaauugauaguguccccaauguucugccucaaauacugaaaacuauccauaaagcgucuuuaccucuugggagauaggcacuauguaaauaaggugaaguuuuuauuauaauugcucauaauaguauucuugucuuauuucuaagcauuucugggaaacuuugacaguccacaccaauuuauucaggguuccugcucaaguaggguacccuacugauaaacacauauuccagguuuauggacaccucaaauaguauguguacauaguguguaugugaauauaauuauauauaaaaaucuuacuucacaauauuuuaaacugugaagaacuuuaucauacaauaaaacuuaaacaagaggugucaaggacccaaauuaggugcauuuuaccuguugcugcugauguauaaccauugcuuuacaauguuuagaugguagaauacugaaguuaaugcucuuauuuuuguuuaaggaacauuuaauguaaaagugugaagagcagucaaaucuggauuuuagaaaaaaauguauuuuaggaugcaucuuugauacaaucugcaguugaagguaauagauguuucaguguuucagcuuucuaccuugugcuauuaguagaggugguauugcugccucuuacgugcuucagguggauggcagauuuggauucuguauggaggagguuuuguuuaggaaaacuuugugaccuguuggcauguuugugccaaguccacuuuucuuucuuucccuaaauaauacuacagggauuuugucaauuuagauuuaauauaauuugagaaaccuuuuaguaagugaccuaccuacaggcuuagagaucaugguaggaaagauggccaaaguuaaagauucaugaacaacaccccgugccccccaaaguagcaauucauuguauuuuggggguaaaauuacuuucuguguaaugcuagauuaugugaaauuguaacgacauuaagaaccugcuuuacuacuuaaagccuguuacuuuuaugacauuuaaucagaaugccuuauuuuguaguuuuaacuuguugcuacaggauuugaacuucugugguacaguuaggagagcuugagaaagauaaacuccuauugucaaagaggaaagugauggugugucugucauucaguagggaccauaacugcugcuuacguucaguggguauggcuuuuaugggauauacagcuagguuuugugaauucuuuacaugauagcauucuuuuauuuuuuuucguaggauaaaaaaaugcauaguuuucuucuaugagggauagagaacuuuuuugaaauaauacuauguugauucuuuauuuuugccuuuuacauaagugucuuuauaacauguaucuuuagagcaguuaagucuuuggaaauauguaaccagaacuguuaguauugcuugugaugcuuuaguuaggguuaguauauacauguauacaccaaaauacaagcauguagauuugcauuuugucucguaaaauuuuauuuuaauaaauucuuccugaaguaaugggaaacaaaauccauaguucauaugccacauguaguauuucuguauuugaaaguagcccaaagaugagcauucuaauucuaaaaugaaaccagcagccucauacaagcacauucuuugguugagucauggucuaacaguuaauaaaugacaucagccagauagagaaccucugagucagugggguacuguugauaauuaacaauguacuguaugaauuaagugacauguuaacccugacuuuauguuucaagguuaaaauaugggcauuaucucaucagacuuaugggcauuauguuaacaagaugaaccauuuuuuccugugcuuuuaguaugugauaugagaggauuccagcuucuagagagugaacacugagggaaaggagagacaucguaggauaaaguuuguucuccugguaaugguuaauugcagauaaaaaaauuugaaggguguuucaguagauuaauauauagauuucauaucuacauuguaagaaauuaccauugugauugggucagaauugauguguguuauauaaacauugcaaagcaaagcugugagagaagcucagauagauguaucuuuuugcaauauaaaguuugcugaauguaugaguuuauuguuuuguucucuguuucccuaguagaccaaaucccuacugaaucccucagggccgcc

SEQ ID NO: 7273 - RNA, 3571 nt, Mus musculus
guccacuuguuuaagacauuuauuacuuuaguugauuugaacaaccucuauacagugacuuguuuugcugaauagaaaagaauuuuagcuaucaagauuuugagucuaguauuuucuggaaaucaaaucauccuuuuaaaaucuccaaaggaaaaccaauuuaauaaaagcaucaauuagauuuugagaccaagccagcuguucggggacaauaccauuucuuccacacucaaaaucacuuugggaaacuacuccaaggcaucgcacaaauagaaauaaaagugugguuaaguauggccuuugugaaaugucaacauccaggcaguuaccagccacuacccauagguagauuguaaacgaugaaauaacacuaccaaaauggacuauucuuacccaugaugaauugacuggaauagagaaaauuucucuauauuguagguaguccuggaaccagagagccaucugccucugcacacaccagcugcuagaaaagcuuaaugucugcaagcuuaaucaaacuuauauuugcuugguugauauuaacuugcaaccacaaccaaguuuacaaaucuaauggaaauaaucugcccuaaauaagcccuacuacauccaauguucaaccuucaucuccaaauccauacucuagauccaacagaaagugaaaccucuuccaacaaauuuaccuggucuucugaaaauaacacuggauucaauucucaaaauguggguuauaguugaucucacuuuucuaugcacaaaacagguuuugaaacccucucuuccuacacauuucuaagcaaaauccaacucuauaaaguuuguacucaucaaacucccaagcagccacuucagugaaccaaaagaugccaucguaaagcuguagauucuaucucaugcaccaacacauccagggucaguuucaggacuuuuuaccucuuacagggucuuacacacagaacaccacuuggcacaaacacuauauacacuuaaucucauaagcagauaaugcaaaguacaucagaaacaagauaugccaucaccugcaguuuucaauuauugcacuuaacuucuacauuuucacagaacacucaugacaaucuguagacuaguuuuaacaaauaacaccuuuaagcagaaaugacuguccuaaauuguuuauuggauaugaauuuuacaaauaucacguguauuagcgguaacgguggagcuggagaguauugcgccuucuccaggcugcacggcgggaaccaccaauagugugguggaacuuguggcccuuuccaaggccacggcucuuucggccagcagaugucagcccacgcauuucucuguguuuguggacugguuuggugauccacugggugucaggauuucuucugauagcuuuauggaacggaucaaugaggauaaccucaaaaaauuuauauguggaaucuucaccaacccaguaggaauucaggacucucaaagccccacaauggcgcccagcucucuccuaaaauaugcagagaaagaccagucaguuuccuguaaacuagacaaaaauccuucuaacucugggucaugagacugaagcaggccagguccccacacaccuuaagaauuagacuagcuuaaaugacagacauguagacaaaagcacauaacuuuuuuucucccuaaaaaccagacaugaaauugagugcuguccuaguccccuucagcaauagggaucaagcccauaacccuauacauuaauucaacaaaugaaaaaaaaaguucuagcuuguggaaagggggcuccuacaaccauuuaucaaccuaagaguaacugaucacagaauauuagcaauguaaauaaaacagaauggcccaaaauuuuacagucuuccaaaagcauagggucuguagaaacuaguccagaaacccaaaccccuuuccgcacauccucaagcaaaacaguaacaaugaguaccgauagugacuaaguacaaaacaacuccauccccaccuuauaccgagggaaacuccaccggcuuccccguuucuuccuagcccaccauuccuaauggguugucaagacaaucgauacucccaacaacucaccucagcaacagacugaaggcuucgggcaaauuucagcugguuaacaccaugguggacaggcuugccguaaguugcacccuuaggaacugggcguuuacgaccaccacggcggacacgaauccuguaaaugacauagccuacacaaacaaacaaaacaacccaaccaccaauacguuagacuaaguuaagacuuuccaaugcuuccuuuuaauuacaaagauagacuauguagacuaaaguauaucuguaaccuauaucacauuuagcauagcuaaaucaggcagguuuuuugggggggggggcacuuccaaacugaggcccgccgacuuuucugggaguguuauagaccacccacaucgugaccucacgcaccuugcuuagccuuguaucccagucuucgagcuuuaucaggccggguggggcggggagcccugugcagcgcagagagcuggcgguauugccaacagcggacccucagaagaaagcgcaucacgucggacugcuucuuccuccauagcuccuggauguacuuguaugcacccaucuuggcucaccuuuugagaggaagaagcaaaucgaaagagcgaucgcugucaaggacauugacuacggccucuccauccuuccuggagccccaccguccaccgggaaugagaagggcucugcagaggcagcaaggcgcagggccggcugggcgggacugacuauuccauacucccggaggccgccagaacuggcagcaggguuauaaccgccaccgcgaguaagaccaggagagcuucgucccacccgggcggccugaugagaggcaagccgaggccacgcuuccaucccacgccuccuucaguccccggcccagcucggauccugccgccauugcgucucucaagccucccggacggcggcguauucguacccucuccaccccguauccucacuaggcgcucgugcgaggcagaaacuccgaggccguagggucgccggggucggauggcugaagacuagcgcgauucgcgacggauagacacacaaacaccaccccgccgcccuaccugauggcugccgccagaggaaaggaagaaggcuuucucccacaaucccuuuuguggcuccuccucccaccccggcgacccuccuuccgguggggcauuguagccgcacugugccucuuggggcuuguagucccgacauccaaccuggugggcggagucaggcugggacagcccgccgcuuccggaugcucucccaagcucucagcagugcuccugagcugccaaggcugcggaaagugagaggcggcgaguuugcuuacgucacgucaaggggccggaggaagcaggucggggaccggcuccagagggacgccuucggaccgcggugaccugcgugcugcugucucacugcccugcagugucagguugguguuuccaccggcgccucgcuccgugaucucggagcacagugaccgcaggacggccgugacuug

SEQ ID NO: 7274 - RNA, 49140 nt, Mus musculus
agaggaggaguggcgcggagcgugugcggccggggaagccauugccugguuaauaguugcuguugcugcacuuccgcuucucucccagugagagcgagacacgaguggccaggcccagucgcagccgcagcagcagccgcggcggcggcacggagcagccagacacaaagagaggugcgggggccccucagggcgggcgggccgcggggccuggggccgcggggccgggggacgggcggcaccgccgggccgcgggcagcagggccgggcgaccgggauggcguggcgggcccgggcggcgggggccgcgcgaacugucagagcggcccgguccccgcggggacccgcccgcccggggcgcauugugcgcgucggccugcgagcgcagccccgcguggcccggccuggccaggagccguguccccgcggcccacgcggcccacgcucggcuugcucacccacucucgcugcucggcucgucccgaccucgccaaacucgagcggacgccgggaggccugggggaccgcggcggcggcucccggcccuccccgggccgcccccgcgcgaucguggcccccgugucucuucggccggugcggcggugggccccgagccucugcaggcagcgggggcggcccggcccgcgcccuccugacagcggaguuccuucccucuuugcagcgccugcauggucuguguuucuguuuuguuuccucccccugcaggggccguucgcgggguggggugggggguucgcuaugucggaugacgauucgagggccagcaccagcuccucgucaucuucguccuccaaccagcagaccgagaaagaaggcagcacccccaagaagaaggagaguaaagucagcaugagcaaaaauucgaagcuucucuccaccagcgcuaagagguaucccacuccuuucuccacaggcauccgagcuucccaguggccucgugcugcaugucagggagggaggcuucaacgacguucucgugaguucucaggcaggaaaauggggcaugggagucccaccuguuuucucuacugcucgcugcuucugguuuuguuagugcccucguccauaugcaggaguugugguuggccucguccguuucuuguugaaguuucaagaauccucauuacuuuuaugagugacucccaaugugauuucagagucuucauccuaguaaucacgaaucucugacuucccggaggcugucaucauacuucauuauuaagaguaccuuccugggcaacucuguuaaaacuaguucugaccaucuuucuuccucuucaccuguugcaggggugguguuuucugaauaggguuuucuccauacaucgcuuaaggaauaacuaacucucauuagcgguuaaaagaaugucauguuuucuggcagaauuugaagaaccuuugccuguuuggagaguuaagggagaugaaagaaucagugaauaacuguaaaauuauuucaguuauuuuuggauuuuuuuuuucuuuucuguuuaaaaacuucaguuugacacuuuucagaaagacuuguuuuacuagacaaggucucuuuuggcccaagcuggccuugaacuuagcacuucuaucucagccucuugauuguuacagaagugagccacuuaguucacccagcgauaaucucucucuuguguaaaaaaaaccagguggauaauuuaccucugucaaccuuaagucacauucucugauccuguguuccuuaaaauaaucucuaguagauaccugggagccugccucuccucuccuuucauacccccuuuuuuuguugagaugguuggccauaguaaggaacagaaacucggcugcuggggaauggcauucuuuaaagaauuuuaaaugaaauggaaggucuaaauggcuucgggucucucugcugaguagugagccuggaacucaaagauugucaguuuguucuguuguuuucccugaacugaaauucagaaacuugguaugcugucuuagugagcuaacuggacugauagaguaacuucaggucauuuuaaaugguugcuguugaggucuggagagaugguugaugcuuugguaaaacuguuaucaguuucaguggucugauuauaucucagucucuccagggucuuugaugaaccccugugaaucucccagaaccuagauucuauccuucuugcucaggauggccuuucuugaucaaccccggccuugagcucucuguucuacuuuugaccuguccugccccagugcaggacauuagcugugaugucacuccugccccagugcaggacauuagcugugaugucacuccugccccagugcaggacauuagcugugaugucacuccugccccagugcaggacauuagcugugaugucacuccugccccagugcaggacauuagcugugaugucacuccugccccagugcaggacauuagcugugaugucacuggggcuuuuacguugugcuagacauaaggagaaaauggacagguauacaaaguaguuuucuuuuugucaguauaguacaaauaaauagauuuucccauagacacagcuuguguaugcuuaaggaacuuagaaacuuaguucugggcauaguaguacaggccuuuugucagcucagcccuuggaaacagaaacagacagauagauguccugugaguucaaagugaguuccaugagagucugucucaugaacaaaaugccaaacaaaaacauguaaaacuauuugauagcuuggauaguaguguacuggccuagcaggcuugaaacaucaucaagaaugguaagcccaggaguaaugguaauaauggucauggucauggucaugguaagccagguaggucaauucagaguuuuccuuucuaaggauauugagggucagaagaagccaacuauaaugcacugaacccugcugauuuuuagcuggaccuuuuucuccaguaaaaagaaaaacaaacugaguguugacuggagaaguuccuacccucagaaaaccuuugggagugaagaacaaucauggcauuccuugucagccuggccuaugagaggccacucagaaacagcugguaaagaaacauuaaaguagaaauggcaggcgggaaauggagccaacaugcaguaugugccuuuuagugcaacagauuuagacuuguagauuccuuguugaaagaguggcuauuuguguuaaaggaaagcuaagguuaacaucaaaaggcaauugggaggcagaggcaggcggauuucugaguucgaagucagccuggucuacaaagugaguuccaggacagccagggcuacacagagaaacccugucucaaaaaacaaaacaaaacaaaacaaaacaaaaauaaaaaaaauaaauaaaaaauacacacaaaaacaucaaaaggcacaaagugaaaaggguaucuaagaaagaaugaaauuaggauggggguuggaaucuguugggaagggcaugugugccagaagaugaugugaaaaugaaaucuccaugggcaggcuaaggggauucguucacuguggagcguugucucugguagaggagagcacuggugggaacugugcugagcuagagccacuuuuugaacaggccuuugaaucacuugcagaccuugcaucaguagucuggaauugcugcaaauggugguguuugagauucagugaguaaaacugccugguauugauuggacuuuaaaaacauaauuuuauuguguguguauucaugugauauguguggauucaggcaugucaggguacauguguggaggucagaggccaaauucuuggagacaguucucucucggcauguagcuuugagggauugaacugaggccaucaggcaucuuuagaugugagcuaucgccagccuucuuagaagcgucacuuucuaagcauuaaagcaacaauuuguccuuuuuacagcucauggggaaacauuugcucucuaacagaucugaaaauuaucaguuccaacacauacaagaauccggaaacuaguccuccaaacuaacauccaguugggaaugaaacaccagaugcaaacauauagggacugaagugccuucuggaagugguggaauuuagcaggacacuaauaaugucaguagagacuggauguucuaaacuggaccacauuuguagggacaggaagugcucuucaauaggaaaguuugaagaacuuccccaggcaccacucaauuuguuuuccuuuuaaugugaaagaaguaccagcuaaaaaugucagugcauaauagcaggcuucuucuuacccuccaaaaaccuuuggaaagggaaaacauccauugucauucagauugccgaguuugaguguugaugagugagcugccuugaugaauuuuuaaguuguaacaacagccggguuaggaugagaaguuauacaaauagccuucccuagaagaggcagcuuaaggcugcaaaguuuguccuuuuaacuggugcccucagcgucuggguuaaccgaagcgaagacaaaggccagaggcgggugugaacugucaguggcuucggccugagcgugggggaugggcucuuugugaggugcggagaugcgggugcggguugcgggccuggggcugcccgagaaagcucguccucgcccgggcagccgggaagucgggcugggaacgggcuggugcucgcggcgggugcagguggcugugcacuugugcggcgcggccggggguccugcugcccucagcuccacccaacacuuccagggcugcucgacccuugacgguggcggucacaggggcccgagcggccauauuggcuuugccggcaggccacugcuccagggugcggacagugcccgggucugagcggcaaugaccugcugagggcgcugaugucccggccugcggggggcgcuggugugcggggggggggguccuggccaguggggcggucccuggucugacaggggugggggguaccugacagggguucuguggucugcugggagaaucagaacuaugggccugaccuggggguggagcugguguguagagucacuguuuaagcacgccaaaaggcccaguacuucagaguucugguccugggguuccaggacagggggcccagaccugagggaaucccaggggagacucacuucaggauaaugacuuuacuauucauucacgggugagauacuggaaaagcugggaaagcagcaagugagaaaauuuuaaacuguuuaaauggaaaacaccgaggccaacugcccuugugugcuuguauuggaaguccuaugcugucaagggugggagagaccuaccucaagcugcuccccugcacugggaccucuaaguaucuucugcuuccucaguggaguaaggugggcuacugaccugauucuggaagggccuccaacuaacuuuguuuccugaucucccaggauccagaaggagcuggcagacaucacuuuagacccuccgccaaacugcagguaagcugccuauggauuguuaguaaauucuccuaacuucugucuuguguuuucuauuauagaauuuugcuuuucuucuauggucugugcaugguuuagugcuaacaacaaaugaaauguaaauguaucuauggguguggcauguaacaggcuaagguauauugagaagugauggauuuucauggagugggcacuuguguauauaaacaaaauugaaguuagguaaaggagcuugccuuuuuuuauuguagcuauaggugacgucagccuuuacacaugcaguuuggggcauguuguguuauauacuaccuuagaugcugggguguucagugagaacaagcugguccucagaccaacaccgucagauucuuguauugacuuuacaaagcaauucuggaaguaaccuguggcuuuaguagaauaauuuugcuuuaaauuauaaauuuaaacucuuaaaaggugguguucuuuguugauauugcuuaauccagugugaagacaguuuaaagccagcuuucaaaggaugucuuugcugcucggcuuuauuuaaaaucaccaguuuuacauuucugagucaagauggcaagaaguaaugaugauuucucuaaacugauauuugaaucauggaggucuaaaaaaaucuuagaaccaggaucagccuugaauggaaggugacguuucauugguacuuucaguuuauagguaggaguuacuggcaaauauuaguggauauacacagcaaguaugugcagacauucagaguggaagcuaacugaaggaucuggcuuuuaacccucauguuuuagucugugugugccuacaugaugugugccuaugggggcuaagggacaacuucguggaguuggucggucucuccuuuauauggauucucaggauaaacucgggcugccaggcuugagcuguaagcaucuuccucacagccgucggguccauuuuguauggauuuguucauaguguugaccagauuugugguacuuuuugaaaguuuguccugauuuguaagaaaguuauuuugaggauuagauaccucuucuuuuucuuuuucuuuuuccuuuuccuuuuccuugccccuugccccuuucucucucucucucuuucuuucuuucucucucucucucucucucucucucucucuuucucuuucuuucuuucuuucuuuuuuugagacaguguuucaggcuggccucaaacaaugucuagcugaggguaaccuugaguuuuucauucuccugucuuuaccuugccccuagugcuggcauuacagguguggggugccaugcuggcuuuaugccaggcuaaacucagggccucaugcaugcaugcaugcaugcuaccaacugagcuacauccccagaaaaauauguuaaacuagauucuuuaacugagccccuaauuauucucagaauuucuuguguggcugaucauuuuucaguguuugagaaguagagaaauauuaagagaugaaagcccagcgcuucccuugguuguuuguguagaaucacagacauucccuacggucggucuguacuguagcugccacugcuauuggugucggcucccuagugugcaucucuugugaguucaaacagcucuggcugaucaaauuauaaauaguagcuucaaacaaguaucagcuauucaaacauacaguggcuuucuuguggguaagugcuaucagauuuaaaacuguaaacaauuugaagauuuucaugagauaaucauuuuuuuuagaagaaggaaaaguacguuugaguccauguuguagcaggguuugucugugagcgguuuguguuucugaagcacggaggacuuuuuaucuuuguaaauucucauaaucauggcuucaagcugaaaucuuugaccauuaccuaucacuggggauuugccaucccacuguguggugggaagguaaaccuuacuacucugaaauguuuugggaagagugugauuuccaagaacauacuagguaucuuuauuuuucaaaaguguauauauuaagcugcacuuuauacauagcaacugcuuuaauuuuuggagauauucuucacugguucuuuuaagucaguaguucucaacuuuccuaaugcuguggcucuuuaauacagcuccucuuauuauggcuacccccaccauaaaacuauuucuguugcuacuucguaacuauaauuuugcuacuguuaugaaucuuaauaugaaugucuaguaugcaggauauuugccaugagacagaccccugugacaggagacuaggacccacaaguugagaaccacuguuuuaagugguaaugaauuuugaguuucugcuucugacugccuuccuaguguuaccacgcugugucaugcugugauuucugucuuuggcucuugucugaguuuggcuuuauauuuugugcugcuaccuauauagaaguuaaaaccagucuuuaaucccagcacuugggaggcagaggcaggcggauuucugaguucgaggccagccuggucuacaaagugaguuccaggacagccagggcuacacagagaaacccugucucgaaaaaccaaaaaaaaaaaaaaaaaaaaaaaaaaauuaaucacauuguauguguggggauguacaugugccacaguguguaagggugacagaggacaacuugcagaaaaugggucuuagugacccagauuaucaggcuuggggaucaaguuccuaccuguugagccauccuaccugacccucuauaagacuuaacuauuuaauauuuugauggccuuaaauguuggagacaaaacagauaauguagcuuggaugcuuuuugaagucagcuucuaauuaaaaugugugaauuaaaugauauauauaaauugauacauuacuuuuuuuuucugguguuacccucagcauaaguacucaguccuuaauagugagauuguaguuucaucaauuauaaauuauauugaauaagcugaauaauugguuuucacuuaaugaaagguuuucacccuuucuuggacuucuuucugucaguaucaauguguagauuuaaauuagacacaugacuuuguuaaaacacagcaguggcacacaguacccucccaguggucagcugcuuaguauacaagagagcuccucuccaggggaggcaugcugcuuguacugucuguacuugacaaaacaguuugcauuccaaguuacugaucuucaaaccuugugugaguugcaguugcuaaauauguugcauuguauuuagauuuuuuaaauauaaauuauguauacacauguguuucugauauggguuuguguuagugcccauggaagucaaaagaaggcauugauugguucugagcugcccaucauggauucuggaaauggaauuuggguccccuaacguaucagcuagacucuuaacuacugagccaucacuggucccuggagacuuuuaaaaauauaaauugauuuauauugccauguaaauuaaauccuuacuuucaaacauaaagcuguuuaguagugugugugaaucucucucucucucucuuucucucacucacucacucacuguguguguguguguacacauagugaauuaacuguuucuggaguuuaucaugcauuugguuaugcuuuuuaucuaucauuggcucuucuuuuaggaggaaaauauuguuuugauuccuguaacaauuccauaaaaagcuugcaugcugucuacaagcucaugggcucugagccacuaggaucacuguguagcugucaucugcuuacgcuuugcuauaguuggauaacuaaacuuaaggguuuggacagugaauuuacucaucauaagggacauauuuugcccaagucuuuucuacuuuaguuuugauaggauugucuguauuauaaguaagccucuaguacaaauggaaaccaaaaauucaaaauuuugauugguguuauuucagauaaaguauuuuugagaagucacuaagucuuuuaagcaggggagaguaaaaauaaauucuuuucuuuauauaaugcuauuauauuugacaaguguuguuuuuguuuauuugaauauguaaaauugagucaguaccuuccccaccaagaguuguauugcauaaucggauaaaguuuuuuuucuuuuaaagauucuuugaggugaaacaauaucauuaacaaaacaguuggaggacagcaagggauacacagagagacccugucuugaaaaaccaaaaagcagccaaacaacagcaguacaucugucucauaauucucagccuuauuaucuucucugcuaaaagggcccauugcuuaacuugccuaccuuucaguguguggauguccagcuuggcuuugagauagccucauauagcucaggcugaccuugaacaugcuauuuaguggaggaugacuuugaaugccuagucuuccugcuuccaccuucaaaugcugagauuacugcuucaugcuagcacagccuuuuuuugagacagguucuugccucaugguaagaagucaauuaucacugaaguuucuguauugaauggugaacauauuggagcuggauagugucaguaguuguacaauauuguaaauguaauaaugucacugaauuguacauuuagaauguuaaaaugcuaaauuauauguagugggcuuguguauauaaaaaccacaguaggacugaagagaugauucaguuugagagggcuugcugcuccuuagaggacugggguguguguguguguguucccagcaccuaugugagaggcuucaaaacuaccuacaauuccagcucaaagugaccuaaugcuuucuuguggcccucacggguacccacacucaauuacauagaaacauacacacgaauaaaauaaauuaaaacacaguaaaaacaauauuguuguuaaauguuguuuuuuuuaaaaauucuuacagcugaaaaggugauucuaguuuuagguaaaggugccuauauucucugucaaaaccuuaugugcuuguuguauuugaaaaggaacuacuuucaagugguucauaaucuauuaaaggugcuuagaaaguauugaaguagucacugccagugccuuggugugggggcagaagaaugagagauaguuugcugugcuggaccacuuagucaucugggaagauuacaagagaugggaaucggguugaagaguaaggagguguagacucacuggaggaaucugcuaguaaacauaguagagggcagguagagagagcuaucacaugguggguggaccuuuggcugcagaauacaaaacaagggggaggguguagcaggaguaaaauuugagcucuaucaagccaagggcuuugaauuucauuuuauagauguuagagaaucuuagaaacuuuugagugagaaaugaaauguuuaugaaacaauuugacagagacaagaacagcuugaggcugaguaagaagcagugagcuuugaguugguguaguuguucagggagaggccacaggucuuaggaaacagacagcagcagucuugaaccagaagaaccaggaaacuugccuauugaagggaacaggcucuggguuugagugaguaacacagaagcuaggauaggaaaaauggcuuagagaggcaaguucucucucuaaaguuggucuguggaucauguacagugcugcaugcugcugccacagaauaaaccaugacuguaguuggauuguauguuugaguuuauuuuuaaucacuuauugaacucucagcuuugccugcuuuuagguaggauuaggcaaguuaaguagauuauauguccuccuagaggcaaaggcaaugacuuaugucuuugauucugauccugcauguacccagcuuuucaguuugaaagaauucaaaucuacagaagacacugggagaccaguguaauaaacuucagcugcuuauggaaacuuuacauuugcaucguucuuaguuucauugaugaugugaugaauaccaugacccaacaccaacuuaggguagaaagucuuuuauuauagucuauuacuaagacacaucagagcaggaacucaaguagaaacucuaaggccagucuuccuguaucacuucuaaccaaggaaauacagcagaagaagccauagaagaguuuugcuugauagcuuaugcaggguaauguuuaguuagcuuccuuagauggcccaggacugccuggcuagggaaugcugccaccugcaaugggcuaggcccuccuuguaacaaucaacaagauaauuccccauagacaucauucugaccuagcuaguuucucacuugagauucccagaugauucuagguugucagccccacagucaaagcuaccaggacacauguuucuuuguuuacuuauagaaugugaaugaaagcuguuuccauuaaguggcuaaguaugcucgagucaaaggcgccaagacugauggugacuuuccacaugaguuuagaaagcuuuugauagugaaguguuugagagucucugggaagaaggggguuagcaauuauguucuaaaagcuggucacauaccauaguaacaacagcacagggaagacugaggcaggaggaucaugcauuugaggcaauucuggucuacauagcaaguuccaaauagaacuuggugucucugaggaauauaugcaaugaaggacggguagagaaagaguaucuggaaaaagaggaagccaagaagcaggaagggcugucauggcucugggagacagaaagaaauuuaaugauuuuugagugugguuuuuguuuuuuguuuuguuuuuauuuuuuuuuuaauagaccaagagggaugaauagaaaacagaaggauggagggaugagaagaugaaacauguuuuaaauagaaaaaagagggugguagaauguggaguuggggcuauugguagagagcagguguuuugaaaagcugaccaccugaaguuuugguggugggacagcucucaguguaugaggagcacuccagcacuaagaacaauagcauccaccuccugccugcucuuucccaugagacuuuaagguccuugagaaacaggggcuguucugucucagcauccguauagugccugagaaaugguugaucaucacugagaauucaacucaugaacacagaaagacaaguguagaccugaugguuacuagaacgucuuauuacauucuuuaagaaacagugaaaagaagaauaaacugggcuuccaguuccuaaagcuguuccaaacaguugguguuagaggugcuggaaccaacccuccugagacaucucauguacucuagucaccaggaaagugaaauagggcuuacauaggaaacuauucuuaacucauccuuguacucagccaugcccugagugacauaaauggagggccugguacugauguagcuugugcuucucaccccugggcaccuccuccucuuggaggcuagaagcucuucaaaccucagcuugagaggcuaaucaugcaggagcugcuauauucaaccauuuuuuccuuuaacauauucauaugacugugaauagcuuuccagacuccauaucaucugggggaagccuggggcaguguccugcucagaguuguagaaauggcuuccucugcuugucagagaguaugugaacuugaauguaacaaguugcuaacaugacugaugagaagaacggggcugaugucaucuagcucaugcauaguguucagaagcagcuugaccacaaguaucacaucagacuccuccagccaggccuaugucagugcuguuucauguaauaauguuguagucucaguaggguucuuagcauugauaugaugaucacuaauauaguaaggacuuuaagaguuugugccuguuuaaaugauagauggaaaguuuaugugggguaaaucuuacagaaaaagacuugaacuugauaugauauaucauaccucuaagcacuuggagucugaggcaggaggauugccuugaguuugggcauagccugugcuacagaguuucacucuaucucauaacaaaaaaaaauaguuugggauaaucuuauuaggagaagaaaaauuuguacagaguggcagcaguaaacuguguugaagacugccauugcucugaggacuaagucuguuguggaacuuggacuuuaguaggugucuuuuguuacggcguuuauugcugcaacuuggggucauacuccauuauugagaaaagucaggucaggaacugaaacagacuguagaaggcugcugcuauuuauccggcuuacuucucaugguuugcucagacugcuuccuugcacagcuuagaacucagggaagcaccauccauggugagcugaauuuucacacaucaaucauuaaucaagaaaaugcuccacaggcuuguccacaggccagucuaccaggagcaguuucuuaauuagggucccacuucccagaugacucuuguaucggguugacauagaucuagccagcacagugggcaguacaggcaggaaguaaagggauuuguacacuuugugaugugcuggcuggcaggaaagaaagugguggaguacagugguaaaggaucucugggcguguguagugggguguguucuaaauacacuuaagcagcauacucggaugaaaagaaaggaagaagcuagaagagguccagugaggacgugggagacucaggcccaauaaagaguucgggggcacuucuagguguugaagcuacaagugacacuuaccucagcagugggcuaaauggcgauaaaaccuggcucagagccaggcugugugugcugggaggucaggcuggaaaugacuguucaggcaaagucgaugugagguuguuuccuaccaggcauccagacuaaggugucuagauagagggguuggagcgcaggaguauuuugaagcuauuuggaagaccucacuaaauugagucuugugaauagggaaagccugugacucacuuaaggagaaggggaugaagaggucucuggagcuugagcaucuugcucacagauguucauacugucuuaguguagugaagaagagagggaacaucagaaaguggugaccugcaccuucuccgaguguucauuaaaccuagcaugaugccuggugggcacagggacgucagccccaaacuacucacugcauagcacaacucugggcguggugcagaccacaccacacagauccacuuuacauaacacaguaaaagggggugauuuucaguuuuaaaaaagauguuucuguuauucuuaguuaaacaauuuuguuguauuuauccagaaaagugauuacuuauuugcccucuuuaggcaaaauuacuuaauuccuagaauucuuuuuuuuuuuuuaagauucauuuuuacuuaugcaugggugagagaauaagaaugaaugguuuauacgccacgugcgugcagugcucacccggaaugaucaguguugaacccaccgaaacucaaguacaugcuccuaaccacggaauguccuuccagcccugcgaucuacuuuauuuuauucuugaaagagggucuucugucuggucuggagcuugcaauuugguccacguuagccuggaaccuguuucugccuccagagcaguaggauuaaagguguguaccaccaugcccagcucuaggauccuaaacacaccuggaaagcauccucucuccugagccaaccauaccagcuguaauuuagauuaugcauguucucuugcucuugcuuacuuucauuaauuuggggaaguguuuggaaacggaucauggaagccuuagcugcugcccgaggcaagcagaugaaaaggcggaccacagguaccuugucugcagagggaauuucacuacagucucacuuaaaucucucccauuaccacaaccuugccuucucugugggaauacacuucacuuuuaaaacauaauuuacuggaauugguguuauaaaaauguauuucuuggcagaguuuacuagagcacauuuauccucauagaagaucauucaauugguuuacauaaaagacccucaaagaaaacauuuguuuuauuacaagcacccgagaggcuuucuaaaacaggagugauaauauuccuguaaccuaaguaaauaucucaaaaugaauguagcuuccugcuuauagcaacgucugcacaguaccugguagugggccauagcuuugcuucugcugcaucauccuuuguccugacugcauagcucaauggagaauauccuuggucacaucacuucauuccucaagggacugguaugguaccuugggguguucucucaugcaggguaggugcccagaaugaugagggcccccaaaugucagugaggauacaguucuuguuccaacuggaaccugggaugguguccaucuucucuggauucuguguccccaguaaacagauucugcuuuauuguagucuugccguuuaugaauguggaagcaugcucuauacuguggcaucugcaaguuacaacaugucuguggguaaagaguagagguguucugaccuucagcccagaguuuucaagugggaauggcgguucuccugcucuuuguugucucucacuuucccuaugagcugugcaagcaauuauggagauguguucuuugcuguggaggcuuaaugaacagaaaaguagugcugucuuuuguccaugugucucccagugacuggugcugucuuguuuuuauuucccagagccacuauuaaaaccuuucuacacuuaguggcuuguugggguccaacugucauugcuuuccaaagguaugugaguccauccugacagacccucuggagcccucuuccaguuuuuuuuuugggggggggugggggguuugagacaggguuucucuguguagcccuggcuguccuggaacucacuuuguagaccaggcuggccucgaacucagaaauccaccuaccucugccucccaagugcugggauuaaaggcgugcaccaccacgcccggcucccucuuccaguucugagucuugcagugcucuucaguccucugaagggcccuaagucugaguaugguacauuugcuuacugccauuuuaccuaaagaacauuaaaaaaucgaauccuguuacacagugagcugacccuacucuccauauauauaauagcauuuuccuuugugcuuggaaucuuugucaaccaugcuuaauuucuauauuuuucucuaaucugcucccuuccuuucuauuccuuuaagaaaauuguggcuagucaguuggauuuucucagaaauuucuuauggacauguucacuuagccugaaaauuguuacauuugaauuuucgugcagauaaaacuggauguaucugccuaugauuauagcucuguauucgagugcuugucuagcaugugugagguccuaaguucaaugcuuaccaccaccaccaccaccaccaccaccaccaccaccaccacaaacaaauagacagacagacagacagauaaaaugcagaagccagguaauaguucaguggcuagagugcuugucuagcgugcauaaugcccuagguuugauccucaacaccaaauaaagcuggaaagugguacaugcccuauaaucccuacaucucagagguggagacaggagaaucugaaucaaggucaucccuggcuacauagaaaguucaagccagccuuggauucgaaacaccaucauaacaaaaacuucuauguaccagaccauacauguuaauccucaggaaccuaaccacugauagcauuguuuagaccucaauaagaaugugccacauuaagcaggguucucaguuuuuugaaauauauuaacguaccaaauacuugccauuacaucguaaggguugucuguuaaacagcagcuugcuggucauuccaguuaaguuguuacugcuuuugaaauuguuuugaggccucacaugauugucagugacucaacuggagugggcagcagucuccuuccugcugucucaccuguaauuugucuguuucuccuugacccagugugagcaguauaaauuguugcaguccuguuacugcuuccguacaggcugcccagggucccuuccucccauagcccagcugaggacagugacuucuugaaguauauuuccacucuaauauuuacugagggauuacuguuaugccacauauucuuaagauagcccuggaaaagaugguguuccagugauucauucaucuagagaaagggcaguaagagaaacccaugucucuaauaaaacaguuucuccuuacuuuccuguugccuguuuauauguagaaccacauuguguauuguacaaaguaacuucagguuuauugcacuaggagcuggccaguuaugacaguggcuagugccacugugagggagaugacauugaaugauaaaaacccaaccaagaggaaggcauuuuaggccaaauggcaacaaguagaaaagugguaagugugaggccaggguggcuagcaugguggagaauggugggcagaggcauauaauucucuuagugucauuaggaagcccugcacagaggccucaguaccauugucccaaaucugaagaaagacacauacuuaauuauuugcuuacuuauuugagauuuugacuuuucuuuauuauuauuacauuuggguuuuguuuucuguuuuuuuauauaguuucaaaaaaucaggguagccauauaucaggguuuuauugcugugaagacacaccaugaccauagcaacucuuauaaaggaaaacauuuuguuuaggcuggcuuacagauucagaaguguaguccauuauugucccagcaggaacauggcaacaugcaggcagauauagugcuggagaugaaccugaguucuacgucuugaucugaagacagcaaagagagaugugccucauugggccuagcuugagcauaggagauaucaaagcccacccccacagcgacacacuccaacacaacuacaugucuuucaacaggccauaccuccuaagagugccacccccugugagucaagcauucaaacacaugagucuauggggggccauaccuauucaaaucaacacacccuacuugcuauguagaccauguuggccuugaacucacagaggucuguuugccucugucuccucaguguugauaauaaacuuaugugucaccaugucuggcuuuuauucagagggagaggagaggaaggagaagagaagagggagagaaaaagagggagaaauuguagaaguugguuuuucgucucuaccauguuuguucuugaacucagguugagcuccaaguccuaauuuauaagagccgauuauaaguuaggcaugguccacucaggggguugaggcagaaggaucaucuuccaggccuggcauagcuauauaauuagaccugucaugaagcaaaacaaaacagaagaaaagaagggugguuggagagagugcgguuaccauguuggguggcucacacuaccuguaacuccagugucucggugugcccacaaacauguacauaccauauauacagaaaaaauaaaaaaggggcuuagcaguuaagagcauucacugcucuuccggaggucaugaguuuaaaucccagcaaccacauaguggcccacaaccaucuguaaugagaaaacaaauaaaaaaaacccugugggccagaagagcaagcggggcuggaacaagaggaagaaggcgggggggggggggggggcggagaguaaaaaaaaauuuaaaaaggaaaaccaaucccucagauacagauugugagauagucuguaaauuuuuuuaaaucuauucauuaauuuauuuuauguauauguaugucuugucugcauaccagaaaaaggcauccuguggggcuguaguaauaaauggugugagcugccaugugggugucaggauuugaacuuagauccugugaagagcagcaaugaucuuaccuuuggagccaucucucuagcccuucccccaccucuuugguuuuuuugaggcaggcuuuuacuuguaguucuggcuguccugaaauucacuacauagaccaggcuggcuccaaacucggagagcuuugcuucuaaagagcuaggauuaaaggcauguaccaccacgcguaaauauauuuauuaauaguuuuacugauguuuuuucauguaacagauuugguuuuguaguaucuagaaacuuuaacaauaauugaauacauucuaccaaaacuuuguguccuuaccugugacaagaaauacaguauugcuuaguguccuuagcauaaggacuggaugggagcaaacaccuuuaagguauguaacagagccagugcuuguguccugcuugccugaggucuugguugucccuaucccuaagggcagcuggaguccagcagugggggggggaaaaaaaaucccacaguugccgggcgugguggcgcacaccuuuaaucccagcacuugggaggcagaggcagguggauuucugaguucgaggccagcuuggucuacagagugaguuccaggacagccacggcuacacagagaaaccugccucaaaaaaacaaaaaacaaacaaaacaaaaaucucacaguuggccuucuaccucuucaaaguaggugcagcugagacuggcagaaugggcaugagcaaucuggaccagggacucuagggaccaggagaccuuggaaaccaggagacagcuugccagaaugcccacuaaucuuaacaugguuacuugugacaagaaaggauuuagcuguacagugggaauccucaguucuagaaugagagagagagagagagagagagagagagagagagagagaggaguagaguauguaugcagcaugaacagcacucugggauugcaguaggacagccugguuuauguagcgcuggggaucaagcucagccucauauauaugcugguauacauucacaaaacccaucccuagucucagaccuccugugagaagagauggugguggaguaguaauacagucauucuuauauguguauuugagauuucaggaacuaacuguucaguuaugcgcuauagacggugacagcaugaaaugcuucuuacugguguuguguugguaagaaaugacauuacuugauguucuuccagaggaccugaguuuaauucccaccacacacauugguagcucacaacucucaauaacuagcuuuuaaccugaugccaccacauauacacacacacagauguuaaaaaauugcauccuuuuuuuguuuuguuuguuuguuuguuuguuuuuuuguugauggugcuuuguuuuuagaacagggucucauguugcccagcuagccuugaauugcuggguacaagaacagccuuuaagugauccuccugccucuaccucccaaauguugggauuacagaugugucacucuuugccaggucugaucaguuucucauuauuugcuucucucucucucucucucucucucucucucucucucucucucucucucucucucucccucccucccucccuccccccccccauccuauuaaacaaguaaggaaaagaccauggugaaauuuuuuuucauuuaccuuucuuuauacaaagguuugucagucuggagagauagagguuaagagcacugacugcucuuccagagguccugaguucaauucccagcaaccacaugauggcucauaaccaucuauaaugagaucuggugcccucuucuggugugcagggcuguguagagagauccuguuucaaaacauagaaacaaaaaaauagaauagaacuuagcugaugauaacauugaaccuuaagaaguacaucagugugguugucauuugauagaagggaugcuuucaaagguuaaguggcuaacucaagucccuggccuccuauguggggaugcuuacaaauuuggucucuguccuucagaaauucaugccuuaccauguacugugcauugugcugucuguuugugguucucaguuguaaaccucacuuggaguugcuguguucuguuuugcgcauacauagaacucaugcauguauguaaaguuuaagagccacucaaggguuuucaucagaguggccauaucccucugguguucucuaauguauguuuaguuucacagugguuuucugucuuuagacagguaucaucuuggcuggcuuggagcucacuauauagccuggcuuugaacucacaguucuaucuguaucuccugaaugcugcaguuaacuauguaagccugccuugccuggaacuugcuauggagagaagaccacauuucuucccgccucugucucccuagugguggguuacaggcaggcuuacauaguuaacauaguuauuaguacaugcagcuagaacuguguugaccuggcccaagagauuucaaaggagaagaauuucagaauguggcauaaagacuguuuuugugguauuuuggugaagaauguggcuacuuuuugccuuugucugaaaagucugccugagacuaaggugaaaagacucagauuaauugcacugacaaaggaaguuucaaaaaggcccagcagagacuuuguucucugauuaagucuuaugaagagaaguuugaacaagcauagcaagcuuagaaaggaaaaaauauaaaauauaugguucaaguauuaaaggaguaccaggaagugaaauggagcaaaauccuauguucuaggagauaacaaauuaagggagugggaccuuggggcaagauccuacccagcuaaauuuagauucaggcauggugguacacaccuuuaaucuccggagacuggcaugcugaucucugcguucaaggucaaucuccagagcaagacccaggauagccaagcuuaggcagugaaggauuuggaaaacagaaagccagugacaauguaauaguaccaaggggucauguucuagucagccauguggcucuggcucuuuccauuaagaauggaaagaacuugccgggugugguggcacacaccuuuaacccagcgcuugggaggcagaagcagguggauuucugaguucgaggccauccuggucuacagaguuccaggacagccagggcggcagaggcagacagauuucugaguucgaggccagccuggucuacaaagugaguuccaggacagccagggcuauacagagaaacccuaucucgaaaaacaaaacaaaacaacaacaaaaaaaggauaauauuuucuuacaauuuugguauuuuuuuuuauuacaaauguauuuuuagaaaagaaauaguaacuugggaaguuuuucuuuaacucuaucagguauaauguccuagcugucuaggugcuagccagugugucuuugcaaauacaugaaacccagccaggaucuaguucagcaguucucaaccugugggccauggccccuuuuggggguuguauaucaugcauaugagauauuuacauuaugauuaauaacaguagcaaaauuucaguuaugagguaacaacaaaauaguguucugguuggggaucaccaugacauguggaacuuggacauguguacuaaaggacugccgcacuggggaggugagggccacugggccagggcaggcagcuuaggaugcagccaugcuggaguaaacacuugugugacuucaucuccugagaguucugagaacaccucaaaguuacagguuuauuuuuaaaauuaaagugaguuuaacacugcauuuguuuuagggcuuggugauauuccccgaaauagaaaaauaaauuaaauaaauuuaaaaauuauaguuucaguuccuuuauaacugaggaaaagaauauagagaauaagauaaugaguugacacuuuauuuuagguuuuacacaaugagcaauuuugcuccccuacuugaaguaggucuggcacuccccaguucaugucagugccucagccugggcugcuaucaguaguacagaaugcauuaauaaaaacagguugaggacccccuccccacuagagucaugucagaagcucacccaucugcaccaaaacaaaacugagaagcuaggguuaagagccaaggcauacgccagaaaagauaccucaguaggaagugagcuugccgcaaagaccucuuuccuaaguucaguuccuagaaaucaaguguuggaaugauagagccagcuccugcaaguuaguggcuuacucaggugcacagguacauacaugcaaaguaaguaaaugaaauguuuuuagucugggaguaguggcaccugcccaucaaguauucuaaguuauuuuaaaacauuuaauuuuagagauuucuauuuuguuuuaucucuuaaaguuuguuuuauccuuuacuggauuuuucuuucaaaguguaauacggagccuaggauccuaugcaagcugaucaugugcuuguaccucugaguuacaccccagggcaugugugauagccucucaggaggcagaggcuggaggacaggaaggggcuaguccagccugacuaaguaaagagcuugccucagacaaaagacaaaggaaagccucaagcuacaagaugucgcugcaccagucuauagguuauuguuuggagaacuuuugugaauugcugacauuaaauuuuggcauguuuuucuaguuaaucuauaugaauaaacauugaaauaaaaacauaauuuucgccggcacaugccuuuaaucccagcacucgggaggcagaagcggguggauuucugaguucgaggccagccuggucuacaaagugacagccaggccuacacagagaaacccugucucaaaaaacaagaaacaaaacaacaacaaacaaacauuauuucaaaacaguagcccaguguguaaaggcauuaggaaaacuggagagagcuaacagcuauuccgagguuuuagcuguuucuaauaacccuugagcugcugagucugcggucuaguuguaaagcagguaagguuuaggagaagauagcuuuuaagaaggauggucuaucuucucuuuuccuccaagauccucucuccuuucccauuccuuuuuucuuccuccuucccccugugaaaucuuccuucucuuccccuucuuccuacacaaguggcugggguuuuuguuuguuuguuuguuuuuguuuuuguuuuaaaguagggcuuuuggaauaagacacauugaugcaaguuggaaagacaaguuguaacaaggaggcuugggaauagauucuuacauuuuggcuuuguaaguaaaguggggguaucuacaacuaauaaucaguaaauaaauugcauguguaccgcuggauuuuagucaauuaagcagucagugcuauagagacuuguucucauuucccuuacuguucacaaacuuucacuaagaugcauccacacauagacuucuguguuagaaauauagagcaggaaagauuagggccuggccauguuggagccucagucuagugaaggaauggagauuauguggaaaaauaaauaaauaaauaaaacaccccuaacuguucuguauaaacuuacauaauguuuugaugaaaaacuaauucuuuuuacaaaagaugccagauuuuucagaaguucuaagaaugaaagggggccuagaucuaguuuuauugcucauuuuacaaaugagaacacuugaaucuacagaauugugagggcuucuucugggcacacagcagauagugugauuggaguaggacauguuucuuucucuacuggcccuuaacucugucccuagggacaggugacaggagcaugccauaagcuguuucugccaaguucuuucacuggucugcuuucccuucuaucuguuaaaugauagguuauuaaguauuuccauccaguauaaaagaauuucagucacucauuuagcauauugauuaagaugacaaguuccuucaggagagaugaugcuuauguucuuguagaggcccugaguucaguucccagcacccaucucaggaagcucaacaaccuccgguaacauuugcauguguguccacacagaucucaguguagacuugaaauaacuggucugugaaaguuagguugaaaaacaguucucauuuuuaucucaaaaaacaaucucugaaauaacagaaguuacccuugaaaaucuugucagaaaugaucuuucauaaauacuggauuucacuucaaucucuuuguuauccauagaggauccgaugccuuccucugaccuccacaggcacugggcgugaagguugcaugcagacagaacaccagcagacgauggauggguaggcagaugaguggauagauggauggaugagcagauggguagacagauagauggaugaauaaauucacauuguauauacagguacuaggcauguaagugguacacaauguacauagugcacacacacacacacacacacauuguaucaguuaaaauuuguggaagaguagacugcuuuacuuugcuuuguuuuuggacauggucucaugcagccagggcuggccucagauuugcucaguggcaggauaucuggucuucuugccucuuccuucucuuguuuauuuuuauauauuuaguacauuuuagggucagggucuucaucuagcccagacuggccuggaacucagagcagucugccugccucugucuuuugaguggcauuaaaggccccgauuuuauucuuaucaacuaaauaguugauucaaagcugcagccacuagggcucacuugcccuuccuucucucuacuuuccucuacaaagaagcuuucccagugcugagcuggcaugccggccugugcaugcauguauaaagagugcuuucuaugaaauguccacauccggccuugagcucacagucacaccacuucccuuugaccaauccucuaaagcaggacucuaaacauucucacuuauccaaucccuuucucuauuuuuaaaaauagaaccaugggguacauauauagguguucaaauagguauaaaauuaaauguggauugagaauaaaugguaaauuuaaagcguuuucugacauuuuaucuuauuuuauuaauuuuauuuauuuuuuuaugaaacucagguuagcaacucaacagcuuuuaaaaucaaacauugcaaaaaagacaacacagaaaguuggcauagggaagaucuugagugaaucuuggaauggggugaagauacacuaugaaauucuuggagaauuaauaaauauuaaaacucaaaaauuauagauaccacaguauaauucagagauguacuaauuugauaauaugccaaggaauggugggaaaauacugaaagcuuuuuuuccuaauuaaaaguauuguuucggggcugucgagauggcucagugguuaagagcgccaacugcucuucugaagguccugaguucaaaucccagcaaccauaugguggcucacaaccaucuguaaugggaucugacgcccucuucuggugugucugaagacagcaacacuguauacaauaaauaaauuaauuaaaaaaaaaaggauuguuucaagcuggguguaguggcacacgccuuuaaucccagcacuagggaggaagaggcaggcggauuucuggguuccaggauagccagggcuauacagagaaacccugucucgaaaaacaaaaacaaaaaaguauuguuucucuuacagcacagaacuuuuuguguauaagaaacuagcucauggcuggagagauggcucagcgguuaagagcacugacggcucuuccgaagguccugaguucaauucccagcaaccacaugguggcucacaaccaucuguaacgagaucuggcgcccucuucuggagugucugaaggcagcuacaguguacuuacauaacaucaaucaaucaaucaaucaaucaaucaguguacuuacauaaaaucaaucaaucaaucaaaaaaagaaaagaaaagaaacuagcucauaccaugcagucgucucaguuccagcuaaggugugugagacaguuuuacuuggcaugugugccugucugcaugcacagugcaaagcgcacacaucaugugcucugcuccaggcaaggcuucagugaaauuaccuuggauacauuauauguuuggauuugaguuaggucccagucauuguguguuuacuauaaccucacguucaguuacgcaucgugaagcauaaccuugcauuugcauuucugguuacuagagccucuuacuguuucuccaugagcaggcuccagugucucaccacuuuuuugaguguuugaaucauaccauagguguuaaaugauuaccaggcuccucacuccaaacacuagccuaguugaagcuuuuaccuauagcaauaggaggucguuuauagagaagguuugggauagagagagcuggguuuggccuuuaccaguuaauaguagcuaaguggcuguggguagguuaagguuacuuaccuuagcuaaguggcuguggguagguuaagguuacuuaccuuagcuaaguggcuguggguagguuaagguuaccuuaaggcucccucugauucuuggaugcaaaaggggguaaaauucuuuccagagugguauuuuaaagaaccugcugugacuuugcuuuaucuaaaaaucuuccuggcucuuuaaaggccuugcaugauuuggccuaauuugucuacccagcagucaaacuucuauuuugucuagcacagaacucaccagauccuaaagucuaaguggguaauuuguaaaccgcaagcuuguuguacuacaguaaacacaugagaauguacuuuauacuugcuacuccgggccuugcagucuuguguggaaaggccacugaacucgccugcagaaccaugucuguggaugccguuuugccuuagagugaaggcugguuuuagcuggugucauugugauggagcccagagacagaagcagcuugugcucagagcggcagaucuggcuggcuggagaugaacauucuguccccuguucagguuucuggggacuggggacuagugcugcagcugcugcugcuccaggacuggcagccaccccuccugacagaugucuugccaagagagucugagugcucuaauuuuaucacuuuagcagugucuugccugguaguccucacucgaguggucauugucagcaugaacacccacuaacagaauuucaaaguggcaacuguggauggugcauuuaguuaacuguacuaggagagguauguaggagagaaacugcaguuuaguggccauccaacaaguaugucuuaccucagucuccugcucaugucuuagacuugugagcccuggcucuuuaaagaacagcccaaccaaggggccaaauaaacucuuuugaaguaauucuguuccuuaaaauuaauuuucucuuuauaagccacaagcuaaucugcaugaaucuguaggguguguguaagggcaugguguccaugucagguggcuccugcagucacucuccacccuuacugacugagaugggcugagcccaaaucgugugauguugguuaauaggccaacaugcccuggaaagucgccugucucagcccaccaugcugggacuacuuguguacacugucagucuggcuucaugaaugcuggccaucugaaucccaggcugcacacgggaagcacuucauuuucugagcugucuuccuggcauguuguuuguuaccugugagaaguguuuuguuuuguuuuguuugagaacggcuucucugucucucaguuuauaacucaggcugucuuucaacuugcagaacuuugccugcuauugcaggaaugcagcaccacauccaguuuaaaggauuuucuuaucaguuucugauauccacaccucccucuguuuauccuuuauggaacauuuuuccuguuguuuguuuguuucuugaaccuucuuuuugcauuuuaauguuuuagaucucagcugacuuucccuggagguuuugaaaucugugcuuuuacuuuuaauuuccagaaggaaaaaaauauuuuugucuugaaauuuccuuuucucuacaauuuugguuuccuguugcuggcugcccucuaguuuuggucauugaauuauauuuuauagaggcacuguacuccuugguugucuaaugcagauguaauaccuguauugagagcugggcguccaucugggagcugaguagaggaagaaaacugagggucuuauuguccacagcaccucucuccucauccauauuaaugaccuugguauugagucuuuccuauuguuuuuucccccaucucuagaagauacaaccaguuaagugaaauuucuguugcuacuuaacagcuuacugcaaauguagcaauucacaacaaugugcacauuuaguaacuugggccgguuuggcucagucuccugcucagggucucuuaagccugcaguccaaaacuggcugucauguguccucuuuaaaaucccuuccaggcuuaaacagucucuggcccaaucugguuccuugcaacucuaagacugaggcuccgugcuuauaguagccacuuguaauucucuggccucuguggggaguuuguaucacagcaagguuagcaggugacucugcugucugacuguaaagacagagccuuguguaaguuaagcacaaccuggucuguggugugguuucggcuauaaggaaguugaaacagcccuucuuagaacucuaccugucacagagguucucgugacuuccccuuggcacuuggagccaguucucccuugaaccaaacauucucuuguagcacugcagccuccagaggcaccacacuuccucaggagacuguguugacugaugcacuugagccuaacuuguuucuugucaacccuuugccauuaucugcuuucuaacuuccuagccuuccuagcucuucuuuuccugcccagcacaugugucuuuuuaaaagcccuuacugcaaugcugguggagaucagaggaauauucacuauaccaucuuuuauuuuaucuguucccuuuaaggaagaaaaaaauuccucacaugcuucauuuuuauaucccuuugcucuuuaauuuugguuuguucaggcaugcauuuggguuccuuaacccuacuauguaucuuaaaggcuacuuuucaccuugagcugugaguaacugucuucuuucuaucaaaccuuuauuauuauuuuucuuugcuuuuaggccuuuuauaugaacuuagauggaauacuuagcuaccuaagccauuaguucucugaaaauaugcuucauguaaaauugaacauucagaguuaagcuuggugacauaugccuuugcucuuagcacucaggaggcagaccaguggaucucuaauucaaguuccaccuagucuaaauauaaguagcaaguucuaggccagccauguauacauaguaagaccuuaucucaaaauaaaaugggaaagucauagaauaagacauuuuuauuagucaggaucuugcuuuguaaucuuuuaguauuagauauuaaauggcugucauuuacggaaguaaaugucaaccugagcaccuguaaaauguuccacaccuguguuucacauuagggccuccaggaggugcuguaguaccuagcuuuggguuaaugcucagcuuaauaaauagcuguguaauagauagacagcaggauggggucacggaagccugagaguuguugguaagaagcagggagaugcaagcccagcccugacuuuuacagggcauuuccacacucaucagucucucauccugccucuaucucuguaggccauugaagccaagacagaugcaagaugacacuucuuugcaguaaauaguucuuuguggauucagcuugcauggaggaggagagaacaaaaaaguacuggcauuaucuucccaggugcugcuacagcagugugucauauuguauccucaggcaaggaccaccucauaguucagucuaggucaucccaauggcugccagacaucucaguauccagcuacggguuggaauggaacagaggggaguggccuuacucuuagguugcaccugagaccauuguauccuucuuugagcuuugagaugggacuuuuggaauagugcuuauuucuuguuuucuuugcaaugcacccauaauauuugaaccauuaguugucaagggcuucugauucuuuaugaaggugggagucuucacuuucagacagucacuuuauuauagaaguuccucuccuccacacaaaguucucugugcagcaaguuuauuuucaacuacugcauuucuauaaauaaaauaaauuuaauugcugugucugugucugucuuaucuaucuaucugucuauguguguguguaugcaggugcauauauaugugucuaucucucuucccaggucaguaucuacuuuguauaucaagacagacuuucuuucucucgaaucucuuggauugagcuaguguagcuuacuagcuugacuugggauuccugucucuaccucuuauguuggacuuacagggccuagccuugcaugggaacgagggaucugaacuccaguucucaugcuugcaagacaagugcuuuacuaacugagucaucucucuagcccucaauucauuuguauuuaagacauuuuuguaacaccauguaguagaucacaaaauauccuaugguuaauccuaguaugaaagugcuuaagcagagugggaaaagcacacaugaugagcaauauuagggguaagccccaaaaucagguagguaaccauugucucuugcugggugugggagagacuaucacuguaggcagaaagcuaggacugcuaagcccaaaugaccgaccaccugacugccuagaaacauaacuuuaagaacaacaauaacaaaaaacugggugacagaaccaguaguaguuuucaggggccaguaagaugcuucuaccuucauguuucuuauacacacaccauagauuuuacucuguauaauucuacagguucuuaguuuuuaaauauauuuuggcucuauacuuaaauagcaccagugauauauacuaccaucuguaccuucuccuuuuccauaggacaucuuucugcagagaggaucucuaacccacaccagcagcuccuuucgcccuuggccuccugcccuaguaacauaaguccuacuuccuguaucgcuagcacuagucaucucuucugagaggccuugcuugcucucaucccuagcaagggagccuuggcuccucacaucugucccaaccaguuccaucagucacagucccaaccaguuccaucagucacagucccaacucauacaucuuccagcaauaugcagccuccccuccacacacccucaucagucccuagguauauccaagaucguucaucagcccugucuacacuaccacuaaccucugucuaggcuugaagcaggaugcacauccugugcagcagccaagccugcuguguccaccuaacuucaugccacccguacccuauccagucuucagacccaacuugccuuccaugucuuguguccuuugacagcaggccauuucugaugaggaacuaacaaaaggaguacacaugcccaaguuucacuauaaauacaaauaaugaauuuagaauaaaugccugagcaauggccaggaaaacaaaaacaaggcuagaaaagaaaugguugagacaauccaggauuugaaagccaaauucaauaagaagguaagaaggcccuuugugcacagcauacaucuuuucuacuuagcaagguccugcauaucuugggccaggaucucacccagaaguuugacuuuucauccccaguacccucaccaaugcccaaauauauucucaaacuccagacuuggaccaggacucucauauccuguauacccaacacuuguguccuucugauuucauuccacauaaguuguagcuaaccuuuagagacauuguggccuccacauccuguguucugcuccaaccugcagggauaguuccuucugaggaucguuagucucuccuuacucaucucagccuggcuucuaguacuaucaacuagagcucugccuuucugccucucucucucccucucccucucccucugugagugugugugugugccuauguguuccuauaaucuuaaguucccuuuuaccuuuuaugagaauauuacuuuaugaauugagggccuaccuugucuagaagaauuucauucuaaucaauuacaucugcaaugaugcuguuugcaaauaaaguuacaagacaaguuacugagauuuaggacuucaacucacaaauuuuuugagagucauaauucaacccuuaacacauacauggguguauguagagguagaaaccaguuccucacucacgcuggccauucacuacugugcuguauauaccccagcuuuggggggggggugcguauacagcguguauucauguucuucucucauacaguauaccuugacuccagccucccuaccuccacuccuuccagugcucccccuccauuucucauuuccuucagaucuaccacucuuuagaaaagaacgggaaucccagggaucuaaaccaaguuuggcauagcaaguuacaauaagacuagacacaaauccucauauuuggacugaaggaggcaagccaauaggagaaaggggguuugaaaaucaggcgaaagagucugagacacccccacucccacuguugggaaucccacaagaacauauaugcagaggaccuggcucagaccuauacaggcucugugguuguugcuucuaucucugagccccuaugagcccugcuuaguugauucagugggccauguucuuuugguguccuuggccccuccagcuccuacuguacuuccucuuccucuucuuugugguucuuccuaguguuuggcuguaggucucugcaucugcucccaucaguugcugaugacaauugggcuggucacuuuucuggcguucuggcagcaggcauggccucugggugagcaggggcccuuucuaugguccagaaacauccauagguugauguccuuguuuuuuauaugacuguaauguuacauuucuugauguguagagugugguagaugucaaaagaauucaaaguuaagaaaauacauucgugaaaauugucuauuuuucuaaaaauauuaggauacuauucugacuuuguuuuaaauuaguaauuaauugagcaucaauuaacaauuuggcucauuugggguuugggcaucugaacaaagaagaggcacucucuuuugguagauggucuccucucuggcuuuuagaucccugcuauugcuguuguuaagaguugauuccaagaguuguugcugcugcugcuguuuuaagcugauuuggaguaagcuugccuuugauuugccuuuuuguagcauuugaguuguagcauuugagucagcucccuaacaguggacuaggaagaaacaaagaaauagcaugugaacugagagguagaauucuugauguaaauguagggaggaauuuuuacuuuuccuuguuuuuaaaauggcuguuuuugucuucuguuuaaugugacuacugagccacaagagacuuuggaaccauuuuaaccauggucagguuuuagggaccacugggcagaggugcuugcagccauucuuagugacuaggacccacauaguggcaggagagagccaacaucuacaaguuauucuuugauuuccacauauacagagagaauuaaauguaauauuuaaaagcauuuaaaaugaaaaugagagcaguuauaaacaugcuugucauacugcaucuuugcuggggaaaaaaucagaaacggaguccauaauaguuccuugucuuagucaggguuucuauuccugcacaaacaucaugaccaagaagcaaguuggggaggaaaagguuuauucagcuuaugauuccauacugcuguuuaucaccaaggaagucaggacuagaacucaaacaggucaggaagcaggagcugaugcagaggccauggagggauguucuuuacuggcuugcuuccccuggcuugcucagccugcucucuuauagaaccaagacuaccagcccaaagauggucccacccacaaggggccuuuccccuuugaucacuaauugaaaaaaaugccuuacaguuguaucucauggaggcauuuccucaacugaagcuuucucugugauaacuccagcugugucaaguuuacacaaaacuagccaaacaguugaccccuugucaacuugacacacaaacacaucacuauuaagccucaacccuuauucuaaauaacuuuaaacaucccacagucuuuacauauucuuaaauuuucaaucucuuuaaaauauccaucucuuuuaaaaauccaagucuuuuuacaauuaaaagucucuuaacugugggcuccacuaaaauaguuucuuccuucaagagggaaaauaucagggcacagucacaaucaaaagcaaaaaucaaucuccaaccauccaaugucucggauccaacucauguucuucugggcuccuccaagggcuugggucacuucuccagccaugcccuuuguagcacacgcaucguccucuaggcuccagaugccugaccuccgcugcugcugcugcuccugguggucaucucaugguacuggcauuuccaaaacacugcaugaccccuucaguccugggcagucaauugcaacugaggcugcaccuccaccaauggccuuccauggccucucacaaugccgagccucagcugcucuucgugaccccuucaugccuuuaaaaccaguaccaccugggugacccuuacacaucaccaagucccgcugcagcaggaguacaaccuuggcugucucuggaacauagccucuuugugcuuucagaaaacacuucccagaagaugucaccucaacgaugcuggucucuucuuaaucguugcuaauuucuuagcuccagcuaaccagcaucaauagucccaguaaugcaaauuuuuuugcuuuaguaguucugguaucuuguuaaucacagcugauucuucagccccagcuaaccagaaccacagaaucuucccaaucaaaacagcaauggcccugaaaagagucuuuaauuuucccucugaaauuucacaagccagaccuccaucuucucuguucucaacauuaucuuccaggcuccuacacaacaucugacagagcucuuaacaaugaauggaucuucaagcccaaaguuccaaaguccuucuacaguccuccccaaaacauggucagguugucacaggaauaccccacuauacugguaccaauuugucuuagucaggguuucuauuccugcacaaacaucaugaccaagaagcaaguuaggaaggaaaggguuuauucggcuuacacuuccacacugcuguugaucaccaaggaagucaggacuggaacucaagcaagucaggaagcaggagcugaugcagagggcauggagggauguucuuuacuggcuugcuuccccuggcuugcucagccuucucucuuauagaaccaagacuaccagcccagagauggucccacccgcaaggggccuuucccccuuaaucacuaauugagauaaugccuuacagcuggaucucauagaggcauuuccucaacugaagcuccuuucucugugauaacuccagcugugucaaguugacacaaaacuagccagugcauuccuggucuccuccuugggcacccagguguugugguauacuauggaagucaggaacugggguggggauggagguuugaggccgaccuuuccacugggggcaucugugugccaggcagagagaggaacaagggcccaagaauacugggggggggggggggagggguuggggggcuggagaggagaaagccuuucucaggaagcuuagaugcugcucuuuagcugaaggccuuccccaagggguuccuuaaugaaacagcugagaugaaccuugcuuguucaugcugguuuauuugaugguggauaugaaugcauauacuuuauucagagugaaccaggaauuaaaugucucuugggagaaggaauacccaaaaggaaacucauuggcugcaggcuuaagacuaucuagauaccucauuagcauggaaaauaacuccagguguuacuuuaugugccugauugcccaugguccucucaguggaauguccagagcagcuuacauguuccagagcagguacaggggcagauagggaauagcuccacaccugccguucucaguucugagaugcccggaguuugagcuuauucaaccuuaccaguuuuaugacugacugguaacauggucccacauacccuacacauccuauggauuacuuuagucuuacccaugaugucauacuggagaagaacccaguuaaucuuauucaaaucuaccuugguugugucaguggcacuucuugcuaccugccccaauguucuagguuccugaaugaaacgcgcgcgcgcgcacacacacacacacacacacacccugauugauugauuuguaaauccccccaagucugaaaucugucugggauaagucagugagucaccacugaaaacuuauuugggccuaagaaacaggagugagugugucuuaccucagauccacacugucuacucuggaacaagauagaacaguuuaaguggugugaguagcccucugacaugaggagccuuaacacugcucuucagccagagcucacuuaccuagaggaacccagaauguuugcuuuuuuuuccaccacuuuauuaguagaugauuggauccuaucucuucaccucuuguuuaauuuucaguguaaaacuauguucuagaaggagugcauggccacugcucuaaguuaauaaugcauuccugggcaacacccuuccucuugucccccaaguauagccauuauugaaaguuuggcugcauugugugcuccuaaagaugagguuguuuguguacugcuauggaaauuguuugguuuuguuuucuuaaauuaauacauuguuauguguauucuuccuguuuacggugcuuaccucaucucauuuacaagccacauuuuuauacuacuaugugcuugucuccuagccauaauuuaguuuagggagauggucaguaaaguacuugucuuuacuagucuauuuuuaaaaaugccuuucgaauacagaaaagguuacuauguuguuaauuuacauuucuuuuuguuuuguuuuguuuuguuuuguuuuguugugagacaagguuuuucuguauagcccuggcuguccuggaacucacuuuguagaacaggcuggccucgaacucagaaauccuccugccucugccuccugagugcugggaucaaaggcauaugccaccaugccuggcuuaauuuacauuucuauaugacuaguuaagauugaggauuuauuagcuaguaagucucccgucuugagcagugccuaugcaugguuucuauuguuacuaaguuuuaauacuuaaguuguuaauguuguugacugcaauuuuuuuuuuauccuucuuaguuugguuucuguugccaugauaaaaccccuggccaguagcaacuugggguuggggaguuuuauuucgguuuauaaguuacaguccauccuuaaggaaagccaaggcaagagcuugaagcagaaaucguggaggaacacugucuacuggcuuuuucaguucccccuuucauacagaucaggccaaccagcccaggaguguaccacucacaguggcugggcccuucugcaucuaauagcaaucaauaaaaugucacacagacuuggcugcaguuucgguaauuccucaacugaguuuacaguucccagguuguuuagcugacaacuguuuacugacuaugacacuuucacuccaccacuuuccccuauacuuuguuuuuauugucauucuguguagguuuaacaucaguggcaaacccauuuuggucaaaggagcuaaccagcuauuuauuguuaaauaacaaaacaucugaacacccacugauuauuguaacuuuucuuagacucagagucuggcuaguacaggguucgcuugggcucugguaacaguuaggggcuggcuaaauucuucgugcacuuuucuacuccuauuucugggauaggaagaagauagcuacaacuggcacauguaugcuaucuaugugguucccaucgucugggugacuucuccaaugaaucagccuucuguaggagguguugaguguacaaggcacauaaaaaaggcauugcccauguagcagaugacauaauauccccuuuagcauauucauuauuuguauuuauguauggguauuugugcauggaagccccugaugcuggacucuguguagaugaagggaauggcgccuggguccuuugcacaagcugcaagugcuacuaggcacuaagccaucucuccagccuauauuuuucuuuuuagagaaagaaacaaaaggacucaauuugguugggaagucauacuucauagacuuauauauaaauuucaccagcuguauuaaaaagcaguuggagcauuuuuaaagaaugaguuguuaagagggcuccuuugaacgaccaauuugauuugggcaccacagcucuaggacagugauagcuguugccuaggcggaguacagucucugucauggguuaaaauggcuucucccacaccccaaacugugaaacuaaccagguacauuuuuuucuagguucuaguaucuguuguugccucuuccuagcuggcuuggaacuugcuauguagaacaauuugggcucagacucauggagaucugauugccucugccuccuaagugcugacauuaaaccugugugccacuaugcuggggucugaacacagaaccuuggaaaugcuugguagaaugcucuaccucugagcuuuauccugggucuuugguuuuuaagaucagacugaccuaaauuuaaaauagacuaucauaccugccuauauuuugagugcuggaauuaccauugucaccaguauguuugauacccacuuauuuuaguuaauuucacuaagguuuaaaauuauuuacuuaaugaguucucugguguuuugguuauaggcugacaagagcuagacuugauggcacguaacuauacuggaguuccaggccagccugagcuguacagcaauaucaugucucaagccaaagaaaccauucuuagaagcugaggcugugugguggcaucaugguagaaugaccaagucccaggguucaguugcuagaaccaccaaaacaaaaaucccauucaacuuuuagaccauuccauuagacccaguaaugugacuguauggcuaauauuuauggaguuuuggucuauucuaaauuaaaacaaacauuaaaaauauaauuuuaaacuaacaauauaaacagcauucuaaaugaauuuuccuaaauuaaaaaccuuagaggaacagcgcuauuuuccauaucugcaaguugcuuuaaugucuagcauaauagggcacagcuggggucucaucuguucagcccuccccagcacagcugcagccgcuggaaaagcccuggaaguaccagcagaucagcaaauggcacuuugcaucccugagaaaccuugaguuuauggguacuugaaggggcugguaggagcuccacuuggccuuucucucccuguccauaaaagccagcuuucucugaaagaaugucuguucucugaagaaauccucaugaguccuggguugaggguauauuccauggacuggaucuucauguccuccaaggaggaugcugugcagguuggaggggaaggcaaggaaguuccaggcucaacuggaaaguaugcaagaauucugaaaucccauaagcaggacguuuauuaaaugacauucuuuuuagagcaacaggggacuacaaaaaaaacacuuaaaaauguuaguacuacuaauaaaaaucuuaccaagcaauaaaaaccaguuucaugucaacaguaagugaccaaaacauuauuguaacaaggucccaaaguucccagccccuggaucagccccuacuugcauucugagauuggcagcaguugcagcaugaagcugcgcaggcagugggaaagaauaaaguguuugugaaucggcccacagaacuuuguaaauugguaaauuccuuugugagaauuuuaguauucuuucaaagcuuuccauguggccccuuuagggcccagcacugccaaaagauucgauugguuuuguggucagaaaguuugaaugaguuuuagggagacuuagggcuuaguaagagcucuugcuaugaaagcagaggguccuaacuucaaauccccacacucccauguauuccuucaaccccuguguugggaaucagagacagagugaucccagaccuugcuggguagccagccugucacuaacgguggacaccauaaaggacacagcaucuacugcauauguacacugaacaugucugaauaaaacuggguguggugccacacaccugcaacccuaacacuggggggcugaugcaggaggacccaaggguccagacaauauugcacuacaucauuucccucucaaaacaggaaacaugaguaagaccugcacucccccaacugccacccacuuaauccacaauacuguagaugaacuucuguccuaaguaguucuguuaguuuucuaaggauauggucuuacaguucuaauuguacagaacaccacugcacugccagaccagaaauaaaagcauauagcuuauaucaguuuuauuuuuaaaaucugaugagaccagugaaacgacuugccugguaaugguucuuguuuccaagccucgcagccugaccucuauuccugaaauccacuuguuggaaggagagaaagaacugaagguugucuucugaccaacacacacacacacacacacacacacaauaugauuaaaucaugucuuuauuaaaguauugaauguaaaugucccgguucauuauauugucauuucuauguauuacuagaguauaucaguugaagaacuagucagauaagaauagaaaaagugaugucauuguuucaccagauaggaauacugccauauaauccuaaacaguggugcauauuuugaccuuuagauaaaguauuguuaaacacuaguaugguagugggaggaaauuaucacucuccagagacaacguaagacagauuuguagccagaugacugccaucauaccuguguaacugcccagauagauuuguuuucuuccuaacuugcaauagauugcaaaaucucaagauucuacagugucucuaggugaccagucagccuucugcuuuauaaaaaguuacauuaaaaauuccuugugaacuuagaagguggcggcaggaaggaguccaaggucagccuguuaaacauaaaauauguuuuuaauuucuuggaugagcuggagagcugagccagggcugcucuuccagagaacuuagguucaauucccagucccacaugacaacuugccaguauuuuuaacaccaguuuucaaggaucugaugcccucuucugaucucugcaggcacugaauguauguggugcacagacauauaugcagggacaacaccuauacacauaaaaauaauaauaaaguuuguuugaauucccuagagaaggcugaaaugggacucugauguagaguuuuugcuuagcuaccaugaagaaaaugugagagccccaggauuuggacccauuugaaauuuucuuacuucuuguuagacacucccuauuggagaguggaguguugguguaauaagaauuaggaauuuguagggaugccauucuugacuggguacugaagccagucuccuucccuuuagugaggaaguuacaacuccuugggcccacuuuguuccaguaaagaugucuagauuuccuggacaccagugacguguggugugggagccaggucuuguacaaccugcuuagguuugucuuugguccacacguucuuuccaaggguuggugaccuuguacccagcauuuucaucuccucuuccuguacagacuuuuacacagaugcucacuaaaacaugccucuccccuuaguccaccacaccguaaaaguccuagguaugcugagugcguaggucuuauggagagggcaguguuggaagaaaggaucuacccuauagcaaaaaaagacaggauaagaaaugaauugugggaccugcuguacugggucaggcauuuaguuccagcaugcagagccaggugaguuugaagugauccugaucuagcaaguuccaagacagccagggaacugucucaagguggguggggaaaguaaaagaaagggauuuuugaauaauguugucagggaauauagacaguuguggacuggauuuugacucuaacagaacuaaguacuuccaggauugaucucacugcagaguuauaguaagaguggggaaagcuacaauaaaaugauaauuaaaagccaaacccuaggaaaagauaauuuguauugccaguuacuguccucuauagcugaccuuuaaacuugaguguauuuaggaaucauuuagggaucuaguuagaaaguaagugugugcauuucuaauaaaaucccaaggggugguaauguugcuuacuuagggaccacacuaauagcacaaauccaacaguaauaauagccauaugcauuucuuuuucuaaagcaggcacagagcaguaaaacaaugauagcuauuauuguaacaaaacuacaacucuuuccuuucuaagcuugaccuugagccaugcucuccaaggcagggcuuccuggccucagcacugccgggaucugcagcugaaguaauuguuuugugcuuuguagaguguacuucagggugcuuagugcugaccucuaccuaccagguacuagcaguacccgccuucccauguguaacaauccagaagugacuucaaugcaggugaagguuugauguuagccucuguggccaguuggcagucuuaacccucuugcucccaaggggugccuuuuauggaguagcagucaaaucaugagugccagaaaaucuugggcucuguuuuaaaacauuguuagcucacauggacaucagaacccuuuucucuacucucacuuccugcugaugucuacuugucugcuucuagcucagcuuucacgguccuuuauuuuuuuucaaucccagcacucuggagguagagguaaauggaucucagauucaaggacagccugguccacauguguauggaaaguugguucuguccaccaugaggguucuguggauugaacucgggucaucagguuuggcagcauaugccuuuaccugcuaaaccaucuugccagccugacaaugaagaguuuucuguggcaguuugguagaauaguguugauugaacuuuaaaggccuuagcucuccucugucacuucgggacaagauauccaagacuuaagugcuagcaguuuuagugcagugaggaaccauuucuuaguuuccagacagcugucuuguugcacuaauccucggcagguaagaagcaaauguucugguggugaggucuuauuuaggacacuaagcuuauacauaaugacuucuacuuucuugaccugacuguccccaaaggcccaaccuccuagugaccaucccacuggaagcaagggacacaaacaggcuaacuuuugauaauugagaacccauucuguucucaguaaacgaagaagcaaagguaacuuuuuacuagggggaucauaguauauuccuaggagagagcugguuaagaucuuguuggaggcuggagagaucacucagcaguuaagagcaccugauucucuuccagaggauccagucaguuuccaguaucugugucaagcagcacacaaccacaugucacuccagcuccagggaucucaugcccucugacuuguaagagcaggcagugugggggcgggggggauacacaaauagaaauaaaucauuuuuuagucuuucccuguacccuaccuuaguaguaagaaauuacuacuacaaagaguauuacuacucuauaggucuuagaaucggagugcaaguuuuacugcuguugcuaagguacuugaauacagagcacucuggaagccaaugcaauauuuuagaaggaugguauagccgaguaaggguacaaccaaguauauuguauuuaacaagaaugggguuugguuaauggcuaaugaaaguucguguuuaguuuaacacugaagugaaaacugauuacaucauugacauucgccucucucacucacuaauuuuuauaagguaggaaguauaggcaccaacuuggaauuacccaugacccagcauuugugagggcugagugacuuugaagacaguuugagcuacucugucucagagggccagaagaucuucuagcuaaagcaaguguguguguguguguguguguguguguguguguguguguguguguaggcuggcuggaagucaaauguuguaugucuuuaugucaguguggaguuuaaaacucugccaaguacuuuaguuagggcaaaaauucuuguuauuuaccagaaaugaugcagcaaugagaaaacuugucacugaaugaaaaaugaggacaugaucacuccuagguaugguuagauuuuauuguagauaaaggggagaacaggcagagacauugggagaguccagacugagccaagcuaacagacugaauggaguuauugggcauggggauggggaggacaagaaaagggggguggggcaagcugaccaagagugaaacaagagcucaagauugcgguguggaccaagagagccauagucaaaauagcugagcaguacaaugaagagaaggugggggaagggaagcagaagcccuguccccaggucucacccuggccugggugagaaguguuuggagaagccacagguacugagauuugcccugaguuucuuugaaucauaauagucagcggcuuauauucuaagaaacgaaucuuuaauugauguuuaccuuacgcuugagaguugaagaaaguucaugucuagcugcagcuagaguguuuagaaugggucugguguucuucuguccuggcucacuaccauauucuuuaugaagagaacccagacauuaaaccaaaaggauaaggggaggguuuuuuucccuuuucugaugcaaugucaccaugucuuuaucugcuccuguauuauuucacagugcuggucccaagggugacaacaucuaugaguggagaucaaccauucuggguccuccagggucuguguaugaagguggaguauucuuccuugacauuacuuuuacaccagaguauccuuucaagccuccaaagguaaggagucuccagugucuccugacauuaacuguuccuugagagagaucaaguuuucauuguaaucacaaaagcuagagucuuccauuugugugcugcuguccuguuaaagcauguuaguaacagcuguguguacugcgguacagucuagaucuguguggcagaagagcucagcuuccuucuguguauuguuugccaguuuuaagugaaugugaugacuguugguuggguuggcuccucaguaggcaauaggcauuucuagauguaaaugcuuaaaacugugcuaguuauugucuagcuuguuagauuuuacgcacacuccgaagcaguguauuacuuccagcuaacacaagaggucagcaaacaacuaacaauccaaacuuaagacauagucauauuuagaacauuaaaauuaagccagauguuacuaguagcacauaucuggaaacagaagcaggcagagggaucaaaaauuugcagcuacuuugggauauaugguaccagacuagccugaucaagaaaagaaaaaaugaaaaaaaaaaaaaaccaacaaaaaaaaaaaaaagaaaagaaaaaauguaaagaaguaucuggcaguggguacugcuguaaaaugagauggagaauugaguguggccucacuucaacagcgucuaccugaaaugucauaaugccuccuacaugaaugcugcuugacaacugccuuauuuuuagguuacauuucguacaagaauuuaucacuguaauauuaauagccaaggaguuauuugcuuggacauauugaaagacaacuggagcccagcccuaaccaucucgaaaguccuccuuucuaucugcucacuccuuacagacugcaauccugguaagacgaauagucaucugcacuguauuucuuacuaaauguuucuuguuuuccacauaagcuaagaccauuaaaggacauuuuaaucaauuguuuagugcacuaguuggaaaaggcagcuacucugagcucacuaaggcugggugcagcucugcugccaguuuugaugaggauucacugagcacuugaccacagccagugcucacuuuagaaagagguauuuuucugcacuugguaauuucagaauuguaaucuuauugggacuaauuguuuuuaaaaagaaagaaauuauuuauuuuucugcuuaaauauacaaauuuaacuaggcauuccauuuucagagaaacacauuuauuuggaagucuggguuuuuggccuuuucuagguauacauuauacaauagauacugccaauugcaccagccagagagacuucccaauaucuacagcucuaauugguugaacaaaguuggucuuggagccuuggucauacacauggagaacaaagagugucacuuguugagagagaacuaaaguagaauaagaaaaugaagccaaggccacuccucccacccuucuagauaagauuagaugaagggcuaaaacaguggcccagcugaagagcaaguguucuugcagagggguucagcuuccagcacccacuaggggcccacauccauaaccugcaaacagaguacccaaaaacauaaaauaaaccuuuuuaaaaacuguuuuuaaagauuagaagaaaacaccuucugacagugaguguuucagacaugggcaaaguaucugauuuucuuucuccaaaguaacauacauguuuuucuuccagcugacccuuuggugggaaguauugccacucaguacaugaccaacagagcagaacacgacagaauggccagacaguggaccaagagauacgcuacauaaacuggguuuucaguucuuacaugacuugucugucacagaagagagcugcuuaugauuuugaaagggugggggugggaguugguaaagaguaggcuauuucuauaucagauauuauucagucuuacuucccaggauuuuguuguaacuuaagguaucuugcuacaguagacaaacugguaauagcgacuuuuagagcugaaacuuugcaagauuagcugacuuuuaguacaaaagaaagcauguguagauacuuguguuccauugaucagcuuaaauuuguauagguacaugucauuuauguaaaguccuauuuucuuguucaaaaaaaauggaauuuguuuuuccuucuuaaaaggaaacaaugguauuuaacaaguuugcaaagaugaguuuguuaccucguauauguaaaauggacaccuggcuacaagacaccauguaguuaauguauuuuaucuuauaugcaaauuacuucaaggguugaaucacaauuuguggaaaccuguagugaaauaccuuaagcuguuaacuguaaguguggaauaggaauuguucagucaauugguuuagacuucuuacgucugcauuugugcuaauaaacaauauuaagaacaacuacug

SEQ ID NO: 7275 - RNA, 1700 nt, Mus musculus
gcucccccggugucuaaacacaggugggagcucaccgacaggugagccccgcgcccggcagucgcaaggauggaguucgucaaguguguaggccacccggaggaguucuacaaccugcugcgauuuccgcaugggaggccggcggaauuuuauacccaaaauggaccaggacucagcagcagcuugaagaccugcuacaaguaucucaaucagaccagucgcagcuuugccgcgguuauccaggcgcuggauggggacauacggcacgccauauguguguucuaccugguucuccgagcccuggauacaguggaggaugacaugagcaucaguguagagaagaagaucccacugcuguguaacuuccacacuuuccucuaugacccagaguggcguuucacugagaguaaggagaagguccgacaagugcuggaggacuuccccacgaucucccuggaguuuagaaauuuggcugagaaauaucaaacagugaucgaugacaucugccacaggauggggugugggauggcagaauuuguagacaaggaugugaccuccaaacaggacugggacaaguacugccacuacuuugcugggcuggugggaauugaccuuucuugucuauucucugccucagaguuugaagaccccauaguuggugaagacauagagugugccaacucaaugggucuguuccugcagaaaacaaauaucauucgugauuaucuggaagaucaacaggaaggaaguaaguuuuggccucgggagguguggggcagauacauuaaguuggaagacuuugcuaagccagagaacguagauguggcccugcagugcuugaaugaacucauaaccaacgcccuacagcacaucccugacauccucaccuaucugucaaggcuccggaaccagaguguguuuaacuucugugcuauuccacagguaauggccauugccacacuggcugccuguuacaauaaccagcagguauucagaggaauagugaagauucggaaggggcaagcagucacccucaugauggaugccaccaacaugccugccaucaaagcuaucauauaccaguacauagaagagauuuaucacuggauccccaacucagacccaucaucaagcaaaaccaagcaggucaucuccaacaucaggacacagaaccuucccaacugccagcucaucuccugaagccacuacucccccauuuaccugucauuuaucaugcucuuggcugcccugagcuggcaguaccugagcacccugucccaggucacagaagacuauguccagagagaacacugauuuuguuuagccggaaguggaaguucccguggaguggguuuuuccuuuuccuccagcuggauuuuugacuucccuuguuuuuccuccuacucuaaaaucuuugggagaacugagugugggaccuuuaggaacugggcagaggaaaggaugccuugcccucagcagccuggugcuggcugggacuugguuccucugccucuuguagccacuggcagcacgccgacugcugcacuuuagauggugaggccacaugugauggucacaagagccuagugaaccuggcuagaaugcugauuggauuuauuuaauuugaaacagccuuugaauaccuaugacaauagaaaaugaaagcaaaaaaaaaaaaaaaaaaaaaaaaaagaacccag

SEQ ID NO: 7276 - RNA, 1700 nt, Mus musculus
cuggguucuuuuuuuuuuuuuuuuuuuuuuuuuugcuuucauuuucuauugucauagguauucaaaggcuguuucaaauuaaauaaauccaaucagcauucuagccagguucacuaggcucuugugaccaucacauguggccucaccaucuaaagugcagcagucggcgugcugccaguggcuacaagaggcagaggaaccaagucccagccagcaccaggcugcugagggcaaggcauccuuuccucugcccaguuccuaaaggucccacacucaguucucccaaagauuuuagaguaggaggaaaaacaagggaagucaaaaauccagcuggaggaaaaggaaaaacccacuccacgggaacuuccacuuccggcuaaacaaaaucaguguucucucuggacauagucuucugugaccugggacagggugcucagguacugccagcucagggcagccaagagcaugauaaaugacagguaaaugggggaguaguggcuucaggagaugagcuggcaguugggaagguucuguguccugauguuggagaugaccugcuugguuuugcuugaugaugggucugaguuggggauccagugauaaaucucuucuauguacugguauaugauagcuuugauggcaggcauguugguggcauccaucaugagggugacugcuugccccuuccgaaucuucacuauuccucugaauaccugcugguuauuguaacaggcagccaguguggcaauggccauuaccuguggaauagcacagaaguuaaacacacucugguuccggagccuugacagauaggugaggaugucagggaugugcuguagggcguugguuaugaguucauucaagcacugcagggccacaucuacguucucuggcuuagcaaagucuuccaacuuaauguaucugccccacaccucccgaggccaaaacuuacuuccuuccuguugaucuuccagauaaucacgaaugauauuuguuuucugcaggaacagacccauugaguuggcacacucuaugucuucaccaacuauggggucuucaaacucugaggcagagaauagacaagaaaggucaauucccaccagcccagcaaaguaguggcaguacuugucccaguccuguuuggaggucacauccuugucuacaaauucugccaucccacaccccauccuguggcagaugucaucgaucacuguuugauauuucucagccaaauuucuaaacuccagggagaucguggggaaguccuccagcacuugucggaccuucuccuuacucucagugaaacgccacucugggucauagaggaaaguguggaaguuacacagcagugggaucuucuucucuacacugaugcucaugucauccuccacuguauccagggcucggagaaccagguagaacacacauauggcgugccguauguccccauccagcgccuggauaaccgcggcaaagcugcgacuggucugauugagauacuuguagcaggucuucaagcugcugcugaguccugguccauuuuggguauaaaauuccgccggccucccaugcggaaaucgcagcagguuguagaacuccuccggguggccuacacacuugacgaacuccauccuugcgacugccgggcgcggggcucaccugucggugagcucccaccuguguuuagacaccgggggagc

SEQ ID NO: 7277 - RNA, 60535 nt, Mus musculus
cagagguccaaguuggagucuggcgggcaguguggcccgcagagacuugcggaguggagggcagagccagggaggagugagcauguuucgggacccgacagccggguggcuaacaccgccaucaccgcuaucgcugcuggugaugcuguugcugcugucgcgagucggggcucugcgucccgacgagcucuuuccuuacggggagucguggggagaccagcugcugccggagggcgacgacgaaagcucagcagcugugaagcuggcaauaccccugcguuucuacgaugcccaguucagcagccucuacguaaguucagcucccggaggugcgcgguugggugugggacucuuagcuucuucccagggaguggaacaaccuccauguuuaacugucguccccucuggggaccaggcuuagcagcggcgcugcaacuucuugauccuuacuguggaggaauaaggaucguuucaagggcgagcuggaaccgugccccucuacuuugacauucuaggcaggaagaugaaguuaaggcugcgagugggguuugcguuuagggcgguggggggggggggacugugcacgccggcagagcuaucuuaagggcgagcaauacuggagaaagauggaccgguucgagagcagccgcaccugugggucgcagugcacuggagggugagauaggagcuugcuacccuggauguggcucaaccuugauuggaguagaaauauuuucuacaauagguggacgguaggugcguacgacuggagcacgguggcugcccuugggcuugagcgaccaccacuauuuugaccuuuuaaaaauauuaaaaauguuggggauucacgugccaccucguguguaugaagaucagagaacuggcuuuuucuuccaccuuguguccuagaacucaagucgucggguuugacggcaaggugcccuuaccugcugaacugucucaccgccccuuggucuuauuguaggugggcaccaacggcaucaucuccacccaggacuuccccagggagacucaauauguagaugaugauuuuccuacugacuucccagccaucgccccuuuccuggcugacaucgacacuagucacagcaggggccggauccuguaccgcgaggacaccuccggagcugugcugagccuggcugcccgcuacgugcgcacuggcuucccgcugucgggguccagcuucacccccacccacgccuuccuggccaccugggagcacgugggcgccuacgaggaggucagucgcggggcugcgccgucaggagagguaagugagggauacccugcagcugaauaaauuaaagggacggccugaauuuuguguuggaucuaaggcuuugacuaggaguuucuucccuugaucaggcguugaacuggaugaaaccagugcuuaggcagcuugugagugaagucuauuuauugucucugggggcauucuaaggcucuccuaaguggcuaagucggcuuagugaaaugagggacuaaggcucagauaccaagaaccaccuauaaguacacaaauauuucuaaugauagguucauugaagggaaaaaauggaaaauugaggaaguuuucaaaaggaacaaccucuuauuuuccuaccacuguuaauuaauuaauuaauuaauuaauuuuuuugguaugaguugggcguggcagcacaugcauuuaauuccagcagaggcaagcagaucucugugaguucgaggccagccuggucuacaaagugaguuccaggacagugagaauccacagagaaaccgugucuggacaaaccaaaaguaacccauauuuuguauguacauucccagcuauugcuuuagcauauucuugccauuagcaaugguggguucacagugcccauaauacuguuucacuugcuucuucugcuggauuguauacucuugaaagugugauucuguaacauugaaacagcuguaucagaccucccccagugaacuuaugacccuuccuagggaucauuaagguugcucccguguuuuuauuauaaucaguacuauacaacacuuuucaagguuuuuauuuuauucauaugugugucucucucugcugguguugguagggcuagaagagggcuuagauucccugcaguuagaguuguuacuuacaggcaguugugaguggcuugacugaguguggcuugacugauugcauacagggauuugagcuagcauacugacaggacuacaugugcucuuagcuguggagccaccucucuagcaccucucuaaagccaacacugucuuagcugacaucccaggaaaguagagaaggaugccacacacuucuuagcaagcuccuuguagcuuucccccacauugccuuuguaacaguuugcauacuucugucugcaggagacuguuuugcaguuuagcuagagaaagcaccaaaaacucugcuccuagcuuuggucuuagcaacaugugaagugggcaaugguuggucaggguagcuugccucauuccugguguagguagagacagaguccucuugugaaauuccaccuggguguauaauggcauaggagcaaaaccauguuugcuuuaacuccuaguguuucuugacuacagaagugauaucaucccuaagagguuuaaagcuugcccauugucccugucacacggacaaugguugugauuguuccauguucuuaaaggaaaagacauguuuucuuaaagucugcacuagcagagaucuagaaauaaacauuauuugaauuuaguuucuuuuucuuuuuuugguuuuuugaaacaggguuucucuguauaguccuggcuguccuggaacucacuuuguaaaucaggcuggccuugaacucagaaaucagccugccucugccucccaagugcugggauuaaaggcaugugccaccaccauccgucgaaguuacaguuucuuacuugacggguuagcauccgguuuuguuuacugacuagccuuguaguaugugggcuugacauaucaauuccaauucaacagaauacccucaacucaaacacuucaugcaggccagccagcuagagggcuagagaagacaguccccuguuucauucauucauucauucauucauacauuaucucuuagacauuuaucuaaaaucauguauaacuuauaguugaaaacaaacuuuucuaauacaagcaacuagguuaccaguucuuauauuucuauuuucuuauagucuuuuuuuuuuuuuuuuaaguuuucauuuuaugagugagagugugcacacaugcauguggggaccagaggucaucuuuaaaugucuuugcuugggagccaucuugucucugggaccuaggaccccucaguuaggcuaggcuugcuggcuagugaucugcucauuuuucucccggaagcugagauuauacgugugcugucacgcccccacuuucaugugggugcucuggaucacgcucaggacuucacgcaugcgcagcaagcacuucauagacugcugccuucccagcuucucuuguuaucuuaaaacacaaagcaaaaggcauauaugucacagaaccauauaaugcacauaucucuauuuaaacacaguugauauuuauuaauucagaagccauuuuuauacaauguugguaggcaccgaaauaaacaccgaguugacugcucccguucugaaaggccucauuuacguuuuguuauggcaauaugguaggcccucuaccuagagcuucuuccaaaccccuccauuuggguagguuucugagagcaagcuaaguuacuugcaggauagaaggcagacuguaucagccugugccuuggggcauggcaggcacugucuuucagaagagcaggggugaugggaucuaaggagggaaggcuccaggguagagaaagguuguccccucugaggacuguagauuggguucccagauagugggcagucgugaaagauucgaagugggggagucuaacuuuuguuguuccuuuuguuuugcuuuuggcaccuccccagccccgccccgcucccccucccccacgcacacacaccgucucuuucucuuuuaagaugguccucaugaaucccagauuggcuucaaaccuuguaauggagggugaucuugaaucuggugcucuugccccaccucucaccugcgugcugagguaaugggugcgcagcgucauaccuacccaguugauggggauugaacccagaauuaccugcaugcugagcaggcacuccacuagcugagccgcuccccagccugcgcacugucauucuggugacauuaguuaguaagggucgaagggcaaacuauuuagacaguugaguucggaacuucaugaggccauggaguucagaagagggcaucagcucccccuggacaggauuaccuacaggugugagcuaucuaucacgugagugcugggaauugaacauagauccucuggaagaacauccagagagccaucucucugcccccucuucuuauaucaggaacauuuuauacugucuucucgacauagucccacaggguaagugcaauauuuacuguuuauaucaugaaagagaaaauaauuuccaaaucugccuuaaguaaggcaaagaucccuuaaaaggcccaguuuuccccuuccuuacgcuuuucauacaagacccguuuucuaugcauggaucauagaagcaguuacaauaauaacaguugugccuuucaguaaacgagguuaccuuuuaauguucguugugacuuuagugcuaugacaguucuuggagcuguauucaaaggaggcaugaaccggagugaaguuuuugucagggacccuucugaugccacugucacuuugaaauuaguguucugcugcucccaaggagaguucagcugaauuagccucuugcaacagaaaaaagaauuagagcgagaggcaugugcgcugaggcucaggggucuugaggcugugguggcucccaaguguauuagugcuuguuugacauaaagguugcagccccagaaagaugaguuuaguuguuaggauucucacuucaucagcaacauucucugacaguuucuccuuuuggggugugugugugugugugugugugugugugugugugugugcgcgcgcguaugaaugaacaugcauuugugcacgcguucaccuuuguguggaggugcaugugcgugcagaccagagugucauuccuuaggcaccauccaccuuuuaaaaauuauuuauuuguugcguguaugugugcauguuuugacacugugguggucauagaccaacuuggaaucagcucucuucuccucccucuuugugggaucugggaguugagcccuggucaucagacuuuacaugguauaggugccuuuaaccugcugagcccucuuuccagcucccuuuaagccacucucaggcacaucucccucugacccaggacuuagcagcuaagcuaggauugcuugacuaggcacgcagggcuaccuuccuagcuauaggucuacagaccuggcaaugacaccgugacuguuuuuguucagugcauaucuagagaucaaaugcggauccucaugcuugaauagcaacaccagacacacugaaccauuucucgcucuucaaauuugcaguucugggacuugaacauagguccucaugaagucucucaugacugagcaacuuccgaaggcacaguaauucucccauuacaccuucaagguucuugcgaggccaguaaccagguagaaaacaccugcagcaguggucuugggagacaagagcccucacucuucauuuucuaagcuguagaaagaggugacaguacugacuuuacagggucgucauaagaauuaccauggugccguuuuguuucugacuuguaacgaucuucuguuagaacuccuuuagguaaggaucugguuguuuuauuucucuugugugugcgugcauguauauguguguauauguuuauaugcugcaugugaauauguauugucuguguaugguauguguguaugguguaugugcauauguaugucuguaugauguguuuauaugugcacagugugugugguguuuguguaugguaaauacauacugcauugaggauccuugugugugugugugauguauguauggggugugugcaugguauguguguaugacauguaugguauguaguuuuguuaugauuuauguguguacacagcauggugcacauguagagcuugggagaagacccucccgguaccuguucucuucuuuuacguggguuccuggauuguacuaggauuucaaggcaagggcuuuaccugcugagucuccucuggcccucucuauaaggacucuuuaaauggaggguuuucugaaucacuuuuuuaucuuuguuuaucuuuucuuuuuguuggggaauuagguggggaaaauucugucuugacuuugccauccagguccuucuucaggaaucgccauaggccaaaugugcuucgggauuugcuccguuggugaggauuugugcacaggcuguguuuaucagucacucccauggaagacuuccgaaugcugugaaaacccugggauuaagcucuugccuugauagacuuuuuuuuuuuuuagguagauuuugacacacauuaaucuccuuugcuuggaggagucugugauuucuacauaguuuucugacaucugguguaguaaucuuaauauuaguuacuggaggcuggaccucagaggaguagugccuugccguguaaaacaccuucccguguaaaaugcuucugcugcucgucacucuccgcgaugcucacauuggguguggcugacuguucuaccuggcaugcaagaaugccauggugcgacugcauuaaacacugaacaaauaaaggguuuguuccuuuaguuaaucggagaguucuuaaacugcugauggguaccguuuuguugcucuguguguuuuugguuucaaggguuucuguuguguucucacugggaguuggggggaauuguuaucaagaacugaguuaugcaguacguugaugaggaauuucauuuggguuggaaggaccacaggaauggggauggaggaugaguggcaggagagcuugccugaggcugggcugcauccagggcuuggaaggaugggagcguggagucuugcucuggaaaaggauggaaacauucugucucuacuugggaagcagagaaagauggguguugguucuaagcuugcuuucccuuuuguauccaauaguauccaucacaguuggucugugcacgcuuaaacaugggaugauggguguugaguuggugcaaagauggcggguguugaucaagagcuuuggauuuagauggagcuucuuaauuuauggagcuacaguccacauacaggguguguggauaauuaaccacauggcagugaagacagagagaauagagaauaacuagauauguaaaacggguuaaagaaaacugcuagggcagugguggcucacaccuuuaaucccagcacuugggaggcagaggcuacacagagaaacccugucucaaaaaaacaaaaacaaaaaaaggaaaacuccuaagguguucuugaagacuauauaugaaggaggauauacuaugcaauuguuaaaguauugggcauuuuucuuaacucugcaguaugaaggugaauauggugaaugccagugucccgacaggaagaauaacacacaaguagagguugguguucacaccaaguguaggaggcuagaaccaguggccuuacaacuccagagaauguguccuuaaggaagacugaacaucaaacuuuguccccaggaaggggucaccccauuucuaauuuuguuaucauuuugguaaagcuggaucccuuguuggaaagaugguggcauucuuugggccuugucagaugcuguguuccagucaccuggcucugccggugucauagcaacacuggaaggugguuucugcgaaggcuuuugguuuucucuguaaacaggaaaggagacagugcagcuaggcagcucuggccugaugcucucuguacugcuccccacccugugaaggccccacuccucucuggcauccaggggaaguugggagcucuuguacaggguuuggcaguccaucugagggcuucccuucagaaccuguguggagggcucuuggaaagcuugucucugggaauggagggccuuucccuuuggaaaccagugagagugugucugugaggaggggcccuucaggaccuaugaaguggccucuuagccauucugaguggaaaucugaagcccugacaagggggcgguuugugugugggcaguuuucaaggagcucucuuggaguguacuuugggaucauaaacuauauuaaaaggaaguuuuuguuguuuuuaccucuggucuuugccuauuuuaguagagacaaggaaaugaaacacuugucaucugaagugagugcuucuccaaaaggugacacagaaaagacacugaacaaauacggcacuaaaugcagauuuccagguuagacgccaggcucucccaucacagccuccucacuucucccucggccuccuccccaccgccuuccaaucuccgcaugcagacagcccuuaucauauggaauuucucuaaauuuagaaccuugguucucccuuaucuugugaugucgauuguggccgacaugcccggagccuccacaguugguuauuuaaggaugggauucuuaguucugcuuuuuaucucccuaguugaacuuuguugugacugaaauaaaacucuggcagccacuggccccacccugacugaugaggguguucugccuguaccugaguuggaaacucagagcuucugaccuuucugaugaaggucaagcuuugcugaugagauaggugaggaccacagcuguaacggaguagcagguugggacugaaacacggaagguauaagcagacucuccccauuagcgaauacaguggaguugcauaguuuuuacuuuuuucuugaaaccguauuaauaccugcauuucguugcccuauuaccugaaccucaaagcuauucuuuuuuuuuuuuuuuuuuuuuugguuuuucgagacaggguuucucuguauagcccuggcuguccuggagcucacuuuguagaccaggcuggccucgaacucagaaauacgccugccucugccucccgagugcuggucaaagcuauucuuuagcauuauauaucagaaagguaaaauuuaacauuugagauguucuagaacaagacagaaaaaacccaagggcacauuuguuccuuguauucaauuuugaggugguucuuguguccaguuuugucuuguuuagcaaaauggagaggcaacaauaccaauuagugauuuuuuuuccuuaaaaaaaguuuucccaguucucuacuaaaucguuagacaaauaugaucuagugagagaagcugacuacagagucuaagacagugaagcaucgcauaacuaauuauuugguggagaagaugguaggcggaacaggucccuuugaaacugaguaagugaaauaccaagaaguaauucccaagucaccaggguguuaauucaggcuacaucaguucuccucugucugcuuuggcuccugcaguguuuaucuucauucauuggcugccacugugccgccaccccacccccacucugauguccuggacucucuccuuucucuguggccucugccaccaugcuugucgcagucacucuccuaaaauuccaguccggcuuugugugccccgguacaggggaacgccagggccaaagugggggaguggguggguaggggaguggggguggguggguaagggggacuuuuggucuagcauuagaaauguaaaugagcuaaauaccuaauaaaaaaugggaaaaaaaaaaaaaaauuccaguccgggcuguuucccucuccuauaauuugggcucuugggacauagucacugaccuuggcuccuucauuccugcaguucagacguaauauggcuuagcagguacucagcccugaugaauuaauagaacgggcucgcuagugaguggagcuacagaagcccacaaaguggguuccauagggaauuacaguacucaauccccaggaggcagugcuuguugguuaggauuuucuuggugcagcgaaguaugaauacaacagcgucaaaacacauaguaggagugggggcccuuacacacccuguugagggcauaguggagcagagccugggaagggagauuggcucagaguacgugcccuggaauggcuugucugauagaguucagaucacugaauaaugcagggcaugagcuguggaacugacugacugcaaccacuacccauugcccgaccuuaagcgagccccugggucucuuucuucaucugcagugugacaggauaacucguguuguaaagagauggaagaggaaagggaguuuggcuaucugaucaguaaggaggccuuuuugaucagucacuuccuggcugaguguugccugcagugggcauuggaugcauggaugcaugggugauccauaucagagaugcuaagacacaagauuaaacaccagaacuggggguauaggaaugagcaagcuaauuuuguuccuuguucagucucuuggaagaguuuggacuggagaaaccugcaaccuuaacaauuuuaaauacacucucuuuuaaaauuacuggauacauuuauauaauaucucucaguauauccacucuucccucuuccacuacuucuguccauacaccuucauguccuuuauuuguucuaauaacccccugcauacaaggaagcccaucggggcacggggcgaggggccaccacugcagcaggcuccaccuaccaggcaccacaccccuaacgaacacucugcccuagcagccaucagcugucagcauccucucagcugcaggugggagcaucugugcuggaaugugaguggguugcucuccugcuggucaccacagcugcaacagucauguuaugugcacaagacauuguuuugaccccauuuccuucugaccucuggcucuuaagcucuuuccaccucuuuucuuuccaguguucucugaaccucaagggaauuagauacaggugggaguaucuguggcugggcuuuccacagauaguuucuucucuacccuuggacuagcgaugaaugugugaauuaacuaccauccacugcacaaagaugcuccgcuaugacugccgagagcuccacuaauauaugaguuuauaacugguauggauaaucaugguucacuuccagggcuuaugaaccucccgcccacacgcccacccuccuuccaccccccucccccgccucccccggccaugguuucuuggccagauuuacaauacagaaguuuccaggcagaaguuuccucuugucgaucaggccuuaaauccauccagaaauggacugauggucuuuauagcauuccugccacuuauggugcccaugaauacaucuugccagggcuuuguuuguaccccugagcagucaugguggggugagacuguagccugcauaccaucuucuagugucaugaaaggcagcuggcagggguggaagcgucaugcaugcaugcgugugugcauguauacauaaaugagugucugugugugguuucuccaagaccugugaccuacauguguggugucaccagcuauagguucuuaccgucacauucugauggggaguccugggcaaugaccauugacaacucuggcauuguugucucugugacauccuugaccaaccuugagggcaagguguccuauaccuggcucugggcuuuuugaggacuuguggcugaugggaggagcguuaucucccauguaagccaguucccuuuaaacauuccuuguauguuggcaaguagguuuucguauggcuuuuuuuuaguguucaugggcguuuuuccugcauguaugucuguguggaacugacguuacaggcaggugugagcuaucacgaucuuguaggugcugggacuugaaccugggaccucuggaagagcagcugguauccuuagcuguccaucucuccugcccuucauaaggcuuuuucaaacguccuuaguguuaguugauccuuccucaucaucucuuuuuccugcagcccugaaaguuuuaagccaguguuuuacuuauacauuauuuaacuauugauuuaaauugguagaagagguuuaaaauaauucauuuauuuuacaaaauuuuauuuguaauuugaaaagggaauucuaaaagagauuguguucaaaaccaauguggggaauuccuaaaaggauuugggcuugggccccuugucuguguucuguuuuucuucuuuuguuuauuuguuuguuuaaggaugucugccauuccuuuuuguccacagcugaacacuuuccaggcuguucuggcauccgaugaaucugauaccuacgcccucuuucucuacccugccaauggccuucaguucuuuggaacccgccccaaagaguccuacaauguccagcugcagcuucccgcuagggugggcuucugccgaggggaagcggacgaccugaagagagaagcacuguauuucagccugacuaacaccgagcagucugugaagaaucucuaccaguaaguaaugugccuguggaugugccuguguuacccacuggaaugacauuuaggagggacaugaucucaagugaccagagaccauucgauaagaagcuuugguggcuucuaagaaaggcacuggcucaaaaccaggagcuaagcuggaccccagagcuucaggcucuccaagauauaaaagauccuuuauuuuuuccugcacugucaguucaggcauggaaaacagaaccagcagcgauuauauguguuuuugcagaaccacugggcuugcuaggaaaaacauuguucuuggagcuacauaaaaauauccaguaauaacugccucaguggaggcuuuucagguuaaugauuucuucagaggaggcaucaugauuuagucuuucaaacaggcauuguugaggauuaaauuacagguaauauaauagagggaggggaauagaugaggcuuuuagaagucucaagauuucuccagacaccaucacccgaaauaaugcugaucgguuugcccacagcguugccagagacgaauccauuucuuagucuccccaguggcuuauucugcuagugcggcaauaggcuauuccgccucuugguuauaggaaacccuuacccguuugcaugcauuugugcuuaucaacuagauugugggcagagagagugacucagcaaaaauuuauugaucacuuucuaacugcaaacauugugauaaaauguuugcaaauauuaucuuaguuaaaacucacucagacuuauaggugcuaagcauagcuaucuucccgguuuuacaaauagccuuacagaaauuaacaaaguugcuuaugucaguuuuaaauggcuaagccauagucaacacagguccgaaucacagacacagggcugauaucauaugcagaguagauagugugacucucacuugaauuucauguuucuguguuguuuguauuuuuuucauuuuaucagucacucuggucacaucucacucugcuccucucuggcaaaucugaaauuucuagaaagcaucgaaggaggaaaugaaggaaauccacggagugggugcauggcagugugugugucugugugcacgggcgugcaugugaggccuuuaugacucuaguagagaaacacaacugcuucuccucacaaacuuuuugcacagauacacgggcauauguguacauaugcaugcacacacgcacacacaccagcuuccuauggccaugcagaugccaauucucauucuaauuuucugugauucuugguccuucuuuccaggugcuguugguguccagggccugugccuuaaaaaaauguagaauuuaaagcacucagcccuccuuccaagggcucuaugcacagcauucuuuccuguuccgugauccauguugggugucuguuggucuccuucuuaaccgcuauguaguccagacgcuagaacaaacuuaagcauuugccuucuauccuuucuccucuccucuccuacccaggagcuuaaagacucucauuccccaggcuguacauaaagcccuuggaaggagggcugagugcaugaaauacuacaguuuuaaagacacaggcgcgcgcgcgcacacacucacacacacacacacacugcgauccacccacuccaguucuuccuucauuuccuccuuugaugcuuuccagaaauaucagaauugccagagaggagcagagugagaugugaccggagugacugacagauuuguuguaccucacacuuaacaagaugagacaaaauacagacaacagaauaacaugaaaugcaagucagaauuauccuaccucuacuuugagugacagcugucuaccuccccucucagagugggguccgcccucccauucagugcucccaugcuugacacugucucaugggccucuuuccuccagauucugucaguauugucgucauaaaggcucaaacauugcauugccugugcccagcaccgugaggacauuuaugaacugaaguugcucaggaucguggcccaagcucucucugaaugcucuguuguacauccccaaggaggagagcauauuccuagucuggaaucucuuccucaaacaagggucauccauuauucauguuugcauggcucuugugagguguaugcacauucaggaagagaggagaguagguauuagguaguauuuaccaacagggccugcgcgcuaagccuuuaaugugggauuucccacauguucuuccuaagaucccaggcaggaaggcauggcugucccaucuuaugauucaguuuuccuuucuaggagacaaauuuuuucuaucaguaagcauuccaaaugaccucagaguggaggguaaacuaauugcuuagauucccaucagccacuguggcaaagcaaacgccagcauauugauuuaugucucauuagaaggcauuuauuuagcuuuacucuuccauaauuuguauucuccuucucuuugaagcuuuuauagcugucgacuuccaaacucaagaggguucccagcugcagcaccccugcuguggggcuaggcucaggccccaggguccccucugauugguuucaguuucuaaaauugcauuuacuguguagaguuggggguuggggcagcugggggugugucugggucagaggugaguuugcgggaguuggugcuuuguguucccccccaccaccaccaccauguggauucugaguacagcucucagcucuuggagauaagcagguuucccuguugagccauuuuagcagccuggaguuuugucuucuguaguguguuuuauuugcaaccuuaauuucuauaagcauaccaagugaggguaggagaugaagcucugcuggaagaauaccugccuuguggacauaaagcccagaguuuuguccucagaaccacacaaacugggcacaguggcucacaccuaguaucccaguauuugggagguggaggcaggaggaagagaauauccugagcuacaugagaccauauaucaaaaaaauuaaaaaggaaccauagcaagugaagauagcaaauuacagaaaggauggcaguuugcuuucugcaucuaagugaccuguaacaguagcugccgucugcuuucucuugcugugacaaaacacugaccugacuuggggaggaaagaguuuauuugguuuacuauccugggucacagugccaaggcaagaacuuaggcaggacaggaaccuggagggagucaggaacuaaagccuaauuucuuacacagccagagaugguacccaaggaugguaccacgcacagugagcggcucuuccucccaucaaucauuaaccaggaaaaugcccuccccccaacagacuugccuucaggcuugugugguugcggugaucucuuaaucaaagcucccucuucccagaugugucuggguuugcauuaaggugacaaaauccaccaguacaacagcagcaucacacauacacuugggcacagguagugagugagugggcugugaacagagcacaggaugagagagagagagagagagagagagagaacugaagaaaaccucaacugguuuaaaaacauuauugcaguagaaaccuagacuagaauggugaauacuugccccagugaacaaagcucucuuguuauaugauccuaugaauuuuaaaacuucuuauuagccauucgcucuuauucuucaguguugacuuuugaggaaauuccauagugugggagaauuugagcaugguauuuagugcaagcacaggguugguaucuuuggccaguuccagcuuuccagaguuugauuaacuccagcuuuuucuuaggcuuaggaguccuacacauggcuguccucuucacagcaugccauugacauugaaauagugggccacugagccggcaagagggccacaugcuugcaaucgcagcagaucucaggcuugaguauagcugggacuaucuagugagacuccucugaaaaaagaaacucuugggaacugaggggggguucauggucuacucuacugagcaaaugaagaucuguucgcagauacugaguuucaguuugauuaauccauuuguaucucacccgagugagcaaaaaauuguuuuagacuuggacauuaaaaaguauugcuauaucuaucauccucugucauuaauagauuaguccaugugaauccacaguacauuuggaacacaaguuuucuuguuagcaugaaauuugugcucuggcucaacucugaucuuuauagucuuuugguuucagaacaaacucugaaggagaaugaauggacugcuuacaaucagcucuucuccuuuguucuuaggcuaagcaaccuggggauuccuggagugugggcuuuucacaucggcagcagguuugcccuggacaauguccguccagccacaguuggaggugacccuuccacagcccguuccucagcacuggagcaccccuucagccaugcugcagcccuggagagcuacaccgaggacaguuuccauuacuacgaugagaaugaagaggauguugaguacccaccaguugaaccgggggaggccccggaaggccacagcagaauugaugugucuuucaauucaaaggcugauccaggccuuguggacgucggcaccucaucuccagguuccgaccgcgcuucuccuuggccauauccagcaccugguaacuggccauccuaccgggaaacagaaucggcuucuuuggacccucaaaccaaacaggggcggccggugggagagggagagguucuggauuucagggacccagcggagcuuuuggaccagauggguaccagagccccagcuccuccagaggcagaugcagcucuccuaacuccagucaacgaagaccuugggggcagaaacacccaguccuauccagaggcagggccagugccuucagagccagauguuccugucccuccucuggaaggagaaguccuuccucauuaccccgagucuggucacguuccgccccugagaggagggaaguaugugauaggacuggaggaccacgugggaucuaaugaucaagguaagugcauugaacaacuuggcauuugggauuuuguuuaaagaaaauguagcagaguugacaaacuagaaauggucaaucaacugugcucauuucucuacugggcaggcugaggcaggcuggggcaggcuggggcaggcuggggcaggcuggggcaggcugggcaggcugaggcaggcuggggcaggcugggguaggcuggggcagacucggguaggcugggcaggcugaggcaggcuggggcaggcuggggcaggcuggggcaggcugggcagacuggggcaggcugggcagacuggggcaggcuggggcagacucggguaggcugggcaggcugaggcaggcuggggcaggcugggcaggcuggggcaggcuggggcaggcugaggcuggaggauuaucuagguuuaagacuagcauaggcuauauagagaauuccaggccagccuggauuauagagugaaacuucuuccaaaacaaaacaaaaaauacagcugugguuuucuucugagugaauaggugaaaaguuuagcaagcagauuggaacugauuuuuccuccuuguguuuaaggagauaaauucccuuugccaaguacaucuuggcagaagaguucuucuuggagccuccugaccauuaauaauguguucuaaaaaauuaggccucauggaguggggaaagagcugggccacuugugccagcucuccucccaaguguaaugaaauauuucaguuugcaaguucagggaaggugagccauuucgaggcuucguaggcauugcaggauggagggcacagccaucuagcuuuggcuauggugaguucauugugcagacuuaggcaaacaugcuaaagagucugcaggggaagaucaugguaaacaccucugccugcugucauuucugauucucauccucacagcuguggccuucaccuccccagaaccuuauccucauuccaugaugcacugaucguagcccgggaaugcccagaggggacagcuuuucauccacacugauggacugggaaacuggccccagcuucguccccccaaccccccucccagggccugcucacugaucucugccaggagggaagggucagaggucacggcucucuccacaguguuucaacuuuacaguuuuugucaguguuuuggcaaaaacauuaaccuagcaaagaggaccuucugguucugcuaggacauuuccugaagguucaggaguuagucagagaaauacuucaggagggaagaaaacacuuuguguuuaacagagcagaguguaauaguuagggaagggacauuggugucaagaugaaucuuggccaaacugagacaacuuauuucacccccaaccaagucucugauuuucuauaaauguauugccagaauuuaaugugaauuuaugugacguucugugcaccuccauuagucgguucuuuaaaagaaaauagccgcuguuguuacuaaucuuuagaggacuuaaaauaugggaaauggguuggaggauggguagagagugaagagcuaggcuggaaaacgaaagagcugaaaacaaaaagacucauuaaaaagcuuuugacgccuggcugcuuuucgccuugaugaagucugaugaaagguuguuucuguaaagucaaagacauggacuuuuuuuuuuaagguucuagaacuuucagauccuucuaacaaucuccaaaaauuucagugcggguucuuucuauguaaagagauuuaaaggcaugaaucaaagguuuucucaaugagauuuugugguacagauguguuucugagcggccuuuuguuggggguuguauuuucccaagaacagcgcacaguuacugaaaaguggaucuguguacaguuggcugcaaccuggguagcuggauauagcccagcaaaaacuguaaacucacuugaaacauucugagcuuuuucuuuuauaacucagucaggguucuugaagcacgaacuuuguagaugacaaugugucacagugucaaagguugugcauggcuguuuaagagcucagaaaagccugaagugggacugaccacugggaacugaggguaacggcauaacuaacccgggaggggcuugaacugugauauuuaucagcugccaaauguagccaauacugacaucuaaaugccagaauguuucugaaaaagacauucagggggagauugccuaacuggaagcuuuuaagucucagaggaaaaaaaaaauacuguuagauuuuauuuaaauuauauuuuuguguguucaugugugcaaguucaugugugcaaaaaaaagggcguuugugagcugugugaagcacagaagcauguaguuguuacuuaugcucagaggaaacacugcugucccggagguuuauccaguagcuguggccuuacucugggggugacugagaccugcacaugccagcucagaguaggaaguccccagcuuccgguggaggauggccugagcacccacagcucugcuguguaguuugaagagagauccuguuagagccuuauuuucugaagagaaagcaccgaucccaggaaauguuagcuuccccuuuacgcguguacagcucacucugcugaguccgggaauuaggaguuuguuaaaggcucagaaaauuucucuucuuuuuuuuuuuuuuuuuuuuuuucauuuuaucuguauagcccuggcuguccuggaacucacucuguagaccaggcuggccucgaacucagaaauccaccugccucugccucccaagagccugggauuaaaggcgugcgccaccacugccuggccuucuauucuuuuuaguauuguuuucauuagggggugcgugugcacgugugugcacaugugcgugugugugcaggugcacucuuguggaggauagaggauaaccuugagugucaccuuagggaugccaucuauaaagucucuugcuggcuuagaauuuacuugcaaaguagucuagacugguggccagaaagucuuaggaaacuaacuggcucucuugguuuuguuuuuguuuuuuuguugguguuuuuaacgugaguucugggaaucaaccugugguccuaauacuugcaaagcaaguuuuucuuuacugauugacccgccuccucagcccuagggauuguauauuuguguuuuuauuuacuuuugaggcagggucucacuguguagccccagcuuucuuggaacuugcaguguagacugggcuguccccacacucaaauugauccaccugccuuugucuccugaaugcugggauuaaagguguacaccauuaagcacauuaugcugguccacuuacagacuuuuuuuuuuccaaaauuccagauucuuuucaaauuaugucugugucaggcacaucuagguucuggccuuguaucauuugcuuucauaacucaucgagccaacaaugagccagcaaugcagcggaugugugagcauccucucucugaggugacuuguauuuuccaggaguuuguugucaagccaagaaauuaccuaagccccggcaugcuucucugagagaccgagggcauuuucuugggcugcauuguauauucugguccucuaggcaggaacuuagcuuuagauucuguucccuugguugcugcucagaauuaacugaaaggagauaucguuagccuucgugguugaaggcuggaaauggguagugucuugcugaguaagagacagccaugcuuguaaucaggucagggacuccgugugugugggggguggggugggaugggggggcuaugccugugucgguggcugcagucagagaaaucuuacugaaggagggaugcuucaagucggucuuggggaccugaaucuaaggcauuaaaagggaagaguguaagaacauucuggaaagguaggcacagagguagaaauggaaucgggguaggggagaguugaggaguugccagagaugcuucagcugguagggaccagagaccgccuguguugucagacagccacuggggccgacugacggguuuuagggugcucuugaaccugcugaugaucuucuguaugaaccucaauaugauuuccuuugguuuggcaaugugaacuagaagggccggcaccugggcuccagauaccuuguggguucugccccguggagggguccgcuucuuucuguuuggaagucauuuauccuggaagaggcugagcccuucuauccuucuggccuucagagggguuacacaaguguccugcucauuggagguccauucuaggaggaacucuagcaggcugugcacuuaacccagaccuccuggccccaaagccucaaacccauggcuaucuccauaacagucugugacuagagucuuccauaccugugaucauaccugugugcagaaagccccugguggggcuugucccucauccagaagguaagauagagccuguugguguccugacagcuaguguaacauagaggauggccgugcagccuggcagggaaggcaugccacugcugcuugucacaaagcagauaugguacucuauguagucagucauucugggaggugagaccauuugggggugggagguuggggaaucugcccugcggggaaaacguuguuucuuguucuuaagggagcugucaguguuguuaaaggcagaaaagucugcccgcuauggggcaggugcccugcgugucuuccugugaugugcacuaugggaucuccuugcuucagaggaugcacucugagaaggcaugccaacggcugaagacaagugcuuaagccuuugcaaaaaaaaaaaaaaacgaaggaugggccagagcaaguccagaggagaauuuucuuuucuuuucuguuuuuuuuuuuuuuuuuuuuuuuuuccgagacaggguuucucuguguagcccuggcuguccuggaacucacucuguagaccaggcuggccucgaacucagaaauccaccugccucugccuccccagugcugggauuaaaggcacacgccaccgcgcccggccagagaagacuuuucuauuuuuguuaaaaacucccaauuaggagaaggcucaaguacccuggcagcacccuggcuuuguuccuguauauauucccaccccauuucccuuucuauuaaggguaugagaagagguuuuuuaaaaaaacauugaauggggaaaaaaagugagauuuaaaacaaaaaaaccccaagaugcccuuugcagcuguccgaccucagauguuaaguguauggcaaauugagcucuuuaagcccgacaacccacugcuggcccaggcuuggcugcauagcauuuuagccauguauaguuuguggaggccggagcacaagauuccugacauucccauagacuugggaaggaagugguggguuuaaggugggccucagaauuagucuuuuuaacaguuaucuccgcguuccuaacauacugacccucccugugaaggugccgugcuaaggcugggcuuugcuaucagguuuccagaggaaucccucagcaguugucacccgugucucagccaguuauccggaagccuacacuccacacacaguguccgagggcagcggcuccugguuucucacacucagucucugucgcguugucucuucugccucuggagccuccuagacaucuucuuucucaugcgcuucauuaucacuucuuacucccaaggccccagcucacugagaucagccauauuuguuuacuggcugcugcccaggagaacaggacuguuugccugacuucucgcccguggcuuagaguguuuaguaaauacuuguucaccuauugugugaaagaaaggaaacugcgguguuuuuagcuuuugcuagcgcgacuccauuuuagguguaaggugugcuagugucuguguaggagaguaaacagacgagggucuaaaugaaccacagcuuccuuagcccggggacuccuccagaccgagaaaggcaugugcuugguucaaguuccauuugcagaacaaauuuccauaaacucucagguuagcuuagcaguagaaguucauucuucgguugguguuggagucuuagcauagccuuuauaaggaauccucuugucauuuuccauucuggauucuuauuaacuuagaacucuuuccugggacuaagagacagucaccauuccucaugaccugggaccuaugugguacccagggguggggggugggggugaggugaaugaggggagagagugcaaaagagcgaggaagcugauucucaugggcuaguccacacacacacacacacacacacacacacacacacacacacgcuaacuuugaguugcauuugaagucuugugugagcugcuggacagugucugggcucccaggaucaucacaucuagugucuuaguugaauuagccuaacucuucugccucugguccucucuucauuucuugauaaggcuuaaaguagggucugucugggucaguacgguuuuuacaaaauaacgagacagcaaaauccaucuaucccucccuuaauuugcaagccaagccguguguggaaaccugcuuucuuuuuaacggacauagcugaaaaugacuccccuguccaccaagauuggauugccuuuguguccuagugacagaaggaggugaagagacagacacuggcuaugcauguuggggacuucugaggccagggagugcaugugacauuugcccguggucucacagagcagagcuuaugaccuucugaaguggcaccugugcugacucaggagcacaccuguacacgugcaccugucugagcuggggaacucugcccuuugacacaucugcgucacacuuacagcuuuuuacucacccugguuuuuguugagauaaggggcauagcuuagugacaaagagcauccgguaugcaggaggcccugagauccauccccaaucucucucucucucucucucucucugucucucucucucucucucucucucucauacacacacucucucucucucucucucucucucucucucucucucucacacacacacacacacacacaccauuccuaaaccaauagcaauaaguaguuuucuccauagaaaagccugugauauucuugucacgaucuauucugccuuuuuuuuuuaaguuuugucuuuuuuuuuauuuaaaaaaaaguuaaugccuaucacuuguugaaaaguugaguuaugacuaauuuucuauuucugucaagcugggcucacucagcguaaucacugacuccauucugacaggucagcuuuucucuuuaaccaagguguucuaagcugaugagcccucagcuugcugcuucccaggaugucuaauugcuaaaggaauguucucacugcucucagcacuucucaauaaguauuuuacuuuuaaugucugucuguguuugggaaugugcacgugaguguaggugcaaaaguaggccagaagagggcaguagauccuguggagcaggaguuaccacccaugggaguucugggaaccaaacuugggccuucacuacuccucaccgcugagccaccuccaguccccuucgccacuucuuaccuguguguuuucucucagcaugcugcaaacgcccguuaguuguuaaccuucaguuguagcccuuaguguuaguuggauuaccccuggggggguaguagggaucuggaccuucagaauucagacucaugugcuugcugcacucaugacuucuucaggugacucaccgcaauccucugcuucuguuucuuuaucuggaaaacagauuaaaaguagcacuugcugcccccagcucuggugcagcugaggguuaauguuaaagccgaugguguauuucagccugcuuaaauguuagcucuguaaaucuuguguuugcugaugcaaggcuuugucgcggcugcauuguuacacaucgggaagcuagaucuucucauugucuugguuuuuguucucgccugggguauuauucucaguaauacugagucuucaguuuuuuccacccuggccuguuccuuguuuucaaacauagcccuggaaggccaccacagccuguuucuuuccagagcugacacucaggccagcaucaguggcuaaagugcacuaaaacucuuugcccuuccugcuugaucagcguucucuaggugucuccagacuacccugacuucugggggaugggaggcagaagcaugcgcaguacccugccuccuaguggccgugcuuggaauugagguauugcccagcauccuagcggaaagcacucaccugccugugacccaacuuucaggcacacuuuggccauuucuucugcagaggauagcgugauggcauugagggcaggcuccucucguucuugcucucuccguuucgucucccucuugcacagcuaccucucuguaaugggaagagagugugggagauuugggggucgagcuuccucuggugcagggugguuuuguggagauucuguggacuaggcuguuucuguugcaugaaagucauccucaagcugggaagcacaaagccugcaaggaccuggggcuccucaguccuguuucuugucgucucucuucccuccccaguccugcauuugacggcaaguguugacgcagcaaguguguguacauccuuuaagcuuggguuccauaagaguuagacagaccuugguucuuaguuccucucuuuugacuuccucucaaaagauuacucuuacauugagucauacaaaauugccaguauuuggccuuuuuuucuccccaccucaccaaauagugauuucacaaauuucacucuaaugcgcgcuuacgguuugucugcaaggcugcucucaggccacucagcucacccucauuguaguaagacccaguuggccgcaaugaucugagcaucuugccagaacauauaaaguuaaucccucaggcugaauguuauucccaucuuuguagcgucaaaucuauuuguuuauuacaguccaagccguuuuacggagcgcuugugacgucuggcgaagcuugguaguagcgaugcuggaauccuuuggcuuucuaaugcucuuugcuuuauucuucagucuucacguauaauggcgccaaccuggaaaccugcgaacacagccacggccggugcucccagcaugccuucugcaccgacuacaccacuggcuuuugcugccacugccagucgagguuuuacggaaacgggaagcacugccugccagaaggugauugacaggccggggcugcugcauguauauuguugaccccugccuguuuccaguuccaguguggguucugcuugguguccuuacaucucugaugccugaaucccagcaccagugacuuucaaggguucaggggaugacugagugauaaauacguuuggacugguuucccaauuugagagugacuugaaacguuucuauuuugcccucuuucuagcuugguagagcuaaaggggagggugaagaaggggaauggaagagagacaggcaggacugggucauaagugaggaaccgaucacagaagggacuuguuaaaugucgcucuaacuaugacuguaacacuguugagacaggagaagcaggaggguugagaguugaaggcuagccuagauuuuaucacgaauccucaguuggcgucuacagagagcuuauugcaaggaaacccaaaccaacagugagaacagcaauaauaguaaagaaaugucuccaaagagugagcaugaggcguggucaggagagugggcucaucuguguacaccgguccccagccugaugggggccaaggcugaaaggauugcuuuugucuuucaggggcaccucaccgagugaaugggaaagugaguggucgccuccgagugggucacauuccugugcacuucacugacguggaucuacacgcuuacaucgugggcaaugauggcagagccuacacugccaucagccaugucccacagccggcagcccaggcccugcucccuguccugcccauuggaggucuguuuggcuggcucuuugcuuuggagaagccaggcucugagaauggcuucagccucacaggugagcagagcucaguucuggcaaaccgggauucagaugugguaccugggcagccucugcggaugauuuuguuucuggagaaacgugcucagauuccaggcuguuggagguuuugaauugcagagguuuuguuguacguggaaagcuuucugcucuuacagaaagaaacauaaugguuuaaugacugguaaauuccuauuuucgacuaucaucccucagcauggaaguaucaaguuaguguaauuuuggaauggacucuguuaauaugcuagauuuuaaagagaacggggacaaggggaauugagagucuuugagaccuucgggagaucagagggucugcagcuuuccagaacugagccugggcguggcauacucuccuucgguaccgucuccagaggagacuggggagaggacacacacacuccucuuagcuagucgaacccacgccucugauaugauaggcaagugcuuuaucauccaagucccagccagucuucagaaugacuuaaacaagagucuugucacccacuugcugaguuucugucuccugcaggugcuaccuuuguccaugacguggaagucacuuuucacccuggagaggagaggguucguaucacucaaacugccgaggggcuugacccagaaaacuaucugagcauuaagaccaacauugaaggccaggugcccuucaucccagcgaauuucacagcccacauuacuccguacaaagaguuuuaucauuacagggacucagguaugugugaguuuccacagcuguaaaauggacgugaugccugccucacaagacagugacaaggguuagguuaagugaauagucacauggaaugccccaaacugcauagaacacaaaugagguugauauaauuguguucguucuuguuuuuaggacguauacacaguuauauuuuacauauguguguauauaaaguauacaggugaucagagugcugacaagaaugucagaguacacaagaaugucaauauauuugcacauuauuuucagauaguaauaaccgauaagaugcuauccuccaggcacggccuguuuugacuguuagacuuuaggagucucuguaacuguuucagcugaugauuuugguuugcuuuaggggucacagaaagaugcuuuccaguguucugaaacaaagcugagauuuggagucaacauauaaaucgauucacaucauggauuugcaauuuaaaaucauugcaaagucauuuuuucauuuuucuuagcacaagaaaaaauaaacauuuucugcuguugauaaguugcauacgguauaauuagcuguacaaaguuuauccagucugcccugucucacaguggguaugaauauagcucaacacagaugauagugucaugucagaaugucagaagguugggcacaccuauacacaguauuagcugcauacaagguggucacaauaguuguuuugaaguuugugugucuugaguggcaccuguuuugugcccccagcuuccagcaugagagcuggguacagggaaaagauuggaauacagaccuuaacuguauucagaauagacuaggucuggucuuggugcaacucccaagaggaacagccuuuugccuugcuuuucccuaagccuugcugacugugcgaagcuguggaggugggaguggggugggggugguuuccuuuguggaaugugccucaaaucuugagagauguagagcuggauugccuugaguuccagucagagauuuaccacaccccaggcuauucccuaaacccuguggucucugcacacgcagucagugccugucuuauguggcucugaggagcaaacuagguggugugcguacagcccucagcaccagcagcguucacacaccaggacaucaugaugcuuguuucuagugugugaugacgacugcagcacuuguagucccuucccuuccucagcgguguggcucuguauccucucagguuccaggagguccuaggucuuuccuugccagcuuccuguagaaacucugggaguucucaauggcaccugcucccaggaaugggguagaaaacuguaggaggauacaccaaacaggaacauuuuuguuuucaguauuuuaaaguuuuaccaguuugccuguaaaauguuuguuacagucgugacguccuccaguucccgaaguuucucucucacuucugguucuauuaaccaaacgugguccuaccacauugaccagaacaucacuuaccaggcgugcaggcacgcccccagacaccuggccaucccugccacccagcagcugacugucgaccgggccuuugcuuuguacagugaggaugagggcgugcugagguuugcugugaccaaucagauuggcccuguugaagguauguaucucauuuugcugagaaaaaaaaaaaaaaaaagaaaaaaaucauguccuuucuuagaagccuuagaucaggucuggggcgaguaaaguuuggugagugccagauagaaaagucaaugaggcuguccuggccugcagguaugacagguauacaacauggauaacaguccaugccaaaggucacacauauguauagagcaugaaccuguaggcugggugguaccagucagccuuuccccagugcuggggagauggacagaggcagauccuuggagcucacuggcuggccaacauggcugaaucagugagcccugagaacggcuggagcucacuggcuggccagcauggccgaaucagugagcccugagaacggcuggagcucacuggcuggccagcauggccgaaucagugagcccugagaacggcuggagcucacuggcuggccagcauggccgaaucagugagcccugagaacggcuggagcucacuggcuggccagcauggccgaaucagugagcccugagaacggcuggagcucacuggcugaccagcauggccaaaucagugagcucugagaauggcuguggcagaagcuccugugcuugauccccaagugcagacccuggaucccgagguggcaugagagaaccaacucuccagaguugaccuguacacaugcacugucguuugcacaugugaaucucugcauauguauacacacagaaaaguuuuaaaaauuaagguggagauuaacaaucaugggagacaccugauacugaccucuagccuccauaugugcaugcauccauacacauaaacacauguauauugugccacaaaacaguccuaaacccacacaguagacaacacucagccaugagaaggaauagaguacucaugugcuacagcauggguggagugugacagccacgcuaagugacagggucagugacagggucagcccagugcaugauuccauaaacauaagaguguccacacacaggcaacccagagaguuacaaaguagacuaaugcuugcucauggacaagagggaauacacuaagggauagucaauuagggugcaggguuucuuuuuagaguuaugaauguccuaggaugucacggugguugugcaguucugccuguggugaagucacugauuuaccuuucaguugaguggauugugcaugagguauugcaucucaacugaaggaaacuggcagaagcaacugagugguucacgucucacugggccuuagccccgccugacggauaggaucguucugugccuggccaucagcaguagaacacaggagaaccuuauguggaagccaggcagucucguuagacugcacacugggugauuccaacucggaaacacuggagaagggagaacuguagaguugguaaaaaagagcagugaugagcaggguggagaggaaauggauggaagagcaggaccuccguaggucuaugaagccauggcauaccaggcagugaugggggguucuauauucuuauacaugugcuagucaaaaccugagcacuugcacacagagugaacccugauaguguuuaaagauuuuuauuacguauauguauguauguauguauguauguauguauguguguguguauggggguggggggaaggagggagagugcaggugccagggaggccagaagcaucagauccacuggagcuggaguucugacagcagacauacguguugggaaacaaacuccagucuucuagaagagagagcagcaagggcuuuuaugcacugagccauuuuccagucuaagcucucuuauuuuuaaauuguagucauuguuauuuguuuuuuaaaugaauauacaaaguaauagguuucauuaugggauuuuuucauauagacuuuuguucucucuuuggguuaucuuucucacuuagucuccuuuccugucucuaccuuucugcccacuuauccccucccuucccaaagaguggccccguucuuucacgaauguguauucuguugcccucuccuuuaggaccucuuucacgaauguguauucuguuacccucuccuuuaggaccucuuucuaguuuuauggcuucccauaggcucaccuaccuagaaauuaacaccuauacuuuuuaugagaagaaacaaugggguaauccauuuuucuguaaaugucacuauuucuguuuucuugacgacuaaauaaaaguccauugucugugugcaccacauagucuuuaucaucuguuaauagacaucuacgaugacuccauuuccuugcuguugugaauagugcaggcucucucugucaggacuugguauccucuggaguuaaguccacaugagacccauggacguuaguucccggcucgauccguggacuuuaguuaccgguacugcaacaguaguucacgauaacaauaggggagcuauguggccgagguuggagagaugaggcuaugaaaacgcucuuagcaauuuuuuuguuaaccugcuuguuccucaaaggcugucuguuuuacaaacaugaccuacguagacaaucuaggaugggcugcaaaaucaggaaaguccacagagaaucaaggugacguuugaguuauuuaaaccaauucaucaugcuuucccccuagagcaagaggcaugugaagagagcugucccucagccacugcugucccucagccacuguugucccucagccacugcacgcagagucacugucagcagcaccugugaguguugcuggagcugacaccccgugugccuccacagacucaauauggguguuuccucagcaaugcguuagcuaaagaggaagauggcaggaccuuggcugaaaggagaaaccugaguuuguuaguuugguugcuuuggauaaaggaaacugggcuaggguuuaccuguuggacagccaacgguggcauuauaacauaggaaauuaaugcauggagaugccacuugauuuuagaguagcauguaaaucaagagggaagauuccaguugcauuccgugaggagaaagauaaaaacaccugugucacacaaaccaccucuccaugcacagauccccgcucugcccucuccaaguggagagaucuggucugugaggaagaaccgcccaugucauagaaugccauggacucauuuaggaaaaugauuuuucugucuuuggaaauaucgcugggucucuucuuaccaaaugagagcaagcuagcaaaaaguaccaauugcuaauuagucuugugagcuucuuucccaccccaauacuauuaacaaauaguaugguaugguuucaaacacugagugaauuagcuuaucuaauccccauagcaaccucuacucaacaaggguguauuguuauuauuucuuuguaguuguaaaacuugauauguugaggugaaagaguuugaaaugcagcugguuaguggcaggcugggauucaaacccuggcacuggguacagagcccacacuugccccacaugguacagcugcaccacaugggcucugucaguuucacaacagccucacaguauagacccagaucacaugggaaucucacaguauagacccagaucacaugggaaccucacaguauagacccagaucacaugggaaccucacaguauagacccagaucacaugggaaccucacaguauagacccagaucacaugggaaccucacaguauagacccagaucacaugggaauguaggguuuuaacauuuugagauugaaccaugcuucgcaugcacacuuccccugucauugcacaggagccuuuccagagggggcucccaucagucuggaaggcaugucaggucacauaaccauggaccaacguggcucuguguuauaguaguaauuuuaggaggggugucugcccccacucuaucccauuuagcucccaaguacacacaaacacuucagaucuuguuaacaaccugauggcaguguugggcagguucugagcuauucuaaccugacuagucuaucaguaagcagauaaaugccagcugagucuugcugucgucuguguguccucagggcaagcuucucuuggccaugugcucaugguccaucauguuucauggugaccuccucuuucccuucuccuuuguucuucuccucauggucccuacucgagaucuccucacucagacccaaguucugccuuccucucucuucugcccagucacgggcucuagcuuuuucuuauccaaucagagauuacuggggagcauucuugacagcacauuggucaauacagugcccauguccagauugcagcccaacucuggagcacagaacucagcaucugaauacacagcgcacaagaccaacuccaacacuggcuuugcaagaugcagauagugcaauaccccaaugaggaagagaagccugugacucuugcuguccuccaacuguaguccucugucccaagcacuuugccauauugucacaggacagaacacggugcucguccucccucggcaggcagggaucagagggccauucugugaaguccagugauggcuccuuuaaggaaaccauucuucucuuucuaagugagucagugaauuccagcucuugcuucagggagucacuagguuaagugggugaaauaugaaauggcuuaagaagggcaugaccgaccuuggcuuacagugagaggagagagcuagcaggcucagaaauuaugaacagugaagugguuuaaggaaacguuuucucaagauguuacuggacgcuacacauagugggugcacgcagaagggcucacugaaguagcugauuuuuacauuuuuauuguuuuucucacuaaggggcucagcauuuccccuuauaacuagcucuuuaacuguugucuguuaaaucaguauuguguaauuguggaugugcuuauauugguguaaguaugguaguuuaagaguacaggucaccucuggucugcuucuaaaauucucuuuuuauguuaaugccagcagggagauaggcucugacaaacacgugcgcccauuaaucuuuccuggaauucacuguggucagcuggcuacugagagggacugccuaggaaggcuaagcauugguauuuagaaacuaaaguaguuuguagaugacuauucccuuuggaagauauucuaaaaugaggaaauaauuguggggagagcaagguucuugucuugcauggccuggugugaggcuguuuuuaguuaaaaucuggccagagacugguuucagugacucugucuacaugcccauguuaacugaguacugcuacccccaaugcuggguucucaucccuuggcaaacagauccagaagaaggcauucccaggauggauggcaggcuuuuuuuuuucccuuuuggucuggcagagauucccuuauguuagcuaacauuggggugaacuggggauagaccuauagccaaccccacauucaggccuugauuggggagcugaaaaugaauguucugcuguuuacuaggagguuaucucagcugaggcauuucaguauacaacagacuguugaagcaaaacagaagaggcuaacuugggcagcaggacagugaaagugagacagugagggucuugagggacucaggaggaagccagcccucugaaguaggcuucaguaacuagcacuuuggacgggucucagcuguagaagguggcugaggagucaugggugagacagaaguggcagagaauccuggcacuaaggacaagcagaaguccugccaagguguauguacagaugcuaggauucuggcuucuaacagugagagaacgauuguacaggugggguguccugggauguguaugaaccugcccuccaaggcagggaucagacacagacguaagaggcagaaacccgcccccacccccauuauuauaucgugcaaggaguagucugauagcaggagugacuuaguacagagauugacguacacggagcuccuugaagcucucuguguccaagauuacaguuccacagacugaggcaaaacagaaaccucagauaaggacaaagcugccgcacugaggaggcaggaggacacagucucucaggaccacaagacaagccaaugggaacaucagccuuggaaauacauuauguuccauuuuaaagagcaaauccaggagauacaaacaaugcccauuggauucugcacugaagagucagaagggggucgcugggcaucuggacagcauccuuguugucugugccuuuggguuagauagauaacuuuaugaggugucucugcugacagcugcagaauggugggcagccugggcccuggccuggagcuguuuggauuuuuuaucuucugacccuaccuacuucuccugacuguaaccuuaggcaaguuacuugacagugccucauagagaaggaagguaggccauugcugcugucugcacaugugaucgugcagauuucaugggauuggacauggaggguuccgaacgccgcugaggagacacccaaggagugucaucuaugacuuguaugacucuccagaagugauuuagagauggauucacaagacuuuggaagaguaggcggugggaagcuauuucuauuuauuugauugugucuuaguucagauuuuacugcugugaacagacaccauaaccaaggcaacucuuauaaaaacauuuauuuggggcuggcuuacagguucagagguucaguccaguaucaucaaggcgggaacaugguagugucuaggcaagcaugguucaggaaggccacuaguggaagaaugacuuccaggcagcuaggaugagagucuuaaaguccccacccauaguggcacaccuacuccaacagggccacaccuucuaauagugucagucucugggcugagcauauauaagcuaucacagguuguaucuuuacaaagaaaguuuuggaggcacaaagaugacccaggauggcucauuggguaaagggguuugccauauuguacucguuuucuuucuguugcugugauaaacuccaugaccaaaaccaauuuggggaggggaagguuaacuucauuuuauagauuacagucuaucaugaggggaagucagggucgggggucaggaacucauggcaggagccagagguaggagcugaaguacaagcuacaggggaguguuguuuguuccuccuggccugcucaguuugcuuucuuaacaucccaggaccaccugcccaggggugguaccacccacugucagcugagccuucucacaucaaucauuaaucagaagaaugcuccuugccuguaguccaguccaagggaggaggcaucuucucaaaugagagucccuuagugagaugaccuuagugucugucaaguugauaaaaucuaaccagugaccagagggcaauuccugaaacccaccuaaguguggaaggagugagcagacuccauggagcuguccucugaucucuacaaguacacugggcauucaagugugcacagguguguguguguguguguguguguauguguguguacauacacaaaauuacauagaucauuuuuuuuaauuuucaaaaugacuuagaauuucaaacuuauccuccugauagagauagcugauaauagagaaacauucuuaucuccaguaagauaaggaaguggcaaugguaguaggaacucuugugugucugugucugugucugucugucugugugucuguugaucaugugcaugcagugaucuggagcauuacaaacucuaaccaaggucuguuuggaugacuuccugucaugcccaguguucuaagcaccaacaugcuagccuucccagcuauagcacauaggaacucuugagcuaggacucuuccuaaaauugagauucugacugagacagagucugagacccugugagguguuagauuuaauccacagugagauugaagugagcgacugacaaacucagccagaaguuuggagguuaagucugugggccaacaugcuugcugacucuggauuuaaguacuguaucccaugucucuugcucgccuuucucaugggaacagaagucuggcacagagucguccugagagcccaggggaugcgagaggccuucuugcccuggaagcaaaccuacugaaagccagacccugcucugcagagcaggcaugaggaagcuguugaaauuagcaucaagauacaaguaguccaccuuagcuuugaacucauagcauagcaaagacuccgucuccuuccuuuccuccacauucuuucugggauagucacucugacuuuuucuguuucuugcacauaguggacucagccccuguuggagugaauccuugcuacgacggaagccacaccugugacacaacagcaaggugccacccgggaacagguguagacuacaccugcgagugcacgccuggguuccagggugacggacggagcugugugggugagagacauguucuccauuucugucgcauaguccugguuuucaccuucucuuuccugcaucaggcaaugauuuuagccucucuuaaucugggcaccaucauaugaaagcggaggcagagucuggcuagguuugggaagguaguuuagagguggguauuuguguuagagcuauagaaagaaaucaucuuacaaaaaaauauaauuguuucacuuuucuaaaguauucaaaaauuaucuuccuauggcuuaacuggaaagauuugaaaaugguugucuuuguuucugaugaacugcaacuugggucuuucugcccaguguccaaaacucucaaauuucuaugcuuuccauuugccaacaauuauuuccacugaagcaucagagugcuggggagauuaaguucuuggaccuuuguuucuggaacacucaggcucagugcuuucuguccucauuuuuuugccuagaugucaaugagugugccacuggcuuccaccgcuguggcccuaauucugugugugucaacuuggugggaagcuacaggugugaaugccgcaguggcuaugaauuugcagaugaccagcacacuuguaucugugaguaccagaaucccucuucccuucagcuaggaggcugcuggaccccaccuugugcuucacugacgucucuaccgugccuguuacaaugaggcucugguguguagcguuucugaaguauguagcccucugcugcaguauguagcccucugcugcaguauauagcccucuacugcaguauauagcccucugcugcaguauauagcccucugcugcaguauguagcccucugcugcaguauguagcccucugcugcaguauguagcccucugcugcaguauauagcccucugcugcaguauauagcccucugcugcaguauguagcccucugcugcaguauauagcccucugcugcaguauguagcccucugcugcaguauguagcccucugcugcaguauauagcccucugcugcaguauauagcccucugcugcaguauauagcccucugcugcaguauauagcccucugcugcaguucagcucaguccugucaugaugacaagucaccauuggguuuuccccaucuagguauuauauugaguuaccugaggauguucucaguugggauucuggagucacaggaccagacagcaauuaguaacaccccagcucuagaaagaauucauguugaaagguaccugucuuaugugaggagccaaagauccccauccacaauaaauauacucucuauggauggaucugaaagaccuagaauuccaaauuuauccaauugauggagcugauaauaauacacauuucagucuccaguaagcugacagaguaccaaugggacugggaacuguaugggguguggcuaucugucggaggugugcagugcucuggggagaugcaagcuguaaccugcaucuguuuugaccacuuauugucaugucuaauauuuuaaacacaaacauacacuagcacaucucaacucuaauagguacaugaaccuugagcuagaaaucuugcuaaaauugagauucugacugagaccccguauuccuuaagcuccgcaggugugccgaugcuguuagucugugggcgggacgaugaagagaaagguucgcacucagcucuaaacucucacuuucuuuccagugaucgccccaccucccaacccuugccucgauggcagucacaccugugccccugaggggcaagccaggugcauucaccauggaggcagcucauucaguugugccugccugccaggcuucauuggcacugggcaucaguguucugguaaguaccugugggugacucuugaggacucugcauggucccuuuagguauacauccucauagagacacagcuucuccccuccugugacucaugcagccuugggauugcugaaagagaacaggcaucuuuagagucaggagggagcccagggguguucuucaggcgccagacuggugaacacccaugguugucuuggaguguugccaucaguuuggaaacuuucuguuccuuggagcuaguguaggcuggagggacucauaccuacaguucuaacuaaauucucccaccuucaucauacaccuagugagaugggcuguuauguugguuaacuugguugguugguugauuggcuggcuggcuggcagguugcuugguuggcugguugguugguugguugauugguugguugguuuguuugugacaggcuuuggucucccuuuguagccauggcuggcuuaaaacucaaagagauccauuugccucugccuuaaggaucaaagggguaugccaucagaccuggcaguuuuuauuuuuuuauuuuuuuauuuuauuuuuuuuuuuaagauuuauuuauuuauuauauguaaguacacuguagcugucuucagacacuccagaagagggcaucagaucucauuauagaugguugugagccaccaugugguugcugggauuugaacucuggaccuucggaagagcagucgggugcucuuacccacugagccaucucaccagccccuggcaguuuuuauuaugaacuugucaugagcuagauuuaucugggaagagagagccucaguugagaaacugccacggucagcuuugccugugagcauccucuugauugcuaacugauguaggagggcccaagucuacuggggcuauaugccugggcaguagaagagaguuagcuaagcuugagccugacagugaggcaggagagcaagccauugaccugcagcauugauccuccauggucucugcuucaguuccuguuuugaguuacugugauggguuguggucuggaaauguaagugguaaaauggagcuuuccuaaacuacuucugauuaguaguuuaucuuuuccauuucaaaugcuuuccaaccuuuguuuccucaugguuuucucuuacaauaaccgacuuucaguauugucauauacuguagucuauuuagacaauuuagaagcuucccugaauaaaccuuuaucuugaugcauucuucaguuucuuaaacauucacacuauugguuaugaaucugauuuuuaaacaggcucacaaggcccaccugcuccugugggccaggagucugggcaugagucaguaggugcuaagucuuaggaucucuaguaaggcuuaagacaagagucaccacuuaguauggacaggugucaggauuguuggacacagagccucuguucugucauagaaugcugugcccuuugguuucuugucacgugggccuuucaugagacaagucuguuuagucacaagucagcuugcuuuauuauggccggccagcaagauggaagucgucaugcaguguuguuuuacuuuguucugauuguaugucucuaaggagagucuugauggagauuaugcauaucaugagacaagggucaccgagauccaucuuggaggcucccuuacaaacuacagccauguuugguaaccauccaggcaggcuucagagagggguuauucuccuaaagauuccacaugauagucugugcuaaucugggaaucauuugcagaguaaaccuacaacguguuagauaugugcaugcauucauauuuagagguguuucauaguccucaugucugugagccaagaaggcuccuugcugagaggcucugugauggggaaccuugcagucagaggcacacaguuuuuguuccaucagaugaaaugaggcugugugugauucccuccagccaugcuuuguuaggaaccaggcucccugggaaggugcccuuggauucggauucucagucugauuuaagucacuagcaggaggcuuugauucgaaaagagucacgucuucucugucuucccucuaacuggagcaguuuccauccuguacuagugugagcuggaucguucccagguuguuaagaaccugggugacuuugcaggaagagcagauugucuuggaguuucaggugaguuaaggaagccaggguagagagggucuguuuuauuuuuguucaggaggcaggugaaugguacagacauuguucucaggaauucugugcucagagacacuggguaacuaaagcauggacaagaggguguggacauagaaggaacaauguuuaucacuagugccaccacuaccacuaccacaauuacaggucccaagggagaucaccacaugccacacaaacacaagcagcagacaguuaugugugauuggacaguuagggaacagagagaagacaaaggcguauggaccaaagcauaggguucuggguaguuuaaagguuaaucagcaccagagaauuaaaacaaugaaagcaaggcagucauucaguaguuggauuugcuuccagcagcuucuguucagaaugagggcaggaagcgcugucaaaacuccaaagcaugagcuacaaauggaagguuccagacguauuuuucaaacagauucuugaguuuaauggaugaaugguguuggcuucgauugugcuggacucucacugccuuuuuucuguugccuuugugacaagggacuguccugcuccucucaguccuccugaccugaccugagucuuccaucagccccugaacaucaucccgcucacuaauuaauuguuauuggagucuucauaucaguggggauuaaaagauagccccuacuuuugagaagaggccaaaguccuucccuaucuucugucuggacacuugucguccugugacacgagcucuaacucucugcaaaucccaugguguuugugcuccugaagagaugcaaagcaagcucugagcucaggcccugggacugcugacugaccucuagcuauccaucauggaggcccuccaagaugaggcuagacugcaauucugggagccuacaguucuccagcuugggggucagggauuucuugggugugauauaguaaacuucuucaaggauuccuuuccuacuuuugcugguuauuugugacaauuacauggcauccaugaagaauguaacaacaggggagaaugacugguucagguuuggucagaaucccuaagugagggcuuuacuaaggagauuuggcagccuuggggacuccccacucccuuaguuaaaaaauagccuaagaaaggacucccugggguccugcaguaggcccuguggucagaaguuccugcuuccugccauugcuugggguuccugucgccacuggaaguacuuauaggguauguucugucauagcgggaauuuccugaauuuggcuggaaguucauuuuuauagcuuuggcuccuuggucaguuuagagccccucuaggcccagccagcuccccagucgggugugcccuggagcuggccuuugaagagacaggauaugcuaguaggauaaaaacgacaguucuuuaguaacugggaugcugucuaggaugcucacuaaacaacucccuucuuaaucuugggaggugaagauaaccagaaaggcaguuugcuugcccagggagagccgcuccagguggaguuaagcuugcucuauugagcauucauggguuuuuggacucagaggcaaaaggaugaauaagcagaugcuuccuagacggguguaagggcuuccuguccagggaaugaaaugccuguguguaaggagcaguggcugcccaccagcugaggaaacuccugagcuguaggagcgucuggagaaugggggcuugggagagucugucccugaucccacucagaucugacccugguuauaaagucccacuuuccacuggugugugccugcccugccaugaccacaaugagcccagcuccuuuucucguuuuagguuucuugccaucaccuugucucgugguuuguuguuguuguuguuauuauuguuguuguuguugucgucgcugucgucuccuccucacacuuccauuugcuguuguggguaugacacaugcuuuguuuugguuuuggucaagcugagguccggaagucaaaccuguaccuuuuguuucccccuccauccuuuuuccucuggcagacuuucugucccccuagagcucaccucacccccuggcaucagcuucaguguuucugcuucagagaguuucuuggggguuuugaguguggaguggggaagagguggcuugcuauugauaaagccugggccagcuuuaacaaguaaaguaaaaggcuuaucagcuggcuuugcucaagcuguucaucuugcaguuuugagugcgauuauggaaauccucgggaagcucauguggagugcaggggccugggcugcuucuccguggucaguaaguucaggcucucgcgugcaugugcaucagaagugcaauagcagccaucucuuuguacaagugaagaguguguuucuguaaagccgucucugguugggggugggggguuagacagcagucugaucaggcaaggaucaguuuccuucuaaacugaaaauguguuuggggcuucaucugacaccuguaccucuacaggaauauaaagggagcggauuucaaacaaagaugaaaaaacuauuguuuccuauauuuaucuuuuuuuuuguaauaucauugacaggaaauuagugauuuacaguauagguuaguaguugaaaggaaauaacgucuagaauucacaguauccaaaaacaccccagaaauacucaaugggauauuuuucucuacauacccauguucagcuucgauuggguuucuacacugggcauuugucucauuuguguuuguuagcucacaugcgccuggauuuaguuuugucucaggugagguuacaauugcugugaugagaccaaaagcagccuucagaggaaagaguuuaucucgcucacacuuccauguaacaguuuguuaucaaaagcagugaggccaggccaucaugcagggguggaaccuggaggcaggagcugaugcagacgcuguggacggggacugcucacugccuugcugcccauggcuugcucagccuacuuucuuauagaacccaaggauggcaccacccccacccacgagggacugaguccacccucacugaucacuaagaaaauacccuauagaagcauuaucgcaguugagcgcgccccuccccuuuaugucucugacuagugucaaguugucauaaaacugccaguacacgcuuucuguuuuguuuuuuguuucuguuaugcuuaguguucgacauuagcacgucucagcucagacccagggauguucuagccacgugcacucugaccauguagucacacagcuguuuguggugaagucauggccuuccuuccuuccuuuccucaccucucugccugucccugaccucugcagauguugaugaaugugcggaaaaccgaugucaugaggcagcuaucugcuacaauacccccggguccuucuccugccguugccagccuggguaucgaggggacggguuucacugcaccucugguaagugauggaagaccugaguaaacucgggaaucucccagcuccuucccuccuauuuuccucccugcccaagauggaaccuggacugaggccugauggggggcacuuuccaggcucuggauucuucucaguagacuccugauguccacugaccgcuagcugguugugagcuucuuggagucucacccacccuguggcugcucugguucacuacccgagugaugugcuuugcuggguguuguuuggggacccauugaggggaagcuuauucaguaggagccucaugcacuggugagcccaagucagcacucguggugacugcuuucaugggccuuggccaacauacagcaacauggcugcuacugaccugggcugcuuagacuuaagacucugggucccaaagaguggauggaguuaacuuguccucuccagagucucccagaacgccaggcaguuuauucuucauuuugcccagauaucagcuggccccaaggcugaggaacaaacuggacuagcuuacauuuguauuuauguagggauguacggggcaaauggagggaauucauaguaacuagguaguugguagcaaagcccgaauaagaacucaggacucuaaaaugugagugucaggcuggcgagauggcucagugguuaagagacugagcucuucugaagguccugaguucaaaucccagcaaccacaugguggcucacaaccacccuuaauaagcucugacucccucuucuggugcaucugaagucaguuacaguguauuuauguauaauaauaaauaaaucuuuggggugcagcaaguagggacugaacgaguggaguugacuggauagagcgaggcugacaggagcgagcagagguccuaaaaauucaauuccuaacaaccacaugaaggcucacaaccaucuguacagcuucauuguacucacauacauaaaauaaauaaagaaaucuuuaaaauguuagugucuuacuguuuuucaaugucauaguaacuuucgauuguauggaagaaacacucaguacagaagacuuuaugggggccugguuaguguggauggguugcaggaccuuuuauuucuccuuuaugucucccucagacacgguuccggaagauuccaucucaggacugaagcccugugaauaccagcagcgcuaugcucagacacagcacgccuacccugggucacggauccacaucccccagugugaugaccagggaaacuucgugccacugcagugccacggcagcacuggcuucugcugguguguggaccgaaauggccacgaagucccuggcacgcagacuccacccggcuccaccccgccccacuguggaccaccuccaggugagccuccugccacaaagacaucccguaugcccacccuggccuggagucaagggacagaauggcuuugaacgugggugguuuauaacccagcucugacucugcagacgugggucugacuggcuacugucuucucauggcuuuucuuccuccaaagaacacuuggcugauauagacacacccaugugcauguuaaugucauagggacauauagauacaaagugacaugcaggauccuuuaugcauuggacucuaacugcauagauccuuguugaguugugccugaaagcugagucucugagucaggcugcgguccacugagagaggcuugagagagcugaagaguuuuccuagcauagcguuaaagcgagacuccuuucuagguaaccguguagaaagcagucugaaggcugugcuaauguuagcaaguaaauuagguauggaacucggaguggaugcauugagcuuccuucuaacccaauggcccccauccuuuucuagccaauccaguguggucuugggaaacccucuuuccacagcugcuuucggaggaaguauagaaacccauccaucugaucugaggcguucaugcaaacauggccaaggugcuagagcguggugggcagagucucacgggcacugugagcagcagcagcuuacaccgggcagcuucccagccucuugcugaauuauucagaauugggcaacacgugcugcugcuucagccugaauacuuccugaugugggagcuaguauccaaagagccacuuucuaaauuauaaaauaaaaaguaaugaaauuauaaaaacaguuuauaagccacugaucucagcuuuuagugugugagggaaacugagccggacaauuuucagcagucuugauucuucaacauucguaacucaguauuuguaagauucauguauauaaaaguuaggggcauagaucugggaagaguugggggagggagggugaauauuauuaaaauagauuguacaagauucucaaaaaaauaaaacuaaagauucacauaaguuaacugguaauggauugcuccacacugauuuugggacacacacacacacacacacacacaucucauccccacugcuucuaauagguucuuuaggaaaaagauucugcaggccuuaaaaaauaaggugccuagagaaauccugauuuggucguggcuccucucaaaagccucaguucucugugagagguuugagagucagugguucaguggccguggagggauggcucggcacucuguuaagcugauuaaacuaacaugugcuaaggauagugacgcaggcacauucccuuguguagacaucucauggcccagacuucuucccuggcacugcuuggccccgccugccaucucugacuagucucauuugcauaaccaggccuguuggauggaggguagcaugcucugcacucaagacuguuugaaccuuaaccaaucaaaagcaggaaauaagcaagcccaugauuggauaacuuagcuuauagcagugggggaugggacgggugcauaccugugagggaucugagcccuaguugacuugcuauguguuugcauccauccagacacaaacccauguugggugguccccagaaacaggaguggcucuuggggguguucaguguggcuauggugguuuucccagcacaucccacugugaaguggaugaugaguguuucaggggguagcuguccucucuccuguccuggaacacuuugggcugagcagggcagagucuugccugugucuccuuugcuuccuguuuguucuuuagcuaaagccugagggucagccacuuccuaaaccugugagucucgauugaacuugcugaguuugagauuagaggcucuauuggcuucuccccagccucaggcgagcuugugaugccccccagcuuuguucuuugaagugucugggggguuuucagcagcagaauggacuaaguuguccuagguuuugaaugcaccauuguggcuguuggcugagugcacugguuugguggagugaaggcuucagaaggugggaacagcaaagccagcccaaaggcuguugccauggucucuauguaagauuaugccuuggguuuaaaugcccccuuguagcugcuggcugaggauacacugguuuggugaggaaagguggaagcaaagaaacuagccagugggcuguugccaugaucccagugugagaggauuccuguagccaggacaacacaugggagaagagacaagaagucaagacaaucuguuguuuuuguuuguuauuguuguuguuugauuuugguuugguuugguuuugagacaaggucucacuaugcagccuuagcuauccuagaauuuacuauguacacgaggcuagucucgaacucacagagaugagccugucucugcuuccugcaguacuuauguucaccuccagucagaauguuuuugaagguaaaauuaauaagacuuuuuugaccugagaugugaggagagggagagaagggcauuggggugauuucaucugagcagugggaaacgcacgugcuguggaguguaacuaaaggcacgaggagcaaguuugggagacagcagaaguccaguucgugcuuucgugcugagauuuggguuaugccucuguaugguaguagcacgaagauaauuaauuggcugugugauucugcagagcauacguaggcuuugaggugcagcgaugaagacagagccagaaaugccuuuaguuaugcucugcaggcuaucuaaccgcagugaagaagugauuucagcagcugaugguggagccuuuguagcuccguccucacguggaaggcagaaccucugugacccuggggcagcagccuagcagaaaguugcagggugagagggacuggcauacaucagaaaccagcaggucuuucuuuaaucaugguggaaccagaagcccgaggauccgagggcgguuggggguguggaguccuagagaaaacaggaugguauugugacagaagaguuuggcagaaaggcucagcuuugagauagugccagcaauacaacagcagugaguuccugaagcuggauaggccaagaagcaguuccccacugcucaaugccaccucugcugugccauaugcagugucccgucacccuugcuccuuguaacuggccacugaaacggagggcuauagcucagcauggucuucagacucuuuuucuagggcacauagaucagccuaugauggcuguuuuagcaaagaacuugagacaggugggaaagaguugcuuuaaagugccaugggucacggagucuucagagagucugaacaaugcucugccaucagagaagcccuggcacauagccagaugcccaugugcaucuaucucacugaccugcgugaggugcauggaugggcuugcuugucuccuuguucuugucugauguggcugggccucugugccagguccuccuggccuugggagaugggagcaucaaggaacaucagggugacuucuuuucuggguuuccacagagaacuucugagaacacaugugcuuccuuggcccaguguccaggggcauggccaaggccuugaacagagggaaaggaaggcuaggagaucaggaguugggaccuggagcuguacugaucuugauuggccauccaagguuuuguuucuccaucuuagagcccacccagaggccucggacugucugugagcguuggcgggaaagccugcuggaacacuacggaggcacacccagggaugaccaguaugugccccagugugaugaccugggccacuucaucccccugcagugccauggaaagagugauuucuguugguguguggacaaggauggcagagagcuacagggcacgcgcucacagccaggcaccaggccugcauguaaguguggcauggcccaggcacuccugagugucacugaggguuuucuguugggguuucugaggugggaauaaagucaucucaucaauaugcuggguugacuuaucaucaagguaucucaggaucccaaucuggauuuaacacuggcuuugccacuguuauaagaauagcuugucucaggccagagugagacuauuuugccccccagcccugggugaaaggggacaguaccacccuagggccccaggguacauuuggcugcuguaccacauccuaaaacccugcacuugguuagaaggcuaguuaucuuuaucuuuugaguaaauggcagaaauaugaguaauuaaucuucaggaaaaaacaaaacaaaacaaaaaaccucagaaaccaggauuucuuugaaauauguuccaggaagaacuggguaauuguggagguucuuacauacagaaguaacuuuccucccucuguccaccuucccacaaacaggcauacccaccgucgcuccacccgugguccggcccacaccccggcccgaugugacuccuccaucugugggcaccuuccugcucuaugcccagggccaacagauuggccacuugccccucaauggcagcaggcuucagaaggacgcagcccggacccugcugucacugcauguaaacugaguuucuccaggagggcugggcuccacgaggaggguggggucugagaugaggaggguggggucugggaugaggaggguggggucugggaugaggaggguggggucugggaugagguugcgccuucaggcuugugggccuggaggaacugagcuuugugguuuucagagggaaaugcagugcugugcagugcagggacuccuggcaugcaugccucugggcuucaucugcuuuaguggggcucaguugcuggaaaucaugucuaacccacucuagccacuauauccugagggcaucaugaaaguccaaauagcggaagaauuucggagcuguuggcuguucaugggaagaucauuguuaccucagguuccuggggguucuguucuggucacagacauuuggaagugaaaacaaaacaaaacaaacaaacaaaaaaccacagaggagguggucauuugagacaucaggguagaaaucaggaccacuugucaggcuguccccuuucauuuuccuuuugucucuuugacucacuccuuuccuggcgcccugccugguccacuguacggcuuuggggaaagugugcugccuauucagccccgccccgcccugucccgcagccccgccccuggggaugcuuaucucuugagcuugcaaggcacuuccauguggagggagggauuucuucucugaaguggggaccagagagacggauagcuaccauggaagcugguccgauccugucuucaguguacaccgagcagacauuucguacagggcagaguucucucuguucacuucuguucuugaacugcuguuccuaagaaagcgucaaagcagccagcgugugaugaaaagagggccuuuuucuucgagauucgaggcuccggccccgaucccaguuuuuaagaguguagggcuuuauaaguuucuccaugcuaaccgucuuguguucuagccacaccagauggcuugauugccuuuccgaacaugucuaaaugggcagggaggagaugguuaugguagaacugaaggagaagagggaauuacaagcacucuugagggcaauuucccuaaagugugaccuucauaccaagaagcuugguuuaugaaucccgugagucccugggcucauugccaccuacaugaaugugugcccuugcuucagaaggagggaggaccuuuuaaguuuaauuuucaaauaaaagugccauugaccuuagguccccccauauaaaugcuagcuuuucuacgggagccagauucuucauacagugucucauggugauuacuuuaggccaagcccuaggagguuuuccuaggcaaggcggggacugguguggccuguguugaacuccgugucugcuggggguuucacagcaagaaacuggguuagaaauggaaagaagcaaggccuguguggagcucaagcgggaacaucgaagauucaggguuuugaauaagacggucauucaucacgaaggaaagggagaaacuaccagccaaaggcuggcgaccacaguccucccaaauuguuaaaucacaggcucucuuguauacugcacaacuaauugcuuauauuaagaggcagggguggcuacaccuugggcuggggaggauuucauucuguucacccaguagggaaaucuuguuggcauguguuagcagauuuuagaaagggucuuuaagaaagugccaggaacacuuagaagcguucaucuuuugcaccauuaaauauuaagggcuuaccuagcgggaugcuccucucaucagggaaagggcugguuuuucucaugaagugaccguguucacagccagugcuaacaguacuggaggagcuugcugucuggagguagucaguggggcccuuuauaaaugccuuacugacugccguuuuggagaaaaugaaagcaugcagguuaaacggcugagccuggcucugauccgagggaggaggcucccccagcaccgcaccaccacagcgcagguuguucacaguagugcuguguagccgugaacuuaagguuggggauucaggaauccuaauccuucugaugucaccauugguccucaaagggcuccauaguuguggggauugacuaugacugccgggagaggauggucuacuggacagacguugcuggucggaccaucagccgugccagcuuggaggcaggagccgaacccgagaccaucauuaccucaggucagcagcuccucccauggauacuuggcgguaccuuguguguugcuuccguuggccuguuuggucccaguuucucccacgcucaucuaaagggaagguuaaguucucugcuggugacuuuagaaaggugguuuaggauaggaugaaugaacugccacuccaagagugguucgcagugagacugcagggucuggcaguuuagauugccugucccuagcaccacggaugccaggugccaucagggcagcaagguccagcacagaagagacuggauaugguuuaaaaaguuagccuucguccuggggcuuaaggcuuuucuguucuaugcucuggauucuguaagcugcucagcagacggggaacuugauuucgccuucuacaccagccaaugcuccugucuuacuuuuauuuccagguuugauaagcccggaaggacuugccaucgaccacuuccguagaacaauguacuggacagauaguggccuggauaagauagagcgggccgaacuggaugguuccgagcggaaaguccucuuccacacagaucuggugaauccacgagccaucacuguggauccaauccgaggguuagcuggcuuucuuuggucucucaugcagaucuguuuuggagacccuggcucuuauauaugucaugggaaggucuagauagaccagaauaaaaacucaaauacaguaauucaccagauauguagacccgcugcugggugucaagcauucuuguaggcaaaaaucagggguuuuuuuuguuuuuuguuuugagcuugcaugcauuguacaaggcauucggaaguaagaugacauucaguaaagauguuaguuagucugggaugggaugugucacacggagaagccagaccccaucauggagaauccagaggaugccugggucagacgaucauuaggcagggccuuggaaaaggaugggucugcagagggaguuguuuccuucagccguucccugagcagaaacaccacagcaggguuuuuggguuuuuuuuuguuucuguuuuuuucuggauggagaguguacaacgucaagauaaaaauguucucucuguggcagugccaaggccgucaacugggguauccaggccugggucagaggucccaggauuacugagcugcagcguccacaaacacaguuacagagaaacccuucaaggugugaagguucuuccugaaaguucuacacaggaagguuccuuaucugcgggacuuaauuaacccuugaggcuccucuuugauggucccugguacuuagucugaccggucagggacugaacaauggcaccuuguucggucauuaggcuccaagaucuagagucuagaggacaaugucacagcagugugcaugcauguaaugugagccccuccucgcagcuccaaggagacugcucacugugugguucucggccugccacaaguagaaacugcucucuggcucucacugccacccacaaggagugacugccacacagaggaaacuguuucucucccucuugcuagggcucccugugguucaaccaaaagauaucuauggcuuucauggaagugccacuguuucugcucuguaacccuguuuccauaugcauaacucaucuccaacuaaugagauccuacuuucugaguauuuuguauguuaggucagagucugucuguccaggucauugccagguguaggauagcuaaguuucccuuccaacacuuaguguugucccaggaaacucucccuugaucccacugaguuucuuauaacaggucccauagcuucuaccacagauuuuuuucuaacaaauacauuucuuuggauucuaggcccaagaucuaauucaagauuucaacaaauuaaggguuucugggcaaaugcaucggguuugugagaggcaaggaucuagacaguuaauagauaaugacuucccacagaguuacgauugucagaaagccauggcagccuaaggcaacauuauuaacugugagugagguaucugggugagguaaugucaaaaagcgacagccaaagguacuagccaggcaaggccagcaugauccagacuuucuuggaaaggucccuuuccaaacucuuguggacugcuggcaggccccaggcuauuguuggccauugggcaagagguagcuugcuguauaaaauccaacuuccccuggggagcaagaaaaggcacuggacagaagccaauuuaaaaaaacaaaacaaacaaacaaauagugaaagugauuuuaugacuucuaccguaccauucaccaggagcaagacacuaaacucagccaaauucaagggaauuaaggccgagaauaccaggaggagacaaucagccagugguggccaguguggcugaugcacagggugugaggcagggagcgaugcugaagguuauacauucgaaacaagagcccuacuacuaagcuauaugccacaaccccugcacaguuguucauaacaaucuuaaaauuuauccacagcaacuuguacuggacagacuggaauagagaagcuccuaaaauugaaacaucaucuuuagauggcgaaaacagaaggauucugaucaacaaagauauuggauuacccaauggauugaccuuugaccccuucuccaaacugcucugcugggcagaugcagguaauacuggauguggagaaagguaugcuucccuuacagcuagcagugugagcacuaugggaacagcacuacaaaccaaauccugcccaucuuuauauccuuucguuuaaauuucagucagcacagaauauaccagaucuguaagcuuuaaaagaaccuuuuacagugauucuuacaguaaauuuucuggggcuuagggaggaggcuggacuguguagcaugucuguccugaccccugaccccacuguguagcaugucuguccugaccccugaccccacuguguagcaugucuguccugaccccugaccccacuguguagcaugucuguccugcccccugaccccacuguguagcaugucuguccugccuccugaccccacuguguagcaugucuguccugcccccugaccccacuguguagcaugucuguccugcccccugaccccacuguguagcaugucuguccugcccccugaccccacuguguagcaugucuguccugcccccugaccccacuguguagcgugucuguccugcacccugaccccacuguguagcaugucuguccugcccccugaccccacuguguagcgugucuguccugcccccugaccccacuguguagcaugucuguccugcccccugaccccacuguguagcaugucuguccugcccccugaccccacuguguagcaugucuguccugaccccugaccccacuguguagcaugucuguccugaccccugaccccacuguguagcaugucuguccugaccccacuguguagcaugucuguccugcccccugaccccacuguguagcgugucuguccugcccccugaccccacuguguagcaugucuguccugcccccugaccccacuguguagcaugucuguccugcccccugaccccacuguguagcaugucuguccugaccccugaccccacuguguagcaugucuguccugaccccugaccccacuguguagcaugucuguccugaccccacuguguagcaugucuguccugaccccacugaacaccuggaaacuuugaagucugacguacuggccgcugcugccacuuggcugagcugagguuagucucccuucugggccauuguuaucacuuggugugcugcgauccuuugacaaaugcugagagaggauguccucccucaggauugccuuugcuuaaccccaggauuaucuauucuguggugugcuuugcauuaccgaaaacccuuaaagacacuguguaugagugugugugugugugugugugugucucucucucucucauucuacuaaagaaaggaaguucucaaacuuacaaaauauguagcugggcguuuuucacaauccagucgucagaauauuacauuuuuaaaagguauaugaaauucagucuucauaagaaauaugaaauuugaaaauucuugaauucuauaggauuuuuuuuucaaaaauucaaaggauuaccauguaaaaauaaccacuaccauuaucuuuuucuuauaccuagaauuuauaaauauauauauuggccaaucuggauguuauguuuucaacuuagaaauuuagacuuaaaauuauaaaaauucuuaucuuuaaugaccccccuuggaaagacacugccagauuucaauauauuagauucuuccacaaaaaagauugaaguuugauucucaaaacuagaguucugcuguaccagguggagaggaaucguaggccaggauuuacagaugcuaauguggacugcaaugggcuuaaaaugccacauguugaaauucugccucuauucccuggagaaggaccuggcagcucauuuuuaccagugguuugcucagggcaugaagggaacucauuuuccuucuugggugucuuaaaaggaaccaaaaaacuggaguguacacuacccgauggaacuggacgacgugucauccaaaaccaccucaauuaccccuucagcaucgucagcuaugcagaucacuucuaccacacggacuggcggaggugagcccccgcagcagccugggggcaacggguucugcagaacaugcugucugacagucagcagcuuuggcuggaagcccaguugacucugucaguagacaucggucuugcagggcuaugacuugaaaucaucccugcauuucacccgcagguuuauuggguguugcuugcaagcagcauuuaaacugaagaaauuugguaguaauuaauaagaagcauuuauuuaaauauguucuuagagaaugaguuuuaagcaguacaaaguuuuaaguugaauuuuccuuuuuaaaaagaucaauaagcaggacaugguggugcacgccuuuaaucccagcacuagaaaggcagaggcagggugaucgcuggaaaaacaaauuauagauaauaauaaauguuuuccuuaaagacuaaaaaaugcuauuugacuccccgcuaagaacgcuucaaaacagaacauaggugcacgccugaauccuuucccccauuccuacaguuucacaagaccuaaugguaguacuugaauagaccccaugggccuagccagaauuaggaacugauuuaaucacuaguuccuauggccacagaacauaaauacauucugugugcuguucuaggguuuugacuuagagaauggccagggagaaggaacagucguuugcauuuccuguaaguaccuaacugauacugguggaggggcuacauccagaaucauugguauagacaaauugagucaaaacacauuuaguggaauugcuuuuuaauguauuauggaaaagugcccaacuguuaucuacugaaacuugaccuugugacugaccauccaugaauccuuccuuccuucuuuuccuagggaugguguuauaucagugaauaaggacaguggccaguuuacugaugaguuucucccugagcagcggucucaucucuaugggaucacugcagucuacccguacuguccaacaggugagucuaucaaagugcaucaugaggcuuccuuggaccagcggguagagaggggcugugcuaacugucagcacugcguuccuuaacuaaugauacacugcuguccacuccccucacaggaagaaaaugaacacuaaauguauaggaggauuucaaguuuacaagaaucuuguccuaagaauauuugcuacgaaggcaaagacaguggaaaaggaauuggccauuaugagcucuuggcacacaagugagcauuuucagugcagugagacucaaguauauuuugugaaauguauaccucaaucuuuacuacuguauuuuuaaaaacaaagguuaucacaaguuuaaaauagaauuuuaaucauugcuuauuaaaucaacuuuuguaaacaguuauuuaaaaggccaaauucauucaacauagaaccaaugagagcaaagacacuaaaucugauuuuuguuugccauggauucuaccuggccaagaaaaguaaagcaaacagauggcuaugagaacugauuccugaagcccacugaggcccgccacagacggaccaugggguuggcccagcgaaguccucagacuuuauuuauacuaaggugcuacaaagaguccccaagugccucuacagaaguaucccucaaaaguacuccggguaaaacaccaaagaugcagcaguucuucaauuuucuauauaauuccaauaaaauauuuuaaagcuuucuu

SEQ ID NO: 7278 - RNA, 60535 nt, Mus musculus
aagaaagcuuuaaaauauuuuauuggaauuauauagaaaauugaagaacugcugcaucuuugguguuuuacccggaguacuuuugagggauacuucuguagaggcacuuggggacucuuuguagcaccuuaguauaaauaaagucugaggacuucgcugggccaaccccaugguccgucuguggcgggccucagugggcuucaggaaucaguucucauagccaucuguuugcuuuacuuuucuuggccagguagaauccauggcaaacaaaaaucagauuuagugucuuugcucucauugguucuauguugaaugaauuuggccuuuuaaauaacuguuuacaaaaguugauuuaauaagcaaugauuaaaauucuauuuuaaacuugugauaaccuuuguuuuuaaaaauacaguaguaaagauugagguauacauuucacaaaauauacuugagucucacugcacugaaaaugcucacuugugugccaagagcucauaauggccaauuccuuuuccacugucuuugccuucguagcaaauauucuuaggacaagauucuuguaaacuugaaauccuccuauacauuuaguguucauuuucuuccugugaggggaguggacagcaguguaucauuaguuaaggaacgcagugcugacaguuagcacagccccucucuacccgcugguccaaggaagccucaugaugcacuuugauagacucaccuguuggacaguacggguagacugcagugaucccauagagaugagaccgcugcucagggagaaacucaucaguaaacuggccacuguccuuauucacugauauaacaccaucccuaggaaaagaaggaaggaaggauucauggauggucagucacaaggucaaguuucaguagauaacaguugggcacuuuuccauaauacauuaaaaagcaauuccacuaaauguguuuugacucaauuugucuauaccaaugauucuggauguagccccuccaccaguaucaguuagguacuuacaggaaaugcaaacgacuguuccuucucccuggccauucucuaagucaaaacccuagaacagcacacagaauguauuuauguucuguggccauaggaacuagugauuaaaucaguuccuaauucuggcuaggcccauggggucuauucaaguacuaccauuaggucuugugaaacuguaggaaugggggaaaggauucaggcgugcaccuauguucuguuuugaagcguucuuagcggggagucaaauagcauuuuuuagucuuuaaggaaaacauuuauuauuaucuauaauuuguuuuuccagcgaucacccugccucugccuuucuagugcugggauuaaaggcgugcaccaccauguccugcuuauugaucuuuuuaaaaaggaaaauucaacuuaaaacuuuguacugcuuaaaacucauucucuaagaacauauuuaaauaaaugcuucuuauuaauuacuaccaaauuucuucaguuuaaaugcugcuugcaagcaacacccaauaaaccugcgggugaaaugcagggaugauuucaagucauagcccugcaagaccgaugucuacugacagagucaacugggcuuccagccaaagcugcugacugucagacagcauguucugcagaacccguugcccccaggcugcugcgggggcucaccuccgccaguccgugugguagaagugaucugcauagcugacgaugcugaagggguaauugaggugguuuuggaugacacgucguccaguuccaucggguaguguacacuccaguuuuuugguuccuuuuaagacacccaagaaggaaaaugaguucccuucaugcccugagcaaaccacugguaaaaaugagcugccagguccuucuccagggaauagaggcagaauuucaacauguggcauuuuaagcccauugcaguccacauuagcaucuguaaauccuggccuacgauuccucuccaccugguacagcagaacucuaguuuugagaaucaaacuucaaucuuuuuuguggaagaaucuaauauauugaaaucuggcagugucuuuccaaggggggucauuaaagauaagaauuuuuauaauuuuaagucuaaauuucuaaguugaaaacauaacauccagauuggccaauauauauauuuauaaauucuagguauaagaaaaagauaaugguagugguuauuuuuacaugguaauccuuugaauuuuugaaaaaaaaauccuauagaauucaagaauuuucaaauuucauauuucuuaugaagacugaauuucauauaccuuuuaaaaauguaauauucugacgacuggauugugaaaaacgcccagcuacauauuuuguaaguuugagaacuuccuuucuuuaguagaaugagagagagagagacacacacacacacacacacacacucauacacagugucuuuaaggguuuucgguaaugcaaagcacaccacagaauagauaauccugggguuaagcaaaggcaauccugagggaggacauccucucucagcauuugucaaaggaucgcagcacaccaagugauaacaauggcccagaagggagacuaaccucagcucagccaaguggcagcagcggccaguacgucagacuucaaaguuuccagguguucaguggggucaggacagacaugcuacacaguggggucaggacagacaugcuacacaguggggucaggggucaggacagacaugcuacacaguggggucaggggucaggacagacaugcuacacaguggggucagggggcaggacagacaugcuacacaguggggucagggggcaggacagacaugcuacacaguggggucagggggcaggacagacacgcuacacaguggggucagggggcaggacagacaugcuacacaguggggucaggacagacaugcuacacaguggggucaggggucaggacagacaugcuacacaguggggucaggggucaggacagacaugcuacacaguggggucagggggcaggacagacaugcuacacaguggggucagggggcaggacagacaugcuacacaguggggucagggggcaggacagacacgcuacacaguggggucagggggcaggacagacaugcuacacaguggggucagggugcaggacagacacgcuacacaguggggucagggggcaggacagacaugcuacacaguggggucagggggcaggacagacaugcuacacaguggggucagggggcaggacagacaugcuacacaguggggucagggggcaggacagacaugcuacacaguggggucaggaggcaggacagacaugcuacacaguggggucagggggcaggacagacaugcuacacaguggggucaggggucaggacagacaugcuacacaguggggucaggggucaggacagacaugcuacacaguggggucaggggucaggacagacaugcuacacaguccagccuccucccuaagccccagaaaauuuacuguaagaaucacuguaaaagguucuuuuaaagcuuacagaucugguauauucugugcugacugaaauuuaaacgaaaggauauaaagaugggcaggauuugguuuguagugcuguucccauagugcucacacugcuagcuguaagggaagcauaccuuucuccacauccaguauuaccugcaucugcccagcagagcaguuuggagaaggggucaaaggucaauccauuggguaauccaauaucuuuguugaucagaauccuucuguuuucgccaucuaaagaugauguuucaauuuuaggagcuucucuauuccagucuguccaguacaaguugcuguggauaaauuuuaagauuguuaugaacaacugugcagggguuguggcauauagcuuaguaguagggcucuuguuucgaauguauaaccuucagcaucgcucccugccucacacccugugcaucagccacacuggccaccacuggcugauugucuccuccugguauucucggccuuaauucccuugaauuuggcugaguuuagugucuugcuccuggugaaugguacgguagaagucauaaaaucacuuucacuauuuguuuguuuguuuuguuuuuuuaaauuggcuucuguccagugccuuuucuugcuccccaggggaaguuggauuuuauacagcaagcuaccucuugcccaauggccaacaauagccuggggccugccagcaguccacaagaguuuggaaagggaccuuuccaagaaagucuggaucaugcuggccuugccuggcuaguaccuuuggcugucgcuuuuugacauuaccucacccagauaccucacucacaguuaauaauguugccuuaggcugccauggcuuucugacaaucguaacucugugggaagucauuaucuauuaacugucuagauccuugccucucacaaacccgaugcauuugcccagaaacccuuaauuuguugaaaucuugaauuagaucuugggccuagaauccaaagaaauguauuuguuagaaaaaaaucugugguagaagcuaugggaccuguuauaagaaacucagugggaucaagggagaguuuccugggacaacacuaaguguuggaagggaaacuuagcuauccuacaccuggcaaugaccuggacagacagacucugaccuaacauacaaaauacucagaaaguaggaucucauuaguuggagaugaguuaugcauauggaaacaggguuacagagcagaaacaguggcacuuccaugaaagccauagauaucuuuugguugaaccacagggagcccuagcaagagggagagaaacaguuuccucuguguggcagucacuccuuguggguggcagugagagccagagagcaguuucuacuuguggcaggccgagaaccacacagugagcagucuccuuggagcugcgaggaggggcucacauuacaugcaugcacacugcugugacauuguccucuagacucuagaucuuggagccuaaugaccgaacaaggugccauuguucagucccugaccggucagacuaaguaccagggaccaucaaagaggagccucaaggguuaauuaagucccgcagauaaggaaccuuccuguguagaacuuucaggaagaaccuucacaccuugaaggguuucucuguaacuguguuuguggacgcugcagcucaguaauccugggaccucugacccaggccuggauaccccaguugacggccuuggcacugccacagagagaacauuuuuaucuugacguuguacacucuccauccagaaaaaaacagaaacaaaaaaaaacccaaaaacccugcugugguguuucugcucagggaacggcugaaggaaacaacucccucugcagacccauccuuuuccaaggcccugccuaaugaucgucugacccaggcauccucuggauucuccaugauggggucuggcuucuccgugugacacaucccaucccagacuaacuaacaucuuuacugaaugucaucuuacuuccgaaugccuuguacaaugcaugcaagcucaaaacaaaaaacaaaaaaaaccccugauuuuugccuacaagaaugcuugacacccagcagcgggucuacauaucuggugaauuacuguauuugaguuuuuauucuggucuaucuagaccuucccaugacauauauaagagccagggucuccaaaacagaucugcaugagagaccaaagaaagccagcuaacccucggauuggauccacagugauggcucguggauucaccagaucuguguggaagaggacuuuccgcucggaaccauccaguucggcccgcucuaucuuauccaggccacuaucuguccaguacauuguucuacggaaguggucgauggcaaguccuuccgggcuuaucaaaccuggaaauaaaaguaagacaggagcauuggcugguguagaaggcgaaaucaaguuccccgucugcugagcagcuuacagaauccagagcauagaacagaaaagccuuaagccccaggacgaaggcuaacuuuuuaaaccauauccagucucuucugugcuggaccuugcugcccugauggcaccuggcauccguggugcuagggacaggcaaucuaaacugccagacccugcagucucacugcgaaccacucuuggaguggcaguucauucauccuauccuaaaccaccuuucuaaagucaccagcagagaacuuaaccuucccuuuagaugagcgugggagaaacugggaccaaacaggccaacggaagcaacacacaagguaccgccaaguauccaugggaggagcugcugaccugagguaaugauggucucggguucggcuccugccuccaagcuggcacggcugaugguccgaccagcaacgucuguccaguagaccauccucucccggcagucauagucaauccccacaacuauggagcccuuugaggaccaauggugacaucagaaggauuaggauuccugaauccccaaccuuaaguucacggcuacacagcacuacugugaacaaccugcgcugugguggugcggugcugggggagccuccucccucggaucagagccaggcucagccguuuaaccugcaugcuuucauuuucuccaaaacggcagucaguaaggcauuuauaaagggccccacugacuaccuccagacagcaagcuccuccaguacuguuagcacuggcugugaacacggucacuucaugagaaaaaccagcccuuucccugaugagaggagcaucccgcuagguaagcccuuaauauuuaauggugcaaaagaugaacgcuucuaaguguuccuggcacuuucuuaaagacccuuucuaaaaucugcuaacacaugccaacaagauuucccuacugggugaacagaaugaaauccuccccagcccaagguguagccaccccugccucuuaauauaagcaauuaguugugcaguauacaagagagccugugauuuaacaauuugggaggacuguggucgccagccuuuggcugguaguuucucccuuuccuucgugaugaaugaccgucuuauucaaaacccugaaucuucgauguucccgcuugagcuccacacaggccuugcuucuuuccauuucuaacccaguuucuugcugugaaacccccagcagacacggaguucaacacaggccacaccaguccccgccuugccuaggaaaaccuccuagggcuuggccuaaaguaaucaccaugagacacuguaugaagaaucuggcucccguagaaaagcuagcauuuauauggggggaccuaaggucaauggcacuuuuauuugaaaauuaaacuuaaaagguccucccuccuucugaagcaagggcacacauucauguagguggcaaugagcccagggacucacgggauucauaaaccaagcuucuugguaugaaggucacacuuuagggaaauugcccucaagagugcuuguaauucccucuucuccuucaguucuaccauaaccaucuccucccugcccauuuagacauguucggaaaggcaaucaagccaucugguguggcuagaacacaagacgguuagcauggagaaacuuauaaagcccuacacucuuaaaaacugggaucggggccggagccucgaaucucgaagaaaaaggcccucuuuucaucacacgcuggcugcuuugacgcuuucuuaggaacagcaguucaagaacagaagugaacagagagaacucugcccuguacgaaaugucugcucgguguacacugaagacaggaucggaccagcuuccaugguagcuauccgucucucugguccccacuucagagaagaaaucccucccuccacauggaagugccuugcaagcucaagagauaagcauccccaggggcggggcugcgggacagggcggggcggggcugaauaggcagcacacuuuccccaaagccguacaguggaccaggcagggcgccaggaaaggagugagucaaagagacaaaaggaaaaugaaaggggacagccugacaagugguccugauuucuacccugaugucucaaaugaccaccuccucugugguuuuuuguuuguuuguuuuguuuuguuuucacuuccaaaugucugugaccagaacagaacccccaggaaccugagguaacaaugaucuucccaugaacagccaacagcuccgaaauucuuccgcuauuuggacuuucaugaugcccucaggauauaguggcuagaguggguuagacaugauuuccagcaacugagccccacuaaagcagaugaagcccagaggcaugcaugccaggagucccugcacugcacagcacugcauuucccucugaaaaccacaaagcucaguuccuccaggcccacaagccugaaggcgcaaccucaucccagaccccacccuccucaucccagaccccacccuccucaucccagaccccacccuccucaucucagaccccacccuccucguggagcccagcccuccuggagaaacucaguuuacaugcagugacagcaggguccgggcugcguccuucugaagccugcugccauugaggggcaaguggccaaucuguuggcccugggcauagagcaggaaggugcccacagauggaggagucacaucgggccggggugugggccggaccacggguggagcgacgguggguaugccuguuugugggaagguggacagagggaggaaaguuacuucuguauguaagaaccuccacaauuacccaguucuuccuggaacauauuucaaagaaauccugguuucugagguuuuuuguuuuguuuuguuuuuuccugaagauuaauuacucauauuucugccauuuacucaaaagauaaagauaacuagccuucuaaccaagugcaggguuuuaggaugugguacagcagccaaauguacccuggggcccuagggugguacuguccccuuucacccagggcuggggggcaaaauagucucacucuggccugagacaagcuauucuuauaacaguggcaaagccaguguuaaauccagauugggauccugagauaccuugaugauaagucaacccagcauauugaugagaugacuuuauucccaccucagaaaccccaacagaaaacccucagugacacucaggagugccugggccaugccacacuuacaugcaggccuggugccuggcugugagcgcgugcccuguagcucucugccauccuuguccacacaccaacagaaaucacucuuuccauggcacugcagggggaugaaguggcccaggucaucacacuggggcacauacuggucaucccugggugugccuccguaguguuccagcaggcuuucccgccaacgcucacagacaguccgaggccucugggugggcucuaagauggagaaacaaaaccuuggauggccaaucaagaucaguacagcuccaggucccaacuccugaucuccuagccuuccuuucccucuguucaaggccuuggccaugccccuggacacugggccaaggaagcacauguguucucagaaguucucuguggaaacccagaaaagaagucacccugauguuccuugaugcucccaucucccaaggccaggaggaccuggcacagaggcccagccacaucagacaagaacaaggagacaagcaagcccauccaugcaccucacgcaggucagugagauagaugcacaugggcaucuggcuaugugccagggcuucucugauggcagagcauuguucagacucucugaagacuccgugacccauggcacuuuaaagcaacucuuucccaccugucucaaguucuuugcuaaaacagccaucauaggcugaucuaugugcccuagaaaaagagucugaagaccaugcugagcuauagcccuccguuucaguggccaguuacaaggagcaagggugacgggacacugcauauggcacagcagagguggcauugagcaguggggaacugcuucuuggccuauccagcuucaggaacucacugcuguuguauugcuggcacuaucucaaagcugagccuuucugccaaacucuucugucacaauaccauccuguuuucucuaggacuccacacccccaaccgcccucggauccucgggcuucugguuccaccaugauuaaagaaagaccugcugguuucugauguaugccagucccucucacccugcaacuuucugcuaggcugcugccccagggucacagagguucugccuuccacgugaggacggagcuacaaaggcuccaccaucagcugcugaaaucacuucuucacugcgguuagauagccugcagagcauaacuaaaggcauuucuggcucugucuucaucgcugcaccucaaagccuacguaugcucugcagaaucacacagccaauuaauuaucuucgugcuacuaccauacagaggcauaacccaaaucucagcacgaaagcacgaacuggacuucugcugucucccaaacuugcuccucgugccuuuaguuacacuccacagcacgugcguuucccacugcucagaugaaaucaccccaaugcccuucucucccucuccucacaucucaggucaaaaaagucuuauuaauuuuaccuucaaaaacauucugacuggaggugaacauaaguacugcaggaagcagagacaggcucaucucugugaguucgagacuagccucguguacauaguaaauucuaggauagcuaaggcugcauagugagaccuugucucaaaaccaaaccaaaccaaaaucaaacaacaacaauaacaaacaaaaacaacagauugucuugacuucuugucucuucucccauguguuguccuggcuacaggaauccucucacacugggaucauggcaacagcccacuggcuaguuucuuugcuuccaccuuuccucaccaaaccaguguauccucagccagcagcuacaagggggcauuuaaacccaaggcauaaucuuacauagagaccauggcaacagccuuugggcuggcuuugcuguucccaccuucugaagccuucacuccaccaaaccagugcacucagccaacagccacaauggugcauucaaaaccuaggacaacuuaguccauucugcugcugaaaaccccccagacacuucaaagaacaaagcuggggggcaucacaagcucgccugaggcuggggagaagccaauagagccucuaaucucaaacucagcaaguucaaucgagacucacagguuuaggaaguggcugacccucaggcuuuagcuaaagaacaaacaggaagcaaaggagacacaggcaagacucugcccugcucagcccaaaguguuccaggacaggagagaggacagcuacccccugaaacacucaucauccacuucacagugggaugugcugggaaaaccaccauagccacacugaacacccccaagagccacuccuguuucuggggaccacccaacauggguuugugucuggauggaugcaaacacauagcaagucaacuagggcucagaucccucacagguaugcacccgucccaucccccacugcuauaagcuaaguuauccaaucaugggcuugcuuauuuccugcuuuugauugguuaagguucaaacagucuugagugcagagcaugcuacccuccauccaacaggccugguuaugcaaaugagacuagucagagauggcaggcggggccaagcagugccagggaagaagucugggccaugagaugucuacacaagggaaugugccugcgucacuauccuuagcacauguuaguuuaaucagcuuaacagagugccgagccaucccuccacggccacugaaccacugacucucaaaccucucacagagaacugaggcuuuugagaggagccacgaccaaaucaggauuucucuaggcaccuuauuuuuuaaggccugcagaaucuuuuuccuaaagaaccuauuagaagcaguggggaugagaugugugugugugugugugugugugucccaaaaucaguguggagcaauccauuaccaguuaacuuaugugaaucuuuaguuuuauuuuuuugagaaucuuguacaaucuauuuuaauaauauucacccucccucccccaacucuucccagaucuaugccccuaacuuuuauauacaugaaucuuacaaauacugaguuacgaauguugaagaaucaagacugcugaaaauuguccggcucaguuucccucacacacuaaaagcugagaucaguggcuuauaaacuguuuuuauaauuucauuacuuuuuauuuuauaauuuagaaaguggcucuuuggauacuagcucccacaucaggaaguauucaggcugaagcagcagcacguguugcccaauucugaauaauucagcaagaggcugggaagcugcccgguguaagcugcugcugcucacagugcccgugagacucugcccaccacgcucuagcaccuuggccauguuugcaugaacgccucagaucagauggauggguuucuauacuuccuccgaaagcagcuguggaaagaggguuucccaagaccacacuggauuggcuagaaaaggaugggggccauuggguuagaaggaagcucaaugcauccacuccgaguuccauaccuaauuuacuugcuaacauuagcacagccuucagacugcuuucuacacgguuaccuagaaaggagucucgcuuuaacgcuaugcuaggaaaacucuucagcucucucaagccucucucaguggaccgcagccugacucagagacucagcuuucaggcacaacucaacaaggaucuaugcaguuagaguccaaugcauaaaggauccugcaugucacuuuguaucuauaugucccuaugacauuaacaugcacaugggugugucuauaucagccaaguguucuuuggaggaagaaaagccaugagaagacaguagccagucagacccacgucugcagagucagagcuggguuauaaaccacccacguucaaagccauucugucccuugacuccaggccagggugggcauacgggaugucuuuguggcaggaggcucaccuggaggugguccacaguggggcgggguggagccggguggagucugcgugccagggacuucguggccauuucgguccacacaccagcagaagccagugcugccguggcacugcaguggcacgaaguuucccuggucaucacacugggggauguggauccgugacccaggguaggcgugcugugucugagcauagcgcugcugguauucacagggcuucaguccugagauggaaucuuccggaaccgugucugagggagacauaaaggagaaauaaaagguccugcaacccauccacacuaaccaggcccccauaaagucuucuguacugaguguuucuuccauacaaucgaaaguuacuaugacauugaaaaacaguaagacacuaacauuuuaaagauuucuuuauuuauuuuauguaugugaguacaaugaagcuguacagaugguugugagccuucaugugguuguuaggaauugaauuuuuaggaccucugcucgcuccugucagccucgcucuauccagucaacuccacucguucagucccuacuugcugcaccccaaagauuuauuuauuauuauacauaaauacacuguaacugacuucagaugcaccagaagagggagucagagcuuauuaagggugguugugagccaccaugugguugcugggauuugaacucaggaccuucagaagagcucagucucuuaaccacugagccaucucgccagccugacacucacauuuuagaguccugaguucuuauucgggcuuugcuaccaacuaccuaguuacuaugaauucccuccauuugccccguacaucccuacauaaauacaaauguaagcuaguccaguuuguuccucagccuuggggccagcugauaucugggcaaaaugaagaauaaacugccuggcguucugggagacucuggagaggacaaguuaacuccauccacucuuugggacccagagucuuaagucuaagcagcccaggucaguagcagccauguugcuguauguuggccaaggcccaugaaagcagucaccacgagugcugacuugggcucaccagugcaugaggcuccuacugaauaagcuuccccucaauggguccccaaacaacacccagcaaagcacaucacucggguagugaaccagagcagccacagggugggugagacuccaagaagcucacaaccagcuagcggucaguggacaucaggagucuacugagaagaauccagagccuggaaagugccccccaucaggccucaguccagguuccaucuugggcagggaggaaaauaggagggaaggagcugggagauucccgaguuuacucaggucuuccaucacuuaccagaggugcagugaaacccguccccucgauacccaggcuggcaacggcaggagaaggacccggggguauuguagcagauagcugccucaugacaucgguuuuccgcacauucaucaacaucugcagaggucagggacaggcagagaggugaggaaaggaaggaaggaaggccaugacuucaccacaaacagcugugugacuacauggucagagugcacguggcuagaacaucccugggucugagcugagacgugcuaaugucgaacacuaagcauaacagaaacaaaaaacaaaacagaaagcguguacuggcaguuuuaugacaacuugacacuagucagagacauaaaggggaggggcgcgcucaacugcgauaaugcuucuauaggguauuuucuuagugaucagugaggguggacucagucccucguggguggggguggugccauccuuggguucuauaagaaaguaggcugagcaagccaugggcagcaaggcagugagcaguccccguccacagcgucugcaucagcuccugccuccagguuccaccccugcaugauggccuggccucacugcuuuugauaacaaacuguuacauggaagugugagcgagauaaacucuuuccucugaaggcugcuuuuggucucaucacagcaauuguaaccucaccugagacaaaacuaaauccaggcgcaugugagcuaacaaacacaaaugagacaaaugcccaguguagaaacccaaucgaagcugaacauggguauguagagaaaaauaucccauugaguauuucugggguguuuuuggauacugugaauucuagacguuauuuccuuucaacuacuaaccuauacuguaaaucacuaauuuccugucaaugauauuacaaaaaaaaagauaaauauaggaaacaauaguuuuuucaucuuuguuugaaauccgcucccuuuauauuccuguagagguacaggugucagaugaagccccaaacacauuuucaguuuagaaggaaacugauccuugccugaucagacugcugucuaaccccccacccccaaccagagacggcuuuacagaaacacacucuucacuuguacaaagagauggcugcuauugcacuucugaugcacaugcacgcgagagccugaacuuacugaccacggagaagcagcccaggccccugcacuccacaugagcuucccgaggauuuccauaaucgcacucaaaacugcaagaugaacagcuugagcaaagccagcugauaagccuuuuacuuuacuuguuaaagcuggcccaggcuuuaucaauagcaagccaccucuuccccacuccacacucaaaacccccaagaaacucucugaagcagaaacacugaagcugaugccagggggugaggugagcucuagggggacagaaagucugccagaggaaaaaggauggagggggaaacaaaagguacagguuugacuuccggaccucagcuugaccaaaaccaaaacaaagcaugugucauacccacaacagcaaauggaagugugaggaggagacgacagcgacgacaacaacaacaacaauaauaacaacaacaacaacaaaccacgagacaaggugauggcaagaaaccuaaaacgagaaaaggagcugggcucauuguggucauggcagggcaggcacacaccaguggaaagugggacuuuauaaccagggucagaucugagugggaucagggacagacucucccaagcccccauucuccagacgcuccuacagcucaggaguuuccucagcuggugggcagccacugcuccuuacacacaggcauuucauucccuggacaggaagcccuuacacccgucuaggaagcaucugcuuauucauccuuuugccucugaguccaaaaacccaugaaugcucaauagagcaagcuuaacuccaccuggagcggcucucccugggcaagcaaacugccuuucugguuaucuucaccucccaagauuaagaagggaguuguuuagugagcauccuagacagcaucccaguuacuaaagaacugucguuuuuauccuacuagcauauccugucucuucaaaggccagcuccagggcacacccgacuggggagcuggcugggccuagaggggcucuaaacugaccaaggagccaaagcuauaaaaaugaacuuccagccaaauucaggaaauucccgcuaugacagaacauacccuauaaguacuuccaguggcgacaggaaccccaagcaauggcaggaagcaggaacuucugaccacagggccuacugcaggaccccagggaguccuuucuuaggcuauuuuuuaacuaagggaguggggaguccccaaggcugccaaaucuccuuaguaaagcccucacuuagggauucugaccaaaccugaaccagucauucuccccuguuguuacauucuucauggaugccauguaauugucacaaauaaccagcaaaaguaggaaaggaauccuugaagaaguuuacuauaucacacccaagaaaucccugacccccaagcuggagaacuguaggcucccagaauugcagucuagccucaucuuggagggccuccaugauggauagcuagaggucagucagcagucccagggccugagcucagagcuugcuuugcaucucuucaggagcacaaacaccaugggauuugcagagaguuagagcucgugucacaggacgacaaguguccagacagaagauagggaaggacuuuggccucuucucaaaaguaggggcuaucuuuuaauccccacugauaugaagacuccaauaacaauuaauuagugagcgggaugauguucaggggcugauggaagacucaggucaggucaggaggacugagaggagcaggacagucccuugucacaaaggcaacagaaaaaaggcagugagaguccagcacaaucgaagccaacaccauucauccauuaaacucaagaaucuguuugaaaaauacgucuggaaccuuccauuuguagcucaugcuuuggaguuuugacagcgcuuccugcccucauucugaacagaagcugcuggaagcaaauccaacuacugaaugacugccuugcuuucauuguuuuaauucucuggugcugauuaaccuuuaaacuacccagaacccuaugcuuugguccauacgccuuugucuucucucuguucccuaacuguccaaucacacauaacugucugcugcuuguguuuguguggcauguggugaucucccuugggaccuguaauugugguagugguagugguggcacuagugauaaacauuguuccuucuauguccacacccucuuguccaugcuuuaguuacccagugucucugagcacagaauuccugagaacaaugucuguaccauucaccugccuccugaacaaaaauaaaacagacccucucuacccuggcuuccuuaacucaccugaaacuccaagacaaucugcucuuccugcaaagucacccagguucuuaacaaccugggaacgauccagcucacacuaguacaggauggaaacugcuccaguuagagggaagacagagaagacgugacucuuuucgaaucaaagccuccugcuagugacuuaaaucagacugagaauccgaauccaagggcaccuucccagggagccugguuccuaacaaagcauggcuggagggaaucacacacagccucauuucaucugauggaacaaaaacugugugccucugacugcaagguuccccaucacagagccucucagcaaggagccuucuuggcucacagacaugaggacuaugaaacaccucuaaauaugaaugcaugcacauaucuaacacguuguagguuuacucugcaaaugauucccagauuagcacagacuaucauguggaaucuuuaggagaauaaccccucucugaagccugccuggaugguuaccaaacauggcuguaguuuguaagggagccuccaagauggaucucggugacccuugucucaugauaugcauaaucuccaucaagacucuccuuagagacauacaaucagaacaaaguaaaacaacacugcaugacgacuuccaucuugcuggccggccauaauaaagcaagcugacuugugacuaaacagacuugucucaugaaaggcccacgugacaagaaaccaaagggcacagcauucuaugacagaacagaggcucuguguccaacaauccugacaccuguccauacuaaguggugacucuugucuuaagccuuacuagagauccuaagacuuagcaccuacugacucaugcccagacuccuggcccacaggagcaggugggccuugugagccuguuuaaaaaucagauucauaaccaauagugugaauguuuaagaaacugaagaaugcaucaagauaaagguuuauucagggaagcuucuaaauugucuaaauagacuacaguauaugacaauacugaaagucgguuauuguaagagaaaaccaugaggaaacaaagguuggaaagcauuugaaauggaaaagauaaacuacuaaucagaaguaguuuaggaaagcuccauuuuaccacuuacauuuccagaccacaacccaucacaguaacucaaaacaggaacugaagcagagaccauggaggaucaaugcugcaggucaauggcuugcucuccugccucacugucaggcucaagcuuagcuaacucucuucuacugcccaggcauauagccccaguagacuugggcccuccuacaucaguuagcaaucaagaggaugcucacaggcaaagcugaccguggcaguuucucaacugaggcucucucuucccagauaaaucuagcucaugacaaguucauaauaaaaacugccaggggcuggugagauggcucaguggguaagagcacccgacugcucuuccgaagguccagaguucaaaucccagcaaccacaugguggcucacaaccaucuauaaugagaucugaugcccucuucuggagugucugaagacagcuacaguguacuuacauauaauaaauaaauaaaucuuaaaaaaaaaaauaaaauaaaaaaauaaaaaaauaaaaacugccaggucugauggcauaccccuuugauccuuaaggcagaggcaaauggaucucuuugaguuuuaagccagccauggcuacaaagggagaccaaagccugucacaaacaaaccaaccaaccaaucaaccaaccaaccaaccagccaaccaagcaaccugccagccagccagccaaucaaccaaccaaccaaguuaaccaacauaacagcccaucucacuagguguaugaugaaggugggagaauuuaguuagaacuguagguaugagucccuccagccuacacuagcuccaaggaacagaaaguuuccaaacugauggcaacacuccaagacaaccauggguguucaccagucuggcgccugaagaacaccccugggcucccuccugacucuaaagaugccuguucucuuucagcaaucccaaggcugcaugagucacaggaggggagaagcugugucucuaugaggauguauaccuaaagggaccaugcagaguccucaagagucacccacagguacuuaccagaacacugaugcccagugccaaugaagccuggcaggcaggcacaacugaaugagcugccuccauggugaaugcaccuggcuugccccucaggggcacaggugugacugccaucgaggcaaggguugggagguggggcgaucacuggaaagaaagugagaguuuagagcugagugcgaaccuuucucuucaucgucccgcccacagacuaacagcaucggcacaccugcggagcuuaaggaauacggggucucagucagaaucucaauuuuagcaagauuucuagcucaagguucauguaccuauuagaguugagaugugcuaguguauguuuguguuuaaaauauuagacaugacaauaaguggucaaaacagaugcagguuacagcuugcaucuccccagagcacugcacaccuccgacagauagccacaccccauacaguucccagucccauugguacucugucagcuuacuggagacugaaauguguauuauuaucagcuccaucaauuggauaaauuuggaauucuaggucuuucagauccauccauagagaguauauuuauuguggauggggaucuuuggcuccucacauaagacagguaccuuucaacaugaauucuuucuagagcugggguguuacuaauugcugucugguccugugacuccagaaucccaacugagaacauccucagguaacucaauauaauaccuagauggggaaaacccaauggugacuugucaucaugacaggacugagcugaacugcagcagagggcuauauacugcagcagagggcuauauacugcagcagagggcuauauacugcagcagagggcuauauacugcagcagagggcuacauacugcagcagagggcuacauacugcagcagagggcuauauacugcagcagagggcuacauacugcagcagagggcuauauacugcagcagagggcuauauacugcagcagagggcuacauacugcagcagagggcuacauacugcagcagagggcuacauacugcagcagagggcuauauacugcagcagagggcuauauacugcaguagagggcuauauacugcagcagagggcuacauacugcagcagagggcuacauacuucagaaacgcuacacaccagagccucauuguaacaggcacgguagagacgucagugaagcacaaggugggguccagcagccuccuagcugaagggaagagggauucugguacucacagauacaagugugcuggucaucugcaaauucauagccacugcggcauucacaccuguagcuucccaccaaguugacacacacagaauuagggccacagcgguggaagccaguggcacacucauugacaucuaggcaaaaaaaugaggacagaaagcacugagccugaguguuccagaaacaaagguccaagaacuuaaucuccccagcacucugaugcuucaguggaaauaauuguuggcaaauggaaagcauagaaauuugagaguuuuggacacugggcagaaagacccaaguugcaguucaucagaaacaaagacaaccauuuucaaaucuuuccaguuaagccauaggaagauaauuuuugaauacuuuagaaaagugaaacaauuauauuuuuuuguaagaugauuucuuucuauagcucuaacacaaauacccaccucuaaacuaccuucccaaaccuagccagacucugccuccgcuuucauaugauggugcccagauuaagagaggcuaaaaucauugccugaugcaggaaagagaaggugaaaaccaggacuaugcgacagaaauggagaacaugucucucacccacacagcuccguccgucacccuggaacccaggcgugcacucgcagguguagucuacaccuguucccggguggcaccuugcuguugugucacagguguggcuuccgucguagcaaggauucacuccaacaggggcugaguccacuaugugcaagaaacagaaaaagucagagugacuaucccagaaagaauguggaggaaaggaaggagacggagucuuugcuaugcuaugaguucaaagcuaagguggacuacuuguaucuugaugcuaauuucaacagcuuccucaugccugcucugcagagcagggucuggcuuucaguagguuugcuuccagggcaagaaggccucucgcauccccugggcucucaggacgacucugugccagacuucuguucccaugagaaaggcgagcaagagacaugggauacaguacuuaaauccagagucagcaagcauguuggcccacagacuuaaccuccaaacuucuggcugaguuugucagucgcucacuucaaucucacuguggauuaaaucuaacaccucacagggucucagacucugucucagucagaaucucaauuuuaggaagaguccuagcucaagaguuccuaugugcuauagcugggaaggcuagcauguuggugcuuagaacacugggcaugacaggaagucauccaaacagaccuugguuagaguuuguaaugcuccagaucacugcaugcacaugaucaacagacacacagacagacagacacagacacagacacacaagaguuccuacuaccauugccacuuccuuaucuuacuggagauaagaauguuucucuauuaucagcuaucucuaucaggaggauaaguuugaaauucuaagucauuuugaaaauuaaaaaaaaugaucuauguaauuuuguguauguacacacacauacacacacacacacacacacacaccugugcacacuugaaugcccaguguacuuguagagaucagaggacagcuccauggagucugcucacuccuuccacacuuagguggguuucaggaauugcccucuggucacugguuagauuuuaucaacuugacagacacuaaggucaucucacuaagggacucucauuugagaagaugccuccucccuuggacuggacuacaggcaaggagcauucuucugauuaaugauugaugugagaaggcucagcugacagugggugguaccaccccugggcaggugguccugggauguuaagaaagcaaacugagcaggccaggaggaacaaacaacacuccccuguagcuuguacuucagcuccuaccucuggcuccugccaugaguuccugacccccgacccugacuuccccucaugauagacuguaaucuauaaaaugaaguuaaccuuccccuccccaaauugguuuuggucauggaguuuaucacagcaacagaaagaaaacgaguacaauauggcaaaccccuuuacccaaugagccauccugggucaucuuugugccuccaaaacuuucuuuguaaagauacaaccugugauagcuuauauaugcucagcccagagacugacacuauuagaagguguggcccuguuggaguaggugugccacuauggguggggacuuuaagacucucauccuagcugccuggaagucauucuuccacuaguggccuuccugaaccaugcuugccuagacacuaccauguucccgccuugaugauacuggacugaaccucugaaccuguaagccagccccaaauaaauguuuuuauaagaguugccuugguuauggugucuguucacagcaguaaaaucugaacuaagacacaaucaaauaaauagaaauagcuucccaccgccuacucuuccaaagucuugugaauccaucucuaaaucacuucuggagagucauacaagucauagaugacacuccuugggugucuccucagcggcguucggaacccuccauguccaaucccaugaaaucugcacgaucacaugugcagacagcagcaauggccuaccuuccuucucuaugaggcacugucaaguaacuugccuaagguuacagucaggagaaguagguagggucagaagauaaaaaauccaaacagcuccaggccagggcccaggcugcccaccauucugcagcugucagcagagacaccucauaaaguuaucuaucuaacccaaaggcacagacaacaaggaugcuguccagaugcccagcgacccccuucugacucuucagugcagaauccaaugggcauuguuuguaucuccuggauuugcucuuuaaaauggaacauaauguauuuccaaggcugauguucccauuggcuugucuugugguccugagagacuguguccuccugccuccucagugcggcagcuuuguccuuaucugagguuucuguuuugccucagucuguggaacuguaaucuuggacacagagagcuucaaggagcuccguguacgucaaucucuguacuaagucacuccugcuaucagacuacuccuugcacgauauaauaaugggggugggggcggguuucugccucuuacgucugugucugaucccugccuuggagggcagguucauacacaucccaggacaccccaccuguacaaucguucucucacuguuagaagccagaauccuagcaucuguacauacaccuuggcaggacuucugcuuguccuuagugccaggauucucugccacuucugucucacccaugacuccucagccaccuucuacagcugagacccguccaaagugcuaguuacugaagccuacuucagagggcuggcuuccuccugagucccucaagacccucacugucucacuuucacuguccugcugcccaaguuagccucuucuguuuugcuucaacagucuguuguauacugaaaugccucagcugagauaaccuccuaguaaacagcagaacauucauuuucagcuccccaaucaaggccugaaugugggguuggcuauaggucuauccccaguucaccccaauguuagcuaacauaagggaaucucugccagaccaaaagggaaaaaaaaaagccugccauccauccugggaaugccuucuucuggaucuguuugccaagggaugagaacccagcauuggggguagcaguacucaguuaacaugggcauguagacagagucacugaaaccagucucuggccagauuuuaacuaaaaacagccucacaccaggccaugcaagacaagaaccuugcucuccccacaauuauuuccucauuuuagaauaucuuccaaagggaauagucaucuacaaacuacuuuaguuucuaaauaccaaugcuuagccuuccuaggcagucccucucaguagccagcugaccacagugaauuccaggaaagauuaaugggcgcacguguuugucagagccuaucucccugcuggcauuaacauaaaaagagaauuuuagaagcagaccagaggugaccuguacucuuaaacuaccauacuuacaccaauauaagcacauccacaauuacacaauacugauuuaacagacaacaguuaaagagcuaguuauaaggggaaaugcugagccccuuagugagaaaaacaauaaaaauguaaaaaucagcuacuucagugagcccuucugcgugcacccacuauguguagcguccaguaacaucuugagaaaacguuuccuuaaaccacuucacuguucauaauuucugagccugcuagcucucuccucucacuguaagccaaggucggucaugcccuucuuaagccauuucauauuucacccacuuaaccuagugacucccugaagcaagagcuggaauucacugacucacuuagaaagagaagaaugguuuccuuaaaggagccaucacuggacuucacagaauggcccucugaucccugccugccgagggaggacgagcaccguguucuguccugugacaauauggcaaagugcuugggacagaggacuacaguuggaggacagcaagagucacaggcuucucuuccucauugggguauugcacuaucugcaucuugcaaagccaguguuggaguuggucuugugcgcuguguauucagaugcugaguucugugcuccagaguugggcugcaaucuggacaugggcacuguauugaccaaugugcugucaagaaugcuccccaguaaucucugauuggauaagaaaaagcuagagcccgugacugggcagaagagagaggaaggcagaacuugggucugagugaggagaucucgaguagggaccaugaggagaagaacaaaggagaagggaaagaggaggucaccaugaaacaugauggaccaugagcacauggccaagagaagcuugcccugaggacacacagacgacagcaagacucagcuggcauuuaucugcuuacugauagacuagucagguuagaauagcucagaaccugcccaacacugccaucagguuguuaacaagaucugaaguguuuguguguacuugggagcuaaaugggauagagugggggcagacaccccuccuaaaauuacuacuauaacacagagccacguugguccaugguuaugugaccugacaugccuuccagacugaugggagcccccucuggaaaggcuccugugcaaugacaggggaagugugcaugcgaagcaugguucaaucucaaaauguuaaaacccuacauucccaugugaucugggucuauacugugagguucccaugugaucugggucuauacugugagguucccaugugaucugggucuauacugugagguucccaugugaucugggucuauacugugagguucccaugugaucugggucuauacugugagauucccaugugaucugggucuauacugugaggcuguugugaaacugacagagcccauguggugcagcuguaccauguggggcaagugugggcucuguacccagugccaggguuugaaucccagccugccacuaaccagcugcauuucaaacucuuucaccucaacauaucaaguuuuacaacuacaaagaaauaauaacaauacacccuuguugaguagagguugcuauggggauuagauaagcuaauucacucaguguuugaaaccauaccauacuauuuguuaauaguauuggggugggaaagaagcucacaagacuaauuagcaauugguacuuuuugcuagcuugcucucauuugguaagaagagacccagcgauauuuccaaagacagaaaaaucauuuuccuaaaugaguccauggcauucuaugacaugggcgguucuuccucacagaccagaucucuccacuuggagagggcagagcggggaucugugcauggagaggugguuugugugacacagguguuuuuaucuuucuccucacggaaugcaacuggaaucuucccucuugauuuacaugcuacucuaaaaucaaguggcaucuccaugcauuaauuuccuauguuauaaugccaccguuggcuguccaacagguaaacccuagcccaguuuccuuuauccaaagcaaccaaacuaacaaacucagguuucuccuuucagccaagguccugccaucuuccucuuuagcuaacgcauugcugaggaaacacccauauugagucuguggaggcacacggggugucagcuccagcaacacucacaggugcugcugacagugacucugcgugcaguggcugagggacaacaguggcugagggacagcaguggcugagggacagcucucuucacaugccucuugcucuagggggaaagcaugaugaauugguuuaaauaacucaaacgucaccuugauucucuguggacuuuccugauuuugcagcccauccuagauugucuacguaggucauguuuguaaaacagacagccuuugaggaacaagcagguuaacaaaaaaauugcuaagagcguuuucauagccucaucucuccaaccucggccacauagcuccccuauuguuaucgugaacuacuguugcaguaccgguaacuaaaguccacggaucgagccgggaacuaacguccaugggucucauguggacuuaacuccagaggauaccaaguccugacagagagagccugcacuauucacaacagcaaggaaauggagucaucguagaugucuauuaacagaugauaaagacuauguggugcacacagacaauggacuuuuauuuagucgucaagaaaacagaaauagugacauuuacagaaaaauggauuaccccauuguuucuucucauaaaaaguauagguguuaauuucuagguaggugagccuaugggaagccauaaaacuagaaagagguccuaaaggagaggguaacagaauacacauucgugaaagagguccuaaaggagagggcaacagaauacacauucgugaaagaacggggccacucuuugggaagggaggggauaagugggcagaaagguagagacaggaaaggagacuaagugagaaagauaacccaaagagagaacaaaagucuauaugaaaaaaucccauaaugaaaccuauuacuuuguauauucauuuaaaaaacaaauaacaaugacuacaauuuaaaaauaagagagcuuagacuggaaaauggcucagugcauaaaagcccuugcugcucucucuucuagaagacuggaguuuguuucccaacacguaugucugcugucagaacuccagcuccaguggaucugaugcuucuggccucccuggcaccugcacucucccuccuuccccccacccccauacacacacacauacauacauacauacauacauacauacauauacguaauaaaaaucuuuaaacacuaucaggguucacucugugugcaagugcucagguuuugacuagcacauguauaagaauauagaaccccccaucacugccugguaugccauggcuucauagaccuacggagguccugcucuuccauccauuuccucuccacccugcucaucacugcucuuuuuuaccaacucuacaguucucccuucuccaguguuuccgaguuggaaucacccagugugcagucuaacgagacugccuggcuuccacauaagguucuccuguguucuacugcugauggccaggcacagaacgauccuauccgucaggcggggcuaaggcccagugagacgugaaccacucaguugcuucugccaguuuccuucaguugagaugcaauaccucaugcacaauccacucaacugaaagguaaaucagugacuucaccacaggcagaacugcacaaccaccgugacauccuaggacauucauaacucuaaaaagaaacccugcacccuaauugacuaucccuuaguguauucccucuuguccaugagcaagcauuagucuacuuuguaacucucuggguugccuguguguggacacucuuauguuuauggaaucaugcacugggcugacccugucacugacccugucacuuagcguggcugucacacuccacccaugcuguagcacaugaguacucuauuccuucucauggcugaguguugucuacuguguggguuuaggacuguuuuguggcacaauauacauguguuuauguguauggaugcaugcacauauggaggcuagaggucaguaucaggugucucccaugauuguuaaucuccaccuuaauuuuuaaaacuuuucuguguguauacauaugcagagauucacaugugcaaacgacagugcauguguacaggucaacucuggagaguugguucucucaugccaccucgggauccagggucugcacuuggggaucaagcacaggagcuucugccacagccauucucagagcucacugauuuggccaugcuggucagccagugagcuccagccguucucagggcucacugauucggccaugcuggccagccagugagcuccagccguucucagggcucacugauucggccaugcuggccagccagugagcuccagccguucucagggcucacugauucggccaugcuggccagccagugagcuccagccguucucagggcucacugauucggccaugcuggccagccagugagcuccagccguucucagggcucacugauucagccauguuggccagccagugagcuccaaggaucugccucuguccaucuccccagcacuggggaaaggcugacugguaccacccagccuacagguucaugcucuauacauaugugugaccuuuggcauggacuguuauccauguuguauaccugucauaccugcaggccaggacagccucauugacuuuucuaucuggcacucaccaaacuuuacucgccccagaccugaucuaaggcuucuaagaaaggacaugauuuuuuucuuuuuuuuuuuuuuuuucucagcaaaaugagauacauaccuucaacagggccaaucugauuggucacagcaaaccucagcacgcccucauccucacuguacaaagcaaaggcccggucgacagucagcugcuggguggcagggauggccaggugucugggggcgugccugcacgccugguaagugauguucuggucaaugugguaggaccacguuugguuaauagaaccagaagugagagagaaacuucgggaacuggaggacgucacgacuguaacaaacauuuuacaggcaaacugguaaaacuuuaaaauacugaaaacaaaaauguuccuguuugguguauccuccuacaguuuucuaccccauuccugggagcaggugccauugagaacucccagaguuucuacaggaagcuggcaaggaaagaccuaggaccuccuggaaccugagaggauacagagccacaccgcugaggaagggaagggacuacaagugcugcagucgucaucacacacuagaaacaagcaucaugauguccuggugugugaacgcugcuggugcugagggcuguacgcacaccaccuaguuugcuccucagagccacauaagacaggcacugacugcgugugcagagaccacaggguuuagggaauagccuggggugugguaaaucucugacuggaacucaaggcaauccagcucuacaucucucaagauuugaggcacauuccacaaaggaaaccacccccaccccacucccaccuccacagcuucgcacagucagcaaggcuuagggaaaagcaaggcaaaaggcuguuccucuugggaguugcaccaagaccagaccuagucuauucugaauacaguuaaggucuguauuccaaucuuuucccuguacccagcucucaugcuggaagcugggggcacaaaacaggugccacucaagacacacaaacuucaaaacaacuauugugaccaccuuguaugcagcuaauacuguguauaggugugcccaaccuucugacauucugacaugacacuaucaucuguguugagcuauauucauacccacugugagacagggcagacuggauaaacuuuguacagcuaauuauaccguaugcaacuuaucaacagcagaaaauguuuauuuuuucuugugcuaagaaaaaugaaaaaaugacuuugcaaugauuuuaaauugcaaauccaugaugugaaucgauuuauauguugacuccaaaucucagcuuuguuucagaacacuggaaagcaucuuucugugaccccuaaagcaaaccaaaaucaucagcugaaacaguuacagagacuccuaaagucuaacagucaaaacaggccgugccuggaggauagcaucuuaucgguuauuacuaucugaaaauaaugugcaaauauauugacauucuuguguacucugacauucuugucagcacucugaucaccuguauacuuuauauacacacauauguaaaauauaacuguguauacguccuaaaaacaagaacgaacacaauuauaucaaccucauuuguguucuaugcaguuuggggcauuccaugugacuauucacuuaaccuaacccuugucacugucuugugaggcaggcaucacguccauuuuacagcuguggaaacucacacauaccugagucccuguaaugauaaaacucuuuguacggaguaaugugggcugugaaauucgcugggaugaagggcaccuggccuucaauguuggucuuaaugcucagauaguuuucugggucaagccccucggcaguuugagugauacgaacccucuccucuccagggugaaaagugacuuccacgucauggacaaagguagcaccugcaggagacagaaacucagcaagugggugacaagacucuuguuuaagucauucugaagacuggcugggacuuggaugauaaagcacuugccuaucauaucagaggcguggguucgacuagcuaagaggaguguguguguccucuccccagucuccucuggagacgguaccgaaggagaguaugccacgcccaggcucaguucuggaaagcugcagacccucugaucucccgaaggucucaaagacucucaauuccccuuguccccguucucuuuaaaaucuagcauauuaacagaguccauuccaaaauuacacuaacuugauacuuccaugcugagggaugauagucgaaaauaggaauuuaccagucauuaaaccauuauguuucuuucuguaagagcagaaagcuuuccacguacaacaaaaccucugcaauucaaaaccuccaacagccuggaaucugagcacguuucuccagaaacaaaaucauccgcagaggcugcccagguaccacaucugaaucccgguuugccagaacugagcucugcucaccugugaggcugaagccauucucagagccuggcuucuccaaagcaaagagccagccaaacagaccuccaaugggcaggacagggagcagggccugggcugccggcugugggacauggcugauggcaguguaggcucugccaucauugcccacgauguaagcguguagauccacgucagugaagugcacaggaaugugacccacucggaggcgaccacucacuuucccauucacucggugaggugccccugaaagacaaaagcaauccuuucagccuuggcccccaucaggcuggggaccgguguacacagaugagcccacucuccugaccacgccucaugcucacucuuuggagacauuucuuuacuauuauugcuguucucacuguugguuuggguuuccuugcaauaagcucucuguagacgccaacugaggauucgugauaaaaucuaggcuagccuucaacucucaacccuccugcuucuccugucucaacaguguuacagucauaguuagagcgacauuuaacaagucccuucugugaucgguuccucacuuaugacccaguccugccugucucucuuccauuccccuucuucacccuccccuuuagcucuaccaagcuagaaagagggcaaaauagaaacguuucaagucacucucaaauugggaaaccaguccaaacguauuuaucacucagucauccccugaacccuugaaagucacuggugcugggauucaggcaucagagauguaaggacaccaagcagaacccacacuggaacuggaaacaggcaggggucaacaauauacaugcagcagccccggccugucaaucaccuucuggcaggcagugcuucccguuuccguaaaaccucgacuggcaguggcagcaaaagccagugguguagucggugcagaaggcaugcugggagcaccggccguggcuguguucgcagguuuccagguuggcgccauuauacgugaagacugaagaauaaagcaaagagcauuagaaagccaaaggauuccagcaucgcuacuaccaagcuucgccagacgucacaagcgcuccguaaaacggcuuggacuguaauaaacaaauagauuugacgcuacaaagaugggaauaacauucagccugagggauuaacuuuauauguucuggcaagaugcucagaucauugcggccaacugggucuuacuacaaugagggugagcugaguggccugagagcagccuugcagacaaaccguaagcgcgcauuagagugaaauuugugaaaucacuauuuggugagguggggagaaaaaaaggccaaauacuggcaauuuuguaugacucaauguaagaguaaucuuuugagaggaagucaaaagagaggaacuaagaaccaaggucugucuaacucuuauggaacccaagcuuaaaggauguacacacacuugcugcgucaacacuugccgucaaaugcaggacuggggagggaagagagacgacaagaaacaggacugaggagccccagguccuugcaggcuuugugcuucccagcuugaggaugacuuucaugcaacagaaacagccuaguccacagaaucuccacaaaaccacccugcaccagaggaagcucgacccccaaaucucccacacucucuucccauuacagagagguagcugugcaagagggagacgaaacggagagagcaagaacgagaggagccugcccucaaugccaucacgcuauccucugcagaagaaauggccaaagugugccugaaaguugggucacaggcaggugagugcuuuccgcuaggaugcugggcaauaccucaauuccaagcacggccacuaggaggcaggguacugcgcaugcuucugccucccaucccccagaagucaggguagucuggagacaccuagagaacgcugaucaagcaggaagggcaaagaguuuuagugcacuuuagccacugaugcuggccugagugucagcucuggaaagaaacaggcugugguggccuuccagggcuauguuugaaaacaaggaacaggccaggguggaaaaaacugaagacucaguauuacugagaauaauaccccaggcgagaacaaaaaccaagacaaugagaagaucuagcuucccgauguguaacaaugcagccgcgacaaagccuugcaucagcaaacacaagauuuacagagcuaacauuuaagcaggcugaaauacaccaucggcuuuaacauuaacccucagcugcaccagagcugggggcagcaagugcuacuuuuaaucuguuuuccagauaaagaaacagaagcagaggauugcggugagucaccugaagaagucaugagugcagcaagcacaugagucugaauucugaagguccagaucccuacuacccccccagggguaauccaacuaacacuaagggcuacaacugaagguuaacaacuaacgggcguuugcagcaugcugagagaaaacacacagguaagaaguggcgaaggggacuggagguggcucagcggugaggaguagugaaggcccaaguuugguucccagaacucccaugggugguaacuccugcuccacaggaucuacugcccucuucuggccuacuuuugcaccuacacucacgugcacauucccaaacacagacagacauuaaaaguaaaauacuuauugagaagugcugagagcagugagaacauuccuuuagcaauuagacauccugggaagcagcaagcugagggcucaucagcuuagaacaccuugguuaaagagaaaagcugaccugucagaauggagucagugauuacgcugagugagcccagcuugacagaaauagaaaauuagucauaacucaacuuuucaacaagugauaggcauuaacuuuuuuuuaaauaaaaaaaaagacaaaacuuaaaaaaaaaaggcagaauagaucgugacaagaauaucacaggcuuuucuauggagaaaacuacuuauugcuauugguuuaggaauggugugugugugugugugugugugagagagagagagagagagagagagagagagagagagaguguguguaugagagagagagagagagagagagagacagagagagagagagagagagagagauuggggauggaucucagggccuccugcauaccggaugcucuuugucacuaagcuaugccccuuaucucaacaaaaaccagggugaguaaaaagcuguaagugugacgcagaugugucaaagggcagaguuccccagcucagacaggugcacguguacaggugugcuccugagucagcacaggugccacuucagaaggucauaagcucugcucugugagaccacgggcaaaugucacaugcacucccuggccucagaaguccccaacaugcauagccagugucugucucuucaccuccuucugucacuaggacacaaaggcaauccaaucuugguggacaggggagucauuuucagcuauguccguuaaaaagaaagcagguuuccacacacggcuuggcuugcaaauuaagggagggauagauggauuuugcugucucguuauuuuguaaaaaccguacugacccagacagacccuacuuuaagccuuaucaagaaaugaagagaggaccagaggcagaagaguuaggcuaauucaacuaagacacuagaugugaugauccugggagcccagacacuguccagcagcucacacaagacuucaaaugcaacucaaaguuagcguguguguguguguguguguguguguguguguguguguguggacuagcccaugagaaucagcuuccucgcucuuuugcacucucuccccucauucaccucacccccaccccccaccccuggguaccacauaggucccaggucaugaggaauggugacugucucuuagucccaggaaagaguucuaaguuaauaagaauccagaauggaaaaugacaagaggauuccuuauaaaggcuaugcuaagacuccaacaccaaccgaagaaugaacuucuacugcuaagcuaaccugagaguuuauggaaauuuguucugcaaauggaacuugaaccaagcacaugccuuucucggucuggaggaguccccgggcuaaggaagcugugguucauuuagacccucgucuguuuacucuccuacacagacacuagcacaccuuacaccuaaaauggagucgcgcuagcaaaagcuaaaaacaccgcaguuuccuuucuuucacacaauaggugaacaaguauuuacuaaacacucuaagccacgggcgagaagucaggcaaacaguccuguucuccugggcagcagccaguaaacaaauauggcugaucucagugagcuggggccuugggaguaagaagugauaaugaagcgcaugagaaagaagaugucuaggaggcuccagaggcagaagagacaacgcgacagagacugagugugagaaaccaggagccgcugcccucggacacuguguguggaguguaggcuuccggauaacuggcugagacacgggugacaacugcugagggauuccucuggaaaccugauagcaaagcccagccuuagcacggcaccuucacagggagggucaguauguuaggaacgcggagauaacuguuaaaaagacuaauucugaggcccaccuuaaacccaccacuuccuucccaagucuaugggaaugucaggaaucuugugcuccggccuccacaaacuauacauggcuaaaaugcuaugcagccaagccugggccagcaguggguugucgggcuuaaagagcucaauuugccauacacuuaacaucugaggucggacagcugcaaagggcaucuugggguuuuuuuguuuuaaaucucacuuuuuuuccccauucaauguuuuuuuaaaaaaccucuucucauacccuuaauagaaagggaaauggggugggaauauauacaggaacaaagccagggugcugccaggguacuugagccuucuccuaauugggaguuuuuaacaaaaauagaaaagucuucucuggccgggcgcgguggcgugugccuuuaaucccagcacuggggaggcagaggcagguggauuucugaguucgaggccagccuggucuacagagugaguuccaggacagccagggcuacacagagaaacccugucucggaaaaaaaaaaaaaaaaaaaaaaaaacagaaaagaaaagaaaauucuccucuggacuugcucuggcccauccuucguuuuuuuuuuuuuuugcaaaggcuuaagcacuugucuucagccguuggcaugccuucucagagugcauccucugaagcaaggagaucccauagugcacaucacaggaagacacgcagggcaccugccccauagcgggcagacuuuucugccuuuaacaacacugacagcucccuuaagaacaagaaacaacguuuuccccgcagggcagauuccccaaccucccacccccaaauggucucaccucccagaaugacugacuacauagaguaccauaucugcuuugugacaagcagcaguggcaugccuucccugccaggcugcacggccauccucuauguuacacuagcugucaggacaccaacaggcucuaucuuaccuucuggaugagggacaagccccaccaggggcuuucugcacacagguaugaucacagguauggaagacucuagucacagacuguuauggagauagccauggguuugaggcuuuggggccaggaggucuggguuaagugcacagccugcuagaguuccuccuagaauggaccuccaaugagcaggacacuuguguaaccccucugaaggccagaaggauagaagggcucagccucuuccaggauaaaugacuuccaaacagaaagaagcggaccccuccacggggcagaacccacaagguaucuggagcccaggugccggcccuucuaguucacauugccaaaccaaaggaaaucauauugagguucauacagaagaucaucagcagguucaagagcacccuaaaacccgucagucggccccaguggcugucugacaacacaggcggucucuggucccuaccagcugaagcaucucuggcaacuccucaacucuccccuaccccgauuccauuucuaccucugugccuaccuuuccagaauguucuuacacucuucccuuuuaaugccuuagauucagguccccaagaccgacuugaagcaucccuccuucaguaagauuucucugacugcagccaccgacacaggcauagcccccccaucccaccccaccccccacacacacggagucccugaccugauuacaagcauggcugucucuuacucagcaagacacuacccauuuccagccuucaaccacgaaggcuaacgauaucuccuuucaguuaauucugagcagcaaccaagggaacagaaucuaaagcuaaguuccugccuagaggaccagaauauacaaugcagcccaagaaaaugcccucggucucucagagaagcaugccggggcuuagguaauuucuuggcuugacaacaaacuccuggaaaauacaagucaccucagagagaggaugcucacacauccgcugcauugcuggcucauuguuggcucgaugaguuaugaaagcaaaugauacaaggccagaaccuagaugugccugacacagacauaauuugaaaagaaucuggaauuuuggaaaaaaaaaagucuguaaguggaccagcauaaugugcuuaaugguguacaccuuuaaucccagcauucaggagacaaaggcagguggaucaauuugaguguggggacagcccagucuacacugcaaguuccaagaaagcuggggcuacacagugagacccugccucaaaaguaaauaaaaacacaaauauacaaucccuagggcugaggaggcgggucaaucaguaaagaaaaacuugcuuugcaaguauuaggaccacagguugauucccagaacucacguuaaaaacaccaacaaaaaaacaaaaacaaaaccaagagagccaguuaguuuccuaagacuuucuggccaccagucuagacuacuuugcaaguaaauucuaagccagcaagagacuuuauagauggcaucccuaaggugacacucaagguuauccucuauccuccacaagagugcaccugcacacacacgcacaugugcacacacgugcacacgcacccccuaaugaaaacaauacuaaaaagaauagaaggccaggcagugguggcgcacgccuuuaaucccaggcucuugggaggcagaggcagguggauuucugaguucgaggccagccuggucuacagagugaguuccaggacagccagggcuauacagauaaaaugaaaaaaaaaaaaaaaaaaaaaaagaagagaaauuuucugagccuuuaacaaacuccuaauucccggacucagcagagugagcuguacacgcguaaaggggaagcuaacauuuccugggaucggugcuuucucuucagaaaauaaggcucuaacaggaucucucuucaaacuacacagcagagcugugggugcucaggccauccuccaccggaagcuggggacuuccuacucugagcuggcaugugcaggucucagucacccccagaguaaggccacagcuacuggauaaaccuccgggacagcaguguuuccucugagcauaaguaacaacuacaugcuucugugcuucacacagcucacaaacgcccuuuuuuuugcacacaugaacuugcacacaugaacacacaaaaauauaauuuaaauaaaaucuaacaguauuuuuuuuuuccucugagacuuaaaagcuuccaguuaggcaaucucccccugaaugucuuuuucagaaacauucuggcauuuagaugucaguauuggcuacauuuggcagcugauaaauaucacaguucaagccccucccggguuaguuaugccguuacccucaguucccaguggucagucccacuucaggcuuuucugagcucuuaaacagccaugcacaaccuuugacacugugacacauugucaucuacaaaguucgugcuucaagaacccugacugaguuauaaaagaaaaagcucagaauguuucaagugaguuuacaguuuuugcugggcuauauccagcuacccagguugcagccaacuguacacagauccacuuuucaguaacugugcgcuguucuugggaaaauacaacccccaacaaaaggccgcucagaaacacaucuguaccacaaaaucucauugagaaaaccuuugauucaugccuuuaaaucucuuuacauagaaagaacccgcacugaaauuuuuggagauuguuagaaggaucugaaaguucuagaaccuuaaaaaaaaaaguccaugucuuugacuuuacagaaacaaccuuucaucagacuucaucaaggcgaaaagcagccaggcgucaaaagcuuuuuaaugagucuuuuuguuuucagcucuuucguuuuccagccuagcucuucacucucuacccauccuccaacccauuucccauauuuuaaguccucuaaagauuaguaacaacagcggcuauuuucuuuuaaagaaccgacuaauggaggugcacagaacgucacauaaauucacauuaaauucuggcaauacauuuauagaaaaucagagacuugguugggggugaaauaaguugucucaguuuggccaagauucaucuugacaccaaugucccuucccuaacuauuacacucugcucuguuaaacacaaaguguuuucuucccuccugaaguauuucucugacuaacuccugaaccuucaggaaauguccuagcagaaccagaagguccucuuugcuagguuaauguuuuugccaaaacacugacaaaaacuguaaaguugaaacacuguggagagagccgugaccucugacccuucccuccuggcagagaucagugagcaggcccugggagggggguuggggggacgaagcuggggccaguuucccaguccaucaguguggaugaaaagcuguccccucugggcauucccgggcuacgaucagugcaucauggaaugaggauaagguucuggggaggugaaggccacagcugugaggaugagaaucagaaaugacagcaggcagagguguuuaccaugaucuuccccugcagacucuuuagcauguuugccuaagucugcacaaugaacucaccauagccaaagcuagauggcugugcccuccauccugcaaugccuacgaagccucgaaauggcucaccuucccugaacuugcaaacugaaauauuucauuacacuugggaggagagcuggcacaaguggcccagcucuuuccccacuccaugaggccuaauuuuuuagaacacauuauuaauggucaggaggcuccaagaagaacucuucugccaagauguacuuggcaaagggaauuuaucuccuuaaacacaaggaggaaaaaucaguuccaaucugcuugcuaaacuuuucaccuauucacucagaagaaaaccacagcuguauuuuuuguuuuguuuuggaagaaguuucacucuauaauccaggcuggccuggaauucucuauauagccuaugcuagucuuaaaccuagauaauccuccagccucagccugccccagccugccccagccugcccagccugccccagccugccucagccugcccagccuacccgagucugccccagccugccccagucugcccagccugccccagucugcccagccugccccagccugccccagccugccccagccugccucagccugcccagccuacccgagucugccccagccuaccccagccugccccagccugccucagccugcccagccugccccagccugccccagccugccccagccugccccagccugccucagccugcccaguagagaaaugagcacaguugauugaccauuucuaguuugucaacucugcuacauuuucuuuaaacaaaaucccaaaugccaaguuguucaaugcacuuaccuugaucauuagaucccacgugguccuccaguccuaucacauacuucccuccucucaggggcggaacgugaccagacucgggguaaugaggaaggacuucuccuuccagaggagggacaggaacaucuggcucugaaggcacuggcccugccucuggauaggacuggguguuucugcccccaaggucuucguugacuggaguuaggagagcugcaucugccucuggaggagcuggggcucugguacccaucugguccaaaagcuccgcugggucccugaaauccagaaccucucccucucccaccggccgccccuguuugguuugaggguccaaagaagccgauucuguuucccgguaggauggccaguuaccaggugcuggauauggccaaggagaagcgcggucggaaccuggagaugaggugccgacguccacaaggccuggaucagccuuugaauugaaagacacaucaauucugcuguggccuuccggggccucccccgguucaacugguggguacucaacauccucuucauucucaucguaguaauggaaacuguccucgguguagcucuccagggcugcagcauggcugaaggggugcuccagugcugaggaacgggcuguggaagggucaccuccaacuguggcuggacggacauuguccagggcaaaccugcugccgaugugaaaagcccacacuccaggaauccccagguugcuuagccuaagaacaaaggagaagagcugauuguaagcaguccauucauucuccuucagaguuuguucugaaaccaaaagacuauaaagaucagaguugagccagagcacaaauuucaugcuaacaagaaaacuuguguuccaaauguacuguggauucacauggacuaaucuauuaaugacagaggaugauagauauagcaauacuuuuuaauguccaagucuaaaacaauuuuuugcucacucgggugagauacaaauggauuaaucaaacugaaacucaguaucugcgaacagaucuucauuugcucaguagaguagaccaugaacccccccucaguucccaagaguuucuuuuuucagaggagucucacuagauagucccagcuauacucaagccugagaucugcugcgauugcaagcauguggcccucuugccggcucaguggcccacuauuucaaugucaauggcaugcugugaagaggacagccauguguaggacuccuaagccuaagaaaaagcuggaguuaaucaaacucuggaaagcuggaacuggccaaagauaccaacccugugcuugcacuaaauaccaugcucaaauucucccacacuauggaauuuccucaaaagucaacacugaagaauaagagcgaauggcuaauaagaaguuuuaaaauucauaggaucauauaacaagagagcuuuguucacuggggcaaguauucaccauucuagucuagguuucuacugcaauaauguuuuuaaaccaguugagguuuucuucaguucucucucucucucucucucucucucucauccugugcucuguucacagcccacucacucacuaccugugcccaaguguaugugugaugcugcuguuguacugguggauuuugucaccuuaaugcaaacccagacacaucugggaagagggagcuuugauuaagagaucaccgcaaccacacaagccugaaggcaagucuguuggggggagggcauuuuccugguuaaugauugaugggaggaagagccgcucacugugcgugguaccauccuuggguaccaucucuggcuguguaagaaauuaggcuuuaguuccugacucccuccagguuccuguccugccuaaguucuugccuuggcacugugacccaggauaguaaaccaaauaaacucuuuccuccccaagucaggucaguguuuugucacagcaagagaaagcagacggcagcuacuguuacaggucacuuagaugcagaaagcaaacugccauccuuucuguaauuugcuaucuucacuugcuaugguuccuuuuuaauuuuuuugauauauggucucauguagcucaggauauucucuuccuccugccuccaccucccaaauacugggauacuaggugugagccacugugcccaguuugugugguucugaggacaaaacucugggcuuuauguccacaaggcagguauucuuccagcagagcuucaucuccuacccucacuugguaugcuuauagaaauuaagguugcaaauaaaacacacuacagaagacaaaacuccaggcugcuaaaauggcucaacagggaaaccugcuuaucuccaagagcugagagcuguacucagaauccacaugguggugguggugggggggaacacaaagcaccaacucccgcaaacucaccucugacccagacacacccccagcugccccaacccccaacucuacacaguaaaugcaauuuuagaaacugaaaccaaucagaggggacccuggggccugagccuagccccacagcaggggugcugcagcugggaacccucuugaguuuggaagucgacagcuauaaaagcuucaaagagaaggagaauacaaauuauggaagaguaaagcuaaauaaaugccuucuaaugagacauaaaucaauaugcuggcguuugcuuugccacaguggcugaugggaaucuaagcaauuaguuuacccuccacucugaggucauuuggaaugcuuacugauagaaaaaauuugucuccuagaaaggaaaacugaaucauaagaugggacagccaugccuuccugccugggaucuuaggaagaacaugugggaaaucccacauuaaaggcuuagcgcgcaggcccuguugguaaauacuaccuaauaccuacucuccucucuuccugaaugugcauacaccucacaagagccaugcaaacaugaauaauggaugacccuuguuugaggaagagauuccagacuaggaauaugcucuccuccuuggggauguacaacagagcauucagagagagcuugggccacgauccugagcaacuucaguucauaaauguccucacggugcugggcacaggcaaugcaauguuugagccuuuaugacgacaauacugacagaaucuggaggaaagaggcccaugagacagugucaagcaugggagcacugaaugggagggcggaccccacucugagaggggagguagacagcugucacucaaaguagagguaggauaauucugacuugcauuucauguuauucuguugucuguauuuugucucaucuuguuaagugugagguacaacaaaucugucagucacuccggucacaucucacucugcuccucucuggcaauucugauauuucuggaaagcaucaaaggaggaaaugaaggaagaacuggaguggguggaucgcagugugugugugugugugagugugugcgcgcgcgcgccugugucuuuaaaacuguaguauuucaugcacucagcccuccuuccaagggcuuuauguacagccuggggaaugagagucuuuaagcuccuggguaggagaggagaggagaaaggauagaaggcaaaugcuuaaguuuguucuagcgucuggacuacauagcgguuaagaaggagaccaacagacacccaacauggaucacggaacaggaaagaaugcugugcauagagcccuuggaaggagggcugagugcuuuaaauucuacauuuuuuuaaggcacaggcccuggacaccaacagcaccuggaaagaaggaccaagaaucacagaaaauuagaaugagaauuggcaucugcauggccauaggaagcuggugugugugcgugugugcaugcauauguacacauaugcccguguaucugugcaaaaaguuugugaggagaagcaguuguguuucucuacuagagucauaaaggccucacaugcacgcccgugcacacagacacacacacugccaugcacccacuccguggauuuccuucauuuccuccuucgaugcuuucuagaaauuucagauuugccagagaggagcagagugagaugugaccagagugacugauaaaaugaaaaaaauacaaacaacacagaaacaugaaauucaagugagagucacacuaucuacucugcauaugauaucagcccugugucugugauucggaccuguguugacuauggcuuagccauuuaaaacugacauaagcaacuuuguuaauuucuguaaggcuauuuguaaaaccgggaagauagcuaugcuuagcaccuauaagucugagugaguuuuaacuaagauaauauuugcaaacauuuuaucacaauguuugcaguuagaaagugaucaauaaauuuuugcugagucacucucucugcccacaaucuaguugauaagcacaaaugcaugcaaacggguaaggguuuccuauaaccaagaggcggaauagccuauugccgcacuagcagaauaagccacuggggagacuaagaaauggauucgucucuggcaacgcugugggcaaaccgaucagcauuauuucgggugauggugucuggagaaaucuugagacuucuaaaagccucaucuauuccccucccucuauuauauuaccuguaauuuaauccucaacaaugccuguuugaaagacuaaaucaugaugccuccucugaagaaaucauuaaccugaaaagccuccacugaggcaguuauuacuggauauuuuuauguagcuccaagaacaauguuuuuccuagcaagcccagugguucugcaaaaacacauauaaucgcugcugguucuguuuuccaugccugaacugacagugcaggaaaaaauaaaggaucuuuuauaucuuggagagccugaagcucugggguccagcuuagcuccugguuuugagccagugccuuucuuagaagccaccaaagcuucuuaucgaauggucucuggucacuugagaucaugucccuccuaaaugucauuccaguggguaacacaggcacauccacaggcacauuacuuacugguagagauucuucacagacugcucgguguuagucaggcugaaauacagugcuucucucuucaggucguccgcuuccccucggcagaagcccacccuagcgggaagcugcagcuggacauuguaggacucuuuggggcggguuccaaagaacugaaggccauuggcaggguagagaaagagggcguagguaucagauucaucggaugccagaacagccuggaaaguguucagcuguggacaaaaaggaauggcagacauccuuaaacaaacaaauaaacaaaagaagaaaaacagaacacagacaaggggcccaagcccaaauccuuuuaggaauuccccacauugguuuugaacacaaucucuuuuagaauucccuuuucaaauuacaaauaaaauuuuguaaaauaaaugaauuauuuuaaaccucuucuaccaauuuaaaucaauaguuaaauaauguauaaguaaaacacuggcuuaaaacuuucagggcugcaggaaaaagagaugaugaggaaggaucaacuaacacuaaggacguuugaaaaagccuuaugaagggcaggagagauggacagcuaaggauaccagcugcucuuccagaggucccagguucaagucccagcaccuacaagaucgugauagcucacaccugccuguaacgucaguuccacacagacauacaugcaggaaaaacgcccaugaacacuaaaaaaaagccauacgaaaaccuacuugccaacauacaaggaauguuuaaagggaacuggcuuacaugggagauaacgcuccucccaucagccacaaguccucaaaaagcccagagccagguauaggacaccuugcccucaagguuggucaaggaugucacagagacaacaaugccagaguugucaauggucauugcccaggacuccccaucagaaugugacgguaagaaccuauagcuggugacaccacacauguaggucacaggucuuggagaaaccacacacagacacucauuuauguauacaugcacacacgcaugcaugcaugacgcuuccaccccugccagcugccuuucaugacacuagaagaugguaugcaggcuacagucucaccccaccaugacugcucagggguacaaacaaagcccuggcaagauguauucaugggcaccauaaguggcaggaaugcuauaaagaccaucaguccauuucuggauggauuuaaggccugaucgacaagaggaaacuucugccuggaaacuucuguauuguaaaucuggccaagaaaccauggccgggggaggcgggggagggggguggaaggagggugggcgugugggcgggagguucauaagcccuggaagugaaccaugauuauccauaccaguuauaaacucauauauuaguggagcucucggcagucauagcggagcaucuuugugcaguggaugguaguuaauucacacauucaucgcuaguccaaggguagagaagaaacuaucuguggaaagcccagccacagauacucccaccuguaucuaauucccuugagguucagagaacacuggaaagaaaagagguggaaagagcuuaagagccagaggucagaaggaaauggggucaaaacaaugucuugugcacauaacaugacuguugcagcuguggugaccagcaggagagcaacccacucacauuccagcacagaugcucccaccugcagcugagaggaugcugacagcugauggcugcuagggcagaguguucguuagggguguggugccugguagguggagccugcugcagugguggccccucgccccgugccccgaugggcuuccuuguaugcaggggguuauuagaacaaauaaaggacaugaagguguauggacagaaguaguggaagagggaagaguggauauacugagagauauuauauaaauguauccaguaauuuuaaaagagaguguauuuaaaauuguuaagguugcagguuucuccaguccaaacucuuccaagagacugaacaaggaacaaaauuagcuugcucauuccuauacccccaguucugguguuuaaucuugugucuuagcaucucugauauggaucacccaugcauccaugcauccaaugcccacugcaggcaacacucagccaggaagugacugaucaaaaaggccuccuuacugaucagauagccaaacucccuuuccucuuccaucucuuuacaacacgaguuauccugucacacugcagaugaagaaagagacccaggggcucgcuuaaggucgggcaauggguagugguugcagucagucaguuccacagcucaugcccugcauuauucagugaucugaacucuaucagacaagccauuccagggcacguacucugagccaaucucccuucccaggcucugcuccacuaugcccucaacaggguguguaagggcccccacuccuacuauguguuuugacgcuguuguauucauacuucgcugcaccaagaaaauccuaaccaacaagcacugccuccuggggauugaguacuguaauucccuauggaacccacuuugugggcuucuguagcuccacucacuagcgagcccguucuauuaauucaucagggcugaguaccugcuaagccauauuacgucugaacugcaggaaugaaggagccaaggucagugacuaugucccaagagcccaaauuauaggagagggaaacagcccggacuggaauuuuuuuuuuuuuuucccauuuuuuauuagguauuuagcucauuuacauuucuaaugcuagaccaaaagucccccuuacccacccacccccacuccccuacccacccacucccccacuuuggcccuggcguuccccuguaccggggcacacaaagccggacuggaauuuuaggagagugacugcgacaagcaugguggcagaggccacagagaaaggagagaguccaggacaucagagugggggugggguggcggcacaguggcagccaaugaaugaagauaaacacugcaggagccaaagcagacagaggagaacugauguagccugaauuaacacccuggugacuugggaauuacuucuugguauuucacuuacucaguuucaaagggaccuguuccgccuaccaucuucuccaccaaauaauuaguuaugcgaugcuucacugucuuagacucuguagucagcuucucucacuagaucauauuugucuaacgauuuaguagagaacugggaaaacuuuuuuuaaggaaaaaaaaucacuaauugguauuguugccucuccauuuugcuaaacaagacaaaacuggacacaagaaccaccucaaaauugaauacaaggaacaaaugugcccuuggguuuuuucugucuuguucuagaacaucucaaauguuaaauuuuaccuuucugauauauaaugcuaaagaauagcuuugaccagcacucgggaggcagaggcaggcguauuucugaguucgaggccagccuggucuacaaagugagcuccaggacagccagggcuauacagagaaacccugucucgaaaaaccaaaaaaaaaaaaaaaaaaaaaagaauagcuuugagguucagguaauagggcaacgaaaugcagguauuaauacgguuucaagaaaaaaguaaaaacuaugcaacuccacuguauucgcuaauggggagagucugcuuauaccuuccguguuucagucccaaccugcuacuccguuacagcugugguccucaccuaucucaucagcaaagcuugaccuucaucagaaaggucagaagcucugaguuuccaacucagguacaggcagaacacccucaucagucaggguggggccaguggcugccagaguuuuauuucagucacaacaaaguucaacuagggagauaaaaagcagaacuaagaaucccauccuuaaauaaccaacuguggaggcuccgggcaugucggccacaaucgacaucacaagauaagggagaaccaagguucuaaauuuagagaaauuccauaugauaagggcugucugcaugcggagauuggaaggcgguggggaggaggccgagggagaagugaggaggcugugaugggagagccuggcgucuaaccuggaaaucugcauuuagugccguauuuguucagugucuuuucugugucaccuuuuggagaagcacucacuucagaugacaaguguuucauuuccuugucucuacuaaaauaggcaaagaccagagguaaaaacaacaaaaacuuccuuuuaauauaguuuaugaucccaaaguacacuccaagagagcuccuugaaaacugcccacacacaaaccgcccccuugucagggcuucagauuuccacucagaauggcuaagaggccacuucauagguccugaagggccccuccucacagacacacucucacugguuuccaaagggaaaggcccuccauucccagagacaagcuuuccaagagcccuccacacagguucugaagggaagcccucagauggacugccaaacccuguacaagagcucccaacuuccccuggaugccagagaggaguggggccuucacaggguggggagcaguacagagagcaucaggccagagcugccuagcugcacugucuccuuuccuguuuacagagaaaaccaaaagccuucgcagaaaccaccuuccaguguugcuaugacaccggcagagccaggugacuggaacacagcaucugacaaggcccaaagaaugccaccaucuuuccaacaagggauccagcuuuaccaaaaugauaacaaaauuagaaauggggugaccccuuccuggggacaaaguuugauguucagucuuccuuaaggacacauucucuggaguuguaaggccacugguucuagccuccuacacuuggugugaacaccaaccucuacuuguguguuauucuuccugucgggacacuggcauucaccauauucaccuucauacugcagaguuaagaaaaaugcccaauacuuuaacaauugcauaguauauccuccuucauauauagucuucaagaacaccuuaggaguuuuccuuuuuuuguuuuuguuuuuuugagacaggguuucucuguguagccucugccucccaagugcugggauuaaaggugugagccaccacugcccuagcaguuuucuuuaacccguuuuacauaucuaguuauucucuauucucucugucuucacugccaugugguuaauuauccacacacccuguauguggacuguagcuccauaaauuaagaagcuccaucuaaauccaaagcucuugaucaacacccgccaucuuugcaccaacucaacacccaucaucccauguuuaagcgugcacagaccaacugugauggauacuauuggauacaaaagggaaagcaagcuuagaaccaacacccaucuuucucugcuucccaaguagagacagaauguuuccauccuuuuccagagcaagacuccacgcucccauccuuccaagcccuggaugcagcccagccucaggcaagcucuccugccacucauccuccauccccauuccugugguccuuccaacccaaaugaaauuccucaucaacguacugcauaacucaguucuugauaacaauuccccccaacucccagugagaacacaacagaaacccuugaaaccaaaaacacacagagcaacaaaacgguacccaucagcaguuuaagaacucuccgauuaacuaaaggaacaaacccuuuauuuguucaguguuuaaugcagucgcaccauggcauucuugcaugccagguagaacagucagccacacccaaugugagcaucgcggagagugacgagcagcagaagcauuuuacacgggaagguguuuuacacggcaaggcacuacuccucugagguccagccuccaguaacuaauauuaagauuacuacaccagaugucagaaaacuauguagaaaucacagacuccuccaagcaaaggagauuaaugugugucaaaaucuaccuaaaaaaaaaaaaagucuaucaaggcaagagcuuaaucccaggguuuucacagcauucggaagucuuccaugggagugacugauaaacacagccugugcacaaauccucaccaacggagcaaaucccgaagcacauuuggccuauggcgauuccugaagaaggaccuggauggcaaagucaagacagaauuuuccccaccuaauuccccaacaaaaagaaaagauaaacaaagauaaaaaagugauucagaaaacccuccauuuaaagaguccuuauagagagggccagaggagacucagcagguaaagcccuugccuugaaauccuaguacaauccaggaacccacguaaaagaagagaacagguaccgggagggucuucucccaagcucuacaugugcaccaugcuguguacacacauaaaucauaacaaaacuacauaccauacaugucauacacacauaccaugcacacaccccauacauacaucacacacacacacaaggauccucaaugcaguauguauuuaccauacacaaacaccacacacacugugcacauauaaacacaucauacagacauacauaugcacauacaccauacacacauaccauacacagacaauacauauucacaugcagcauauaaacauauacacacauauacaugcacgcacacacaagagaaauaaaacaaccagauccuuaccuaaaggaguucuaacagaagaucguuacaagucagaaacaaaacggcaccaugguaauucuuaugacgacccuguaaagucaguacugucaccucuuucuacagcuuagaaaaugaagagugagggcucuugucucccaagaccacugcugcagguguuuucuaccugguuacuggccucgcaagaaccuugaagguguaaugggagaauuacugugccuucggaaguugcucagucaugagagacuucaugaggaccuauguucaagucccagaacugcaaauuugaagagcgagaaaugguucagugugucugguguugcuauucaagcaugaggauccgcauuugaucucuagauaugcacugaacaaaaacagucacggugucauugccaggucuguagaccuauagcuaggaagguagcccugcgugccuagucaagcaauccuagcuuagcugcuaaguccugggucagagggagaugugccugagaguggcuuaaagggagcuggaaagagggcucagcagguuaaaggcaccuauaccauguaaagucugaugaccagggcucaacucccagaucccacaaagagggaggagaagagagcugauuccaaguuggucuaugaccaccacagugucaaaacaugcacacauacacgcaacaaauaaauaauuuuuaaaagguggauggugccuaaggaaugacacucuggucugcacgcacaugcaccuccacacaaaggugaacgcgugcacaaaugcauguucauucauacgcgcgcgcacacacacacacacacacacacacacacacacacacaccccaaaaggagaaacugucagagaauguugcugaugaagugagaauccuaacaacuaaacucaucuuucuggggcugcaaccuuuaugucaaacaagcacuaauacacuugggagccaccacagccucaagaccccugagccucagcgcacaugccucucgcucuaauucuuuuuucuguugcaagaggcuaauucagcugaacucuccuugggagcagcagaacacuaauuucaaagugacaguggcaucagaagggucccugacaaaaacuucacuccgguucaugccuccuuugaauacagcuccaagaacugucauagcacuaaagucacaacgaacauuaaaagguaaccucguuuacugaaaggcacaacuguuauuauuguaacugcuucuaugauccaugcauagaaaacgggucuuguaugaaaagcguaaggaaggggaaaacugggccuuuuaagggaucuuugccuuacuuaaggcagauuuggaaauuauuuucucuuucaugauauaaacaguaaauauugcacuuacccugugggacuaugucgagaagacaguauaaaauguuccugauauaagaagagggggcagagagauggcucucuggauguucuuccagaggaucuauguucaauucccagcacucacgugauagauagcucacaccuguagguaauccuguccagggggagcugaugcccucuucugaacuccauggccucaugaaguuccgaacucaacugucuaaauaguuugcccuucgacccuuacuaacuaaugucaccagaaugacagugcgcaggcuggggagcggcucagcuaguggagugccugcucagcaugcagguaauucuggguucaauccccaucaacuggguagguaugacgcugcgcacccauuaccucagcacgcaggugagagguggggcaagagcaccagauucaagaucacccuccauuacaagguuugaagccaaucugggauucaugaggaccaucuuaaaagagaaagagacggugugugugcgugggggagggggagcggggcggggcuggggaggugccaaaagcaaaacaaaaggaacaacaaaaguuagacucccccacuucgaaucuuucacgacugcccacuaucugggaacccaaucuacaguccucagaggggacaaccuuucucuacccuggagccuucccuccuuagaucccaucaccccugcucuucugaaagacagugccugccaugccccaaggcacaggcugauacagucugccuucuauccugcaaguaacuuagcuugcucucagaaaccuacccaaauggagggguuuggaagaagcucuagguagagggccuaccauauugccauaacaaaacguaaaugaggccuuucagaacgggagcagucaacucgguguuuauuucggugccuaccaacauuguauaaaaauggcuucugaauuaauaaauaucaacuguguuuaaauagagauaugugcauuauaugguucugugacauauaugccuuuugcuuuguguuuuaagauaacaagagaagcugggaaggcagcagucuaugaagugcuugcugcgcaugcgugaaguccugagcgugauccagagcacccacaugaaagugggggcgugacagcacacguauaaucucagcuuccgggagaaaaaugagcagaucacuagccagcaagccuagccuaacugagggguccuaggucccagagacaagauggcucccaagcaaagacauuuaaagaugaccucugguccccacaugcaugugugcacacucucacucauaaaaugaaaacuuaaaaaaaaaaaaaaaagacuauaagaaaauagaaauauaagaacugguaaccuaguugcuuguauuagaaaaguuuguuuucaacuauaaguuauacaugauuuuagauaaaugucuaagagauaauguaugaaugaaugaaugaaugaaugaaacaggggacugucuucucuagcccucuagcuggcuggccugcaugaaguguuugaguugaggguauucuguugaauuggaauugauaugucaagcccacauacuacaaggcuagucaguaaacaaaaccggaugcuaacccgucaaguaagaaacuguaacuucgacggauggugguggcacaugccuuuaaucccagcacuugggaggcagaggcaggcugauuucugaguucaaggccagccugauuuacaaagugaguuccaggacagccaggacuauacagagaaacccuguuucaaaaaaccaaaaaaagaaaaagaaacuaaauucaaauaauguuuauuucuagaucucugcuagugcagacuuuaagaaaacaugucuuuuccuuuaagaacauggaacaaucacaaccauuguccgugugacagggacaaugggcaagcuuuaaaccucuuagggaugauaucacuucuguagucaagaaacacuaggaguuaaagcaaacaugguuuugcuccuaugccauuauacacccagguggaauuucacaagaggacucugucucuaccuacaccaggaaugaggcaagcuacccugaccaaccauugcccacuucacauguugcuaagaccaaagcuaggagcagaguuuuuggugcuuucucuagcuaaacugcaaaacagucuccugcagacagaaguaugcaaacuguuacaaaggcaaugugggggaaagcuacaaggagcuugcuaagaaguguguggcauccuucucuacuuuccugggaugucagcuaagacaguguuggcuuuagagaggugcuagagagguggcuccacagcuaagagcacauguaguccugucaguaugcuagcucaaaucccuguaugcaaucagucaagccacacucagucaagccacucacaacugccuguaaguaacaacucuaacugcagggaaucuaagcccucuucuagcccuaccaacaccagcagagagagacacacauaugaauaaaauaaaaaccuugaaaaguguuguauaguacugauuauaauaaaaacacgggagcaaccuuaaugaucccuaggaagggucauaaguucacugggggaggucugauacagcuguuucaauguuacagaaucacacuuucaagaguauacaauccagcagaagaagcaagugaaacaguauuaugggcacugugaacccaccauugcuaauggcaagaauaugcuaaagcaauagcugggaauguacauacaaaauauggguuacuuuugguuuguccagacacgguuucucuguggauucucacuguccuggaacucacuuuguagaccaggcuggccucgaacucacagagaucugcuugccucugcuggaauuaaaugcaugugcugccacgcccaacucauaccaaaaaaauuaauuaauuaauuaauuaauuaacagugguaggaaaauaagagguuguuccuuuugaaaacuuccucaauuuuccauuuuuucccuucaaugaaccuaucauuagaaauauuuguguacuuauaggugguucuugguaucugagccuuagucccucauuucacuaagccgacuuagccacuuaggagagccuuagaaugcccccagagacaauaaauagacuucacucacaagcugccuaagcacugguuucauccaguucaacgccugaucaagggaagaaacuccuagucaaagccuuagauccaacacaaaauucaggccgucccuuuaauuuauucagcugcaggguaucccucacuuaccucuccugacggcgcagccccgcgacugaccuccucguaggcgcccacgugcucccagguggccaggaaggcgugggugggggugaagcuggaccccgacagcgggaagccagugcgcacguagcgggcagccaggcucagcacagcuccggagguguccucgcgguacaggauccggccccugcugugacuagugucgaugucagccaggaaaggggcgauggcugggaagucaguaggaaaaucaucaucuacauauugagucucccuggggaaguccuggguggagaugaugccguuggugcccaccuacaauaagaccaaggggcggugagacaguucagcagguaagggcaccuugccgucaaacccgacgacuugaguucuaggacacaagguggaagaaaaagccaguucucugaucuucauacacacgagguggcacgugaauccccaacauuuuuaauauuuuuaaaaggucaaaauagugguggucgcucaagcccaagggcagccaccgugcuccagucguacgcaccuaccguccaccuauuguagaaaauauuucuacuccaaucaagguugagccacauccaggguagcaagcuccuaucucacccuccagugcacugcgacccacaggugcggcugcucucgaaccgguccaucuuucuccaguauugcucgcccuuaagauagcucugccggcgugcacaguccccccccccccaccgcccuaaacgcaaaccccacucgcagccuuaacuucaucuuccugccuagaaugucaaaguagaggggcacgguuccagcucgcccuugaaacgauccuuauuccuccacaguaaggaucaagaaguugcagcgccgcugcuaagccugguccccagaggggacgacaguuaaacauggagguuguuccacucccugggaagaagcuaagagucccacacccaaccgcgcaccuccgggagcugaacuuacguagaggcugcugaacugggcaucguagaaacgcagggguauugccagcuucacagcugcugagcuuucgucgucgcccuccggcagcagcuggucuccccacgacuccccguaaggaaagagcucgucgggacgcagagccccgacucgcgacagcagcaacagcaucaccagcagcgauagcggugauggcgguguuagccacccggcugucgggucccgaaacaugcucacuccucccuggcucugcccuccacuccgcaagucucugcgggccacacugcccgccagacuccaacuuggaccucug

SEQ ID NO: 7279 - RNA, 1857 nt, Mus musculus
ugcugaugaagugagaauccuaacaacuaaacucaucuuucuggggcugcaaccuuuaugucaaacaagcacuaauacacuugggagccaccacagccucaagaccccugagccucagcgcacaugccucucgcucuaauucuuuuuucuguugcaagaggcuaauucagcugaacucuccuugggagcagcagaacacuaauuucaaagugacaguggcaucagaagggucccugacaaaaacuucacuccgguucaugccuccuuugaauacagcuccaagaacugucauagcacuaaagucacaacgaacauuaaaagguaaccucguuuacugaaaggcacaacuguuauuauuguaacugcuucuaugauccaugcauagaaaacgggucuuguaugaaaagcguaaggaaggggaaaacugggccuuuuaagggaucuuugccuuacuuaaggcagauuuggaaauuauuuucucuuucaugauauaaacaguaaauauugcacuuacccugugggacuaugucgagaagacaguauaaaauguuccugauauaagaagagggggcagagagauggcucucuggauguucuuccagaggaucuauguucaauucccagcacucacgugauagauagcucacaccuguagguaauccuguccagggggagcugaugcccucuucugaacuccauggccucaugaaguuccgaacucaacugucuaaauaguuugcccuucgacccuuacuaacuaaugucaccagaaugacagugcgcaggcuggggagcggcucagcuaguggagugccugcucagcaugcagguaauucuggguucaauccccaucaacuggguagguaugacgcugcgcacccauuaccucagcacgcaggugagagguggggcaagagcaccagauucaagaucacccuccauuacaagguuugaagccaaucugggauucaugaggaccaucuuaaaagagaaagagacggugugugugcgugggggagggggagcggggcggggcuggggaggugccaaaagcaaaacaaaaggaacaacaaaaguuagacucccccacuucgaaucuuucacgacugcccacuaucugggaacccaaucuacaguccucagaggggacaaccuuucucuacccuggagccuucccuccuuagaucccaucaccccugcucuucugaaagacagugccugccaugccccaaggcacaggcugauacagucugccuucuauccugcaaguaacuuagcuugcucucagaaaccuacccaaauggagggguuuggaagaagcucuagguagagggccuaccauauugccauaacaaaacguaaaugaggccuuucagaacgggagcagucaacucgguguuuauuucggugccuaccaacauuguauaaaaauggcuucugaauuaauaaauaucaacuguguuuaaauagagauaugugcauuauaugguucugugacauauaugccuuuugcuuuguguuuuaagauaacaagagaagcugggaaggcagcagucuaugaagugcuugcugcgcaugcgugaaguccugagcgugauccagagcacccacaugaaagugggggcgugacagcacacguauaaucucagcuuccgggagaaaaaugagcagaucacuagccagcaagccuagccuaacugagggguccuaggucccagagacaagauggcucccaagcaaagacauuuaaagaugaccucugguccccacaugcaugugugcacacucucacucauaaaaugaaaacuuaaaaaaaaaaaaaaaagacuauaagaaaauagaaauauaagaacuggu

SEQ ID NO: 7280 - RNA, 12674 nt, Mus musculus
cacaggaagaaaaugaacacuaaauguauaggaggauuucaaguuuacaagaaucuuguccuaagaauauuugcuacgaaggcaaagacaguggaaaaggaauuggccauuaugagcucuuggcacacaagugagcauuuucagugcagugagacucaaguauauuuugugaaauguauaccucaaucuuuacuacuguauuuuuaaaaacaaagguuaucacaaguuuaaaauagaauuuuaaucauugcuuauuaaaucaacuuuuguaaacaguuauuuaaaaggccaaauucauucaacauagaaccaaugagagcaaagacacuaaaucugauuuuuguuugccauggauucuaccuggccaagaaaaguaaagcaaacagauggcuaugagaacugauuccugaagcccacugaggcccgccacagacggaccaugggguuggcccagcgaaguccucagacuuuauuuauacuaaggugcuacaaagaguccccaagugccucuacagaaguaucccucaaaaguacuccggguaaaacaccaaagaugcagcaguucuucaauuuucuauauaauuccaauaaaauauuuuaaagcuuucuuguggucuaaauaucuauauugucuccaggacaaaguuaaggguuggagugaauguaaccauaaagggugcacaauaauuguagaaacagaauacauggacucaaaacagagcaaaacaaacaagccuuuuacuucuccaacuuuauuaaagaaaaagcagcggugguaaaucucuagaacauagucaaucuccugggguucucccuucaaagugugacaucugauuuccaagcacaugcugguguaaugguucccaucacuaggcaggugagaagcugacauccucaugugcucaucucccaacuuuucccagucuguggucugucuuuggaucagcaaugauggccuggacggcuacuauggcuucauuaauuuuugucuguagcucucugagcucuucuaugugcagcaaccgcaggaucugagcagcuucauuaagaacugcaucuaucacaagacaggaacauugcaucuauauguaugauuucuggccuuccagccacccacuuacaccucaguaagucccucaaaauagcuugacuucaugaaaauacuuaccgccugugucaaagccaagaauauguuucucuaaagcaacagguaagcccuuuaaaacaaaacaggaucauuuaguuaagggucacuuugcucauuugaaacuuggcuguuugguuaggacuaguaugauuuaccuugugaugagcuagcucuccagccacccaggaaagagcucucuucaaauguaccagagacaucaaagcccauccagccuuuuacaccaggcccaugcaaaagcacuuaauguggcuaaggaagaagggcuggcagcuaagcaagugcugugcaaaucagauuacaaaugaagcuacaaaguaugcaaacguaucuaagacauagaaguuuuucagccagcuuguuuaccagaguauuuacauguuauuuuauuauagaaguuacuuuuagucaaggaugaaaauaccaaacuacacucuucagaagucugggcuaucugcugaaauuagcaguaauuagcuacugcuaaguucuugccuaaccuaauaugcuccaccuuggcucucucacugagcuaauaacuuagaugaccugaaguucagagaacaaagucaccagcagacugguaguugagugguuuuauaugucaccuggcaccacagacugggguucuuuuugucugccaacagaccaccaaggaacagcuaucccugaaauccaccauaucccucaaacagucaggaauggcuacaaagaauaguaauaugaaguuauaaacugcagcaaugaaaagcuagauucuacuuugcaaacagaagcagagagcucuggcucagcacuggucagcauggccuccaaaccaaagacaucauuuugguaaaugaaugacuauuauagcagaacaauuugcugcuuguucuguagugugggugaaauaagcugaucuuugauccaauuuccaguggccaauucauacauaauuaagcuagugagaacccuuaguagaaagcagagcguguuucagagggccuauacugcaucagcggcucuucaucacuacuggacuuacuaaaggggucagaggacaaagggcacuggaggacuugggggagagggaagaaaaugaggggccauaauccucagugagaagagaccauuauugauaacugcagcugucccuccuuacccaacaacauucccagcauuguggcuuuggggaaauucaauuuuuccuuccuucuuuuucccuuucccuucccccucuuucuuccuuccuucuuuccucucucucccuccccccccccccucucucucgaccuccugccuccuagcacuaggauuaaauacugguaucuccacaucuggcauuuucaggauuaucuauauugauggcaugguuaaaaauauuccaguagggcuggugagauggcucaguggguaagagcacccgacugcucuuccaaagguccagaguucaaaucccagcaaccacaugguggcucacaaccauccguaacgagaucugacucccucuucuggagugucugaagacaacuacaguguacuuacauauaauaaauaaauaaaucuuuaaaaaaaaaaaaagaaagaaaaaauauuccaguaguauucgucacggggagguagccaugacauacugagcaaaaggagauaaauuacaaagaaucccaagugugaguaugagaucuagaucuaacaugaaaggaauaagugugcccugccuuucucuaccauguagccaacgauccaacacauuucacaaggcuaaaucccuuggcacuugccucaaguuuacagacagaauggacuaguagauucucuagagugugaaauguggucacacaugaaauucacuguucauccaguugucugaacuucaguuacugaauauauugaguuuacuuaagaaucaaguucaauucacaucuaaccuuucuccuccuguuccaacaaaaugggcaucuuuuguguguguguugggggguguguggggaggggagcaguucucuguguaguccuggcuguccuggaacucuauauguguaccaacuggcuuuauacugaagaggucugccugccugacuccagaguacugggauuaaaagugugugccaucauacccagcccagaauguguaaauaacaaguuuaaaugcaugcaauaccagagggaguuuccauuaacuggcuuagaaucuuagaaacacacguaccucuuuuguuugauuugcuuuagcaacugcauccuguguuagacguuccugaaccaaaauucgaauugccuaggaaacccaauaaagaccaaacuuacuauuuugccaaauuacuaauacacaauuguccaucccugccccugagauuagacccaagcucuaaugcacacaaagagagcacucuaccccugagccuuaacaugcucacuucugugccuggcaaaccuaagauauccuccauauagaaccauaauuacuugagugccaaacaggauaauuaucuauuagaccuaggacuguacaaagcuuucugauauagcuacuguaaguuuaaguacuccucaguuucaaaguuugguaaaaguuaucccaaauauacugcauucucuguuuuccuuaguuuaugauugaaauuuaugugggccugucccuaggaaauauuuccauacuagauugagcaaaaaauaaaacuuugaaacagcuggauuuuacuaacaacaacuugaugucuuuggcauccaaccugggugagaaagauccaucuggauucaacaugaauauucuauuaagcuaagaacacuacuuuuguuguuaaaacuguucacauaacccauacaauucuaauaagaaggauaaauuauaaccccuucuggguagagggaaguuuauucaauuuauuaugaagcaguuuauaguaagcuucacucgagaucugcaacagccauaucuaagucuccgaauccuccugccccaccccacugcacauccacagcagaaaguugaugaaauguuuuccuuucucaaaauuaaaaguucuuccagagagcuguguuccuugauauagagguauauuccaagaaaggaaagaugcugaagaugagagcauauguuugcuaaaguagcuaaauucaccauuagggaucuggcauucccccuuaacacagacugaacucgcagacugagcagucaggcgucucuaucacugugucuugcauguucauuaacuucuagaucuguuuccugauaaaacaucuucuuugggugugagguguacacacguucaugcaaaccugugcauacaggugugugcgcaagugguguggagauuaaagguuggcacugcuguuuacccaguuguucucuaccuuuucucaaauuagccuucucugcucaauuagguauuugucaaaaacaaaaggagggcagugaugaauaugaugugccucacauggucuuggcuaggcuggcuggccagcuugcccggagauccagauaucugcccucccagcacugggguuggaguugucacuguguuugguuugauacgggguuuugaguuccaaacccagguccuuaggcuuaacccuuuagcagcagagccagcucccuaggccccagguuuguuaguauuucucagcaugauuguuaauaggauugagugacauuuuaggugugcaguuaaugcucagauaucagcuuacugcuggauaaugugaaacauaaaauaauaauguaugugcucuaggucccacauucuucugaauuucuauucaccagcccauuauaaguguaaauaaaaacagcauauaggaaagugaagguguuucuccaugugcagucucugacaagaauaaaaugggcagcuuaccuuaagcauuaccaaguagucaucaugacgcugaaucugaaggagguuagccagagccaugacacccgccuuaaaaucaggauuauuuacuauaaaagauuaaaagugaauaagcaaaacccaacucuacaaacaucauaacugcuugucugaacacaggagcuuacagaaggagcaacuuucuaggaccaacauaaagcaaguucaagucuaggggaagccuccuuacuaauugcaccagccacauggagaacuucauaaaugacuaaccuaacucccggugagcuugcccugcagcggucugcgaggcccaacuauggacaccuuuuaguguuucuccccaaagcuauuaauuuuaauacagaugcacucgaugggugcauuccccagaugugccuuccugucacagaggcuuuggaguaugcaagcucauucccucuugaaaauagcuuacugcaggucccaaugcaacagucggggaaagcuuauuuaacacacuauacucuaggugauuuccauaaucuucaggcuuuaaauggaaauugcuaaaagggcaugugggacuuguaauaaugaaacauuuuaccauuugucacuagauuaaaaaaauaaauuauauugccaggaagguaaccaaugagugucacaaugagcaagaaaucaaaauccaaauuacuugaagcaaaaaaauaaacaccauugcuuuuaacauucaaauuucuguguugaggggaugggggagagagggaaagcucacugcaacugagucucaaacaggagagaggcugcuaugcacuccuguugggcuugcacuugggcauacaaguggaaagcagcuacaaaaccagggcugccaccuguacgcaccacacucaccauccaaguugaucaguggcucugcauuuuuagcugcguugucaguauuuuuccuguuaucagguacuaaguccuuguacuuuucagcuauaaaaaacaagcaacaagguaaaauaacuacaacuuaagauuaagauaaauauugcuuauuuacugaaugucauuuagccagauuaugauauccacucaaaaauuauuauacuucacuacaauuaaaauuucaaaaaaaauaauguaacuuuuugauuaaguuuaaguccuuacugguacacuggacacaagggucuucucaguaauguuucugagauaagcuuuaaugcaccaaaggcuggcccugaccuuugacccuccuccuccucuacuucccaaaagauuaggaaauauagucuuuuagaccucuuaaguuugggacugaagaagugaagaacagguaaaggggggaggggcagauggagggacgacagggcacaacuaugagguaccuagaaauuaaacagaagcagggcacggucccaguuacagaagccaagcaggacaaccacaagucacacaccugccugagcuacaaauuaaguccagggacaaugggcagcuugucaaaagccugucucaaauucuaaaaauauaaauaaauaaauaaauaaauaaauaaaagaaagauaaguuuaaaaaaaaguauuggguagacacuaaaaccaaauccucccaaaucuuuucaauagguaaaauacugcuuucaacacaaaaaucaaaauaucuuaaaacguaucguacacggauuuaagaugucauggagauuaaaacucugaagguauguuguuuucacuugaaaaauauuuuaaaaguaaugaauaaacuuacugccaaaaacggcuccucagaucuugauauaagaaaacucuuuguacuguuauaauuuuucuaucaaccuaaauuuuuaaaaaguaguaaacuuugaaucagaucuuaauaacauuaauuggcauaugaauaaaguuuucuuaaguaauggaagagcaagcaaaaauucucaaugauuucaacacauguaagauguuuaauagcaagaacaccagcgccuccugcagguuaaggccagcacugcuaccuuaaucagcuuagugccugucccugcaaugcugaaacugaagauuaaacaaagcaugcuggcuaguugagauuuguaauauaccuguuauaccauucaucuuucaacuuuccuuuucccaauauagaaauaccccacuuacuacacaaguuuuuauugaaacuuugagaaacaaaugcaugugcuaagaaugcacugugcugggauacaggaaacaacccugaagccaaguauaaaauggagccaaugugaugagaaaagacauggaggauggcuaggaauccaucagggagcagcugaagaucagccuaggguccaggaucccaggauacucuguugcaaauaaccucccacacaguugcuaccaagccagagcaggaaacacaaagaacccgcuaaaggccccaaacaugagcaaggcugaggucacaaggccuacauucccauauauuccaucauggaaagaaaccacagggcugcuugcuuuguucuuucaaauaaaacugagaguguuuuuaugaaaaugggaaagugacaaugcuuuagauuagaaaaugcaacuagagcuggucuuuagaaagaccagcuugaaaaaaauauuuuaaaaguaaugaauaaacuuacugccaaaaauggcuccccagaucuugauauaagaacacucuuauacuguuacaauuuuucuaucaaccuaaacuuuuaaaaaguaguaaaauuugaaucagauucuaaaauauaguucagaaaguuagccagaggacaugcagcugagaacaggggguggcaccgcccuauacuagaagaaggugacaagagcugaagccuacagggcggcagcagcagaaacacaggugacacagcagacucagacaaagacuaaugguaacgggauggguggggcagagaagcuauacauaucagacagguuucaagagcacacaucuaggaccugaaagugacaggcaccgugaaggaaagucacaaacccaaggauggaagugaagcggggugcucagccugaagcugaggugucugaugaaaggaagcagugcaaugaggcaccucuuccacuggcaccaacuucaaacgcuucagauaacagaagacuguccauagcugaggaagauuaaacacuacacauacauauuggccuacacugucuuaaugugcacuggcacuagacacaccaguauguuucuaucuccugugaaauagcugcugcaaccaauacuccaaaccccaagggcucugauguuggcagcagugucaauggcuuaguugcaguggaagcuggcaaauuaaccaaguaacguuccuuuguuaaggaauucuauuaaccuuuuucagaaaacaacuuccaaauucuaaaaaauaaugaaagcaucagaaacaaagcagguccacuuuuuguaauaaaauaaaccaagagcaaaauacaagauaagaaaccucuucccaccgccuucuuucucaucuaaaaacuauccacaacagugaacuaaagaugagcuggagugagugcugucucagcgguuaaagcccuggcaaaggaccuagauuagauucccaguacccacaugguaguucacauuuguaacucuagcucccgcagaucugauauccuuuccuggcuucugaauacaguaggaaugcauauaauacauauacaauuaaaaauaaaaaucuuuuaagaagccccauaagccaacacccacccuauauccugcacaaaacauaccguuaucuccauauucaagucuaacagcuaaaccaagaagccagucaaucgcuucuugccgauccugaaucuugaaaggacaguuaacaucuuugagauacugugaagggaaagagggggaaaaaaaaucuauuucauuaucauagagccacagaacacagaacagcagaccgacagaggccucaguuuggagcuuuaagaauuucuuccaggccugccuugaaucccagauauccaggacuggccuggaacuccugauucucuccccuccaccuuccuggugccaggaucucagugugcgccaccacaucgaucauuauuaaaccuuugaugucauuauacaggucagaaaaaaaaaugcuuagaagaaaacaauaaaauaauccuuuuuaaaauauuuguaacuggagaucccagguaggacaagauacaagaauaaucucauuuagacaacgaaacuacaaccuacaaaaaucugauacuuaacacuggccauaccacuuagaucugggaccagaaccuuagcuuugacuccaggucccaaugcacagggcaauuagauaaaaagugcaacuuuuaaaagaaggacaauucaauuaauuacuggaauuuuaucauucauaugcaaaugucauauacaaaugcauaacagagcaagccauggaacuugugugucagcuacagccaaguccuuuaggcaaauaagcugauccuucagucucucgggagcugaaaguugacccuaacaaaaaaccuuucagugaaaacuucagggauaauuuauaaauuaauauguuuuaguaaaaauucauuuucuaaccaaaaauuuuauuccuuuaaugaaacaaacaagucucauucauuagauuuggccacgaucaaaagccacuuugugaguacugaaugcaaguuaauaacuuaaaaucuauauuaauuaccaaauagauguuuccuaagauaccuuaaacaacauuucuaauaguauuugggugacuuaugauuuuuuaaaaauauuuauuuauuuuauguaaguacacuguagcugucuucagacacuccagaagagggcaucagauuucguuauggauggcugugagccaccaugugguugcugggauuugaacucaggaccuuuggaagagcagucggcacucuuaaccgcugagccaacucaccagcccgauuuaugauuauuuuacuaucugucaggaucuuuuaaacaagcaagugucucuaaucucugcauacuuuuucauuuacaagugaaccaacagaaaacacuagcacuauauuuuaagaucuuuaaaagcccacugaaaacugaaaaaaaaguuuaaggguaaauaaagauaaaccacuacaaguaguugcaguggcaagaagcauuaggccuugguauggguaaacauuuaugggagaggccuaucagguauguggcuugugaacaagaacagagacagcugcaguggugguggcacaugccuuuaaucccagcacuccggaggcagaggcaggcagauuucugaguucaaggccagccuggucuacagagugagcgccaggacagccaggacuacacagaaaaacccugucucaaaaaaccaaaacacaaacacacacacacauacaaacagaacagagacagcugccacugucauucccauuuguugaugacacuguaaugacauaaugugguuuuuuuuuauagaguuuggaaacaauuacuccugaaagaauauuacuaaaauuaaaauaaaucaaugugaaacaauucuagucacaagaucauccacagagcgcuuuuagggggcaucuguaccucaccuacaagaauaaacaugacaguuucaaguuucaggcauggaaaugaugcucuuaaugaguaugugcuaguuugaaugagaauggcccccauggcucauagauuugaauguuugguucacaguggguggaacuguuugggaaggauuaggagguguggccuugcugguggaggugugucacugacggugagcuucgagguuucaaaagccaugcccaccccacaucuuuucccuucccacaauucccagugagcucucugaguccuccuugaagauaaggaugcgaguucucagcuauggcuccggugcucugccugccuggugccacacuccacacaugauggucauugauucacccucugaaacuguagggaaaucucaggguaaaugcucucuguuagaagcugcuuuagccaugguaucucuucacagaauagaaauguaacuaagacaaggacucaaaaguauauugcugcauuuucguaucuaauguaacuaaagcuccaagagacgugcugugcucuucuggccucugcggauacccgacauacauauaaacacauacacacacauacauacauacauacaaauuauguagacaauccuauuaaggaaugccgugacauuuagaaaaugauguuuaauccaaauacugacagcucgguuggagauaauauaauuugcuuuaaaaaucaaaacaacagaguuugaauccauggaguuagcuuuacucacacugaucacuauuauaucuuaaaagaacauaggaauuuucaacucaacauacaacguuuacaaaaguucucugugcuuccuucuacuuccugauucauuaccuuuucaaagaacuugggccagucacugcuguggauguuucucaaguuaccucugucuucaaucuuguagugucugauuuucuggucuucaagccaaacgauaaaguuucuaaauucuguuucaucugcaacgaaacaucauauaucaagucacuaaaagccuuugugauccuugguggcuuucuaaccugcaaacacuacauuaacugaccccgagggaagucagcaagagcucaaaguucagacugcagagccauagauaccuggcucacugcaauagacucaaauucuggaugagccucagaaaaccggauacacuuucuaagcuucagauucuucagauacaagaugaggaaaacgggacuuacuucguggggauguuuugaguauugaaugaauuaaacaugcagggcacaguguuuccuauguuuuauuagaacucugguuccuuuagaguuuaaggggcauugggcagguaaaaacuuugaagcaagccaauagaauaaaauaaacuagaaauaaacgauuaaagcacccugaauacaaauauuaaaaacugaaagcuaggggacaguguacaguuaccgggacgcaccugcuuccuuagauccaaccccuccaaacaccaaaacccaaaacccucaggaaagauccucauuuuacucgucagaaaacugaggucucaacccccaauuucggcucuaccgccacccagcaaucuugagccaaguaaaagccaaguaaaaaccaggacugacccugauaugcuucuggagaccaaacgcugccaccccgcuucuaccggugcguccugcacagcggaaugaggcccugguccccgccucacucucaguuucccacuggcccgcaggacuggaauaucuuuuuuucugaacgguuccacuucccuggcagccggccacgaacuuucugcgcgccccgaagggcauccccgguccccuccccuaccccgcaggugcccgccgagccgcccgggggccgggaagccugccgagcgccucagggcagcggcugccgggucuggguccggguccgggcgggcuggggaggcgccgucgccgaaccccgcggccgccacccaccuuugcaguugaagccugagggguugugguaauccagggccgugagcuugcgucggaacaugguccccgcugcucgcgcuggccgcccgggccuccgccgggacaggagaagcgaggugaggcgggcagcgcaggcaccggcgacgcggcgaaggggcggggcggugaccgacgcuccgacggacg

SEQ ID NO: 7281 - RNA, 62901 nt, Mus musculus
cauagcccuucagccccagcagcgccaauuacugugugcuggagaugggacuuggggauuaccuuucagggacagagcugaaggggacacugacagauuauggacacacaccgaggaaggcugagcucuugucuuccuaugcugagcuuaaucuggagcguucugaagcaggaggcuggaccgaagcuggauagaagguagagcagagcccuggccaggcucccccacuuccugagaggucuuggacagagaaagggggugcuucaggagugagggauggguuguggagguggaagcagugagcuggccccaggcucagaagucgcugggcacucuggcaggcacagcccucccuccauugaagccacugaauuagcccuagccuggggcagugcuccagaugggcgagaucaauagacucaauggaaguccauggugcugguccucccagcagccucuagguucugcugccuccagaagccagccuuccagcccuggccugagauagcucccuacucucccucaguaucauugcacucucugccgccacuguuaacuggucaccugcugugcgcuagguuagguguaggcacuucuggugcagcuaggugugggacugacaaauggcccugcauccagggagcaaaaauggugucuguccuaguguaggugggugauggguauugauaccccccaagauuucuuuucuaauuuuaaauuauguguauguggguaugcacauaugugugcagguacuugagaaggccagaagagaguaucacgucucuuggagcuggaguuacaggugacuuugagcugccugaugugugugcugggaacgccacaagagcaguauaugcccuuaacugcugagccuucucuagcuccugggacuucaaaacaaaaacgaaacaaaacaagaaauauuauuuuauuaauucuuugggaaucccaugcaugcauuuaacaauuuugauuauauuuccccccucuuccuaccccuaauucuucccagaucuauuccacacccccaccuccucucccaacuucauagccucauuuuuuaaaaacaacccauuaaguccaauuuguacaaauggggggaggggagcauuggagcaagacagaccuaccggggccacaccuuuaaagaaaacggacucugccuccuuuuuagugaccacuugucaacagcuccuuaguuugggcugggggcuggugagcccauccccacccgugcuggaagguuggcuggauugaucuugugcugugguugaguucaugagugugcuggcccuguaguguucauccaaaagaugucgcuugccccguucucccugaccuccagcucguacagucuuucugcccccucuuccgugauguucccugagccuugggggagggguuaugcuauagcugucuccuuuguggcugagcacuacagagcacuuuuucucugcacuguggggcugugauuuuuugcauuaaccagcaugcacuguguuaaaaagccuuaagcucucuuuuaucuaugccuuuuaauccuaacguguuauuaacuucaucuuacaaaugaagaagcagaagagagcaauuuuccccaaguucaaacagcuaugagguggcagaaaacaccugcucagacuuguguuccugucccucacacugcccucuggcaguuaugaaucugauagggaagacaccccaaagucuguuggagguggcggaggcucugaccuucaaagagucuguaaucugagggggagggagaccagauauggagaaaccaacacguauacucuaucccagcugccucucuaccaccaccuccuccuccuccuccuccuccuccuccuccuucuucuucuucuucuuuuuuuuuuuuuuuuuuuuuuuuuuuugguuuuucaagacaggguuucucuguauagcccuggcuguccuggaacucacuuuguagaccaggcuggccuugaacucagaaauccaccugccucugccucccaagugcugggauuaaaggcgugugccaccucucuaccuucuugugagaccccagaagaaucaccauuguucaggaggacuaaacaaacaaacaaacaaacauaagccugcuugggugucaccucauccuagaaugggcuuggcaggggcaggguugcuugggaaguuucugaagccaaggcuaccaugugggaagacagugggcaaguuaggcagauugcucugggagaggucuccagcaaagacaaccucucuuuggggcgcggggugggggugggggcaccugaaguuuggucucagcucugcccaucugcucuccauguuugaauaacaaguuccugcuucaaacagacaaacaaacaaacaaacaaacuaacuaacccacuuauuuggugaggggguggggaccacucuguccuugccaaagucagaagacaaccuaggggacacagacauccuuugucauguguguuuuggggaucaaacacagggaaucaggauugagagcaagugccuuuaccugcugagcugucuugcuggccccaggugcuagucuaugagucuccacaguguuccugcuaucuaggauccacuccaucacgugccuuuacuuucccaggggccaccugcuaucaccuuuccauagccaccagccagcccucuccgagucuaggcuggguaccuuucccuguguggcaccgucccccucaggaaaccaccucuguucaaacugcugugaccuguucaaguucccugucucccacucuuaugcccucuucccggcagagaagcacucgcuggugguacugaagacuggguuagucauguguguauucccaccagggcuuaaauacauguggauggucucugcuuucugauauuugaaaacugcagggugaaugccccccccccccacgccccggaucccauacuucucauuggcaguucugucccucuguuccugaagcagaggccagaccaggaucaaaucuuguuccacgagggcgaguuccaacaaagccagguggaugaacuugagggaccuuguggcagacugagguggccugaugagucaccucaucuuaugccaagucaucugagucuagagggcagggccaggacacagcauaccugauuucucccaccugagagcauuguuacugcaaaccucuuuuauacaucuccgcaucuuuaccucucuguguuuccagaugauucgaaacagaguucccauggcccccaaauucuuccuuuccggccaucuuuucaggcuggaguaucucuuccgucguuagccccacacaacuguacuggucucuugguuuacaaagcccuuucacacccuuugcuauguggagauugcucaacaaauugaagcaaacagguguaguguuuuauagcccaacugaagggcuuuuuacaaguuaggaaaucugguacuuugguuuggggccuagaagagcaaggccucgggcaaggucagaaguagcagacauggagguggggggugaugauggagaaaagagaaggggcagcagagauuuacuucuaaaacauuauuuuaaguuucuagugcucucucucucucuccccccucccucucuuucccucucucuccuucuuccucccucucucuccccucucucuguauaugugugugugagagagggggcagagugagcgaucgagggagcgagcaaauguguauguguguaccacauguguguggauggcugaagccagaagacauugucagagccccuggagcuggaguugcaggcgauugugaacuacccaacguggugcuagaaacagaauucaggacucccccccccccccccccccgccugccccaagagcucuuaacugucaagccaucuucccagccuggaguuguacuuuugauccagucaugcugggugaagccagagcuccauccugcuagggcacuugugugaagccauagucagacauugcccacaggcagguuucucugaaggacagugccuacuuccagugcuugagaagggccccagggaaacugucccuuaccuuccucacacacgauggguggaacacccuguaccggccagaugccucagauaagcaucgcccccccugcugacuuguuagcaaugagaacuggcuacguccaucaacaaaagaagcccccuuaaauguggcuaauuuuuauguguuugcuuguuucgcaguucuggggagaggaggucuaaaacugaacagcccaccuagcuauuuuggucuauaaacagagaggugauuucuguuccuuuggacauauaauaggaagaccugaugcuucuguccucugggggaagaucgcaaucuaagaaauccaaguaccuugagacccaagcaauaaagaagcccaacuccaaucaugugaccacauggacaaauuagacaacaucuuaaacaccccagcccuaggcaacauuucaaaguacauagccagccauccuauaaauugcagacuuaugaggaaauaaaugacagcuguuguagugaguguguguugcuacaacaacaaucuguuuguuuugcuacacaaaaugccugagauggaguacuuuauaaagaaaagaggcuugcucaccucagugauggggaucucagggcauaguaauggaaugggcuucuucuggugagggcuucaagguggauagcaucacaugagaaggagguggagagagagagagggagagggggagagggagagagggagagagagagagggagagagagagagagagagagagagagagagagagagagcacaccaagggaaaaugagagcaagccaagaaagcugaacuuaauuuuuuuuuuuuuuugaaauaagguuggucuugaaccaccauugagccaagggucacccugaccuaccuauucuccugccucuaccuuuugcccauaugcuugcuaccuugcaguuuaaaggaugccugcauugaacccagggcuuuaugcauuuuagccaaggacucaaccaauugagcuauauccucagacccugaauuugauuuuuuuuuaaaagauuuauuuauuuauuauauguaaguacacuguagcugucuucagacacuccagaagagggugucagaucucauuacggauguuugugagccaccaugugauugcugggauuugaacucaggaccuuuggaagagcagucagugcucuuacccacugagccaucucuccagccccugaauuugauuuuuuguuuuguuuuguuuuguuuuuuugagacaggguuucucuguauagcccuggcugaccuggaacuaacucuguagaccaggauggccuggaacucagaaauccaccugccucugccucccaagugcugggacugaauuugauuuuuuaacagucugccauugggauaaccacuacacacucacaaaacaggcuugaauuccuucccaggauggugcucucaaaggcccaauaaccuuuacuagacucuacuguuauaggauauuugaaucuguuuauaguuagggugugguucagccuuuaguaugcaucuuuaaucccaaacaaugaagguaaaauuaguuuguaaaaggaaacacccauauuugaaagugaugucuaaucgaguggcagacaaagugaugaaucagagaaagauuugacagacuaggauaugcccaacucucaagagaagagagaggaaagggaaacuacuucaggagagacaggcagcacacuaagaagagaauauaguacaagaacacaguaguauauguggagacauuucaguagaguucagaaggagagcagagcagcacagagagggagaaagaggcaguuuuaccaggagaauuuuacagagacagguugaagagagaacaagguagacauagguagagacagaaugagcaaaagaaugggaaggaaccagaaaguuagaaagauugcuagaguuaguuugaggucaagcagaacaauucagaggucaagagaaaagccagacuggauaagucgggggggggggggggaggaguuugaguaaggucaacugaguugaaccagccagucagaggagaaaaaaaaaaaaagaaggguuagcuuauucagcaguaagucucagagacugaaaacauucuaggccuagauuagauuauacagagacuagaagcuuccaagacuaggccuagguuagcagacugaggcaguaagccuccaaagcaacaauuacaacaggugaauaaaauauaccuuuacacucccucuuaacgauucuaucaccuucaacauaauuacacuagggaccaagccaccagcucaggagucuuugguagauaaccuguaugauggucugagacauuugcugugcuuaucccaagcaaauggcugucugcugggcuauggagaagguucugagguacagagacagcccagcaccuaccacaacuacacuaaaaugugaagcagugaggcauggggcuggagagauuguucaguguuucagagcacuugcuuuuacagagaacccaggcuuuguucccagcauccacaugguggcucagaauuaccuguaauucuaguuccaggggaucugauuuccucuccuggccuucaagggcuccuucaaacacaugcuacauauaaacucauguagcacacauaaauacacacacauucuaaaacuuguaaagugaaccaccuuuuggguauacuugagccaaaaagcaccggcuaccccaacucgaaaacucuguccuuagaugcaacaaagcugagaccagauauuauucuuguccaaugucuuuuccucggauguugaagauccaucuguuuccaguucuccagaccucugugcucucuguuaaauguguuaggaggucuggagucugugauuaucuaggcaggugauguuaauagccauuucugcuuauguaaagaugccucacugucuuacggauugucuuagucaguguucuauugcugugaggagacaccacaaccaggguaacacuuauaaaggaaagcauuuaauuggggcuugcuuacaguuucagagguuuaguccacuaucaucauggcagggagcuugguagcacuuaggcagacauggugcuggaaaaguagcugagaauuuuauauccagaucugcgggcagcaggaagagagagacagugaaugggaccuggcugaggcuuuagaaaccuaaaagcugcccccccccacaccagugacacacuuccucuaacaaggucacaccucccaauccuucuaaguagugccucucccuaugauuaaacauucaaauuauaagccuaugggaggccauucuuauucaacccccaacaugaauguuaccuugcuggcacgagugaagauaucucaaagaaauacuugccaggcaucugacuauugaaacaacaguccucaagaaauuggaacuuuacguuggaagaaggaacagguuggcaccauacaaacagaaggaaacuugucuucuggaaagagauuuacaacugagcugagccuugguuguuagggcugcugaggccuaggcucugucuccaacaauugugguagcaacuccauccagucacuauuguuuaugaacaccaucucacuuaagcacccaccauacuguaugaggcugcuguuauuauccucaacuaagaacugaggcucaaagucacacagcuccagagaggcagagagcccagguucucaucugagaacuccaagcuuguguuauuugacuuuacauggcgggcacaacucaccugcuccaaagcaagggugcacugagacagugaucuucccacaagucacagccacacuccauagaguguguaaagccagugaguuggaaccagcaucccagcccagcuuagcagugaugacaacucaagacucacagggugggggugggggugggggugggggacucgugcagauagcucaguugccguccaagcagggaccuuaguucacuuccccaguacucacauaaaaagccugacucagcaaugugcaucugucaucccaguacugggcaggcagagacaggacuugauucucagcaaguccagacaaauccaugagcuccuaguucaguaagagacccugucucaaaauauaaagugguuucagacuggaaaauuggcucuguggauaaggcacauacugaucauccagaggauacaaguucacuucccagcacccaguuagugguucugcauugccuucuaacuccagcucuagggggaucugacacuauaggaguaaaacacacacacacacacacacacacaccccaaaaucacacuagggguuuucugggcucuggcuuagaaagguccugaugaagaagcaauggaggaaggaucagaaauacccaagcccugggaaccccuggcugaaggacucaggggucacauauuuguguuucuuguauuccugccaagccauccugccuguguuucccccugcauugaaaugcauguuuaccccuucauucucugauuccuucaccugcagcucuggccagcugaccugcucugccagggcuguugacaucacacaccccagagcagaugaccuguguuuguuaaaguugccuaggacaccugauguuggugauugagaaggaaggagaaucucucucucucucucucucucucucucucucucucucucucucucucucucucucucucucuccacucagaucucuauccucaacagucucagcaguucacuuccugagaaaagacucuaauccaggagccuggaguccacuuauaucagcucacggaagucaaaugguuugcuuuucagaaccuuuccaaacugguuaucaaacuagccccuuaaagaaaaaaagaacggaauaaaagaaaacuaaaccacagggcugagaagcagcucaaugguaggacugauuagaguuugaggcccagcugccccauaaaaagaaaacugugugugauugcucauccuugcaacccugggacugggagauggagauuccugaggucccuggccuaauggaugaguuccuguccagcgagagacccugucuccagaaacaagguagccaacacaugaggaaugucagcuaaggcugagcucuuguuuccacaugcaugcacacccaugggcuuccacaccugcaugcacgaguguguggacacugugucacaaacuacuaccaagacuggacacaggaagucaucuuagcauugggaaguugaagcaggauuauaaauguaaggccaucugggauauauguaucaagauccugucucaaaaaauuaaauugaauuauauaaguauguaauuaagcugugcuggcugccaguuuuccaucaagcugagguaaugcuaugucaaugcuauaggcaaaaggcacacacacccugaugagucugugaagauguugugauuggcaucugacagcuuaaaaggauuguuuggauauuuggugcccaugacuguggugugacaggugacacacguugacggcucuaggcugucauggcuccucagucccaccccagaauccucucaucugaaccaggauaguaccaccagccauguuaucaggcguucuaccacacacccaccugccaugccuaugaauccggagucucaugcaaagcucugacccuagcaggugcagcuacuuugacguaucucaaaacuggguccuuagagaauuuucuugugcaaagaucauugaagagacucaaaugaacuuaggaugguauaguucagaggccucggcucuuuacaaggggacuuagggaaaaggucuuuuccccugugugugugcauguaugugugugugugucugucugucugucagucagucaguuagucugucugucugugucugagugcgagguggagguagagagagaaguuggaacgugggggucagggaacaaccuggggaugacucaggucaucaggcuuggcugcuuugaucugcuaggccaccuagggaguaaagauuuucccauagccagccuauggaaucaugcauuuugaaggacccaucgaaaguguuacauuguaguucugguucuccaagaagcagaugccuguggugacgggugagagacugggugugccgcuguuuuauugcacuucagguugaacuccaagaacugcggagacacccuagaguucugugcagacaaagggaagccuaauagccuacggcugcugagauguccuccaggcaaagggggaaagaggggccccuugcccgugcuuugcccccuccugguauguucacugccuugccaauagucaccaauggccugagcagagccuugggguuggguuugagagcuuugaccaguacuuggaaaucucuggggaguguuuuaaugaccacuguuauaggggagcagaaagcauggucauaaaaagucagauaggaagggauggggagauggcucaguaaaguguuugccacacauacaagaggaccuagcauacccaaaagucuugcccuacagggaauaccaaaaaccuaucacgguaaagaaacuuggugcacugaaauucaguuugcacucaacccacgacaguaaguacugaucuucugccauugaaguugcucagacuaagaguagguguuuaccuauugcagaaguugacaaguugaacucaaaggucucacucaacugugugacccugaguuuccaccgcgggucgggaggggguauuuuaagauuguuuucgcuccuucuuggcacucagugccccaggcuugacacuuggcaaggaagcuuguaccucuagggacagcugugaagcagcaccgcaaacaaaggguaccagaaaauuccugcugcccccuccccaccugggcaugcgcacaucccacagagggagaguggcaggacuauggaacaaugggagccuaugagucacgagguaagaccggauggaguuucucuagcaaggcucccucuagccgccggaggagcugacgcaggccccugacaggcggcaacuggaauaaccgcugauucccagucuugcccuguauggucuggacuuuuuauccuuuuagaucaacuuuuauuuuuagcaaagcuauagcuauaaacauuuucagauagucaaauucuacuacacaaugggaaauagcagccgccuuccucaccuuuuccaaacaccagucccagaggcccuuuccuuuauauuuccaagguuuagcuuuuucuuuuuagccccuccuuacuuuucuaggcaacaucuagcuccuguuuaaaaagaauucccacaaucguuuuaaaaacuguauucauuuaguguguaugugugcgucugcgugcaggcaugggcaccuuguacaugcagguaccugcagaggucagaagagggcauccggcucccugggaguggaguuacaggcaguugugaugugggugcuuggagaaaccaggcccucuggaagagcaucaaguguucuuaguuucccagccgccuucucuccagcuuccugcaguugucuuuuuuuauugugcuucaguuaguauagguucgcuuccuaugcugagggcugggcauguggcucagugcuuaccuuaccuggcaugugugauacucuggcuucauuucccaccauaaaaaaaaacuaugcagcuacuuuuggaucagauuuaaggcccacuccacaagauuaaacucauacccaacgccauucucguacugacaaccuguaacuagacaggucauagaacaugguacuauuauucuguugaaugaauauaagccaaucccuaaugaccuaucauuauagcaauagaucagugcaucucucacucaguacuuagcugagaugugucuauuugcaguagauguugacuaacacagugaccuacaacuggccaagaugcagagaauaagaguguagaauguccagcccuaaaugcaacauuguaugcauugccuccuccaaagacucagagaucauugcaaaaggggaggaaagcacaagaggcagaggugguggguuacugcaagaaaacugucuucuagacacaacaaugcagaugcccauaagaaugcacaguggcugugucagcacgcacaaaccugugcaagcccaagaaccccaacauggagaagggaauuuggucaugagccccacccuuagacaaggagcuauuggcuaguugcuagcgaaggaaaggucaguuuucucuaagagugcagccccugguaaaucgacugugcucuaguggccacauauaugagugugcuuggguagcacacagugacauugaugggaacaaaaagacagaaauugggggagagguuaagggguggaucugggaagacguggcugagggagauuaaguaugaacaaaacuuuuugugagaaauucucaaagagcaauuaaaauauuuaaacaaaagaaagcagaguuggggcuguugagacggcgaugaaaaggugcuaguuggcaagccuuaagacucauucaauucaacucgcaggaccuacauaguaguaggagaaagcugacccuuacaagcugcuaacugacacacacacacacacacacacacacccuaaacacuggcacacaaaauaaguuacaauguaauaaaaaauacaaaugaaguaaaauagauacaaaaccacaaagagguagccccauucuaucccuaauauacacacccuuggauucuuuagccgauauaguaagauguuaauuuauggguagaucuuaauucaguguuuauauuauuauuaauauggauauuacaaaaaaccuggaguuacacccucuuccucccuucucccaggacauuuucuucucccugccuuuucuguuugcuaggaucuguauguuccuaccacucauucacuccccguguccugaugcaguugguuguaaagcucuuaaaaugguuaucuaucagucccguucauuuuuuccauauaaacaucucuucuagccucuaugaucuuucugcucucagcuggauauuucucucuggguuuguuuuguaccuaacugcccuagaacaucccuucaccauuaacugggaauucucuuugucucuuucucccauuauagccuguuuucagaacccaaugcuucuugucuuucuuccuuccuaguuugaugggguacucucugaaacaguucucugaacaaugauguagggagguaaaauuaauuuuuaauuacauugugugugugugugugugccuguauguaggcuucaguuggaguuacaggugauuggagccaccugacaugggugcugugaauugaaugaacuugaauccuccggaaagucaauuaaguucucuuaaauauugacccauuucucuaucccuaagauuuauuuuacuuugugugugugugugugugugugugugugugugugugugugugugugugugugucuaggucuguuuauguaugaguucaaagugacauugaugcccagaaaagugugucauagccccuguugcuugugguauaagugcuggacacugaacuugaauccuuugaaagagcaguaagggcccuuaaaccuuugagcuauaucuccaguucuuuauccuaaaucuuuguguuaguuuagcugaguaucuaaaugcccuggaaacuuuuuucucucagauuucugagaccuuuucccuuuguuuuucagcuucuguuguaguugugaaguucagagacacuguuaguccuggguuucaaaugugcugcccccuccaaauuucuuucuuugcugugcuuuaauuagcauauuuuccauucagaagcuuacaccugucacuccuuucugcauuuauuaagccucagcuuuuugagcaggcuacuuaaauaguuccuccaguuucaaauuuuguuucucaauccuccuaauugaaaagaaaaaaaaaacgaccuuauuuucauuuuaucauuuucuucuaauuuauuuaaaggaaucguaaaugcacauaauuuuuucuuaaaaaguggcacacuuaaugaauguccuuuucucuccauuuaggucagcccuauucuguggaaacauaugagccauuuaugcaagcuuccuauuauguuuuuuuucccaguugucaaauuauuuauuugaaugucuaaaauaaaacuuuuuuaacuggacauuuuauuuauuuacauuucaaguguuaucccuuucccaguuuccucuuugcaaucccccuaacccauucccccucacucagcuucuaugagggugcuccccuagccacccacccacuccugccucacugcccuagcauuccucuacacuggggcaucaaggcuucauaggaccaaggaccuucucucccauugaugucagauaaggucucuucagcuccuucgguccuuucccuaacuccuccauuggggucccugugcucauuccuaugguuggcuaugagcauccacaucuguauuggucaggaucuggcagagccucucagcagacagcuguaucuggcuccugucagcaaguacuucuuggcaucauaauagugucuggguuuggugucugcaugugggauggauccccauguagggcagucucuggauggccuuuccuucagucucuguuccacucuuuguuccuguauuuccuuuagacaggagcaauucuggguuaaaauuuuggagaugggugguuggcacuaucccucaaccugggggccauuccuaaucucuggauauggucucgacagguucucccuccccuuugugagguauuucaauuaaugucauccccaugagguccugggaggcucuugcuuuuccccauccgggacuuucugguuguuaccccagucccccaucccccauugcuucacaccucuguucuuuuuccugacccucuguacaucuccuccaucuccucccauaucugauucuuccccucuuuuuccccuuccccuucucuuccucccaaguccuguccacccucuacuucccuugauuucuuuuuuguucucccuucuaaguaggagugaagcauccgcucuuugaucuuccucuugagcuucaugugguccgugaguuguaucgaggguauuccacuuaucagugaguagauaccauguguggucuuuugugacugaguuaccucacucaggaagauauuuucuugauccauccauuugccugcaaauuucaugaagccauuguuuucaauagcugaacaguacuucauuguguaaauguaccacauuuucuauaucuauuccucuguugaggaacauuuggguuguuucuagcuucuggcuauuauaaauauggcugcuaugaacauaguggagcauguguccuuauuacacauuggagcaucuucugggcauauguccuggagugguauagcuggauccucagguaguacuuuguccgauuuccugaggaaccaccaaacugauuuccagaaguguuauaccagcuugcaaucccaccagcaauggaggaguguuccucuuucucuacauccucaccagcaucugcggucaccugaguuuuugauuuuagccauucugacugguguaagguagaaucucagggucguuuuuugauuugcauuucccugacgacuaaggauguugaacauuucuuuaggugcuucucagccauucgaguuuccucaguugagaauuuucuguuuagcucuguucccuauuuuuuauaggguuauuugguucucugaagucuaacuucuugaguucuuugaauauauuggauauuagcccucuaucagacuuaggauugguaaagaucuuuuuccaaucuguuggcugccauuuuguccuauugacaguguccuuugccuuaccgaagcuuugcaguuuuaugaggucgcauuugucgauucuugaucuuagagcauaaaucuguucuguucaggaaauuuccccugugcccauguguuugaagcuuuuccccacuuucucuucuauuagauucauugugucugguuuuauguggaguuccuugauucacuuggacuugagcuuuguauagggagauaagaaugcauugaugugcauucuucuacauuucgaccaccaguugaaccagcacuacuuguugaaaaugcuaucuuuuuuuccacuggaugguuuuaguuccuuuugucaaagucguauuauguuuugauggaaguugaguuugggacuucuugcauucuaggcaaaagugcuaccaaucagccacacccugguccuuaguuaaaaaauucuggggggcuggagagauggcucaucgguuaagagcacugauugcucuuccagauguccugaguucaauuuccagcaaccacaugaugguucacaaccaucuguaaugggauccaaugcccucuucuggugugucugaagacagcaacaguauaaucacauaaaugaaauaaauaaaucuuuaaaaaaaauucuggggagcuggagagauggcucuguaguuaagagcacuuguagcucagccagauuaaauccccagcucccauauggcaguucacaguuucaggggauccaacacccucuugcagauauaugcaccaauaggcaaaacaccaaugcacauuaaaaaaaaauuaguugcuguaugagauaaauggaaacagauuaaauuaaccguaaaggacuggggagaccagucugaccucaaaaucacagaguguuccaaugcauccagguguaaguacacccugaaagucccccugcaccucccccccaaauccuucaguuugcagauccuaacacuaaggacacccuacuacauaacgauacgauuguugccacaccuguaaaaauucauaacuaauaucuuuaacacccuuccucuauucaacauccccuagcggugucugcaggaucuuaccuggccucauuugguugggcagguaccuuggucuuuauuaaaucuauuguaaccuugcuauuguuucuuugcuuuaucuauuaaucacacagaaauaaaguuuaacauuucuucugaaguuuuauuuuauguguauagguguuuugcuugcauauauccacuugugugcccagugccuucagaggccagaagagggcacuggaugcccuagaacuggaguuaauaggugguugugugugccaugugaguguugggaacugaaccuggguucucuucaagagaaauaagugcucuucacugcugagccaucucucuagccccuaauaaaauauugcuuuuagcgaaaaagggagagagaggggguacacuuuuagguuggggaaguagcucaauguagagggauacccuagcuugugcaacgcuuugggcucuauccccagcaccucauuaaaaacagaaaauuaaaaacauguuucucugaggugugcaucacagcuaugaaauucuacacccccuacaauuucaauuuugccuggugggcguggcuuguggucucgaagggucucaggagaaaacagccacuuccucuucaguaacagcuggccucuguagcaggcaggaagcuuggagagauguuguggaggccccacacucauuccuuucuacccagcaaagugccgcaccaggagaguugggagaagcccgggaugggggugggguggggugggaccuggcaugcuaaugucuauuuuaggacugacucuuucaaagcuacuguuguuacuuagcugcuaaaggagugggcauuccagagucuugauuuuguccccaacacuagaauucugagauggccucuguugcccaggcuagccagugcuagcucaucgauucucccaauggcuguacaaucaucgggggcugaguacaugauacuguguccccggaccccagguauggauucccgugagucccucccgugaugauaucugcugccuuggggcuagaguaggcacuacugucaugugguaggaagagggcccagaacagucccuuauaagagagaguccccagccccaagugucaauagcgagcagauugagaaauguugcucuccuguaaccccugguucacccacaucccuaauccucagagauaaccagaguggagaacagaggcuccgaauggaaccacugcgugcagccucggguagcaacccagacagugggcggaccacagccuccgcaaucggcggcuguugguuuuggccuuugcaagaucagacuauccggugggaaagaguucccaagccacuucagcuacugcuguuaacuguucaccugacuggccuugguucagggaaugaguacacagccggcccuccacccaccuuacacuugccucucccacugugagggaacagaggagccgcagaaggagagaacuccaacagugugagugggaacacgcuucaguccuuagccaggaagcuuccggaacucaguauggagcgcaggagagaaagccagugccaggcuugucuuccaucacugcaacccuguauuaccaagaccucuacaggccgaguccacuuccugaggucagcaggacuaggguagacaggagcgccuggcucugaugaaguuggugaaggaagccagagcagcccaaggccaaggaagggacuauggagagacccggcuccaacucuacuuucagaccuugagucaccccauguggcagaaacuaccuuuugcuccccaaguagccaagauuccccccuuuugcuucaguacuggggguggaaggcaaggcguuacacaugcuaagccagcacucuaccauugagcuauguguacccaaccccucaagcuccuuuucuuagauaauaauaauaauaauaauaauaauaauugaauuuuaaguuacauuucccaggcucucuugcagcuagguaugaccacaugaggccauuuuggccaaugggauaggaaugguagugacauguacaccuuauggauuaugucuuuagagagaaaggguacaagugugauggcaagagcuuggacuguaggaaacagaagcuuuguguuaugacaucagcacaaauuagaaggucccuggcuccuccacugaguugucuugcaaccacccaacagcucagacuuucacaugagaguuaaaugaggugcucuccuccuaaaccucuauguaccaguacguaccaguugcuuuuccuguuacuaugacaaaugccugaaaaaagucaccuaaggauagaagagaauuauuuuggcuugugguuugaaggagaaucaucuaucauggcuggaaggcauguggaacugaucacagcauccauggugagagagcagagagaugaaugugaguacccagcucacucucuccuuuuuauuuagucugggagccuaggcaggaggaugguccugcccauguucagggcugucucauuuacaccucucugagaauguucacaguccaccaagaugugaggagaugagaagcccuauucuacacucccgccaucacagagccuucugccaccaugucuuccccuccaugauagacuguauucccacaaaccauaagccaaaauaagacccuuccuccuuucuugucagguauuuguuuacagcaaugagaaaagcaacuaaugcauccacuaaaccaaacuuuccaguggccagcaagggccucggauugucuuuaucuagaacauucuauccacaaccuuucugagcuuggucccuagcuggggcuccagagccuggcccuuaguuuagggaaacgguguuuuguuccuucagccucccaggacacuaucugagacccaggucucaccuguccaacugacauuccacaccacacccuggcaacugaauccagggcaccucuccccaggaccacucuuccuccccaggcuagcucuccaucuggugacaguggcagcuagaacacuuuuggaucagagccauguuuuaaguaagugcuuuuccagguuaauuaacuuuaaaauauaaaaucucagucucucuauuauaaaauauuauauauaucacauauauauuguauaauauauaauauauaaggagagacugagacuuugcauuuaccauauacaguauauuauuuacuauauauaaauguauauuuaauacacauacaaagauuauaucagaaaugucugcucccagacuacagaaaaaugaauguaggcuuuaggcuuuuguacagcagaguccuucugguuguauggugcugugugugugugugaguguguguguguguguaugugugugaucauagguccuugauguggaugucaacguaggcccuugugucuccugagaauucuucagugcucugaguggucaucuagcucuagaaggagaaggaggaggaggaagaggaggaggaggaagagggggagaaggaggaggaagagggggaggaggaggaggaggaggaggaggagggggagaaggagaaaaagaagaagaaggaggaggagaaggaggaggaggaggaggaggaagagggggagaaggaggaggaggaggaggagcaggaggaggaggaggagcaggaggaggagggggaggaggaggaggagggggaggaggaggaggagaaggagcaggaggaggaggaggaggagcaggaggaggaggaggaggaggaggagaaggagaaggagcaggaggagcaggaggagcaggaggagaaggagaaggaggagcaggaggaggaagagggggagaaggagaaggagaaggaggaggaggaggaggaggaggaggaggaggaggaggaggaggagaaggagaaggagaaggagaaggagaaggagaaggagaaggagaaggagaaggagaaggagaaggagaaggagaagguagcagaaaccucaucccucucucuuccuuucucccaggucucccucacugaauaagcaccuggcuggccccucagauguguagaguagccccagggcucacacacuuccucuuguucccucaggcuuaggacuggccagaccugcacaggaagucuggccuaaccguaauccaggcaugggaaaagccaaggcaagaggcucccagccaauggacaggccagagcuaccugcgccacaguuacaguaugacucuuaaucacuuggccccacguccguggcuggugagaacaaugcaagcaggucucccaagcaaagccagacccacaccauugacuucccaggaaggugggguggcucuacuaucaucagcacccaguucucuucuuugacaggcucgccugcaacagaguggagaacuguggcccagaaguccucauggcacaagcuaagcuggccagucagggcaaggcagcucugcaagcacaagauaacugucacuuacuggggacaagugcuccugccacucugaacuucuaugguuacacguguuugguucccuggacugcagggaagaaguuggcacccuggaguugucucuuuccuucacgucucacugcauaggguaaauuccagaacacagccucugauuucuaugguuaccaacaguuggugucccuuuuccugagacaggaagugacuagguucaugcaaguuuaaauguuuaaaaguuuaaaaguuugaaaugggaucggaaccacauuugggguccccucaugcucauagucucucucucucucucucucucucucucucucucucucucucucuauauauauauauauauauauauguauguauauguauauaugcauauauauguauauguguguauauauauaauuuaacuuuauuuuacaugcaugauuuugccugcuuucacauuguaugacagugucagauccccuggagccagaguugugagcugccauguuguugcugggaacugaaccccuguacucuggaagagcagccagugcucuuaaccauugagccaucucuccagccuccaugcucaggcucuugaccuccccugcacagagggccagccaagggcgauuugcaaauuccugaaugacaccuagcucucccugcucccugcuucucagucuagccucccugugggugguuagacauccggcuggucagcucugguucuccuaagucaccgucacgggucccuccagugucugcagccuacacgcaugcucccuucuagccuuguuuuccuuagcagccaggccaagaaucagagccugugaguccgggaggaaaugacugcaaggcggagcuugcacgccaucccucuuucugcagaccagacuauagaccagaaccaguuccugaggguugccagcucccagaggcagagagggugcacuucaguucaaagccccugaguucaauuaaggacuggagccucacccucagcaauaugaguucaaggcuuuaccgacucugauuuacugccaagucaggcucuccagaguucuuggaacugggagucugcgcccuuuggcacuaauuaagacuaagauauuagugcaucaucgacacauagaugcuuuucuuuuagccaggccuggugacauccaccagugaucccagcaccugggaagcccggacaggaggguuugaagguccaagaucaacacccuguuucaaaauggaaaaugaagaaaagggaucuggggaggcagcuuggugugugugaggucugacuuguaaucccuaggaagggaaaggacggaaaaacaaaagagagacuuuuggguguggauguguagauguuuccauuucugucagugcauaugcuugggaggacaagacagacagacagacugagacagaaaggcagagggcaagguuaaggacacagcagggcacccugcagagacccacagaaauaagacaucuaucuucuuugccccaaacugucugcccugcccuuugaacagagguccccaaugacgggucaugucucccacagacuggggcucucuaaggaucugccccuccugggaaugaggccuauuuaagccguagcacucagaguacaucccuuccacgggugugugaugagcccucuuucccauguuuucugcagcaucccugccaaugccuggggaauagucccgauguuuugcccugaaguguaaaguugagcccagggauaaacuugaauucugcgaguccucagggagcagcccauucuuucccaguuaucuuucccuuuagggauguaagggacaaucucaggaacugcucacucugcuugguuuuggagccaggagggcaccaacuaggcuaggccaucuuuaccuucccaguguugggauuacaagccuguaccacugagcuaagcuauuuugugcauagccuuagaaaugaaacauaauagcuuuaccaacugagccaucuccccagccucucugcugcuaugcuuucaacagcuacauguuuuuuuuuucuacucaucucucacugacuucucacacccaaggagggucacguggggagcucaggaaaccccgaaguguguagccaggcaaaucuccgacauuggucucagauuuucacccacgauaggaguaguucaaagauugcccccauucccaagcagcggagcucuuucuucaaagagguuugucuuucccaagacaaugccucucuguguagcccagguuggccuugagcucaagauuccccugcgucauccaccgugugcuaucuucaaaggaaaccuaaaauagcucaaaauaaucaggcaaggugaagaagucuuguagccccaguacguggagaagcugaagcagaucggccauuaaaaguucaagggcagccuggucuacacaguuaguucuaggcuauagagcaaagaccguuuucaaagaaggaaggggagggcaggagcggggagaaaaaguggagcggggagaggaaaagggggagaggaagaaacugcuagcaucugagcguggggaugugcucuaaagaggagagaggacuggugcccaguuuguccucucgaagguucuugauguucccuggagcccagugagcaaccucacagggccuguucucuucugcuuuagauuuuaagcucccaggaugggacagugguggaugggaggcucuccgugcucgcagugcccgggaacagagagagcaugguccaggugaauggagggaggggcgggaaccagagauuuugaguugugcuaaaugugcuaaaugugauauuugagggccaugggcuacuccuccaguaaucaagccuaguucgggaaacuaaggaaagacuacauugcgucagucaugugucaaaggcugaggcgccuaugagacugggaagggaccuuggagguugggagcucuaggaaauuuucccugaagcugagucuccaagaucacuuaaauagaccucaagccaggcagcgguauaucaucacggggcgccacugcccccuuguggucacauccucugcgaagcacagguuccugccccucccuggguugguacuauagcuggggccagaacuggagaacuugggauauuucugucccugacuugguuauccacuugugaucuagagaguaggguuugaacacuguggccucugauaagcuguguguccuggcuauguugcauacacccucucugagcuucuccaucuuguccuaccagcuuuccaggugugcugcccugagaaaucccagagcucccguuguaugcacccuggugggaauacccuuacccaagggaacagacugggguggggcugaaaggcugcauccggggaaagcagagcuaagaaguuugagggagacauucagagaaaggagagugggugagaggauaugguggaguggagagaaccacagcagcccuuggauuccauuagcucauucucccacugacccugugaccccagccuaccucauccuguuuaucaacagggcagagugcauguuaaccgcuaacacccuucuccugaguagguguuccugcuggccuuggcugguccugucagguccuaacagauccuugcuaacccauccugcccuuucuggaucuuucuugguggacucuucuucccuggaaccauugcuggcuucugucuggcuacacagccaaguucaaauguuuuguucagcacacaagggcccuuaagucagguuccucccuaucugugcccccucugcauuuccuuugccuuuguaacacauccuuuagggucacacugggaguacacacucccucacgaggccucgaagcuuccucccaugaugugcagccacccauuccuucugcugagcguguccuccccaucuccauccugaguguucacaucuggcucacuggagugguuccuguuaaucacuggggauuuuuaccauggaugcccuugcuguggguacacagaucacauguccuucaggacaguccacguucaccaguauccagagcaauacauaauugacaaggcuaagaaccaggucacuagaaccugggaaaucagagaagagauaugcgugacuucuuuuaaguccuaggccuaaauucuucauguaugaagucuuuauuugccaacaaccugaagaggugugugugugugugugugugugugugugugugugugugagagagagagagagagaaagagugugugcacaagagagagacagagacacagauauauaguguguguauguacaagagagaggcacacacacagaguguaugugcacaagagagagacagaugcagagauauagugugugugugugugugugauguguuuauucaggcucuguaagggaagcauggaacauucagggauucuaacucuuauggaaagaugguuuucucuccuuggugccuaucuuauucugaugaacaugagaaaagagacuaggauuaucuaagaguucaaaagaccuagggaaaacacuggcauagcucacacaggucuuagggaauuaaaauuaccugugcucauuaccugucucuguagaacagagcaguugagaguuaaaggaaugaaaacucagccucuugauggcuuuuuuuuuuuuuuuuuuuuuuuuuuuuuuugcugaaggaagaaaaggacuggaaagcaaauauccacagccuucuuuaaauucauauccccagaaucuagaccagaagcaggcacuuggaaagcauuugguucuaugcaauuacaacugaguuauugaaaaaguuuaguggaaaauuugguuugacuuuggaacccauuaauuugcaacauugccaccuuguggcauuacuaauaaauuacaggcuaaggcuaacaggaaguguucgcuacagagccauuuuccugucaggcucuucuccuuuacucuaaggcagaaguucucagucugcgccccaggggucaccuaagaccauuggaaaacacgguauuacacugcaauucauaacaguagcaaaauuacaguuacaaaguagcaaacaaaaauacuuuuaugacugggggagggggucaccacagcaugaggaacuguauuaaagggucauagcauuagaaagguugaaaaccacugcuccaaggucuuaggagguagccuaaggugggucacuuccaagcaucuccauagaggugugcuaccccuuuaaaacccaaaucggguaauguuagggguuaucacuuaagcuucuagagcucucuccaaaaauggcuucaauucccaacuuuagggcccagaguguucaacuuggguguccuaccagcuugaaggguuguuugccaaaauauaugaacagcuacaaaugugugucccuucugcggagccauccagucuuugacuagaucccgaaagaugucugacucuaagagauuacaaaaauuccuguucugaaaugacauagaccaaagcucaucaaaaggaugggagggcguguuuagucuaaagaacugcuacauagacauaacagagauuacgcaagacuccccgagaggguaaagccuggaggagucuauuuucuuugcuuucuuguacuuaaaauguauuuuacuuuucugauugacuguguaugagugugcaugugugcauguguguguauaugaguguguuugugucugugaguguguguguaugaguguguguguuugugugaguugucucagagcgcacguauggaggccagaagacaacucuuaggaguugguuaucuuuccauaucgugugggucucuauaguugaacucaugucaugaagguuggcggcaaacaccuuuauuagaaaagucaccucugagcauagguaggccugcuucccuacucuugaugcuuacccgcccccccccccaacacaggaauucagagagaauucaaacuuccucagcagaugagugaccuucuguccuuccaaagguuuauggagaaaaggaaggauuuuacagccacccagagagacugauuaauccaaaguagcuggaggcaaaggaaccaggcuacuaaagauaacaguguuugaugcaaacaaccuccuucuuugucuccagaucaggugcccaggcugggcuugagaaguugauuaauagguuaguuaccuuuugcauuagggaaaagugccaggcuuuaucuccuugauugcacaaaggugccuagcugccacuuugcuggccacacccucuuguuuguguguauauagggaguucucugggaagaggguaacuuuuuccaaauguuuaguucuauuuucuaaaaccuaagaauauugauauccuagccauguauuuaugaaucuaguacauuauuuuuaaagagauuuauuuuuaugugaugagccuuugccuguagggcacuguuuuagcuaguguuuuacugcugugaacagacaccaugaccaaggcaacucuuauaaggacaacauuuaauuggggcuggguuacagguucagagguucagucuguuaucaucagugcagguacguggcagcauccaggcaggcaugguacaggaggaucugagaguucuacaucuuuaucugaaggcugcuagcagaaugcuggcuucuaggcagcuaggauagggucuuaaagcccacauccacagugacacaccuacuccaaaaaggccacaccuacuugaauagggacacacuuucuaauagugccacucccugagccgagcauauucauaccaucacagguaugugugaaugugcguuugcauguguguguguguguguguguguguguguguguguguguguguguguaguacauguagaggucagaagagggcaugagauucccuggaacuggaguuguagaccguuauuguaaugggugcugggaaucuaacccaaguccuuugaaacaccucucgagccccaaguauuuguuccuauauuuguuguuauuacuugaauauguggggucuucuaugagccccaauuuccuuaucugaauaauaagagugucuuaguugagguuucuauugcugugauaaaacaccacgauggcaagcaacuuggagagggaaggguuaauuucagcuuacuuguacuaaucaguccagucuuaaggaaguaacuccaggcaggaaccuggaagcaggagcuaaugagugcugcuuccugccuacucugaauggcuuguucaucuuucuuuuuuuuuuuuuaaugcuuccuagcaccaccagcccaacaguggcaucauccacaguaagcugggcccucccacaucaaauaucaguaaagaaaacacaucacaggcuugcucacaggccaaucuuuugggggcauuuucucaguuuucccaaugacuuuagcuagugccaaguugacauaaaaacuagccugcacagagaguguggcugcaaaggucuacacuacccuuucaucuugaaugcugcaugcugauacuuggcagauuugaaugacauugguccuuuagaagaagaggaucuguccacguuucuuuguugaagauccuucccucuuaccuaagaguagagauauuuacauguuccuuuccagagagcagcagccaucaggcuaucagagagagcagcagccaucaggcuaucacaaaggccaucaguauagucacccccucauucaguuaggcgucacagaagagcuggugugcacacguagacagauuuacccauugccuugauaugaagcauuacccagaucauaaagaacaaagagcuucuuccugucaucccccuacacacauccccggcccaccuugcuaggaugguagguguuuugcuaaucaaagcaguggcagcucaagugggaagcagcagaucauuauaaacauuagagcagauugaccuuggauccaaauggaccuauccacaggcaaggcauugagauaggauagugguggcggcauucuggagcuagaggaggcaaugagucugcuauagagucacucuucugcagacccugccuuguguacaugaguaggccggcugagaaccuguuucuauuggaauccaccucuuccauuuggcggacuucuauuauuuuccaaaccugguucuuugcuaagaaaauugacaaugacccacaauacagaaaucuaagaguaaacugaaagcaaacugugaaguuguaaaaccuugcugugggccccucauuauccauccguccguccguuuguccauucauucauccauccauucauccaucuauccacuuacccaucuauuuaaaaaguuuaauguuuuaagccagcgcugugcugaccucucaguuugauugacaggaaucuuguuauucagacuuuauagggugauuaaggaacaaugcuuauuucugaagcuagagauagcaucagugccuuugugcaaggacuugagauauaaaugaugaaaccugggggcuggagugauagcucaacaguuaagaucauguagucuucuugcaaaguccugaguuugguugccaguacccaugaccagcagcugacagcugucuguaacuccaggggauccaaugcccucuucuagucuccacagguacugaacucuacguucauauucacagaaacauccacugaguuugauugguuugauuugggggacuuacauccacacuuggaaaacgugcauugggaucaggucaguggguuuugaacaucaguggucaccaguaacuugcagggcauagcauacgauuaccagagauucugcucuauuguguuggccagggacgcugcaauguauacuuccucagucuuguuuuaaccucuauagcagcaagauucaaaauccuggacaugugugugcauauguauguaugcauguauguaugcauguauguauguauguauguauguauguauguauguauguaagugugcauguguguaugugugcaugugugcaaguguguauguacguguguauguauguauguaugugugugcauguguguauguguguaugcauguaugcaugcauguauguauguauguauguauguguguauguauguguguaugugugcauguauguauguguguauguauguuuguauguauguauguuuguauguauguauguguguauguauguguguauguguguauguaugcaugugugcaagcguguauguauguauguguguauguauguauauuuguauguauguguguauguauguauguguguauguauguauguguguauguauguauguuuguauguauguauguguguauauauguauguguguauguauguguguaugugaauguagauguaugugcauguggagaccugagcuaaucauucaacuccuccuggugggguugacgccucucagucaacaccagagcuugaugagguggcugugucauuguccaguuugcucuggagaucccauaucuuugccuucugaggcaggaauuagaggcaagauuucaugucccuuugucacuuauguggguucugggucacugaagaggugauuuccuauucggaaacacaaagcucagagugugccuguguggcuagcagagagaaaacgaaaaccacauuuuaaaugccaagcacgcgcauccaaggugcaaagcaaacucacauuucaucuggaagcaugugaaauguccaaaagguuucacucauuuucuuaauuucuaauugauguaggagggucuagcccacugugggcggugcuaucacuaggcaggacucacucucaagaccaauggccaauggugugaggcacaggaguugcuaacagguagagcagcaauagggucugaugacaggcgcaauuuuagaccaagaaaccaaucucuuuggagagacugaccucagaagaaagaaaaagcuauauauuuuaguacugcuucucauauugucucuggcuuugugaaagggacaccuuucauuuugcacuggauucagcaaauucuguagcuagcccuggauagacaacagcuacaauucuaguggguauauucuggauucagaggucuuucuguggcuggauuugauggccaugucuucuuggagucaagucagcaguauuugaagcauggacauuucugcuuuauuguaucccagccucuccugucucagccacaaagacuccuggcuccugcugcagggcuguguauccauccuuucuccagguagacucugugccuugcaguggccagcauccagcuucuuugugcuuccagcccaugccucuccaaugccucagcccucacuuugaagugaacucgucuucauuucaucagucuacauuuugagcccaagcagcuauuguuuaucuucuuuggcuuucuuucuucucucccuggcaaucaguuguucugccaggccagggucaugcuucaggaugaccauuccauccuguuugugugacugagucuuucauaggacacucugaaauuucuuacagaauuggauucauucgcucaucgagguaugcuggccacugcaaucuucuuccuuccaugccaacuuaacucuggaauguucuggaacuuaagcgaguauaggcaucgucaucucuuuucuuggcuuaucuuucuuagggaauuuccuucccucuggaaguucuuauaaaguuaccaguaaaaccauguuacuuuccuacugccuagguuugugacgucucuucauagucuauuuuucuuccuggcuccccccauagcgagcucaucuuccugugcaugugaguuauuucaggucaucugauuguaucuuuaaggccagauacuuccugagagagauguuuacuucaaaucccgaucccuuuaaaagauauccuugcugcuugacauucuguucuuagugggauggccuuauguuuugguaacuuagcccucacuuuguguaaacagucacaccacuggcaccucgaucaccacucuugccugcuucaaauaguucaucuucaaauaguucauccuaccucuucagcugugcuguguacuuuuuugacuaaaaaauuugaagucaagaggucgcagaggugacagcaccugcuuccguaguuccuuaagaaugcccagucaguaagauaaaaacagauuauaaccucaagaucuaaaauacaagugcuguuaaauuaucuagauguuuguccccuaggugaaucugacaauuuuuaaugguuucuuggugugugugugugcacguaagagugcuuacauguggauggcaggaauagaucuuugguauuguccuuggguaccuuucaaguuguuuuaauuauguaauauuuuaaugccugggcaagaaugugucauagcauuuagaagucaaagggugauuugcaggacucagguugguagacagugccucuguucacagcccucacuagccuggaauucacugauaucacuaggauaucuggcaagcaaguccccggggggugggggagugggguggggaccucuguucucugucuucucagaacagggauuacacgugaggaugaccacaaccaacuucuccuccucuucuuccucuuccuucucuuccucuuccuucucuuccucuuccuccucuuccuccuccuuggcuuccucuucuccuuccucuuuaauguagacucugagggucaaacuuggguccucauccgucuacagcaagcacuuuacaggcuggguuaucucccuagccuuuugauucuuucuuuuuaguucugaacgaucguuuuaaauuucugcacaaccuguuagucccuugauauuuugcacucuccucuaguuuucuuauggggaagaaauuagucaaugcacuacauccgaggagggaacacacccuccacacacccagccagagcuccuugugaaaacccagacaagggaugaaguucagugcuauaaaaccacccaggcaagcaagcauggaaaaagaaaacucacaaaauuccagacgcgcuuuucucccugcucagaguagauaguauuaucacaaugugucaguuugaggauucuuuuuuuuuuuuuuuuuuuuuuugguuuuuguuuuuuuugagacaggguuucucuguguagcccuggcuguccuggaacucacucuguagaucaggcuggccucgaacucagaaauccaccugccucugcuggugggauaaaaggcgugcaccaccauugcccggccaguuugagaaucuucauuuuaucucuguguggugugacugcaucucugcgguuaauuuugcugucuucugugaaauuucugagcucaggcaacauuaugcuuccagucucuuucagaagagcuaaguacucuccaggcacuccuguccuaacaauggacuaaugaugucuccauggcuaacauugcuuggggggcucugucauccuauguucuuaggguuacucaggguugaaguuggccucacaauaguucuucgagaaugucucacgagaacaaucuucagguucugaaauguuuggauuuaaguuggguauggcagugcuuaugguguagucucagcauucaguuaugagacugagucgggaggaucuggaguucaaggcuagacugacuguauacugagagauccacuaggauuauaaguguguaccacuauuccuggcucuuuucacaugaguccuggggauugaacucaaacucagcuggggauuaugcuuaucuuggaaagcacuuuaccgacugauauauauauacauauauauauacauauauauauauguauauauaucauaugugugcaugcauguguguaugcuucaugguagcauguagauuaaccaaacaccuagauuaaccuuacaaccuauguaaacagacacauuaaccagcauagaccuugaaccuuuuauaucacuucugauccaggggagugauccgagaaaggaaagcacugucuagagcuguagacagaccugaggcuugaauggcugggcuguugauuugauagcaagccccaaguugagaguuaagaaaacaugaagagagugaugguucaggagacauggagacgggcagcaugugacuacaggggcaacaagggcuuguaaaagggaagcccuucuuuggaguguuaauaauaaccaugcuaaccugguauaguaacacacuccugcaaccccaacacucuagaggaagaagcuguaagaguugugaguuugaggccaucuuaggcuauauagugaacucgaggccauucuggguuacaaaagaagacucaguuuuaaacaagaacauauugacuagaauauaguaauauuaaaaauuaaaacaacagcaacaaucuagacacagcuuugccuuuaucaugugcuuacuacguacacuucucauguacauuacucuccuaacaaaauagggauauuaaucucauaugacuugugauaaaauugaagauuaaaagacuuuucuaggccccuguuagggcuugauucaaagccacaggcuguggaagccaagccugaucagugagcaaggcauggcacuguggagccugaagcccuucagagaugcucugcucagaaaaugauugaaaucggauggggaaauagugaguuugggagaauccagguuacucagagugcgucugagcauuuuccugcugucuuuguugcaggcccucccagagccaucucugugugugcuguuguauugugugagccuucagaaagggaacaauaagucagggcuucgcaaacgucugggugacuaaacacacuucuccuagagcauuuuggaaauuucccaacuuauuuggaugccagacaagcagagagccugcuagaagggggcuggaauauagcugaaccuugcuggcgacuguccuagggugugauggaggaggaggaaauagauaugucucccaaccucuccaggaauucugaaaguaggaggggaaguaaauagagauuagagcaaaggagccaggagacagauggguugggcuuagccgguauagcacuugcuaagugugcacaaagccccagguucaagccccaguaaugcauuaagacgggugugguggcaaaugccugucauucuagcaccugggaagagcaaaugggaggaucaggaguucaggauccucuauggcuacauaggaagugugaggccagucuuggcuacaugagaccauguggaagaaaaaggaggauaagaagaggagaaggaggagucgggaagaggaggaagagggggcaaaagagaaagagaaaaagaaagagacacacagagggauggggagacccaucaagagauggcccugauuucauguagugcagauggaagugcauggcuccuuggucagaaagcaagagcaaauaccaucacgggaacaaaaccugaaagcuuuucccuuucuuaagcugacaugguauuuucacuauuuaaagcccuucuauguaaagaaucauaauggugaccaaagacgagcuguuacuuguauugugcggugccaguuugaaauauacagugcuaauaauauaccaagggcagaaacuuucugaucaugggucucaugggacuucguagguggcauauucaccaagccagcccugggugcaggacaaaacccuugaaugaauuuuacagucuuuaagcagcuggcuuuguguacucuccauggaacuguugggugucugacauuuacagugucuccugcaggaguuacacaagggcuuuggcugcuggaguacaccucugaaggacuuccaugaccacauuauucacuagagaaagaggggucagcaagaagaacauuucccuuucauucuuccagcuguaaaugucauugcucacacauagcaaaggaaugguucccccaugccagagcuguuucacaaacagguuagacgccagccuacuggcuucgaggaugaauggacagucaacagacagaagccaaaacauggcuuuccagggacagaauuaaaacucuuagccuaagagaguguuugugucuucaaugucccucaaagccauuguaugguaagacuuggucccuaugggagguggccgaaccuuuaaggagugaugauuugggcuggagagauggcucugaagauaagagaacuugcugcaagaacuagaguucagaucuugacacucauguagugugccuggcaugguccugcacauaccuggaauuucagcccuggggaacggaggacagaggcacgagggggaucacuacagaggcacgagggggaucacugaggcugcuauaagaaagccaagagaaaagcacaagcuccagguucaggaagagacucugccucacaaggaagauggcaaagacagauagaggaggauacuugauaucuuauucuggccucaaugucacacacacacacacacacacacauacacacacacacacacaccacacacacacacacauacacacacacauacacacacacacacacacacacacacacacacacacacacaccacacaacacacacacacacacacacacacacaccacacacacaccacacacacacacacacauacacacacacauacacacacacacacacacacacacacacacacacacacaccacacaacacacacauacacacacacacacacacacacacacacacacacaccacacacacacacacacacacacacacacacacacaccacacaacacacacgugugcacaccccacucacaaauuagagacuaguagaaggaagauaugaucuugaaguugggggcaugcccuggaacccuugaagucuggcauugugcuagccacuggccauugcuguaaccauccuggcagaagagaagauauuuuaaagagauagucuuauguuaucagauuacuggaacaauggcuaccaaagaaucaaaauguauucaggaggacuggagagauggcuuugagguuaagagcacuggcugcuuguccagagacccugaguucaauucccagcgaccaugugguagcucacaaccaucuguaaugagaucuggcacucucuucuggccuucaggcauauaaguaggcagaacacugcauauauaauaaauaaaucuuuuaaaaauugucuacaggaaucucaugcugaggggagaagcacucccuaacccucacccccacccccaccagagugauuucacacaguucugacaacuuaccaaacuaccuuguaggagaggucaguggggggcaggaccacccuugaccggguguacuggcuaguuuuaugucaaccugacucaagcuagagucaucagagaggagggggcgucaaccaagauccguccauagaugaggcuguaggaagccuguagggcauuuuccuaauuagugcuugaugggggaggguacagcccauuguggguggugccaucccugggcuggugguccuggguuuuauaagaaagcaggcagagcaagccauggcagaaagccaguaaacagcauuccuccauggccucugcaucagcuccugccuucaggauccuauccugcuugaguuccugcccugacuuccuucagugaugacuaugauguggaaguauaagccaaauaaacucccuccucgucagcaugcuuuugguccugguguuucaucacagcaauaguaacccugacuaagacagcagggcugcuuaacuggauguaacuacugccuguccucuauuuaaaccuaaacaucaugucaggguuggggagaaaaugucguggguuggggggggggggaucccagaugucuuugccacauuuucucuacuuuccacaauuacucaucuguuuaauuguccuccagaggacaaguggcucagccuaacuuguuagagccaccuggacccaggcugacccuaacagcucugguaaggaugcuaugguguagauguuauuaucccaguuuuccagaggacaagagagaugccaucaaaauccucugcaaggcagagauacagguggacuggggguagaauucaccguaagggaaugagagguguuuuguguuuucuuguuuguuuguuuuuguuuuuguccaagauaaaauaaacagagagaagaaacucagggcucauuucuaauuuggcuccaagaguuggauuuacaaauaauucuaaaccaaugacucugaguauuuugagaacuggcaguuccauuuccauggagaucauaacauagagaauaccuccaugacuguuggcauaauguuuaagaaagaagauuuucauguaauuucucaccuccaugguguguguguguguguguguguguguguguguguguguaucugucuaugugugucuuuguguguauauguguguaugucucucuguguguauauaugaguaugugugucugucucugugugugucugugaguguauaugugugcaugucuguguguguauaugugugucugugugugcaugucuguguguauguguguguguguaugcaugugaacgugugaaugaaggccagaggugaaccucaggugucauucucagaugccaucuaccuugugucuugagacagggccucucuuugacccaggauuuguuaauuaggcuagaguagguacccaccgagccccagggaucugucuguaucuacuuacccagaucaaggaucacaagcaugcaccaccacacuuggcuuuuuaauguggcuuccagggaucuaacucagguccucaugucuguaaggcaagcucagauugacgaagcuguuucucagcccaaacagguuucuuuagggaccaggaucuuggcguuagaaagaagcauggagucuauuguucuagacaggugucacgcagcuccagagaggagcaguuccuugcucagguucacauggcgaccuugugcuggagccuugacugaagcgcaggugccugacaauucaucagggaacaccuagaacacacugcucucuucccauucuuucccaccucgcugucugacagaccaucuucccaacaugaacaagggugggcuugcuuuuguuuuuagaacuuucucugugucagacaucuaacaguguucuuaggcagggacuuaccaucucggcuguagaaauggcucagggguuagggcacuggcugacuagagaauuuggguucucuuccuagcacccacauggugccucacaaccaucuguaacuccaguuccagggaaucugagcccucuucugaccucugaggacauuuacauucucauacacauacauuuauagacagacacacacgcacucaaucaaaaauagucuuuaagaaaaagaacaagguauagaaacauauacuaucagggcuaacagccaauuuauagaguugagaaauaagucaauaaaauauaauuuuccaagggcaguggggacuugagagauggcucggccccuaagagcauguucuuacagaggacuugaguucaguuuccaacugaaccaccugucacuccagccucagaggaucuggccucugggcagcugugguuauuugcacagaaagacacacacauacacauguauaaauacuuagaaaagaaacaucucaggguuugaacacaggucugcuaacuuauaaauccccuguguaagaauaucaggucuugccuccuucaguucuggcuucuucuccucccccuggaguccuccaggagccaaguauauccauuccuugcauagggcacaguccacugaaacccaccuucucucuagcuaguuacuucccucuccuuguguuuaucaacacaaauagcuuguccuccccauauuuauuuuauuggaggccuaccuugacccaagcccucaagggccccgccuccauccuggauggccuccucaacuuuccucuucacacaguccccagcagaggaugucuguaaaugcgucacacacauguuuacuggccuuuccugccuggcccaggguuccgcuggcuguuucuucccugagagguucuccugaggugagcuuugaucuccagaggggaggggugaugcugagugccugucagccuaugagucacuaucugaaagaaaccagagaggaugcuggugaccgcugcauccuuccuuuccuagggucagaagugcgacagaaaugaaaauuccacaaggcaggggugucugccccccacccugaccuuucuucuuggggcuaggagaaugaucuaucagauaugaaaccaaugggcagacacugcacucagaucccgaguuaaaucuaaaaguguuuugagauguguagcuuccuuggaacaaaauuguuugcaagagagcagaccagagaaguuuccagaucucuguaugaaauaccaucccacgaggaggccacauauuugggacuucuggugacauauuucucucaaaacucacagaaauuaugaaaaggccacucuaggcagaaaugcaugugcacaauagaaguuauggacaugaagagaaacaugagaagcacucaaaaugcccuaacugaagaaaauaauaaaugugagggagcagguaggagaaccagcaugguggcccaggacucauucacuuacucaggaggaugagacauugggaucucaaguucaaauccugucugggucacagugugaguucaaggccagccuagaaaacuuaguaggacucugucucaaaaauucaaacuacaucugaagagacagauuagcccuaguugaauccuuggcacccacggaaaaucugugugugguggcaugaacuugcaacccuggugcuaggaaggcagagguauguacaauucgggggcucacuagucagccagccuuuccuggucagggagugccagguccugaugaucucucucucucucuuucucucucucucucucucucucucucucucucucucucucucucucucucuccuucucucucaaaaaagugugugacacuuaaggaaugacacccaacauuaaggacuggucucuguacauauguguauucacacauacaugaauacacacuugaaugcauguacacaucagagacagagagagagagagagagagagagagagagagggagggagagagagagagagagagaagaagaagaagaagaagaagaagaagaagaagaagaagaagaagaagaagaagaagaagaagaagaagaagaagaagagaaggaaggaggaggaagaggaggaggagaggaggaggcagagaagaaacaccucuaugagauacuccaaaacccuuaauacugguucauuggcuagcuauaaugaaauucugcugccuucugacuaugucacuaauagaugaagaauucuuaugucccuuuucuuauguuuuccuuuucuacauguaugucuguguaugcauguaggcaugcagaugggcacacauaggaggaugcauguucacaucugcauguggagauccaagguugauuugggaauuaugcuuuauugaucuuucacuuuauugagacagggucucucaaccaauccaagccuggccaagggcuagucucucuaaccaacuugcucugaggaucuucuguguccacccuccaagccuggaauaccaggaugucacacccaccuaguguuuacauggaugcuggugcucccuggcccucaugccugugccacaagcaagaacuaucuccauagacugcaccccuuuucugauuuucucugcucaaagcucagcugguauacaugaacacacaaucucauuaugggacaagauggccuugcuuuagugccugcuugcauuuagugcauauauuuugauuguuaauuauuuuguuuagguuguuaguuguucuauguauagaguauuugagacauaugcagguuggagaugaaguccauuugcucucucuaugcuuccgacguauuaaggaacagaacaucaccauagggaaccucugaaugccucucuaaaucaaauguccagcuuccuccccagacaaaagcagcaucuugauguuugugcuaauucauaaacuguagagucuuacuuagcuguauguucccaaaacaguguguauugaguagaagcacaaacauagccaagcaugaagugguaauguuuuaauaaaagugcucagaauagaggggagugcuguuugugcuuucagcuuccauaagaauuucuaaggacacuuucugggguagcauauggauauggucauaagcaggccaccauaaguugggcaucugguagggcucuagugugggccaggaacugagucuagggaaaauauacaccccacaacauggcuucaucugccccagacuuuuuuuuuuuuaagauuuauuuuaaaauuaugugucugagugcaugcaguuucucaagaggccaaaagagggcaucaucguccccagagcuggaguuacagagauuguaugcugcccuacaugggugcuggcaacuugaucucggguacucugcaagagcaauuggugcucauagcccugagcugucucugcagccucagccuaaacucugugcuucacucagccuacuguaaacuucuggaguagagcaaagcucgucugcagggugaaaugagguccuugggagguacagaaaucaacccagaaaucaagaaaaguagccgggcgugguggcgaaagccuuuaaucccagcacuguggaggcagaggcagggggaucccugaguucgaggccaaccuggucuacaaagugaguuccaggacagccaaggcuacaaagagaaacccugucuccaaaaaccaaaaacaaaacaacaacaacaacaacaaaaguagauaauggcaaaccuagcuaucucagccagacucacccaggucugaaaaaguaggucaauagagguaugguccuggugguaacagcucuccaacgucugcuguuugagacagguuccugugaccuugaggacuugaccucuaugccuguggacagcugcucucaccauuaacacccccuugggcauuucuuucauuccuucuaaguugaacucguguguucuguaucuaaugacugucuauuccuugauuuauugucuguuuguuguggaccacauccucuggucguuuccugaggaaggaugcguaaggaaauuaaccugcuaagacucuggaagucuagaccuauuguuauucugugggacuugauggagugcagggcuacgucagauggaucugcuguucuguuagggguuugaaggcaucucucuucuucuuacuccggggauucccacugagaaaucugaagccacucugauucuaguacuugguaaccuaccugacuaugcgagaacugcuuugcucccuccaaucugaaaugauaugcuacuguaugugugccuucuaaauucucuucuguguuuuuauuaagcugaguuuuagagaguccuaugcugauaaauuucuuucauuauuucuaugauaauuuauucccuucuuccucuucuucccccuccucaccuuucuuucucccuuucucuaagaaaaggucucacuaugcauuccuggcuguccuagaacccacuguagaccaggcuggcuucagauucacagagaucuaccugucucugccucccaagugcuggguuuuaaggugaaaacuaccacuucuggcuuuuuuucucauuucuaagauuuuccaccauuuuaguauuuuccugucaugauguguccugcuaagaagguaagugucuagaugccaaggugcuaggacucaagugucaaaauggcaaaggaaggauuuuucagaaucaauuuuacuucauauacuguuucuacgaggaccacaagcaugagagauggggaaggaaguguuaguccaugccuacaagacuuguugccguguucaguacuagauuuucccucauacagcagauggaguuuacugugcugguguaggguauaaaagugcacaccugugccuuaauacauucaccauucccagaaggccaguauguuaagcacuggggaguuacuggagacagguccagagacaccaaauuaacuuacugugguccuacaccugugauauggcacacuuuugguucagauccuauuuuacuuuaaaggucugcauugauauucuguuuuaaauuacauauuuuugugacagggucucaguaugcagacaggcugaucucaaacucacagaccuccaccugccucugucucccgagugaaugccgagauuaaggcuguaugccaccacacuggguccuaaaugauguauauuuuuuccuaguaaggaaauucaugguuauuagacauagguaggaaauacauaaaguuuccguuaaauguuuuaagaaacaaccauaaggccaccacaacucaggaccaugacuuacaauucacgcuaauaccauugucuauuugauucuuccgucacauaacucacuugggcuggugaagcugucuauacuauuucuaacugcauagccucaagccaagggugagaggcauagucagaaggauaggauagagagagcuggugcugauugaagugggugcagagaaaccauucaguaccacggagaguucccagccuugcuuccccgguguaaagaccacagacagucgggauugggacuugaggaucguuucucuuugcaucuaaggaacugaucuccuaacacaaucgaaaaagcccuguggagguggacaugauucucccuacuauuuaucuugcugcccccuaggcuggaaugacugacuguuuucuaucuacccuuuaguguauuugaucauuaauuucuuccauaagcuuucagggcucucuuugcccucgcccucagugaucucccccccauuccucuucauuucucuugauaucauaugugccacauuagauuauaaccauccauugucccaaucagccuaugaauguuuugagucagggacugugucucgguuuucuuugauucuaguaagcacucguuaauauaaacacaucagaucaggccaggucuggaguuagggcuccgugguuaagagcacagcugcugcagcagagguacuggguuugguucccagcauccauaucaggcagcauacaaccuccuguaacuccagcuacaggggcccaaugccuccggccucuguggacaccuguguacaugugguaaacacaagacccauggacccucauacguaaauaaaaauauagaacucuuuuaaaugauauuuuaauuaaacaagguuuaaggagauggcuugguuguugaagugcuucugcacaagggagaggaccugaguucagaucccaaauacccacgucuaagcugcauuuguaguaugcgccugcaaguccaguacugugggguaaagauaggcaguuccagagguugauggccagccaguccagccaaaucaguuagcucuguguugagugggaaaacaaaacaaaacaaaacaaaacaaaguggagagagcagaugauuguccacuacagcaguuguguauauuacaugauauuuacaagcauacaagcaucuuggcauugacgaaguaccugucuuccuuaaccacuucucugauuuaaaaaaaauauuuuuccauuauauguacauguggaaggucuauguacaugugagcacaagugucuacagagucuggaaaauuguuucagaaccucuggcgcuggaguuacaggagguuaugagccuccugugcaugguguuagguacuaacacaggacuucugcaagagagguaaacaccaagcuaguucuccagcccccuauacuuuauuuuuugauacaaggguucagucccugccugggcaauuucuaaagacagaaagcuuuguccugaggauuagugagcucagagucauggaagacagauggucagacugaagaagcugcuuuuuaucaagguccaacuaaggucuagagauuuuuuuccagaccucuuuacaagauguaaaugguugggucugggcugaggcugagcuggguuaguuugaggugcucagcuauguguguguaagcuucaggagaauggguuugucacugaguagcuugggcacaguucaaagcucuuuggacuuugcaauaaccuggaggauuagaauuuagagagaguaucaaacaagagccacucugccucuaguccaaacagagaaaguccuuucacuagguggaaagggcaugaggccccuguacucacagauaggcaguaggaaaacuggggauguuuaacacgcaggguugucucuucaaagaaagagaugcauaccuguuuucugcccagaaggcagagaaugggugagguuaauagccuggugaccugugcuaucuguagggccaggccacaacuggguccccaggcuuauguuuauuccagacuuuuccucccaagacccuuaucuugaacacuguuucucagucaacagagcucauccuucgggaagacgucacaugcacuuuacaagugggacagagguggcuagcagcccagugaccucugugcuaucuguauuuccaggccauaucuggcucccucuucuccugagauccuuaucuugagcacuguuucucugucaauagaacccauuuuuauggaagaaguuguguguacuuugaaaaguuucaauguaaucaugucugaagcuuuguuguucacacaggauugaguuaauuaucaggaaacuauuuuccaaaauuuuacugcacuuaaauaugccuaaaauaaacuucccacuguuagacuccagaaguuugaaccaacacugccaacugggucauguugaacuggauuuucuucuugccucacguggaucacuacccugcuggaacucaacaaauauucuucauugaaagugaacgaauuaaccuauccucaagguguuuaaaacaugaacauagagauagaaagaucucuuuuccauuggaaauaaauuaaauaaauaaauaauaaauaaauaaacaaacaacaaacacccaagaaggagacuaacuuuaagcauggccucagucccccuccaucauguccaccuugcaacagaaugcaguaauggcuucccuggauacagagcuuugaaaugaugaaacagccaagcaaguagcacagagaagggucaggggcccagguuccuauugucaagaggggaacagcuuugccucugguccucagcauccacugaugcuguuaggaugaaacaugagucucuauggguacccugguaucuuaggcaaggcucuucaaauucagagguuggagacaaauacgaggguugaaacugaagcuucuagggagguggugucaagagucaggaaaugcucuagggccugugaaugccaggaagacagccagguuuuaucaaggagcuuaaaggccaagaccuuguguguucuccaguuucaucaccuguacugagaggcaggaugcccugaagcauauacaacggguuucgggagagcuuuaugagguugacguaaucauucuucucauucugaugaggcugccugggaggcugguggcacucaucacaggguaagccccaaaaaggagcaagggggcuacaguuccuacccauacaaaguugauuaguuauuggcguguguauguaugaugcucuccuaacauuuuucgcauguaugugugguuugcauguguauauggaggcagagauugauaccaugcauuuuccuccauugccccccuccccaccuuauaucuaccuggcauuuauguggguucuauaaaucugaaccccaggccucauucuugugugguaagugcuccacccgcugaggcaucucaccagcaccucuccuaaaaggaggaguuucuauucuauuucuuguacuaguugagccaacacuccugcagcuggagaaaggcuccgggugcuuauagacaccaucagcaugcacagcaagacugugauuuuaaugacuguugauggcagcacugaugcuucauggggguagcauguacuuauugaacccugggaaggggaaauuccagauccuuguuuucaaucccaggcuuggugggucugccuauguuuccaaguccgguaggaaauuuuacaugcccaacugucagacuuccugcaauggucucaaagcagacccaguggccacauacucaucucucuaccauuugcauucuuaagccugucaagacagaacacauaaacaaacaagucagggaaaacugugcccuugcagauaggcagcaagaaucacuggacuccugggauccaugaaccaggaaagcuagacaggguggauggagucguguuuguguguguuucacuucauacaacaacugaauguccccccaaauacucuucucugcgguuucauuccugggauagcccuuggaauacagagcuuaagcaucucaggacaucccauugugaagaaucauuagcagagccugggcugaucucaacaguuccuucuucuccuaggaugugugacauccuugguaccuucuucagauucccaagagcagauggagucgagucaagcaaggucacccugggaaaccacuuuucuggaucuuauacuacauauucuuagugcccaagucuucuauucucuccuccuaguuuauuucaccugcacugaagcaaaguucuucagcugcaagagcagugguagccauggaggugaauggcuccucagcucucuucuacaacaccccacaagaaaccgguuaguuagcuucuggugcuggggaacucacugcucuggaagaugggguacuuugauacgaagauaaucagcgccaagaugucuuuuguuuuaaauuccaaaucugccauuguguaauuuccaauuaaguuuugccauuuguagaacccacaguguaauucuccuauuccauuuauaauagcacauucuuuuuuucuuuuuuuaaaagauuuuucauuauguguaugucugguuuucuauguguggauaugugcacacagucacauaggcauguguaggcaccuauagaugccagaagagggcauuggaucucuuggagcuggagcuacaugugguugugaaccuucuguggguucugggaacugaucuuggguccuuugcaagagcaggaagcaccuuuaacccgagccaccucuacagaugcaagcaguaugcucuugcugauagugucuaaaagugccucggaugauuucacacggacucuccccuggcucagauuauucagggccuuuaccauucuuacuucaacaucgucuuuaugcuaauccuacaagaaacagggcagcuucagaaaaaaaaaauaacuggccuguaagaucagaagugccacggcuggagagauugcccagugguuaggagcacuugcugcucuugcagaggaccaggguucuguucccagcacucacauggugacucacaaucauccaaaauuccaguuccagagggcucugaggccuucuuacccccauaggcaccaggcacacacacaugauauauauaacacagaaaaacagucuuacaaauaaauagaucuaaaaauaaauguucuuuuuuaaaguaucaaguuugagauacccugagcuaauaucaucuaggccguuaccaucuacacaguccuauggcuuaucacugcaagcauaaugcucaaaguuuaggagcaccuguaaggacagaaccagacuguaggggauggagggguggaucaguggguaaagcacuuacuguguaaguauaaggccugaaguuuagauccaugaacccuccaaaagcuggaagugguugugcauaucucugaacccagugcuucuaugguaagauugaggcugagacuggauaagcuugggaggucccagguuagugacugugacauacucaggggcaaugagaccaguaucaaacaagguagaacaccugagaugcuccuguggucuuguuguaugugcuaugguacuuguaggacugaauuuacacacacacacacacagagugaugagaacacacaggcauauaacuauccucucucauuuuuugauccuggaacagcuaaauauccaccaugcaccauguaccccuccucccaucagggaagugauguugucagggaaagaauccaaguuggauugaaacaaauuguucuuaagccaaagauuaagaugcaaaaacagaauuauaaaacacaaaugucaaucuagaaaaaggcaguguucccucugagcauuuccacaaugcucuaguaguaacuagaauccauguagguuuuuauccauaaagacaugcacauagaucaucucuacccauuuuuugucaccccaauguaugaaaagauucuauuucuauuuucacucaaagcacuuguaaaauguugauguuucuugaccuuuaggggaggguaaagaugagcugcuaacuuauguuuauucauguagcacuagaaaacucuagguugcuaagucuuaucauuuuauucaaacuguucuaaucagugggguagggaagauggaggcagauuuuagcauauuucauaaagcuagcauaauccuaaaauccaauucuuucaaagcaaaguacaugaaaauuacaggaauggcuuauuaaggagacuagaaaaaaauuuccucaaaaaaccacacuaaacccagcuuugaauuuuauaaacugacugaguuuauuccaagaaugaagcagauggcucaagaggagcuggugagaaggcucaguggcucagaggacuuguugcuuuugcagaggacccagguucacucccaaguacucacccggaaucacaaccgucuguaacucagguuccaggugagccgaagggugagccgagggccucuucugugggcaucaggaaugcagacaaaauagccauacacuaaaauaagcaaaucuauaaacaauuuuugaaaagaugacuuaacaacagaaagucuguuaacuggagugaugagaaagaaucgggaaugggguuaggaucacagaggacuucaaagguaauaucauuaauuggguguaugcugguuaguuuuugugguguaaccaauaaccacaagcuuucaauaguguguguauguguguguguguguguguguguguguauguguguguauauauauauauauauauauauauauauauauauauauauauauauauauaugaaugauguucuuauacauuuuggacaagcgauuuuggguaguguucacuagucagcucagcuugaaaguguaggucuauggguuggcugaguaaccauggcccaggugucucuugcuauuccuugaccagaugacuagguauugcaaguucuccucauggcaaucuauagaacuaagagggugcacuugcuuaugaacagaacacauuuuaaaccuuugcuuggauacccuugccacuaucccguuuugauaaagcaucauuuauggcuuggauuuaagcuugagagagagagagagagagagagggagagagagagagagagagagaauauaggagcugcagagauggcucagcauuuaagaguacauaucacuuuuguagagcauacacguucaguuuccagcacauacaacagguagcuuacgauggcauauaacuucagcucugagcucugagggaucuggagauucuggucucuguagacacacacacacacacacacacacacacacacacagaaaacacacccugauccaauagcacacacauaguuaaaaauaaaaauaugggcuggugagauggcucaguggguaagagcgcccgacugcucuuucaaaggucuggaguucaaaucccaacaaccacaugguggcucacaaccauccguaacaagaucugaugcccucuucuggugugucugaagacagcuacaguguacuuacauauaauacauaaauaaaucuuuuaaaaaaauaaaaauaaaaauauaccuaaaaucaaaagauggagaaguccacagaguauaaugguauggcccagagugaguauauaacuguagcccacacucaaaacauaacacaaggccauagggcacauguguauauuauuauuuauaauuacacauacacacauaugcauacugagauauauaauuuuguauguacaaaguauaaaaaaauuaauucagccuuucuuggcuuacuccaaagcauuaaguuuuguggcagauaacagacauuuauauauucuuuguaguucauucugauaaaaguagacucucuuucaacuugaaugugcccuuuugacacuggauauaggauugcauuaaguuuuucuuuuuuuugaaacuacauuuuuaucuuuuauuuaaaagauagugacaagaaagauaucuguagaaguucucuaugggcacaaacauaaauauacuuauauacauauauacuauauauacauauauaauguacauuauauacuguauauaguacauauacacaguauauauacuauauuuauacacauauauacauauaugcacacauauauguauuauaguauacauaauucacacacaauuuuuuuuaggcucaggcuuuaagagacuaucacuuucucugcuuaaauggguuuuuaaucuuggaacuacuaguauauuggaaagguuuaugaguguuugccuauauguauauacaugcacaauauguaugccuggugccugaggucagaaaaggaugcuggauccucuacaaguggaauuauggaugguuaucuaugaccauguagguguugggaaucaaacccagguccuuuggaagagcaacaaguguuauaaaccucugagucaucucuccagcccuccaggaaacaauuauuuacucucccccagggcuuauuuuuaaagauucauuuuuauuuuuaauucugugucuguguauaugcauggguaccugaggaggcaagaggagggcacuggauuuccgggagcugggauuccagguggcugugagcagccuggugugggugcugagauucaggcuccagaccucaacaaaagcagcacauuugcucuuaaccccugagccaccucuugagcucucuauccugcaguuucaucugaagaggaaaugaaguuggcuuggcgggauuuguucuucaugauccuuucaucuuuucugguaucucaucuuucaaccucuuccaaaaaggacuuaaguuuacaaaguaccaaaacaaauuuauaagaagaaagcacagcaaauagaaaaugggucagcaaaucaagacagaagaugucagcacuugccuggaaagucccgguuugccucagcugauccuuuucccacccuucccuacccauucugugauccuucacgggcaaccuuggcucauccuguuauuccagcuccaggugcuggcaagauggccucugaaucaucccuauugguucacuuaguucugccaggccuccucucuuacccuucugaaggcaccgcauuuaccagggacacugaucaccacaggccacagauggccaugcauuauuucuaugcgccuucccugugugcucuaagguuuuaguguugucgggugacaaaugcaaugaacaaaaaggauuugcagucucuaaggggaaacaggccuaugacugaugagaaagagauuuucauagcuucucaacaugacacugccauagaaacuccacuuugggaguaggagaaauggcucagcaguuaagaaugcuuccccagcuacugccuggaacuccagcuccaggggacucaacacccucuucugguuuccacaagcaacugcacugacauacagaccacacacacacacacacacacauuacacaaaagaacaaaccaaaaaaaaaaaaaaaacccaaaacccaaaacaaaaaacccaaaacaacaaaaaaaucuuuccaauuagaauguagaaagcaaaggucuuuauuucauuugugaucccugccuccugcucucaauccuuaauguuuggugccgaacucaacacauagcccuagacaaacauuuguuaaaugaauauuuucuagcuuuuugacucgaacucaguaguauccaacaaguauuugagacucaauucugcaagugcuacuuagcuaaauccuugguacuuagcuuggagcuuuaaaaaucuguaaaacuguaagaucuaaaauuuuaauuuuuggguaaauacuaauugcaagaaaggauaagaacacccagaguucuagaaauguucuuuacuggaugguaguuacacacuauaguuacgauuuauagauuuuauauauuuuuaguauguuuuggucauaugcauucuccuccucuaacuccuccaacauugaccccucucgcaccuuguccucuuuuucacuuuuuaagaaguccacaaauucccauucauggguauggagcaauccaccaggaucuaccagggcuuacaugaaacugacucucuaccccgcccgaaaucaucacccauaaguagcuccccaguuaggagugggggcuugcgaagguugggucguuugguuuugugcaggcaaacacgcugcugggaguucaagaguggcccugugauggccauaagacaguuucagucuggcuuccuccuauccuuagcuuuuaaagucuuuugacaacccccccccccagguuuguguauuuaaguuuuuccucaguaaguucguuuguuuuacauuucuugucuagucaaugcaucuuucuaguguagcaagcaaacuaaaugcuaagaaaauggaggugugaacaccuucagcgagacugauagacugcaguaagaguuagaagguaggacgcauccugccuuucugacacgggaaacuucccagagaucacaggucuccucccgcgucccgagacgcuuuuucugcggugcugaccacuggcuuccccgcaugcguucuucccugaaccugaggugaggagcaaacacgucagaacugaguucugcggcccgggcaagagccggaacaucugacgguucucauacuuuaaacgcaaccuuuuagccggaggagaugggacacucaguucacucuccucucgagaaccgaggaccgcuccagguacaggagggucaccagacgucacaaagccuuggaaaauuccgacccgggcucaugcaacgcgcaggcgcaacagagggccacgugcgcaggcgcacggcggccgaggacaggccuggacacacaccggcgagcgggcggcugcgcaccauggaacagcgguuagccgaguuccgggaggcccgcaaacgggccagucugguagcccagccuuccacguccagucagagcguacagaccucgggagcgaaggcggagccagcggcggcgaccccaaagacagccacgggcuggcugacacgcuuccugaaacggaaagccaaccccgccaucgcucaggcucagcccaaccagccucaggugaggagagaggccugcaccuugaagcuccgccuccgcgcgggggccacgccccugccugcccaagccacacccaggauaucuggcucuuccuuguccugugcgcucucuccucgccugccucguggcuggacaccgcauuuccgcucuguguaucagcacaugauacguggccuugacguuuuccaucccagacaauccuaugcagcaacuaguugaaaacaaagcgaagcucuagggagcuugaagaaacaucucugcucuccaguuguucacugcgaguuaaugacagagauucguggcuuugagaaacugauaaguuauuucuccacuggugaaguaagccaauucaagccagauuaguauauauauagguuuaucgggaagcugcuuuugugccgaugaguucacuggcccuaggaaggaggccagggaagucgccaugagaagggagacagaggggagggagaagagaaagagagaaggaaaaggaagaagaggaagagagaaaaccaaccaaacaaaaaaaagucuggguuauauaguaaagagccugugggcuggaaaguucaggguuggggguaggguaugcuagguagggacugagagaugcuuggagaaccuggaggccaggucugcuugguguguaaaauauacaccucagcaccuuguccuggggucugaaaccacugagcugcauccacugcuagugaggggguaaaggccuuacugguuauggcucagagguggcaguaauuaaggcugcacuuuauucacaccuuggguagaggaagccagugucucggguagcuuguacuuuagaaaugggauuuggaccaggaaacaaaaagagguuugagacuauggccauacuguucugaaugcagcuugauuucugaagcuaagcaaggucuggccugugcaaaacgggguuugacuauggaaguguggccacuguaacugccuagagugaugugcaugggcuuauaggccccucuuggacuagagaaggguauucaaguucaacugugagugaucuagguagaaauaauuuggacaaguaugauagcccauucgaaucucauuguggcuucauauaguuccacacaggaguauccuggcaaagguacuugccugugagguuggaaucccuggguggaaauaugaaacacuccaaggaggaaauuuguguccugguuugguuuuuguuauuuugauaaacaccauaaccaaagccauguggggaggaaggggcuuauuuuagcuuacaggccauggacuugccuacuggcacucucauuucucaauugagauucccucuucccagaagacucuaguuugggucaaauugacaagaaaugaaccagcacacuacgcuuuucagcagucacagggccuuaguuucuuguaaccauaacaagagccaaauacauacauagggcugggucuguaagaagucaaaugaggaaaacagagaauagacccagucugaccucuacacaaagcagacuuuuauugcucugagaggcuggcacacccaaacccugcugaucaguaccugaggguacaggagaacgugccauguaggaucagggacugggagagcauggcuuugccagacccagaaacugcuuuucuggguaaacugcuuuuugaaauaagugugggggaugaaucuguuuguuuaaccucugggcagcaggugaaagauaagucaguuugccuuuuuugguuuaccuccagaguuccaguacauguuaauggggguggacugcuuucuggagaauauggguggcaggcauuuuggagucuuugcccuguuuuauggccuugucuagggguggggauuuccuuaguaaggaaggacuguaauccuagcuccuuaggaggcuauggcaggggauugugaauucaaggcucgacuuugacccuguuucaaaauuuaaaagaaaguuuuaagagcuggagucguagaucagggccagaguuguucuuuugcauguaugauguacuggguuugaucuccagcaccgccaaaaagguaaugggaacaugaacaaacaagugcagggguauaaaucaguggcaaaggacuugacuaacauguucacuucccuagguuccauccucaggacugccucccaauaagauggcugaguaguggugcaugccuguaaucauagcacuuaggagucugagggaggcagguugugaacuugaagcuggacugcuacauaaggaagaaaccauguugaaaacaaagaccccacucuacccccaaaucacguuauaccagaauggcuaaucuugcucacauuaaaaucauuuaaguugaucuauuacaugagggggucccugcucccugcagguuucaaggaaccacaaagaggugagaaugaaaacuugauucagauugauuucauugaccuggagcagacuucagagagucugaugccaggccauauaguaugggcaugcauauuuaaacacaauagaauuugaaaaaggauuucuaagagguaagucuagauguacaauaaagcuucaggugccacuacauagaaguuccuuugcaaaguacaugugaccuugaagaugggcucucuagcuuaauggccuaacaucugguguggccucugaucaaguagcauagaggucagcagacuauaaaguacaugugauaucuccucuaagaaugggagcuaaagauaaaggucuagggagggagagucuggaagaaucauucugggguuugggugaggucugucucuauagauagcagaagaucaccaggucauuaacaaauuccagucucaaauuuccuccacugaggagacaccccugcguguuuaacauuccugguuucccaaugccuccugucccccaaacuacacaguaucuaguuuaaggaauuuucuuuucauuaggaagaggauaugguugcucaguuugacucuauaguucucucugcaguauucagguuucccacuugcagacacucugccauccauuuccuucaguacuguuuguauaacucgguugucuuuggauaacgauugauuaggcaucagcaaacagaggcuugagaacacagccucccucuugucuuccccuucucuccccugcuccaguuaaaaaccuacuaugucuaaccacauaaagugcuuuugauuguaugucucauuuccaaaggaauaugaagucucugaguugaguccagagaagcucaaacucaaguuuccuuuauaaaaucccagagauuaaugagaggaaaugcuggggugagacugcacuaacuauucugccuuucuaaagaaacuuggcuuuagguuuauuuucacugacuauuauccuuccugggguugcccugguauaaaaauucuucuuuuauuuuuugguauucuuuggagauauuauucaucucccucugcccaaaguuuucuuagaggaaacuagucuggcaaaugaugauauucugucacauugugguuaaaagguuuauaacuguuuaauccuaugggaacuugcucccucuuucugacucuauucuaggcaagccucuaguacuuucagcccuagggcuucguucuccauccuggucuacaacucuggaucucucaaccuuggcucaaagggcccuaccgcucaaauguuuuucuuugaggaccugaguucaauccgaaacaccgacauuaaaaagccaaacuuggugaaucauaaucugcucugaggaggcagagauaggaggauuccuugaguuccauggagagccagucuauccuaauuggugauauccagguucagugagagacccuguauccaaaauaaaugugggaagcaacugaaauaacaccugauaucaaucuuuccugugugcucacauguacacacacagucuuucauauugcuuucuauuauaugucugucucugcaucuugucucuuucuccuucuggucaggguccucagguaggaagcagcuugcuacuggaggcaugaaaauguguucucugagccauggcuaugagcaacauacaaccauaaaugcuucugcacauggcuauuguugaaaaggcaaacugaaucaauacuagauacaauucucagucagaggaauuuccauauaugcccccauguuuguccccucugacaguuuguuuaccauaacucuucccaucucccaacccuuugcccuacugucccccccaaggcacugaguuaaauaaaaagggaaggaaaucuuuaggcucuuguucuuaaagacacaagucaugaccuuucuuggacaguacaaucaacauaagauccuguuccccuuaaaagugguugaagaauaauuuggaauguaagaggacuuuuccaggcaggcaaagcugacuuuguuuccauugcacccauguaccaggcuacaguauauaauccauuucuugcucugugucaaaaagagacucuuaacaacuugggaaauagaggcuugagagauggcucagugguuaacacugaaugcucuuccagaggacccaguacccacaugguagcucacaauugucugugacuucaagaucugacacucucacccagacauguaggcaaaacaccagugcacauaaaaagaaacaaaggaacaagcaaaaacauuaaaaaaaaaaaacuuagaaaauaauggagaucaggcaaagcuccuauagucaccuauacaccaaaggauucccuuagcaucuggcacugucuucccauguaagaacgcuggauuuuaacaugcaggcaaugggauuuuauugaagauguguguguugcaaggugauggcaauuuagagaacucauugagcagucagucguacacaggcuggcuuggagacuagagagagauaggaggcaaggggucuaguuagaagaugcaucccaggccuggggaugaucagugaagaccaggauagggugggcaauggcauaucacugauuuuuuuuuucucuguaaguguguggaagggauuuuuguuucuguuuuggguauggucuccauuuuaggacugcguuaccucggauguuucaguccaucucaucaaaucagcaaacguguguugcccacggcugugugggagacaagugcugccgcugcugcauuaucagccccugcguagguucugcugggguacacauuagguguggcuaacaguccaguaaucucggcuuaggcucccccguucuuacuucuguuuguuucuguguuuuaggaagcaggccagcagcucccugagagcacagcagucccucugccuuccuccugccgccagucuuuccugacuaacaucaccuucuugaagguucuccucugguugguccugcugggacuguuuguggaacuggaauuuggucuggcuuauuuuguccuguccauguucuauuggauguauguagggacucggggucccgaggagaagaaagaaggggagaagagcgccuacucuguguucaacccgggcugugaagccauccagggcacgcugacugcugagcagcuggagcaagaguuacagcucagacccccucagggaaguaggaccagccccagcuguuccuccuauccuugaacguggacuuuagaggacaaaggacagcuugcaggguggucauguccuccacuuucccccugaccugcugcaguuucaucuuugaacuccacuuugauuuaggugaauuucucuaaaggacacucaggguggggcuggugcuguauauaaaagccauaaaagaaggaggcugguuugucucauuauuggaguggugaugcuggcaugcuagagauacacugugagguucuuugguuuacugagugauuugguggaggaguaggcacauuggggcuccuuuuaaauauuuuaauauuuacauagcuaaguuccaggccagggaaacuggucugcccccaccuuaaaugugugaauguuuuguccaaauguauauagauauaccaugugugugccuggaacccucagagcgccaaagagagcaucagauccucuggaacugaguuauggaugguuguaagccaccaugugcaugcugggaacugaaccucagucuucugcgagagcaacaaaugcucucaaccacugagccaucucucuaaccuucaaaaaaauauuuucagaauuauuuucucaaaagguuuagguuguaagguuuagaaauuuuuguuuguuuuugucuuguuucuccucuuuuccaucaucagugcuauugaaauauaaaaugucuuuaagauucuauaagcagguccccauauacuaccugugaccaucuuucauuuuccccuuaacccugucccuacuuaggcaggaaaccuaagagaagagaaaaaguuucaauaggacaaagucaauaguggagauaaaaaauacuuuauuuguaugacugucuacauauguauguguguaccaugugccugaggaugucagaucgccuggaauuggaguucuguauggugguggguucugguaaccagcucaucugcaagagcagccugcucuuaacugcugagccaucuucccagcccuggaagaaauuugauaagagguuauuuaugauugguacaucaagagaaauucuugaguaugugcagagggaagggcuaggagacgggauucuaguuuuacugcuuggguuuugucucuuucuuuuagguauuuuuaaaaaagauuuauuuauuauauguaaguacacuguagcugucucagacacaccagaagagggcaucagaucucauuaccgaugguugugagccaccaugugguugcugggauuugaacucaggaccuucaagaagagcaaucggugcucuuaaccgcugaggcaucucaccagcccccuuuuagguauuuuugagagggucuccuguagcucagacuggucuuagacucauuuugugguucugguuuauauauuggggaccaaaccugggauguuuuaugcuuugggugagcacucugccaauggaguuacuuucccggcccuugcuuuucauguuucaauugccguagaacccuguauguuucugucugugggcucuaguuagcaguuguauagguagcagcuguugggccuggcuuggguguuauuucgucuuccaguacagcaguggaguuuaguuucauuggaauugggccacacauacuuuuucugugagucauucugaugaauaaaaagauuaauuuuguucaaacuuaagguuugaaaaaacuuac

SEQ ID NO: 7282 - RNA, 41761 nt, Mus musculus
gcugcuuaaagagcccugcggaggcgcgcugggcguacugucgcgcgcgcagaggcggcacacgugucugcugguguggguccugaguuucacccuacccuucaggaucgagagauugggguggccccaacccccuuuugaugugcgcucacccuggccugugagaacgugauccacgcaguuccccgcguucagggagccaacuuggccaagcaacugucccgggagcggcgcgcggggguaccgggcacugcgcaugcggagcuccaaauucaaacagcuguguccagggcugcaggacgagugaacccggagcugcuggaauuaggggacucuuucuccaggagguggccauuccagagucaugguggaccgggguccuuuacucaccucggccaucauauucuaccuggccaucggggcagcgaucuucgaagugcuggaggagccacacuggaaggaggccaagaaaaacuacuauacacagaaacugcaucuacucaaggaguuuccgugccugagucaggagggacuggacaagauccuacaggugagccgucggucgccagaauccuccacaugcaucugaagcuguugggacuauagcgguauugaaggggauacucccuccuacaguuuaagacgaccccccaccccccagucccaaccagaagucccuggguggcgggagaaaaugccucaucaggugucaggucgcaaagaucugugucuuucgucuagggacagggagauucccccacgcgcgcagacuuggucaguaccuaguaaguuccgagagaacuugggguugacuccaggaugaacugggccccgcgguggcuuagugugggugugcgggugccucccucuuuggagggaggcuguggggcggauaaaggaguuuaucuuuccuuggagacgcucccggaguccgggagcagagccgggugccaccccucgcgucaccaccucccgcuccagggccguugccgcgcccgcucgaccuuucuaaacuugaauacagcagagggcccccagaccuggugugagcaaaaacacacccgccaguugcugcacuuugaguggggcagggagcucggacauauccuaagugccucggaggaaggucuguggcuggaauguucgggacggucccaggcuuccaugaagucuuagcaagcugagccaucccucaaggacucggaauuaagcuuugucaaaacagcagguugcacaaacgaacacccaaauucagguagugcccuuuuagggagcgaggauagugugggugaggggauguuucccugauguuagcuuguggagucacuuaucugagaaugcacacacccaguagaccauugaccucaccaugguaaacuuggcugaccaucucaacuggaaccuugagccaacuuagggucagagguucuucucuguuucuugagggcucagccccaagcauccauccauccuguuccuggccuucuaacaauaaugguaggauuaaacuggagcagggguagacuguucaaaucauuauagaucugaucgacaucagcccccacuucuuuccacuugucucaugccucucacuuuccagccucauuuaccuguuuugucaaaugggaacaaaccugucuucauccuuguccugcccugaacuauuguaccauugacaacugagaaaaccuaaacacauccuauugguacuaccuccuaauuucagauggacauucacagaaacauuuuaggugcccgagagaucaugggcucaucagagaguugcccucagcagguuuacaccacuagguguguuguugcuuuugaguagaccuguccccuauguuuaggggcugggcguggaagguuacgugauagugaugcuaguggugaguuucaaaagacagcuguucuuccaggggguucuggaaagauccacauacccgucugcugcaucugggugugcugaggaggaagaagguggucaguuugugauagcccugacaggaucucuggaggagaguuuuguguguguguguguguguguguguguguguguguguguguguguaguuugcucugggggcuuuguuuaggggagggggaggagaggaugauaagucuccagcugcccucgaagucuccccucccugcugcuccuccuccuccguggcaggggaaggaaggaaagaauucaaggcuaaaugugggaaaauaaacuucaaaacccaaggagaaggggugggggcaguguuuaggggcuaugcagccugguacaucuggugcgguggcuuuacaggucaagugguuucuguaggguguuugaaaaaacaaaaugcccuuuauuuuaaggucuugucugucagcaguaccuccacccccaaaguggacagguaacuuuuagaaaaaagaauuugagcaacaucaggccagugugauuuggagaagauucuagaugcuugcuugaaugaacaaggacagucugucacacacacccuccccagugaaaaaaagaacaaccuugucaacugggcaaguucccucuuuucaaaggaaaaaacccaagaaaugaaaauggaccaaugaaagcauuugccagccucagcuuaaucugcaaaaaucugccucucucggcuuucugaucugugacuuggggcgcugccucaggccucaggaaauugguuuaaggaaaaaaugaaaacuccaaaaucuuccuucucauucggcugccuggguauuuuccaccugagguucuggguuuuaacccuggucaucacaaagccccuuaguugaaaauuccuggggugggagcaggagguagcuaagcuugggggggggggggaugggcuuacugcugcaaaccguggcuguagagucaaaagcacagaaaaaaaggacguagcccuucccuccccuacuuaggcugugguugagcugugccacacaggcugccuuucaagugcccuguauccaacccaggacccccuggcuguucuugccuucaaaaccgucugaacucccacugaaguaacaaacugcaccuuauuguuagagcuguuuguuuuuaaggcagggucucagguagcucuggcuggcccggaacucacuguguaucugagggugaccuugaacuccugauccuucaaccuucagcucuuauguaugguacccccacugugaaugcaguguugggcauggaacccagggcaaacacucuacccacugagacacaucugcagcucuuacauuaguugccauuaaugaaucuguuuauuugguuauuuauuuauuuaugaaagcagggucucccuauguagcucugucuguccuggaauugguuccgugcauagaauguacucacagagauccgucuacuucugccucccaagcuuggggguuaaauaaagaugcauaugcuccacugauuuuagggauugagacaggguccugguacgaggugaaagcugccuuugaacucuuaagcacccugccucagcccccuggaugcgagauuauaggcaugugccuugcuguuuggcauuaccagauuuuuggguggcuggcuauucuagcuguuuauguauuuuccucuuuuuuuuuuaaacccagcaagugaaauuggcauguauagugagugcaucuacugugcugagcacugugguuaacauuauucuucugugcagaggcauaagcuguuagugcuuccuggcuggggcauuuccucaucaaaccaguuaacuuaccuuagccuuaauauccucaucugcaaaaugagcaguuugguagggcucccgguaagaggguaugaauagaagaagcagggagcucuugccgcuagcauuuucugaguuuuauggagugcucucugcggacggcguccugccaaguacuuuaccugcuuauuucaggugcuuuauggugaccucaugcuuuaagauaaggcaacugacacccagggaaguuaaaguggccacaagggcaacagcuccagucuuggggguuccccuacagcaauauccaccuuugccagcccaccgcaggagacuugcugucucuaagugaccugaguuaauugguucagcuugacuuuggacugcugggaaauucuauuuuuuguuucccuuggaacaggcacacagucuucuccaguguggcugccugauugacucggcacugucuccgucacugaagcuguguguacacccuucaguucugcacagcuguuuuuagaagucccucuuucuucucccucccggaaagcugaggacugaguuaaauugacaggcugacaauucaucuaagucuuuuagguagaagguuaaacaaacaguguuaugccuucauacagaggcgucucaggaggucaggucagaguggagaauagagaauaguggggggagagagucuuaacuuugugggguguccucucuuagccuaggaagggucaacaagcuucuugaugggaucauaugucccacugucuucugagacugggauagggcaacaggccuucuuuucugcccugguaucccaaagugagcccuggcguucccugaacccccucccagcuucucaccacauucuaggggauuuuggguauaccuccuuucuuuuuuuuaaauuuauuuauuguuauauguaagacacuguagcaguauucagacacaccagaagagggcaucagaucucauuauggaugguuaugagccaccaugugguugcugggauuugaacucaggaccuuaggaagaacagucagugcucuuaaccacugagccaucucuccagcucccugguauaacuccuuucaugguuaaacccuuaaauacaucccaguuuugaaauucugacaucuguucuaacaccaacccuccgccaaauuuaugaaaaaacaaaacuguggacuguuuaaugacuucagaacaaaauguucaaagcgaagaauauugaaagguuuagagaaaaacuucucugagcccaguucaggggaacagaggguuaauacgagcacucacuuuguuucaagccaagguggacacugugaggcucacuggucucacccaccuuugguaaaagagucauuaggucuuuugagccuugaucuaacccugcuugaauucucacagucuagaacugcagagcuucgaagugggcaaauuuguuuuuuuaaaaggaagacaacccgcccuuuauccauccuuccuuccuuccuuccuuccuuccuuccuuccuuccuuccuuccuuccuuccuuccuuccuuccuuccucuuugagaaaggguuucucuguguagcucuggcuguccuggaacucacucugcagaccaggcuggccugaacugggagaucagccugccucugucuccagcugagccauuaaaggacaaccauuucuaaugguuuggcuuuucuuaaguuacaccuaaguugccgggcaaugguggcacacgccuuuaaucccaguccuugggaggcagaggcaggcagauuucugaguucgaggccagccuggucuacagagugaguuccaggacagccagggugguuacacaaagaaacccuuucucgaaaaaccaaaccaaaccaaaccaaaaaacaaacaaaaagcuacacuuaaguugaagacugaaaaaaaaaaaaaccaagcaaacaagaaaagccccacaccaacaaaaacaccaacacuaccucaaaaggucugccuuaguaaacuugugcugguuagagcuuuaccaguuaaagugaacuguuacuaagcucucuugggagguuuaguggagcauuagcaugguuagaugacacagucauggcgaaccaucuggggagaaauucgcaugcacugagagcuugaaaguuugcaggagguggugauugucaccucuaaguauuuuccugggguuucgccuauuuauagacugguguuuaaaagaaacucaguuccuugguuuugcacaucaugcuuggcuggcccugaccuggggccaaacaaaggccuucaucuugaacuuagggguuugcugucaaguuggucucagccucuguauucggugaguuuguguuuagugguaggggguguacaggagggaagggaaaugaaaacuuuggggagcagagagcuaggcuucugagaaagaaccccuaggagugucuuuauauuggggugauguaagacgauggccagaacuggggugcagcagggacgcuccagacagaagugagguggguaaccaucaggaagcacggggagagaucugugucuuccauuguuugcugagacccucggacuugucugugaccauuccacccugccccugcucaguccugcacagggucugaagugauuuggguuuucaugcauuuggagugucugcagccacaagagcagcucgaggacagggccugaaucacaccacaaaagucuuguuucauguacaacagguacaaacacccugagagugguuucuauggacuguaguguaccugcguugugguucaucgugaggucaaguauagacuuuuccacuugggaugucccguuagugcuuagucagaaggguuugacuuggagugcuuuagauuuucagagaaaaggauggccacccuauucaggacuguauggagugccgcgugcacagacauagugaacuucuaaacuguaaagaauccaaaagacuuguagggguggugguggugcacgccuuuaaucccagcacucaggaagcggaaguaggaggagguaucucugaguuugaggccagccuggucuacagagugacuuccaggauuuguguagccagggcuacccaaagaaacucugucucaaaaaacaaacaaacaaacaaaccaaaacaaaaccuuguacauuagugugugggggguggggggaaagcacacacacacuguggccacgugguugaggucagaggacacaaguugacucuguucuucugccauguggugaguccccgggaugaaacccaggcugucagucuuggcagcaagugucuuuacccacccagccauuucgguggcccaagaagacccuccuagagcauuuaauguuagggcuagcuuagugcacaaggucuuagcacaugcuagacacguguaccacaccgagugaggugcuuucucagccugaauuuauuuuuuauuuguuuuuaguuuuuuuaaggcgggguuucuuuauauuuuuucuuuuuggcuuuuuucgagacaggguuucucuguauagcccuggcuguccuggaacucacuuuguagaccaggcuggccuugaacucagaaauccgcuugucucugccucccgagugcugggauuaaaggcgugcccggcuaaggcaggguuucuuaauguagcccuggcuguccuggaacuuguaggacucuguagaugaagcuggccgcggauauuuuuuuaguuauaaaaaacaaauauggagucuggagagcugcuucagcaauuaagagcaagucuuguucuuguagaggagccaaguucagcccccagcgcugacguggcgcugauaccuuacuuccuagcuuucaaggacaccugcauucaugugaugugcacucaccuccacccagacagacagacagacagacacacacacagacacauacauacacauguaauuaaaaaauaaagaaaaguaaauguuaaaaaaagucaaauguacuaucuucagcagguuugagcaucauccagugcuaacgagguucucacuguugugacucagaucugaguugcuaacccuugcuuuuuguagaaccgaaacuucccacuaaucagcaccucuccccaccuucucacccagucacuagaaaccaccguuaugcucguguuuaugaaguugcugcccucaaaucuguuggguagaugaaaucaugcagcguuugucuuuugauguguagcauggcaccgccguuggaaaacuguauggagguccuuuaaacaguuaaaaauaguccugccauauaaugcgcuccuggagcaucugggccuauaucagcccaguuuauuugcauucuaguuuugcugugaugagaauggaaccucaggucuggcauaugcuaagcaaaugcacucucgccaagccacaucccaacugucaacugaauauucgguuuuacugucuuuuuuuuuuuguauguauacgggcauuuuaacugcauguaugucugugcaucauguguguguagugaauaaggaaggcagcagagggccuugcaucccuuggcuggaguugcagaugguuguggggugcuacguggcugcugggacuuaaacccuaguccuucuggaagagcagccagugcacucgaccguugagccagcucuccagccccucgauggaauauuuucaacaugaaaguggguggggaaggauggcgugggucuuccccuuccaaagcccccagagagguauaauuuagcaccauggugcuugaggugcagccacaggccagagaggugagggucagaugacagagccuugugaguguagccaaggaauuugaacuccaucaaauguuugccauuuucaagaggggaaguggauaacauuacagaaaguucccuccuucuucacagccauuuacaacuugcaaacaguggaauauucugacugaaauuaaauuuccguaggccgagccacucacucugugaguguucugauaaggacgccuccuuccuuucagcuucuggugaaaugggaguguggcuuuucccagaagcucauagucuuuagccccuucuucaccucagaccucauuaaggugccucuuuuccuguguaggucagggucugggauggucuacccagacacuccauuccaggcuaccuuucccagccguccuucauguccucuuguggaaaaggacaggauaccaaaguucuucuugaagccuuuugugagacuuaacuccaauccuuaaguaaccaaaaaccccaaugggcgggugguguggggggcuucucuugcuggccagcuuuucugugcaggaagccucaaaaaaaaaaaaaaaaaccaaaaaacaacuggagggucuugagcccuugagcucagucuugcuggggagaggaaauugcucuggggguggcagagugaggggaaaugcagacugacgugccgagugaugggugacagaugguggaggccagaggggaggacacgguugcagggccuuggaaguuucacuugccauuuccagaagucugcgcaagaacccuuucucuggggaaaucagacucugaagaaacaaaacaaacaaacaaacaaccccagccucuauccucagggaacccuggucugcagggggaacaacaaggagccaccagcagguugguguuagugagcguaccuggaauauccaguagugcaucauggacacauggguuucucuucuccaauguaaggaagaaaggguggcgaguggguguggguagcaggccugugagcauacugugggcuccugcuugcuaugcuaggcaagggacuggcccauuuucuguaucucuagaacuaugggcugggacuuacugcuguucuggauguacacgguaaaguaaagggcugaggcccacugucaacuaagccuuggucuugcccaugguuaguuaguagagcuggugacuggagcacacaggcaugggccagggggagacuguuacuaagaauguccuuggccaggugccaucaucaccucacagaaaagcaagcagcagcaaaauagaagagaccaccgugauggucuucacugucgaguugccauggcaacacaccucuggguguaucuaagaguguuuccagaaagguucagcugaucugggaagacaccucugaauauaggcaacagcaucacauugggguccugacugaagaaaaaggcaaaagcaagcugaacuccagcauucaccucugcuuccugacaaaggacacaauagaaacagcugccucacgcuucuguugucaugacuccccugcuguguacccucaaagugagcucaaaucgacccccuaaaaaauuauuucuaucugauauauauauauauauauauugccugcaggcaugcaugugcgccauaugcuugucugguuuccgguccacagaagucaagaagucagaagagggcuucagaucuagaacuguacuuauggaugguugugagccaccaugccguuucuuggaauugaaccuggggccucugcaaaagcaacaagugcucuuaacuaucgagccaucucuccagcccugcagacccucccuuucucaaguuuuuguuaguuauuuuguaacagcagugagaaaggggaaaugguaccaggaauugggggagggggaguccuuucugugauaaaccuggccuguaggucuuuggagcugguaugcaugaggaauguauaagaguuuggagcuacaagcuagagaagcccgaggaugcuugcuguaagcagaagcuuagugggccuucuagauugaguuuggaagacuagaaugcccgugccuucugugcccugaugugauggacuauaugcucuugaccuuugaaaggcagaauaagcccaucuuccuaaaguugucaggaguuugauuacagcaacaagaaaaguaacaauacaaccacagaggucacagcaugucugaggccuugugauugggagagugaugaaggcuggcacccaguucucaugcuuggaaccacuuugcuguccauucggcuguguugaugguugaagaagcaagagggagggaggcugagaaauggaaauaugccacauagacuuggugucucagaaccuuuuggugcacagggguaauguaagcauucaggguguugaugggugugaccgagagcaaguugucuccuccaugggaugcaaaaguggugcuccacuguaucagggcuuacaccauacaacagagaaccuaaguaucaguugcucucuguacccccuuucucugggcaucuuguuccguacauccccacaguccucgucaugcauuuuuaaucuagaaacuggugucaaagaggaacccagaaagcccuccuucaugcugcccaccauugucuacuccuucccagucaacucaguucacuccuugauggucauaaucaacgcuugaaaaugugacuucucccuuccagucucaagcuccuccuggagaagccuggguccagauagccucaggacugucuuccuuaggugguggcugugcaggguuggugaccacauuggaccuucccuagagacaggacaguaucagcacucuuggggcucucuugguggccagggcucuuugguuagguuugcaauaugcauucuuuuuucucuuacccaucuaaauauuuaagcuuccugcugaaauauuuaggcaggacuguguacuucuggcuguugucacccacucccccaugcccugcugugaucuaacugcagcuguuuagccaaguccuuccuacaaaggggcaugugugucccaagucugugagaaccuaugcaggauaguugaaggaaggacuagcuuggcucuauuguguagccuggagccugguccuguaggccaccuggaaucuuaccagccucaucucggggacugcacaccuugggcuccucuaauugucugaauugaccuauacuugaggauggggaaagggagccccuauuugagccauugugaagacaaaaccugaucauaacuguaguccuagucuuacccuauacauuaguucgugcugugugacuuuggccagauuuaauuaccucauguccauccaucuaugaagagggauuggagugccuuuaaguuauaagggcccaacauggcacaucucccuguccccagacuugugugauaagacccaguucucaagauguucagugcggagguaagcgcuugcuucauguucccucgugcccagguucucaguggcauguaccuucucgugaaagucugaugaggaagagaccaggccuuuacaaaaucaaagugaggugacuuuaaccagguaaaggcuuuggucucucacagacuuugaaagaaaugaucaguguuuacaauagugagauggcccaguggggcuaggugcuuccucucaagccugauaaaaccugggagagaacugaccccugaagguuguccucccaccucuacauuugugccgugacuccaacacgccauacacaauuaaaaaaaaccuuuaaaucaauaaaaagaguuuauuccugugcuagauaguguuauguuaacucgacauaagcuagagucauuugggaaaagagaacaucaacugaaaaaaaugccuccaccagaugacaaggggacaagccauuggugcguugucuugauugacaguugaugugggagggcccagcucacugugggugaugucacuccuggagugguccugugugcuagaaagcuaggugagcaagccaguaaauggcauccuccauggcuucugcauuagcuccugccuccagguuccugcccugacuuccuucagugauggacagugacauagaaguauaagucaaauagcccacccuucucaaauugcuuuugguugugguauuuuaucacagcacuauaaacccuaggacaauugcuaaccccacccaaccuugccccuucaaacuugcucacccccagcuccacccugcugugcuuugugucaauguuuccccaagcucuuccugggaugcuggaugcccagguuguggucgccaaguccuggucuucaggucucugcugggcgcugggguuggagggagaagcugugguuucuacuuucaaggaaauauccaggucucacagcagauaaaaagcacgugcugaucgugaagacccacaagcaugagcacacaccauaugugugucuccaucucugaggauguugugccuacuccugguccuuccugcaccuucaggaaugccuuugggcuguguucuggggaaaugaggaagguaaauguaauguggaugggcugggguaggccaccuguauguguguaugccccugcccuuguuuaaucuacagagccuugccaggaggagcugugaggacaggacuguuugcaggagaggaggugccucucuagcugauagggccuguggugugacagaucuagaccacagccacauuggaucuuuccaccucuugaccuacacacagggagggagcagaaguguuugcaggguguuuccuaucucaccuaggugacgccacccagucuucuaaaaagcuugcagaugcaggcuuugugcucacccuacccucccuccaccuugccuuuuccaagagucugcagaaccauucauuugacaccuuuauucugucucuuccauggacccaguacaggaaggggcccucuccauccuccuccuccauagacaaaugcaugccauccccuuuguuggauuggaaaccagggccagcuaagggccugccacuaagcugguggcagaacugucuugcagggaugucuaaccuguuggcauuacgugacauaauaugcaaauauguggagccagaugcauagcucuccugggaugcaugugaccugugggcugcagguuggauguuucugguugagaggcaaauuuggucaguggagcagaacugcuugcagguguggcugugggccuuucuucacagagauaauucuuagcccauuucuaaaccugcacauguauguuugauauccuugugugucugugcauguugguguaugugagugugcaugugccaccgugaagccuggggguuaauccuuuccuuucaccuuucuagagacaagucuuguucacuccuucgugcagcaggccaacuggacugugagcuucugggaauccuccugucucugucucccaucucacuacugccucaggugacccugugaggugugacuugguuucuggggucagaacucugcagcacucccgugccuuuguaacauugcuuuuuaagucacagagguauugauuauauuuuggggugcagagccuccuauguuucgcuucuccuaaccugcccaacauggcccucccugagaucugggggcggggcuucccugcugaugagcguugguggaagaaagguaaauguuaguggggaagcucccaguggcgcagaaagaaggguguuuuucugggccaggcuagauccuggggcacaagcgcuccgacugagacccacucccaccuccaaacccacuccccaaggauuuuguccagcauugggcucagcuccccgagaaucugcacccagagagcugcugguuggcugguaccuccugcccaucguggagguugcaggaggugauuuacaccgaggaccccucucuuucccggcaacaaaacuuaaaaacuguaaggcuggaagagcuucguuauuuaagcagccuccuggagccaaggcccagcccuuuagagaaaguuacacaacuuugucuaagacaucugugcuuacaagggguggggaagugcaaugaagagcaauuacagcuggggggcaagcaauuaaggcagggaaggcuuugggggaaaguggccucagagggcagucagucagucaaagguguuaccacaccugucaguggcucuccaggucaccacccaaggccucuggcaauaaauccucccucccagcggccugguggggugggaauggggaggugaucuguugaucuuuagaucuuaggauucuuucugcugauccuaguaggccuugcagacagggggcuugaggucagccuuccaugggagguguucugcagccccgcaugccuguagcaugcacuuugacaaagaccucugagguuuauguugucccaauuccuuuuugagauagggucucacuaugguagcccuggguggucuugaacucgcuaugaagaucugacuggccuggaacucauugagccuucggccucuagaguguuggaauuaaaggcaugugcuaccaccaugccuggugacuuugagauccacuguuacagaugacuuggcaaggguggcaaagagaggcaggcacacagcagcgaugaaugguaugagguaaggauucuugcacacaguugaauaacauaaucuggauuacccagcuaaguaucugcuuguacccaggcaagucuggagccagagggcugcaaagcugcucuuuucagagacuugcuaagucuacaaagcacucuuugguuucauuuuuguguguguguguguuuugaaauagagucucagcccaagcugacuuugaacuugccauauaacuaaggaugacuuugaaccucuaccccgcagagugcuggaauugcaagcauguacaccaccaagaccauuuucauuuggugcuggucauggaacccagagcuucaugcaugcuaggcaagcacucuagcugagcuacccagccuucugcuccacccucccgguugcuccuagcuucaggaguugcccugagcaaugcucuuuggaauucugauacuucagguaccuuguccugcuuaaauagacaguguguguguguguguguguguguguguguguguguguguguguguguuuaccacuuuaggcaugaaaacuuucaaaucaggaaaaccuugguuauacaagaacugucaacauuaccuauaccuccagcuuguucccugcccccauuuacaacaccuccaaggggcccuuagccuucaugcaccugaucagccuccuguccuuuggcaagacugugggccuggggacagucagaaaggaccccaugagaaagaauuaaggagcuggagggagaguguaaucauuguuuauuugugaaguguugccugucaccucucucacuuagacccacacuugggacaggcaccucuacuuggccuccccaggguuagugacuccugccccccacauaggacacauagguuagugcuccagagagaaucuuuagucuuuuucuccaguggcucacaugccauuccaggcacagcccugccagggacaauuaggugacuuauaguaugcugagggcugggugggagaagagagcuuuauggguguuuauuuuggccaggguggcuuugggucuacuauaggguuugugcugcucccgugccccaucccccaagcaggauggaaguaggcaccuguccacagacccuggaguagaaugaaggacaggcccauuccucccuaucauugcuguucaaacaaaacucauguccccugggcuguggaaugcauccugccaauguuggcuuuggaaggaugcccuuucccucccaucaucccugcccccuccagagcugccaaggggauaagugcugagcaggcuaaguggggcaggcuggugugggagugucuugucagcacccccaagguagguagcaggaagagggagguuguccugauuaauagcuuuuccacacacacccaguccccucuccuagacucucaacucagcucuauauccauuggaauggcccagugagugggacucacuagccuguuuggggagccucauuugcugugugacugggccaggccauugcaccucucugagccaaagacuuguucaccaaggccauuuaaacagggagugccaguuguacgaucaguacuggucuaaagggcuguaggaaugaaaagacuacuagaugccauguuucuuccuuugaagucaguggggcuuagcaggugcugggggucguuaaccauacaguguuggaagcagguaggagcauugcaaacuguagcuaccauagguccucccaguaaggaaaugaacgcagguugggauguuaucccuggcauggugguaucuccugaugcugggucuggggguuaccuuccuuugagccccaucucucaguacacugcucuggaguuuugucauggccguuuucuuucucauccucuccacagggcucuugauuugugcccuguugcaucugaaacccaggacccuguauguaggguaaucauuaaugaacaaccauuaacguuccccuccgccucugucugccagcagcccucaaggcuagauguagugcugucccaggucuguccguggcaaaugucagugugcccaccuucaauccagaagaugucuaggcaggcucuccccauccagcaagcacccugcagccgacgguacuccgccccacccucaucuguucagcacucucuuggcuaggacauuuugucuaccaggcagguccauagguugcuggugaaggugugucaacggcugccuaggauuuugccuguauugcccucccacccccagcagaggaggugcaacuuuagugucauggaggacacuuugggguccaaaccuagaagguucuuguugcacuggagaugagcagagguguguugugacauucuugugaagcuccaagucaucgggucccccugcuuggucuguugggugucauuauguaucuuuguauuuguuuguguugaaggcaccuguguuuaucgaucaucaaauugguaugcuuuagccuguggcguggcauacccuguccagacaguauggaagcccugaagccugaauuacccggggcacggugguuuccacugagugaauuuuuaaaagcagguuugagguucaagccacacuucagguuuacaaaaacaagccagggaauggcuguaaguuuagcacugagucacggaaacucaauuuaaaaacagaagcuaggcagggccaagcuguggggacuggguuauugauggcuuuuucucuuucugccugcacauuuucuguaaugcaguuguauuguguuuauaacaaagaacuugauuuuuuuuuauggcacggaaugcacauucacccguuacacacuggccguuuuaaaguaugggggaacacaaggcugguuuuaacagaacauccucuaaagccccuucaguagucagugaacggugggagagaggucuucaguuaaauaaaguguaaccucugggaagugagugcucagagugacaagaacuuucuaaagccgagucgccucugaggacuaaugccauucauuagcaguagagacucagggccuggagcacucaggguuggaaguuugagaccaggcuggggagguggcuccauugucuuaauugaguucagauuuccacacccaugagaaaagccagccacagcagugugcagugugugucuacaguuucaaggcugaggaagcaggcugcagaguuccuggggcuugucggccggcccugcuagcccacagugagcgcuagguuuauugagagacccuaucugaaaaauaaagggaaagugauugagcaagacacaugugugugcacgaguacacacacacacacaugcacgcacgcacgcacacaaaaacaagcacacgaaguuuaagacugaucaccugaccuagcaggcuaaagaaggcacacagcuccauuguacaucgagcuggcucuuaccuggguugcuuggugucuugcucaggugagaggacucuccuggaggucuguaaacaagugggguccugaccucucuaugccuccagcccugccgaauuccuugggggcccaagaaaucucaccguguguuugagauuaccaggaaacaggaucucaggcgagagaugaagaaggcuguuguagccugaggcuuuggucagccugacaguccagggaaggcacauacauccuagggggagaugcagguaggguauguuugauauagauucuacaagugggauaugcugagaugugcguuuacuucuuaauaugauaucucucauugaagcuguuuaaacgaauaaaugaaaguucagaucgcauugcucaguccuuggcuggauuucaaguacucaguagccacaugagacugaaccgaugagccuaucucguagugcaaaguucugcucgcuggucuguuuucuguugcugguaaugcaauaccacagaugacuuuguacuuugugaagagguuuauucuggcucaguucuggcccauggucaaggggcugugucugaugaugggcuucuuguuggcagcauccugagguggugcaucauagcccaugcagaaaaacaaguaucuaugaugguguggaggggccccacccugaugacuuuauccaauccuuauccccucccuuaggcacagcucagaaagccauaguuggauuaaauuuccacccucuuagcaucucaccauggggauuaaaucucagcuugugaaccuuugugggggagggcacuuacaucauaucuaagccacaggcguacagcacaagggugcugguaauaccgcauauuugagugugccuagccaccuuguauuccugaucuagggagggcugauagcauauccaagacaucuuagaagauccuaaaauggggagaggggaggugagaugggcuugugcuuuaaguggguggaaucuauggcuaagugauugccucaguccuagcuuauuccugucugguuugcuuuguuuuauuuuugagacauauucuugccauguagcccaggcuagcuuuggacuggugauccuccugcuucguucggccucugaguguuaggauagcaggcgugugucaccgcgccucgaugccucucugucuuugugccuuuguuucccugcuuccagccuuuugcuuucccuugaaggggccaguauggcuuguucucuuguucugugaccucucucucucucucucucucucuuuuuuuuuuuuuuuuuuuuuuuugagacaggguuucucuggccucugccucugccucugccucugccucccaagugcugggauuaaaggcgugugccaccaccgccugacuuguucugggaccucuugugguaucuuuuugccuaacuuccaucugccagccuaggcucuaccuuugccugguagcagauccuccugggcaggcaguggcuuguccugccuguguugugccccuuucugggcacauggcuguggcucagcaaagucgcaaaugaaucaauugacuguguuccaagcugcaugggacagggaacagccguggcucuggucccaccuuuggguuacauguguuaagugaucacccugcauauggguggggugcuggucccuggcuaggcaggcaucuguagcagccagacacaguugccccuuugucccuccauagagaggaauggcucagaguccccuggggagaauggacguguaaagaaaggccuccuguucucccaucucucccuguuuuucccuggauugaccagaagccccauguuagaauggggagggccaagggcccugaagagggcaggaugagucaugaagccugaugcuggguuguaguucuauuauuguugauauuuuauguguaugauguuuugccugcauguaugucuguguaccuggucccccagaaaaccuaagaggggauuggauuccccgaaacuggaguugacaggugauugugagcugccauaugggugcugggaaucaaacccaggucuuuuggaagagcggcaagugcugcuaacuuccugagccaucucuccagccucuaggguaguuuuuaagugacuccuguccuagcuccagcugucccagcuccagcccggggacucuacuuuagcagaugugaggauagauggccccucuggcaauuccaagaaaguccuuccugcugcucuguuggaaaacagcucacaggaggacaucugcuucucuguuugacccacaggugacuugggaauacgaugacauuuguucuuucuucuuuuggucauccaugacaacacccagccccacuuuccccacagccccuaacauguauagaccgcaaguuugugguugaggaacaucuuccuggcuucaucauugcuguggacccuuuggaaaugcugagaggacucuauucugugagcuggcgggagguguuaguauuuguauuuucucucucucucucucucucucucucucucucucucucucuggcuuuucaugacaggguuuuuuucuauguaacccuggcuguucuggaacucacucuuuagaccaggcuguccucaaacuuagagaucugccuccugagagcugggacuaaaggcguuaaaguuguguauuuuauaaaugaagaaguggaagccaugauugggggacgaggcaauagcuggcauggacagaccugucuguuugaauguucaccacucaguaggaagcaugagguguugcuggguucugggaagggggauaaggacuuaaacaauaugaggauuaguuuguuuguugcuuuuuauguagccuuguauuuccuugaacuugggggaacuccugccucguucuccugaguucuggagugacguguguggcccgugcugguauggaggaauaaauguucuugcuuaacaacacagcgugcacuuagaaggcugaggcaagaagaccacagaacuuggggccagucaauugugggccagucugcacuaccuagugagaccuuguuuaagaaaaacaaaauaacaaaacaaaaguaucuacagcucuugggagaaggaaagaggacaggguacaagcugggcaggguccugcuuacuucuggccccuagcguuagcaguaggccccugucuuugguaacauucuugugcuagucagcggagguuuccauuuccuguugcccagcuugucccuggucccugguuagugagggugggagauuucuucggcuccuaccacaacccuuaccucagccuggcccauauguccuggaggggcccuggcuguguuuuuccaucaccucaguacagaauggcacuuugcuuaaccuggucacauccuacacuguauuuggccugugaugaucaguggacagaagaccauucaugcaggguagacaagcagagucagcuauucuggggaggcucucuguuuucccacaugccugagugguggggccacuuucccccacacugggcucuguaugucaucccugucaucagaaccccuguggugagauuugagagggagagccuauuuggggucaucaucccuugugucuuauccaaugguuuggggguuguaggguaucauggucucaagcugugacccaagucuucuaguggguugacucugggucucagaagccauugaggcagagaaagcauuccucacugucccuccuccugacccacagagugcuguccgugcuaagaugccugugcccgguuccuggcaguuucuuguacaauuuauuccagagaggauggaggccagcuguugucugucuccagccagugacuaaaguagaggaaaugggcuuggaccacagccgggggugaggugggggcuggggguggggucagguuagagucaggcaauaaggaaaggguuucgugacaggugguuggcucccagaaggagccagcagggagcuuugugcaguuggggcaagaucaugcuuggagcauagaugaaugacagccucucuagcaccccuguaggcuuuuauuuuuuuaauuagugaaaagguuuacaguuuaaccacuggucaucuuaaauuauaaucaguggucugcuucaaaaccccuuaucaucagaaacccagccuuuaaggaugagugcuuaguuauucauuauccaggcugacagcuacagguagaagcagggauaugcccguggggugggaaagcuugcuacauugugacauugugagagacacagugggacagaguucaaccacacuucuccaggggucagggauaagggccaggagccggcauccuccuggggaggcaggagcuuggacacccuucuaggcaagaguccucagaacaggaccggcugccaccagaacugggaugcuacagggaucuggaagcacuaccucuccucuuccaggagaaccugagguaauggugugcaccaagagaccuguggaccuucagccagccaccugggauaucccucacucagccccacccuccccuccccacccagucucuuaccuuuggaaucuaguuccaaagucgacaaggaauugacucaaugggccagaaccucuguguagggggaaagccauugggaucuggaaccagguaccacccccugcacuaguggugcgcccuacccaccucagccaugagggcacucacaucaugccccagcaggcagguaucccagaaaccccaucauucguugguuaauaugggaugcuauccagcagguucugcuuuggguuucauagugugagugacaucugccaucucagcacugacccauucaggcaauauucagagugagcuagauaaacagaugcccaacagcgugaugaagugugaugaaggacugacuggaaggaggaccggagaaggugauagugaagaugaaacccgauugaaggaagaucaugaguccugugcaggggccuacaggaacacacaaguggaaauccaccaagcuggagccacuguccccaucucugcucuucaggguggugauggucagaggcagugucucacacagcugucacugcccucagaacauaggccucucucagacguuucgauuuguguguagaagaaccguggcuacaucagucuuucuuccccaguacccacuuucagaacaugcugggugcucggcaccguaauuccuaugcuagcccaaguggaaucaugguccuccuaguucaccuguccugauguuaaggcaugucccagguguccugcuugugacgcgagggcuugggaugucugcuccaaagucaggaucuuugcccuugaguugcucccaagggagggucccaaacuuggcacuugggggcuuugaagugaacuucuagacacacauguucagggcagaccugggcuacagacaccgggaagcaagggucccaaacuuggcacuugggggcuuugaagugaacuucuagacacacauguucagggcagaccugggcuacagacaccgggaagcaagcgugcacgcaugcacgcggcagggcagcugagcugcaggugagccagcucuuuccuagguugucugccguggauggggaguugaccagucagcaguucccacggugaccuccuuuguagccugcucaaggugcuguuuuuagaaaccuugagcaauggcuuccuguggucacuccuuccaucucuccucaaggucggacugaauugaauagaguggggagccuaaguguacacgaacccuaaaguuguagucaagauuagauaagggugugugucuccuggagucuuuuuuaagcuuuacaaaaaacuuuccuuugacaauuccguacaguguuuucagucauauccaccguagcucccccccuucuccauaguuccccccaacauguggccugccugcuaucacgucccccuaauuagcguuaucugugugcacaugggcaaccuacagggagccacaaucccuaagaaaaguaaucccucauucccuagcaggcgugagcugcccagcuccucagcuagggcggauggguccucaugagccaugcuggaguuacugacagaccuuguacagguaaccaucguggccgcgagucccugaguguaacagcgugcgccaaccucgagacagcacuucuuggcauucaucugccucugacccucuuuuauaguauucucugcauaguccuugcucugcuguaggugacaggugacauuccccaacacaguaccaggguugacacuggagaaucagguuuuucugugcaaagggacucuacucucccuuuggcuucuuauggcucugccaccagcuugcuugugugguuucaaccaugucacggacccccucagcagauuccucacguauaaauaguaagagagguguccagggcucucuggguauucuggcuccccuugaagggucuugugcuguagagagagaggacuggugucugcuguauggaggagcgggagaugcugacugacauaugagcuccuacaguuugauacgggagagugagggcacaggacugaaaggccugccuguuugucuggaagagauacauucaacacaggggcucuucccagagcccuaaaccacccuuggaaggaaaccucucucgcuuguaaagcacaucccaagccugguaggccuguggggccuaacugaagccauuacccucuuggcauuggucagagcagagagaugccaggcauuuuggguugugaauucuggugauggaaagggaugaagucacaaacccaagguccaguauauacuagcacagagcaggaacuugggucacuugggggagggcaguggugguuaauuggggcucagaggugcugcagggagauaaaagaugccccuuuucuugucuuguuggccacagguaaguucuaagagcuucacuccagagggcccagcuggugugcauguuugggagggaagggcccuuuccuguuccccaaggccaguucuugggcaagcagcuguguucugugacugcauccauacacagggacuuccagcccuccaggugccccagcauccuugcugacauuccauccugaggcugaccuccuccagccuuucacuauacuccuggcucagccagccccugccaaacuccgcucuacauucaugggaggagugcuggcugccaggaacagggcaggugaccaucucccaggcugagaacaauagggacagaggcaccugccuuguuuucuuugucccuuccaagugaggacaggguucccaggccugugaaagucggaaacccagaaggaacugcuaaaacccugccgcucccuuuuggcacagaugugcucccgggaguucgagagagcgugagaccuaggcugugucucugagcgccacagagccugcugagagacagcccagugagggcagcggggggaaucccaaagcugggugagaggacauucacacacaaagugcugacugggagggugugggggaggagggggcagaccuucaucccuuggauucaggguagcuguuggaaaauugcuugggaggauggggaagacgauuuagucaguaaauguggagaaccuagguucacauccaguacucaaguggaaauccagguacagagagacaugcgugcgccucuaaucucagcccaggggaggcacagacagguggauucucggagcucucuagccucccagcguaacugaaucugugagauccggguucagccagagaccuugucuaaaaaaguuaagguggagaggaacuaaggaacacuccagaggacggucggucggucucuggucuccacaugcacacacgugugcauauucauguuuacacaaacacaccacuugcacaugaaaauuggcuauguaguuguuguuagcaccuccugggaaagccuuugaaccucacuuuuccaguucaggcccugacuuucucugggggcuaagacgaagcuaaaggcuuccccuucccuauguuaagguacuguccaggucaagaagccacagaacagucauuuuccuuugugguuucacuuucuacaaucucugauuaccuauggucaguugugguccagaaguauucaacagaaaauuccagaaguaauucaugaacucgaacuaacuaacuugugagucacaugaugaaaauucaugcucuuggccgcuuccugccugggacaugaaucaucccuucucauccaguguauccacacugugucugcuaccuacccauagcucagucacuguguuauguugccaugguaccgguaucauugguccaagaaauacacagcucccuguuuucuagcaucuacuaugcugucuuggaaaacaccugcacggauuguuaaugcuaacauggauaaguaggauaggucuauagugucccaaugcaugcagagaguaaaugugucauuucccacccucucucucucucaccugugcuccggcugguugcuucugcagugggugaaggaacagcaggcugggugggcacuggacauacacuccuucaaagacaaaauaugagucuagacaggaaaggggccuucccuccagugugagcuggguugaggaagacagaaggcaaacuguuccuggcuauggggcuccugaugugggagcugggcuaaggcucaauaaauuucgaugcugauagcaauauauuuugaacaugcuaaagagaagggguaggcgaggaaaggugcuggucugagcaguagaaaacugguauuuuaggagguuguggucagaucuuguuuuguagagaagacgugggcagaaaggcgaaggguuccuagagagucuccguucuugguaugcucuaacagccaagcacacugaggaaggaacaacgugguguggcccuccccugggccauccaucaucuguccucucuggauaaggcaaggcugcuaugagcugggccuccagcgggcccagggagggaguugguacuaaugggcucuugccuauaccucgcucugaacuauggcugcccucugagccucaccccagucacccugaguuggggagaaggcagugaagaaauaccaggaauuccuuaucccugcccuauucccccugcucgagcuccacagcucccacuccaugccagccugcacuaaaggcagcugcuaauguuuuuuguuuuguucuguuuuucauuuugcuuugagagaaauugcuuucuuguuggcuugcuuugguguguguuuuugaaauagggucuugguguccagguuggccuugagcuugugacucuccucauacuucuccuggacuguuaagauuguaggugugugucaccauggggauuguuuguuuguuuuuggagacaggguuucacuguguagcccuggcuguucugggauucaucuguacagcaggcuggccucaaacccacagaaauccuccugucugccuccugagcuuaggguuaaagguguguuccauuaccaccugacaccuuuuggagaauuuuuaaaaucuguggacacgugucugcagggcuugguauuuuaagcuuaaagaugguuccuuggacagugcagccuggucuugagagucccugccucacagugacucuguauugucaaaaucuuaguuucaucuaauauaagcaagccuuacaucucuucccaaccccaaguuaacauugagaaaauaaugcaagagguagaguugacuuggccuggucugcaauggagaugcacgcgcgcgcgcgcgcgugugugugcgugugugugugugcgugugugugugugugugugugugugugugugugcucauguacuuguauguguaugacagccagagauuagucucagaagaagcccgccucacuguuugagacuggucuuaguggugcccucaggcucacucacugauggacuaggcuggcucaccaguaagcuccuagauccuucugccuccacuuccccauugagaucacaggcuugcgggacuuuuuacauaaaugaugaagauggaaugaguccagguucugucccaugcuugcaccccaagcccuucacugaccaaguuaucucuagccauuccaagauauucuuauguguccauaaaucccaguggggauuaucagauuggauggaugccagcugcucagcugggcacacuaacauucccucaucucccacccugauuccuaaguugcuuugguguaugaagguugguuuggggucucccuccuuugaccuaugccugucuguagcuuuaaaauuuuggcagacguuguacucaguauguuuaccuggcauguaucuagcuguuaacuuuuguacagagaaccccuccauuuaacguggggucuucauccacccuuggcuucccaccugggaggggauuguguuagagacauggacauggacagcaagugacugugaggccagugucaggcagacuuuuguugacugugaagcuugaaacaguagggggguggggagugagggauuaaguucagagaaguugccaucuguccccuccuguccuccaccucaccuggggagugcagcgcuaaccccuauucaccuagacagccuccucuguugcuuaguugaauggcagacacacuauuagggauggcccagaacuggaggcagggggagauuagguucccuucugaagguaaggauacuuuauaugugccugaguuucuuccugccacgacaccuaacuauggagacguagugcuuucuccauguggucugaggaagccaagcgauaagaggcuuagggagagaaaggcuucucacugccucccuucuaggcaugggcugugaacuuguaguccuguccaggguuugccacucccuccuguccuuuuuguuuguuuguuugauuuuuguuuguuuugggggguuuuuucaagacaggguuucucuguguagcccuggcuguccuggaacucacucuguagaccaggcuggccucgaacucagaaauccuccugccucugccuuccaagugcugggauuaaaggcgugcgccaccacuaucuggcugggcaagugagucuuuagugggaucucaugucuacagugucugugcuccugauuuagaccaagauagaugagcuagcaugcugauggcaggcacacuuggccagcccucacgggggccuggaugcuccucuuguguucagaagaugcaggccaagagcagccaaguacuuuacccaagccuuguugcuagccuuugggagaccuugcccagcucaaucucagguagguccaacugguucuguguguagacagccuguaucugagauggcucagcuugucaucgccgcaguggacugucugugacuaggggugagugcauuuggagaggagagguuggcaaagagucagugaagcggccaucagucagcguggacuucuauacucccuuuccugcucucgcuauauagccauugccuuugugaggguuuccggaggugaccgguguccuuccugcaggaaggacaaccugguuaccccauggguauuccccuagcgcagccauugcaugcucuguugccuuuccucuggcucuuucugccccccuaacccucauccccucucuagccuggcuccuucccuucccugggcugggugcacagucccguggccuucccaagugcagugcucagcucuauccagaacacccacugcuucccccgauucugcuggacagaagccucugcuuuguugcagauaaaacuguuuaaaacccaacugcagccagguaugguggagcaagucuuccaucccagcacugagaugcaggggcaggcggaucucuguauaaacuugaggcccacuuggucuauauaggaaguuccagaccagccacaaccauacaaugagucccuaucuuaaaagaauaaagcaacuuuagaauaaugcucaaagauguuggggugugugggcauuugaagacaaaugagccgaggcuggaguaccccauucuucauucaaauucacuuaacaggaacaggcacucagucgugcggugacuacucucugugaggcagagaccuaagcuccaggaauacaaagccucuucuuggcauuuauacuacagggaacucuuuuuuuuuucccccuggugacauuuaacauuuccuuugugauugucugaggcaguguguuauaaaucugacuucauucuacuaaccagcguacccaguguuccaucuucucccucuguacuguagugguccugccugaauucacaucccagcucugccacuuaccuuggacuggacccugcuuucuuaucguuaaaauaggcuaagggucccugcuuugcaagaccuagccauuccgugagagaaguguuuuaaguacaugaucaguaccuguccccacacgugcccaacuaucacuucagcagcuacacaguuaagagguggugucuggaaaagccacaguaaggaggcugauaauggcuucaguauuugaggucuuaagcaccguggacaggugaagugacuuuccagaacagagggacugugugagcacaaaggauuaaagaagggauccagaggcagccagugagagcacgaggguucuggcucuuggaacaccauaggacugcaguuuuccaggucaggaguagaggauggaagaagggcuguguucgggaagccauaggagucgugggagagaucaaauagcugcauggaugcuucuuagcuggaaccccugcaguaggcucaugucuuggccaguuccccccacccuaugcaaagaaaaguccaccugacugcgguggcguggucggucggugucuacagguuagagugggcguguggauguuggccacuagaagaccugcugggaauggcuggacugguuuuugggcacuguuuucucagcuggugggaaagguuggaagugugcauaggucuccuuccugugcccucuguggggaaagggggcgggaucaccaugguuaggacccagguggcccuggguucuagucccagccuuguagcuuuuaguaccaugaccucuggcuacuuccuugcuaucucagccucagacucucauuugcaacguggaaaaaaugauagugucuucccaguagaauccuguccucauuaaaugagcuaaaaggcacguaaaaugcugagcacaccccuuggcucauaggaagaccucaauaaaucacgcuggcuuuaugaugaaggugacaaguagggaacucgauuccguccccaaacaggagccuggccuggauugugcaggcucggcucccucucuccaucacccucccagcuuaggaggaaagugaaaauauugucucuugugaguuuaggagccaaguuaaagaauacugcaagugaacaggggccaccuccucccgugaaagcuguuucucuaaccccgagaacaggacgccuugucuaacaggguuugccugccucccccccacagcccucccuugacccaggcauggcccucauccugggucagcucguuuguucugggagacugauucaggccucuuccucacccugugggauccaaccauggccaacugugccucuccaccauggcuccacacagugggaaaaagagucgcuggcccugaaguucgcauucagaccucagcucugugccaagugauaccuggcagaaucaggaagagccaggcaggugauggauguguccaaguccaagcaagggagugucuggccacagcggcagucuugugccccaucuugugaucaccccccccccccccauccuuguuccagguuuggcgaaaagccgugcagccauauuucggaauggugggcaggggaagaaacaguaaggggcucuggggagcugugcacaccacuaccuuuuucacccuucuuuuaagacacugugccuuuccacgauuguaguguuucacggggugaggggcucuuaggagagugaacgccuuccacaguuaucuguccuugaugggugacucaagagaacgcaacgcaagucacggggaaagcaggugagcggccgcuccugauaagccaggaagagggcgaggcugugugccucggaggacaccaccaccaguggggugagggcaggaagcccggcauugcuauccucuaugcuguccugauuuuucaguucuucugucaggggaauguuuaguacuuucugacugauuucugaauuaccgguggccuuugagucagccuguuuccaggggagcauugaggcauuauggguagggcugucuugugaaugcuauggcauuuauugccuuuggucagccauccacuucaugccaguauugucccccuguuaaccacgugugcaaaccugugagaagacagauucaauuguucacaaccguacucccugucugacauauaguacucccugugaacaccaucuccuaacccuccagaaacuacaacuaguccugaguagggucuccuguccucugcgcccccauauaaacuccuccuggacgaugcucaccccuguacuaaccgagucucaguagagaaucugcagcggcagaugguuauccucaaacacuucgaugauggcucucuuuggucuugagcucauugacuaccaugacguguauaguccgacacagaguuggaacaguguguuccuuguggccugaccuugaaacacaauggacuaggugucuccaacucuggacagguaacacacccugggauuuacuuuuuaccccguuuauugaucuguggucagcggagaccaagaaagaacucucccccauucuugcauacucuguuucguuuuagguuguccgguuuaagauuucuaucugauaacagguggggacuuaaaugguauugccuuuucucccaucuguuuaaugucaacacucggggcucuagacuuuccucauucuccugcugcagacagauuuuuaaaggcuaaauagcugcuaagguguggcuugguacccgagccauuucccaguaaguagguucagucucucagaauugaagggagaaccuguuguaugcuccugcuggucugcagcaucuaagaugcucuuacacauagacuauguaagauagucugcuuuccauggucucccaagcuuggaauggcagugggagguagggcagcaagcggccuguggucugauggggugucgagcgggcaugucaucauggaaaauucuucgccaaaguaugcagauccauuuacacagccucugcugcuucugcaaacugugcauuccuuuggaaccauccaugcguucucuccuucccuccaaaccucagucaugcuucggguggcuuagaaugauggcuucucuaccucuccguuguuuccacucucuggucccugcuguccuuggcuuggauuuuauaggaaacuuggcuggguuccuggucucuaggcugaugggucaucccagggcugaccuugaaugacagaacuugaaccccagauuuagagccccuaaugggucucuuggguacagucucuggcagcucuugguguauguagcucugauacugcuccuuuggucagaugaguugagagguaggcagagucgguguuuguaagugaggcagguagugguauguagaaccagguuugguauuucugggaaauuccuagaguagauaaugccugcccuggggcuuccaaccaguuggaaacuguagggaccgguacguuuggaucaccuugaaguacaauugccaccuguugaucugucucugucccaacaauugcucagcccaggucagagaaaagaaggaacucagagaaaagggagccugucacgaugagggacaggaucgggaaagguugguuuagcuaguuuacguauccugauacguauccuuggccucuaggauacugagcugaucucaguggucauccucaagugcagugguuaaaggcuccuucccaggucacagagggcuaagguauagggggacauuggagguaccuguauugagucugcccucuuagagauaggaauagucucguagcucuuggaguucaggcccugaacuccacuucuuggaaaccacauggaaacucuuugggagagcucccuucccagaagccuggggugcaagcuuucucagcucugggugguuugaggauauguuucugucaaauuuucgaaccaggugccuacuucguauaucucccuagcuguguggaccugaguagaucauucaaccucccugauccucucuguaaaauguuucagcuauauaauaaagaacugcuacccaccuugguauccuggugguuaaaugaggacacuugagauguguggcugcugcuggugguauuaguuuggggcaggggcucagguagcccggccuggccuugaagcauaauccugauucccuucccccugcuuucuuucuuccuuguuggguuuugguuugguuugguuuuugagacaggguuucucuguguagcccuggcugucuuggaacuugcacuguagaccaauggggccuggaacucauagauuuaccugucccuccuccuuagugcugggauuaaaggcaugugccaccauuggcgggcuccucuguuuccucgaguguuggcauuacaagugugugccaccaugccagguuuaugucauguuuggaauggagcuuagaguauguauguuugcuaggcaagguggacuccaccuuggagcuacaucucuugucacugauaaauccucuugucucugaccuucucuuugguuuucuuuuuuagguggugucugaugcugcggaucaggguguggccaucaccgggaaccagacuuucaacaacuggaacuggcccaaugcaaugauuuuugcugccacagucaucaccaccaucgguaaguccccgaacaccuucaguacaccaagauccacauccucacuccucagaaccguacaggaauccagcuuuggugacuguaaguuucacccuggccuuuugguuaggaaggacuuaguaagucccgagugauuggccauaccuaugcaaccacuuccauagguccugauuuagacuguauuuuuuuuucauuauuucugcaugccuauguguguggugugcacacaugugaguguguguuugcauuuguguaggcacacauauauucgaggauauauguguuuggugguccaagguuaacaucuaguaucuucuuugauuguucucuaccuuauauauugagauguggucucuagcuaacccaaaaauucaccuagucuagcuaguuuguucuagagauccuaugucugugccaccguuuguugggaugauaggccacccaccucacccacccagccuuuacauggcucccaagguucuuuauuccauuuggacucuucaagcagaaacaccagaguggcuugacggggagaaccacacuggugagauagacugcuuacugcacaaagccccauuguucuaugguucuguggcuuaacuaucuucacccuuucaggguuggcuggguucagcuaacaguucuuacgugggcucucuagcauaugguagucaaauaguggcugcccacuggucuggaguccagccuggcuucucccaccuacuguuugacucuugguguugacugcuggcugggguugaaugcucagagccucugcagcugggcacucgaaggaggagucuuccaauucagugcgugaagacaggaagcagcagugggcuuuucccggcucccccugccuauaucacucuggccaaccacgccacugauacucagauucacagacuacacuugacacgagcgucuugacacuugacacuugacacgagcgucugggcagagggauucagaguggccaucuuuggagucuguccuccacacugggugagggcaggcaucuuuguuuuauuugcauagcaguacccagugaucaguggaguacccgugggccucaugccugcccacaaggaacucacauaauggaggggacaaagccccuacuguagaaauaauuguauaauugaucagggucagggucagggcaugaucaggggaucauacauugauguuacuaaaaccagaucaguuuaucuuagaguguguuucucucaagcuagcauguguguguguguguguguguguguguguguguguguguguuguuguuguuguuguuguuguuguuguuguuguuguuggaggugguggcuccauaaucuuugcugugauccuggccuuacucuauucuccuucucagguuauggcaauguggcucccaagaccccagcugggcgccucuucugugucuucuacggccucuucggggugccgcugugccugacauggaucagugcccugggcaaguucuucgggggacgugcaaagagguugggccaguuucuuaccaggagaggagugagccugguauguuccuaaccuuagacacagaguuaaggggugggagggaccauggcaggggaggagagguguugggacaggugacccugggcucugugucucagcugggauaggaaucccuucccacagcugacuugcuuucucaccaacccugcuagaggaaggcucagaucacguguacagccaucuucaucgugugggguguccugguccaucuggugaucccgcccuuuguguucauggugacagaagaauggaacuacauugagggccucuacuauuccuucaucaccaucuccaccauuggcuuuggggacuuuguggccggugagucccugccuccuuccucugaccucugccaugucuaguucuaauucaaggcagaccuuuguugggcaccugauagauguuagucuuuucucucucucucuugcuucucuuaucccauccucaacucacuuggauucaccuugaagcuuacagcaacacacacacacacacacacacacacacacugagccaggauggcugccagacaagagaggccuucuccccacugcccugcccccucagcccugcuuuccuccuccuccucugcuuaauccccacaggcaaugaagagguucuuuguccgauuuguguaaaggccugugccugucccagccacccaugcucugugucuggugccuguggccugcacagccuccugguuccuaaucuugaaaccauucuggaccagugucagccugugcccuauugaccugcaccucagcucccagaggucacggcgccagcugcuuugcccagggggcagguggacgucaugccucugcccccuuuuuauguggaaugcagugagagggcagcugaguggguagaaggaacaggacgcuugcuuuagugaacacuccugacccuugcuucacaggccugccugcugucuggauauaaauuuagaggcacaacccugucguuguuuagucucaggggcccagagccugcugaggggaaggaagccugugguauuaagaaguccagugguaacuuuaggcauacuuugguguuccagagagauaccagauccauccuccuaucuuaagugucuguaacaauagccaccagcacaugggacacuguguacugaaucccucucaguccucaggugccgagcuuagaaaccagccaugugaacaugugacaucauugcugccauucauugugaucaggagccaaugcaguauugccuucagagcaaggcacuuccuaagucagaggcucugcuccuggcuccagggaagguugcaaugagggcuggggguuuccucuuccaggcccuucccuugacuaacuucccaccguggaaggcaggaugcagauaaagcuccaaagguuauuuuuaaaaauuacuuuuuuaauuauuauuuuauuuauuuguaugguggggguuugcacauguggaggucaggggacacuuuucaggaguuuguucucuucuuuuaccauguguguccuggggggucaaacucaggucuucaagcuuggcagcaagcaucuuuagcucacugagccauguugccugaccaugaaggaaaucuuaccuaauucuagaagggagaagcagcucuggagcuguggggugaaggugggaaagacuuucuagaguguguugucacagaggggcauacagaguguuggagccaccaaggaccaccagagagaggguuacacugaagagggccgagcuaggaaggcaggaaggcaggcuccgucuuggaggaggguaaagacaguucagagugguucuugccaggucagugcuuccugggucaucucgacccaaccaucauucacaguaaaucuguuaggcccucccaggggcagaggcugccagcacccccaaugucgacuuuccauuccauuuuuaacugugcugugugaugugcucacuagcugggaggaauagagaaaggagcagaaagauucacacucaggagcugguuauucaacaguugccucaaagagccccccuggggggagggagggagagagagagagagagaguuaguuaguuuugccuggauguauaucugugugccacaugugugccuagugacagaaagaggguaucagacucuuggaguuacuagaguuacagaugguucuaaguagccguguuggcacugggaaucgaaccuggguccaucugagagaacaaucagugcucuuaaccauagugcucuuaaccguuaagacaacagcaacccucaugugaauuuuguguaacaacccugacuguccuagacucacuuuguagacuaggcuggucucaaaacucacagcugucuaccugccucugccucccaaauguugggauuaaagguauccaccaucacgccugacucccaggcccucuuuuuuuggacacuggacucugucugcaugguguuauaucagccagcacagcucuggcccuugcugacccucugggcuuccugucuuuacaggugugaaccccagugccaacuaccacgcccuauaccgauacuuuguggagcuuuggaucuaccuggggcuggcuuggcugucccucuuugucaacuggaaggugagcauguuuguggaaguacacaaagccauuaaaaagaggcggcggcggcgcaaggaauccuuugagagcucuccacacucccggaaggcccuacagauggcuggaaguacagcauccaaggacgucaacaucuucagcuuccuauccaaaaaggaggagaccuacaaugaccucaucaaacagauugggaagaaggcaaugaaaacaagugggggaggggagagggucccaggaccuggacacgggcugggaccucaaggggauagacuacccaccaucccugcaucccuggcaccuuugguggucuauuccaagaaucgggugcccagcuuggaagagguaucucagacucuaaaaaacaagggacaugugucaaggccacuuggugaggaggcuggggcacaggcccccaaggauaguuaccaaaccucugaaguguuuauuaaccaacuggaccguaucagugaggagggagagccgugggaagcccuggacuaccacccgcucaucuuccaaaaugccaacauuaccuuugaaaaugaagaaaccggccucucagacgaggagaccucuaagucuucuguggaggacaaccugaccucaaaggagcagccugaacagggacccauggcugaggcacccuugagcagcacgggugaauucccuucauccgaugaguccaccuucaccagcaccgagucagagcucuccgugccuuacgagcagcugaugaacgaauacaacaaggcagauaaccccaggggcacgugaggugggccuggcuccccacuugcuuuccaguggcuuccucucacgaggauuguccugugauggccagaccccagggagaaggcucuggaaaugagauggggagccagggaccugccuuuccuucuguccucuccacuugguugcuuccaugggaugugguguuggcccaggacaggccuccguucuguggcccaguagggaggcugcuguccugggccugcccggcagguguauugcugauucaggcacguaggccgcaacacucacccuggagguccuggguuugcugcuugugucuucccccaucacucgguugacuguuguacgguucucugaggccaggagcuucagcugaguucaccaguguuaaugggcaacgcccuugugccuugcacuaagcuagacauuuggaaggaggagcucauaagacccagguuuggcaugugguucucggguguucugggaaagcacagauaugaugggguuuggggccucucaguaccccagcaguagcaggaccugcuugcccaaguaggcaucacugcccagcaagccccuuacugcaaaccucagggcaggggauguaggggagagcuauguguguccucuguguggagucaugcccaccucagauucccucugaacaacaacagcaggccaaagggucccugugccccgaaagugcagaagaaagauggagccuccggauguggucagggagcucagagaugaggugcaggccccucagccccagccuaggcacccauacucccagcccaccgucucauuucagagagauucucucacugccucucccuccucucuuagugggggccaaauuguucuuggcucauagaacugugaauugagccccccccuccagccacuauaugguauuagcauguguaacugccaaucaaugggcaugcgugugcacauuugggcuggggagaaaagaaaaugugaaucuuacugguccaguuccuagcgaggucugggaacuagcugcuguauauguccuugaugcucagcccacucuggccuaaaugcuuuuuguuauuaauauuuuuuaaugaacuguuauuuuuauacccagagccaguaaagaacagggucccugccauuagaauggaggucugucaggcacucuguuguccuuccaacucagcuuguccuuugucaagccaaggucuagcuacggaggggcaggcgcaggucucgggugaggggcagcugauaaccugccucagccccuuccccugcugugugcauuugcggaggggcauauagggccagagcccccacacguuaggacagugagagguguguauccauaccuccaccauuaucaaagcgguuguagaggccacagcagccucgguggggggaagagccaggcuccugugagaggaccucagcugaauguccuggcggcacaccaaccacgcugugugcaugugccgauggugaaggcagauguaauuuauuuuaacauuuuuuuacaauaaaacacaugaacaagcccac

SEQ ID NO: 7283 - RNA, 5926 nt, Mus musculus
ccuccaacagaucagcaucagcugugccugcuugagaggagccaucacauuugugaacgguuacauccacguuuguggaugaggagagggugaggaggcuagacucgggaggcuaaugggagagggguuccauccaugauggcuuuccuauacuguugcuguggggucacucgggaaccugucagucaucccucacccaguucacuugcagguucccaggagagaacggaccuuguaaggagauggcugguguuguuugccucucccuggggaagggauucuccccagacaccccgccuagcaccauuugcaccuugaagguuguucugucaguacaaaaagauuucucccuacccuuguuugcuuuucugcugccgugauaaauacuaugaccaaaagcaacccagggaggacagguuuauaucaucuuacagcuugaagggaagucaggacaggaacucagggaggaaccugggggcagaaacuaaagcagaagccacgggaaacgcugccuacgggcuugcauccuguggcuggcucagccugcuuguucauuaccaucaagaacuccuugccuagggcuggcagcacucacaguugguggggccuuuccauaucuauauucaucaagaaaaugcccacagaguugccgacaggccaguguuacagaggcauuuucucaauugagauuauccucuucccagauauguuugugucaaguugacaaaaacaaccagcacaacaccccgguaccaccuguccagggguggcacugcccauagugggcuggacccucccacaagaaaccauccccacagauuugccuacaggccaaucugauggcaaucccucagcugacagucuuucuuccuagaugacucuaccuugguuuuuuuugguuugguuugguuugguuugguuuuugguuuuucaagacaggguuucucuguauagcccuggcuguccuggaacucacuuuguagaccaggcuggccucgaacucagaaauccaccugccucugccucccuagugcugggauuaaaagugugcgccaccaugcccagcaugacucuacuuuguaucaaauugacaaacaaacaaaccucacaaaagacaaaugcuaacaaguacugccccauucuuuuacauagcugcaggguccuguuguuuaaauacagcaucauuuccaacuagucccuacuggugggcauuuaaguuguaaccaacuauuguaggcuucuguaaacagccuacaggugccauuuugcacgucuaaggucuguaggauaaauuugucucaggacaccucaggcucgugggucuuagacauugguucuguuuguguguuugcuuccgguguggcugacucauuguuuucugugugucugggauguucuuggccuuuauggcucaguucuuaagacgggaccgugagaugagguggcuugggacagugggggcccuuggaggagccucugaugggaaaugacaaagugcugggcugugaguggguugguaguggaaagggauggggugagacaccgcacacucagaagucugaaaggagucagccaagaccuaggccugauucaaucaaccuggaccagaaugaggguggggcuccucucuggaggcaucucacuuuuccacugccuagagugauucagagcaggacagacccccaccccauccccacccccagggugggcuuugccagccuggccugggggaagcuucugcccgguuucuguggagugggacagaacugugugugggaugacuacccacuguccaguuuaaaaccgagucuacaccuacacuuccuuuuaguguguguguguguguguguguguguggugagcacauguauauacaugcacgugccagagagcacagauagagaucugaggagcaaccuugaguauuaguguugagguuaggucuguugcuacauauuguaaugcuaauucuguaccaaaaggucuaggccucggagugaauucucucaguuacagacuuuuguugugcagaucuuguuccuuguuuaaaaaaaaaaaacuauuaaaaaaauaauuggcuacagacaaugacuggaaggauuagagguaaguggguuuugaguuacaagguuggggguagagaagagaaagcagagaccaggaggagaaggaagaacaaaaaaaaaaaaaaagaggaagccaucaugagaggagauggaccaugagccuguggccaggagaaacagcaaguaucugggguacacugcuggggaggcagccaggucagcaguuagaaaaguaccuuagggguuacuccccaguaauuaucaaagccaaauaaaacaaaucagagccugggucuuacuuaucugucaccuaguugaggauaaguuuaaauugguuguacuacauguuaguccucaucuuccaacuuguuggcuuuuauugauuuauguacucauuuagguauuuauucauauauuuauuuaucuauuuauuuuuguuuaaaauauuuuuaauugaaaauaguuuauucuauacaauauuguuuaauuaugguuuucucucccucaacuccucccaguucuuccccaccuccccccauccagauugaccucuuuucugucucuccuuagaaaacugggagguaggcauggcgacacaagccaucucaaagauccauagagugagcuccaggacagucagagcuacacaaaggaaccccaaaauaaacacagaagagaaaauaaaauuagcaggcaucuaagggguuguaguauaauaguauguaauguaauaauaugauaaaaagaaaaaacaagccaguugaaauagaaagaaacaaacagaaggaaaagggccaaagaaaaaucacaagaaacacauagacacagaggcacacacagccacacccaugggaauuguauaaaaacacaacaccagaagucacaauauauacucaaagggccuguaagguuuaaaaggaaaaagaaaaaaaaaaaaaaaaaagccuugacaacauucucagacacagaacucccgaagaugcucuugaguucguuuucuuguuggccaucuacaucugggcaugugcccuaccuauccucaaaagcaguguuuagauccagauauccaccaacaaaugaauagauuuaaaaaaaagugcauuuacauaaagaaaguuuacuaagcuguuaaaaacaaaugaaaauaugaaauuugcagguaaauggauggaacuagaaaaacaaagucaucccgagugagguaauguguucccagaaagacaaacaugguguguauucaaaauacuuauauguggauguagaugcuagcuguaaggccaaaugagacccaacugcaauccacagaaccacugauuagguaagaaagggaccgggugacagggauagaucucccuaggaauggaaaauaaaauagauaguuauagaugaaugagacaggaacaggcuggaacucgaguaucaaaaggggagggagggaagaagggaacaagagaagugagugauacggggaaggagagcugaaauuaaggaaggagucauacagaaaccugauacaguagaagcuuccugagauauacacauauaugaaggugcaauaaaugaaauugccaaauaacagggaagacagagccccaacucuugucaccaaauggaaauuccaguacuuggaauggcuuauaucugauuuaauuguugacccaaaagguuccaugggaaccuccaaacaacccagguuauugccaaggucacuuuucgaaaauugacagcaagaaucuauuguugaagacaauaccuccacuguuguucacuuuacacagagagagcacgcuggugcccacuuacagccuugacccuuaugggccgguguuauugggagcagaaugcacucugcauucuaccuacccaaggagaaagguaaacaccaacccagcucugaccuacgaugauguccugccugcuauauacacuaggccgacgguggcacaaagcugugggaguacccagcuaauaucugguuugaguucaggcccauuuuaucagcuggagcuccuugaugcugcuuggaugagcaagaaccugagaguagauaacccaggaaccuagaguaaaaccaaguacuacuguuaugaaaaaaauaauaaugaugacuucuaaugacauucugcuauacuccucguuggauuuuaguuuuaaagauuuauuuauuuuuguuuugcauuuugccuguguguuuguauacccccccaccuucagggaggaaggcggggauuacagacccucaguuguauccaacuuuuacacggaugagaguaauuuccccauggaaccauuaucuuccuagagccucugucugucugucugucuguccuucuuauacaugcacaccauguucccugccccuaggcuucagcaauaaucguucuuuacugccauccucaauucuuaaucauugacuagagcuggucaggugggguccagucacugaugaaugcaagaaucauguggucuguggaacagaugccaauagagacuccucugcccucugcccccaccucugcagccuuucugccuugggcuccuuuccaggcuccacccacccuugcuacugacccucccccacacucccaccccaguuuugagacucucacuagccuuugagguuaaucugggacuugcuauauaacucaggcuauucucccagccucucuguuuguuuauacuagaauaaacacacacacacacacacacacacacacacacacgcacacgcacacgcacacgcacacauauacauacaugaugguacaugccuacaauccuagcacucaggagguagaggcaggaggaacagaacucaacgucguucucaguuacaucaucaucaucauggauggauggauggauggauggauggauggauggacaagggauggauggauggauggauggauggacaagggauggauggauggauggacaagggauggauggauggauggauggauggacaagggauggauggauggauggacaagggauggauggauggauggauggauggauggauggauggacaagggauggaugaacaggcaaaugugccuguaggggugacccugaguagcaauucucaccaggagacagcaaugguccuaugcuugcugccaucacauccaaagacuggcugcgggaggcagaugauccaguagugcugaucccuccuugccagugccucagccgcagcuuguugguuccaguuggagaaacgggucccccugggucgugggaugggccagggcuggaaacccaguggguaggugaaggagauugucaugaaugagaauaagccagcauucuuacagugaaguguguguaguaggggugggggcaggaaggagggugguggaauguucuggaaggaaggagaaagggcacaguacccacaguccacagguccucaucacugccuccucuccuuccuuauccucucugucuuccaggcuucccaaccagcaagucuuuccagauugucagcagagcccagaccacaccuuagcuccacagccgcuuugaauuuauggaugcaguuagcuaugguguuuacucucccugccccucuguauuguuaaccuccccucccccaagcuggacuccccuugaaggagcucuuuguuucccccuuaguuguagcuuuuaucagacagcagugggggucagaggguuugaguggcaggcuucgcaggcagucuggugacugacugucuugguggguuuaaagaaaacagagagggcugaagcacccggggagaugcguccccacgccccuguaacugagaaacaauaccacucaauauuccaaccggcuggggcuggagcgauggcucagaaguucagaaugc

SEQ ID NO: 7284 - RNA, 5926 nt, Mus musculus
gcauucugaacuucugagccaucgcuccagccccagccgguuggaauauugagugguauuguuucucaguuacaggggcguggggacgcaucuccccgggugcuucagcccucucuguuuucuuuaaacccaccaagacagucagucaccagacugccugcgaagccugccacucaaacccucugacccccacugcugucugauaaaagcuacaacuaagggggaaacaaagagcuccuucaaggggaguccagcuugggggaggggagguuaacaauacagaggggcagggagaguaaacaccauagcuaacugcauccauaaauucaaagcggcuguggagcuaagguguggucugggcucugcugacaaucuggaaagacuugcugguugggaagccuggaagacagagaggauaaggaaggagaggaggcagugaugaggaccuguggacuguggguacugugcccuuucuccuuccuuccagaacauuccaccacccuccuuccugcccccaccccuacuacacacacuucacuguaagaaugcuggcuuauucucauucaugacaaucuccuucaccuacccacuggguuuccagcccuggcccaucccacgacccagggggacccguuucuccaacuggaaccaacaagcugcggcugaggcacuggcaaggagggaucagcacuacuggaucaucugccucccgcagccagucuuuggaugugauggcagcaagcauaggaccauugcugucuccuggugagaauugcuacucagggucaccccuacaggcacauuugccuguucauccaucccuuguccauccauccauccauccauccauccauccauccaucccuuguccauccauccauccaucccuuguccauccauccauccauccauccaucccuuguccauccauccauccaucccuuguccauccauccauccauccauccaucccuuguccauccauccauccauccauccauccauccauccaugaugaugaugauguaacugagaacgacguugaguucuguuccuccugccucuaccuccugagugcuaggauuguaggcauguaccaucauguauguauaugugugcgugugcgugugcgugugcguguguguguguguguguguguguguguguguguuuauucuaguauaaacaaacagagaggcugggagaauagccugaguuauauagcaagucccagauuaaccucaaaggcuagugagagucucaaaacuggggugggagugugggggagggucaguagcaaggguggguggagccuggaaaggagcccaaggcagaaaggcugcagaggugggggcagagggcagaggagucucuauuggcaucuguuccacagaccacaugauucuugcauucaucagugacuggaccccaccugaccagcucuagucaaugauuaagaauugaggauggcaguaaagaacgauuauugcugaagccuaggggcagggaacauggugugcauguauaagaaggacagacagacagacagacagaggcucuaggaagauaaugguuccauggggaaauuacucucauccguguaaaaguuggauacaacugagggucuguaauccccgccuuccucccugaagguggggggguauacaaacacacaggcaaaaugcaaaacaaaaauaaauaaaucuuuaaaacuaaaauccaacgaggaguauagcagaaugucauuagaagucaucauuauuauuuuuuucauaacaguaguacuugguuuuacucuagguuccuggguuaucuacucucagguucuugcucauccaagcagcaucaaggagcuccagcugauaaaaugggccugaacucaaaccagauauuagcuggguacucccacagcuuugugccaccgucggccuaguguauauagcaggcaggacaucaucguaggucagagcuggguugguguuuaccuuucuccuuggguagguagaaugcagagugcauucugcucccaauaacaccggcccauaagggucaaggcuguaagugggcaccagcgugcucucucuguguaaagugaacaacaguggagguauugucuucaacaauagauucuugcugucaauuuucgaaaagugaccuuggcaauaaccuggguuguuuggagguucccauggaaccuuuugggucaacaauuaaaucagauauaagccauuccaaguacuggaauuuccauuuggugacaagaguuggggcucugucuucccuguuauuuggcaauuucauuuauugcaccuucauauauguguauaucucaggaagcuucuacuguaucagguuucuguaugacuccuuccuuaauuucagcucuccuuccccguaucacucacuucucuuguucccuucuucccucccuccccuuuugauacucgaguuccagccuguuccugucucauucaucuauaacuaucuauuuuauuuuccauuccuagggagaucuaucccugucacccggucccuuucuuaccuaaucagugguucuguggauugcaguugggucucauuuggccuuacagcuagcaucuacauccacauauaaguauuuugaauacacaccauguuugucuuucugggaacacauuaccucacucgggaugacuuuguuuuucuaguuccauccauuuaccugcaaauuucauauuuucauuuguuuuuaacagcuuaguaaacuuucuuuauguaaaugcacuuuuuuuuaaaucuauucauuuguugguggauaucuggaucuaaacacugcuuuugaggauagguagggcacaugcccagauguagauggccaacaagaaaacgaacucaagagcaucuucgggaguucugugucugagaauguugucaaggcuuuuuuuuuuuuuuuuuucuuuuuccuuuuaaaccuuacaggcccuuugaguauauauugugacuucugguguuguguuuuuauacaauucccauggguguggcugugugugccucugugucuauguguuucuugugauuuuucuuuggcccuuuuccuucuguuuguuucuuucuauuucaacuggcuuguuuuuucuuuuuaucauauuauuacauuacauacuauuauacuacaaccccuuagaugccugcuaauuuuauuuucucuucuguguuuauuuugggguuccuuuguguagcucugacuguccuggagcucacucuauggaucuuugagauggcuugugucgccaugccuaccucccaguuuucuaaggagagacagaaaagaggucaaucuggauggggggagguggggaagaacugggaggaguugagggagagaaaaccauaauuaaacaauauuguauagaauaaacuauuuucaauuaaaaauauuuuaaacaaaaauaaauagauaaauaaauauaugaauaaauaccuaaaugaguacauaaaucaauaaaagccaacaaguuggaagaugaggacuaacauguaguacaaccaauuuaaacuuauccucaacuaggugacagauaaguaagacccaggcucugauuuguuuuauuuggcuuugauaauuacuggggaguaaccccuaagguacuuuucuaacugcugaccuggcugccuccccagcaguguaccccagauacuugcuguuucuccuggccacaggcucaugguccaucuccucucaugauggcuuccucuuuuuuuuuuuuuuuguucuuccuucuccuccuggucucugcuuucucuucucuacccccaaccuuguaacucaaaacccacuuaccucuaauccuuccagucauugucuguagccaauuauuuuuuuaauaguuuuuuuuuuuuaaacaaggaacaagaucugcacaacaaaagucuguaacugagagaauucacuccgaggccuagaccuuuugguacagaauuagcauuacaauauguagcaacagaccuaaccucaacacuaauacucaagguugcuccucagaucucuaucugugcucucuggcacgugcauguauauacaugugcucaccacacacacacacacacacacacacacuaaaaggaaguguagguguagacucgguuuuaaacuggacaguggguagucaucccacacacaguucugucccacuccacagaaaccgggcagaagcuucccccaggccaggcuggcaaagcccacccuggggguggggauggggugggggucuguccugcucugaaucacucuaggcaguggaaaagugagaugccuccagagaggagccccacccucauucugguccagguugauugaaucaggccuaggucuuggcugacuccuuucagacuucugagugugcggugucucaccccaucccuuuccacuaccaacccacucacagcccagcacuuugucauuucccaucagaggcuccuccaagggcccccacugucccaagccaccucaucucacggucccgucuuaagaacugagccauaaaggccaagaacaucccagacacacagaaaacaaugagucagccacaccggaagcaaacacacaaacagaaccaaugucuaagacccacgagccugagguguccugagacaaauuuauccuacagaccuuagacgugcaaaauggcaccuguaggcuguuuacagaagccuacaauaguugguuacaacuuaaaugcccaccaguagggacuaguuggaaaugaugcuguauuuaaacaacaggacccugcagcuauguaaaagaauggggcaguacuuguuagcauuugucuuuugugagguuuguuuguuugucaauuugauacaaaguagagucaugcugggcaugguggcgcacacuuuuaaucccagcacuagggaggcagaggcagguggauuucugaguucgaggccagccuggucuacaaagugaguuccaggacagccagggcuauacagagaaacccugucuugaaaaaccaaaaaccaaaccaaaccaaaccaaaccaaaaaaaaccaagguagagucaucuaggaagaaagacugucagcugagggauugccaucagauuggccuguaggcaaaucuguggggaugguuucuugugggaggguccagcccacuaugggcagugccaccccuggacaggugguaccgggguguugugcugguuguuuuugucaacuugacacaaacauaucugggaagaggauaaucucaauugagaaaaugccucuguaacacuggccugucggcaacucugugggcauuuucuugaugaauauagauauggaaaggccccaccaacugugagugcugccagcccuaggcaaggaguucuugaugguaaugaacaagcaggcugagccagccacaggaugcaagcccguaggcagcguuucccguggcuucugcuuuaguuucugcccccagguuccucccugaguuccuguccugacuucccuucaagcuguaagaugauauaaaccuguccucccuggguugcuuuuggucauaguauuuaucacggcagcagaaaagcaaacaaggguagggagaaaucuuuuuguacugacagaacaaccuucaaggugcaaauggugcuaggcggggugucuggggagaaucccuuccccagggagaggcaaacaacaccagccaucuccuuacaagguccguucucuccugggaaccugcaagugaacugggugagggaugacugacagguucccgagugaccccacagcaacaguauaggaaagccaucauggauggaaccccucucccauuagccucccgagucuagccuccucacccucuccucauccacaaacguggauguaaccguucacaaaugugauggcuccucucaagcaggcacagcugaugcugaucuguuggagg

SEQ ID NO: 7285 - RNA, 22895 nt, Mus musculus
cgucaaucccacugggaagggaaaagagaaaccauuugaacuugaacauuuggaguuuccaggggcgugcagaccauuggggcauagaaggcaucucgaaaagagugaguacaggaaacgaaaccuguucuaagugcaacuaggauguaguaaggagccauaaucaaaacuugccagacgcucucgguuacagaguuugacaguuuuaacuuaaaccuuucaaaucucgagaaaccggacguuuuuguacccaacauugaguaccucuaaauauuuucugaaauauuuuugaagagcuauuuaaaauggaaguuuccaauauuucaccuuuucucuuaauuuuuuaaaugguggcgggaucuuuuagaaauaaaccauaaagcuuuuuauauaaaccagggcacagagaccgugaagucugcaacacggcugcucaucagcuuccagcauucccagccaucgaaguccacaguggaguggcugcucccugggcaccugugaagauucaggaggaacccacggucacgcuuuaugccuuucaagucauuccaucuggaaagaugaacagaaugagaaaugugugugugugugccauagaaguuguuaguucauacguucaaaugccuuggcauuuauuaguuuugaguaaaaacaacguuaccuuucaucucaucgauaauucuuuguauacacacacaccaggagcgucaaguguggggaugcuguuugacauauuguccagucgucaggccaugauaaucgacaguuggcuaaaauuaauuugguaucaaauauuggacaagaaaccagguagcuguauggccauacaagagcagugaguaguuacagcucgauucccaggacccauuaaccucaccagaggaauuccaguagccuaaauuuccaguagcgugaaaauaaccucuuuuagccguuaguccuggaaacuacugguuuuguuauacauuauuguauuuauauauacauauauauguguguguauguauguauaugcaugugcuuuaaaauuuaaagauagccuauaauccuuccugcugaagcaaaagagucgcuaugagucugaggccagccuggguuacagagugauacuuugucucaaaaauaaauaaauaaaugaaauuuaaaaucaguaaaaauaaauaaguaaauuuuagucagggcuggaaaaguggcucagcagauaaagugcuugcugaguuugaguccccaggacccauguaaaguggggugcaauagugcacaucugugacucucuggaagcucacaggcuaaccagccuaguauacacagugaugaaugacagaaauaucauggcucaaaauaagguggagggugaggaccaacaccugaggguguccucugaccuguacacuuauccuguggcaugugugugccugcaguaucucucucucucacagucacaugcauaugcaucaugcacaugcagucacauacuuaggcaccaaacacauaugcaucacacacacacacacauacacacacaauuguaaguguacaaaugaacaguuuaauugcaugugccccugucaaccuucaucgccaucucuuucuccuaaacuagccacugucuauagucuguguacuucugaaaaauacaaaagccuaauuauaaucucagcauucaauaggcaguagcaggaggaugggguucaaggccagcuuggguuauaugacaccuucucaaaaccagaaaacaaacaaacccaaguaacuccagauaagugaaguguuguacacuuguaauuucagcacucuagagucagaggcaggagauugccaugguucaaggccagccuagcccacuuaagcaaagaucuaaccucaaaauaacaaaacaaaacaaaaauuaauuuauguaccccagaauguuuaucuguucucuuaauuauacauaaauuagguaauggugaccaaucaaauauuacuugucuuuccaccugucuagcugaauauauaauuggcaaauaaacccagguauggugcuggguauguguguuuaucucagcauguaggggucugauauaggaggauugccucuagcucaaggccagccuagacuacauugugaguucuaggccagacucaucuuagaaagcaacaauaauaacaguaaauugauaaaaaaaauauauauauauaguauacaguauaauauuuuauauuuguauaucuuauuaaguaaaucaagcuaauauaucuauuaccuuauauauuuguaguuguucguugcgauaagcacguuuaaggucucuuaguuuucaaguguauauggucaccaucaguacugcagaucuacagaacuuacauauccuguccaaguggaacugugugcccuuugaccagcuucuccccauugccuuaugggcauuucucauuuaauaauauguuaugaauacucuuuccugcuacuacacagaucauucuaaauuuaaaagcuauuuauuauucuguuuaaucauaauuggggggguugcuaaaaauuaaaccuugagccccaugcauguuaggcaaguugucuacauccuauagcugagccacauccucgagcuacacccccauccccacuaaacauuuuuuuuuuuuuuuuuuugguuuuucgagacaggguuucucuguguagcccuggcuguccuggaacucacuuuguagaccaggcuggccucgaacucaguaauccaccugccucugccuccuggugcugggauuaaaggcaugugccacuaugcccggcaccccacuaaacauuuuguuauuguucuaugagugugaugccugugccugcagaugcaagcgugccgugccauagcaugcacauggaggccgguggacaacuucggggagucagcucuguccuuccaccauggguuccaagaaccaaacucaggucaucagguuugcacagugagugcuuauaguggcucagccaccuugcuggcucccguucucaugauuuuuuaaaaauuuauuaauuucauguguaucaauguaugucuguguaccacaugugcgucugaugccugcagaggccagaagcgagcacugaguccuaugggacuauaguuccugguucugagcugccaccuaggugugggaacagaauagguccucuggaagagcagccagugccuucaaaugcugagucaccucuagccccuaucauuuuuuaauuaacauucuuaaauuuauccucccuaggauaaauucuuagaaguagaauuuuuguugaaaaagaguuuaacacauugauaguuauucauaaauuaaccuuaaaauauuagaacaauguacacuucugaguuauauaugagauaguaaaauugaccuuaaauacaugcuauuauuaaguauuauuaccugaacauguaaauuauuaaaauuacacguuuaacaccaucucagagugcuuuauaacccacauagcacacccugccuucugugaacaggauucauauuguauauuuuuguuuguugagcgaccuugaagaacauuagucccuaauauuuuguuuaguuucauuugcuaaauauaucuuacccuugccuaagucauagauugcaagcaaaacuauucacggauuagucaucagugacucagaauugugcaacugagaagcuggccugaacuauaaacaucuuucaguaggcucgcaucaaagcuugcuucccucaggcacaguuggaaggugguugguuguuuaauuguacuaaugaccuaacuuucucaguggaauuucuugacauuuuuacuacuaauaugaaaguuaccuugcacaggaaagacaacacaccaauaaauaaguuuuaaaagaaacugggcuggauguagcucagugguagagagcuugcuugggcuauagauggguagcauucagaugcgugaggcccuggggucaauccccgggaauguaaaaacaaagagucagauaaacacaauucugaaaguggacuuuugagagaaagaauauacuacaaaaauagaaaguaacuuggauuccuaugaucugcuagcugcguacugaaauauuuuccuaauggucaugauuuuaauuuuuuuuuuaaucuacaucagugguucucaaccuuccuaauacugugacccuuugauacaguuguagcaaugcccaacaauaaaacuuucauugcugcgucauaacuguaauuuuguguugugaaugauaauguaaauaucugacauacgggauaucugauauacgaccuccaaaggggucaccaccccagauugagaaccacugagauuuuucucaaacuuuacucucuaagagauguuggauuuuuaauuuuuuauuacacuuuaaauguauauccuuuguguguauguaugcaugccaugguacguuuguggaggucaaaagacagcuugugagaauuggcucuucacuuccaccacauggguccuggggacugaauuggguugucaggcuugguggcaugaccuuucccugcugagccaucccaucagccuggaauguuguuuuucauagaugagaaacuuggauucgggagucugaaacaucucagaauugucauuuauucuauuaggcuaaugccacugagccauaauaaaugucaguagucaggagacuuggggcagagcucaggauagacugcauggcuugccucugcacucaaccccagaaccaaaacaaacaaacagcagaguuucucucuagcccuggcucugcacucaaccccagaaccuagauagauagauagauagauagauagauagauagauagauagauagauagauagauagauaaaaacagaguuucucucuagcccuggcuuucccuauagaccaggcugaccuugaacucaugcagauuugccugccucugccucugccuccucugcccccucugccuccucugccucugccucugccucugcagugcugggauuaaagguuggacucaucugucacugcugagaccaccgucuggcuauuuuuaaauucuuaauauggaaaaagccccaugaccccacuuccacccguacccaaugcucaaaauucauuucuuacaaacaguccgaugcaggagaguuuggguuggugggaagcuuuucucuguaugugagucaagggucuaagcuauuccaucugauggcgucuuccagacccuggagaagccauauucacugcuaauugcuucgucccagaagggauacacaucauuuccacuuauaccauauuguuaagugccgugcauggccuacuuagggaccuuagaggagagagagaugguuggcuuugcaacuggccucccagcuccugccucacagcauggaggaggaagugcacuacuuauguuaauuagcugauucucuuaacuuacuaguuuaguagaaugguuuucaauuuuguauaucagaaaauaagcacagagcugggugugguggugcacaccuuaaucccagcacuugggaggcagaaacaggaggaucucuaugaguuuaaggucagccuggucuauacagagaaaccuugucacuggaaauuugagacccuguuuagugauaagaugcauugaagaccaggggugguuuugcacaucuaaaaccccagcacucaggaggagaggcaggcagagucugaggccagccagggcuacauaaggagucacugucuuaaaaaacaaagucaaagccugagucuuauuuuguuguuguuguuguugcuguuuuauuuugcuacuuccugauacugcaaagugauucuguccaggcuuaaacuauaacucccuuguugacuuauugcuuuaaaugcauaaugugaucaaaacaaacaacaacaacaaaagccaaacaaacaagaacccucucuuuuucucuaggaaucggacaaugucucuguauuguagaacauuuuucaggaggaaaucuuuugggugcuauaggcugcugucaaccuaugucacuaaggcacggugaguccugaccagucugauuauuuuuggccuauuaaauacuaaaauguaaacucuuaagagcuccauauuaagaauuaaauauaugagauaaaaaauacacaaaauaacacccacuguaaauuguuuacaauugaaagccauucaguacuaaauuuaaaaauguauaaaauguuucaugcucuugacuacaagcuccacucggauaagacauuguccuuucacccaagaguggugauguacaccuguguccccagcaugugggcgacugaggcaggaggaucuggaauacaagaucauucuuaucuacauagagaacuugaggucaccccagguuauaugaaacauucucucucaaaaaaagacuguucuuuuuuguuauuguuguuauuguuuuuguuuucaggugggaucuaguuguauuuuucauguguguguacauauuuauggcaaccccuguggagaagggugaauguauauagauguccauaugcagauggaggcagguugaccaugauaucuuccucaaucacuucuccuccuuacuaguuuccucacguuuuaugugcauggguauuuggccugcauguguuuguguacugugucagugcagcauccacagaagagggaguuagauccucuggaacucacauaaauggucgugagcugccauggagguacugugaaccgaacccagguccuauggacgaacagccagugcucuuaacuacagaaccauuucuuuagucccccacuuuauuuuuuaagaugggaucucucacugaaccuagaacuccaugacuggcuagccggcaagccccucuugucucuaucucuguagcaccgggauuauagagcccugcccagcuuuuucugugugccacagauacaaacuccagucuucauguugguacagcagacacuuuacugagugagucaucucuauaucuccuauuugucguuugugguagggucuuaccgcgcugguaguucaggaugacuuuuccccuacagguguuuccauguugugccaacucugcuuguugcuuuuacagauguuuccagaucuuacagaaaacaucuguaaaauacauuucccaguuaucaaaauauggcauaaacucgagagucuguuuuagggcucaauuuuuuuguccuuuuguguugggaucaaacccagggccuuucacaugcaaggugagcacuaccacugagaugcagucuuaguuugguuuggggguuuuauuuauuuauuuuuuaaagauuuauuuauuuauuuuauguauaugaauacucuguagcugucuucaggcacaucagaagagggcaucagaucccauuacagauggcugugagcgaccaugugguugcugggaauuaaacucaggaccucuugaagagcagccagugcucuuaaccacugagccaucucuccagcccugauuuuaggguuuuuuuuuuuuuuuuaaagauuuauuuauuuauuauauguaaguacacuguagcugucuucagacacgccagaagagggcgucagaucucauuacagaugguugugagccaccaugugguugcugggauuugaacucuggaccuucggaagagcagucgggugcuuuuacccacugagccaucucaccagccccgauuuugggguuuuaaaaagcacacacaaauaaauaaauaaggaaaaaaauuuuuaaaguacacaaaaaaguuaauaaauaagcccccaagauaacacgcauuuagucacuagugguuuuuaaagacugauucaauuuguaaagcuggugaacagacucucaccacccuaagugaagcuacuagagacgccuagaacuugauucauuauuaucucuuuuugaaaaaccaguaaguuuucuuucuuucuuccuuccuuucucuuucucucucucucuugcuuucuuucuuucccucucccuuccuuccuuccuuucuucuucuucuucuuccuccuccuccuccuucuccucuuccucuucuuccuccucuuccuccucuuccuucuuuucugacagugucucucuacauagcccucaaugucccagaacucacagagaucuacugccucugccucccaaguguaggguuaaaggugugugccaccaugcccgaccuagaaaguuuccuuaguccacauuuuuaucuuggcuacugaaaauauuaucauuaugaauuagaucagucaagaaugggcucuaugguacacuuaagaagcugaaagaguucaugucugaacaagggugcacugaugucagauauguaccucgucuucccuagaaugagugggaauuccuaaaagcguuuaugcucuucugcaguacagcccgcucccaucuguggcccuucugugcugagauuuuuaucauuguccucauuuuccuuuuaguccaguuccugcaaauucuugccucacuguguaacacuggcaaaguuccuuaauguuuaacucaauauucauuucccuugaaguucaagucaauggaugcguauugagcuaagccauucaucaugcuaauuacagagaugaaaagccaaggaucugugcuugcacaggucacaguaggcuuggggagacaaugaacaaauggugcaaugacaugcagagggacagaggggaggugcagcaggauggcuugggagcaaacugggaugaaaguaagugaauggagcuuggcgugacggcacagcccugugcucauggcuguaccagaagcugaggcaagaggauuauagucaaggccuuguuagacuacagagugaguucaagaccagccagggcaacuuagugauaaaaggugaaaaagaauugagcacauagcucauuguuagagagcuugucuguccaugucccuggguucaggccccaguucuguaauauauauauauauauacacacacauacauacacaugcauucacauaugcauacauacacauaugcauacauacacaauacauaaaacuacaggagaauuaagaagaauguccccagaugaaugauagauauacagccaagugugauuuauuuauguuugcuuguuuauuuagcuuggguucugucuggauauguucacagcgugcaugaagaggucagaggauaacguggggggcacugggcucuccuuccaccauguggguucuggagacugaacucagguccuugggcuggacaacaagcaucuuuuaccugcugagucaccgcacuagccuaaguauggucuuucaauggcuuauuucccaaauacagauacuuauuugaauugaaggaagaugaagaggccugcaggaaggcucagaagacaggaguguuuuaccucuuucaugaccuggauccuuugcuccaggcgucaggacaucgauaccuggugccccggcuuagccgagcagguaaggucaaaguauaccaguggaguaggugagucuuccccaccagcuaggauucagguaguuacaaaaaaaaaaaaaaaaaaaaaaaaaaaaaaaaccuugcauuuuaaaguucagauuuuucaaacagcucuugaucaagcuuacauaaccauuucugcuaauuaauaacucauuguaugaacuugaauugcuagguauuuuuggugguaauaugaaccaugagugccuuaaaacggagguccauggagcugcuguuccaaagcuugcugcccauuuugucaauaaaaucguauuguaacacagccauacuuguuccuggacacacuauguccagucguguuuaugcuacaauagcauuugcguagacacagaagaaaacguauagacucuaaaagacuuggugucucuuuucagagaagcuuugcccagccuugccuuaggcaaaugauugcuagcgcagggaacugcacguuacauaguuuaagguuugcauccuaaccugguucugcuaggguugaaacugaauacaaaugacuuuugagaccccuuucaguacaugcaucuagagauguaggucucugcaucugggggggggggugguuaucuuugagguuccagugugaauugggaauucuucaaagcccgacugcuggguguguaugugugugugugugagagagagagagagagagggagagagagggagggagagagagagagagugagugucaguggagagcacuuggccagcacacaugagcaucuugguugcuuuucuguugcugugauaaaacacaugaccaaggcaacuuacagaagaaggaguguauuugggcuuacuauuguggcagggaacagggcagcuggcagacaggcauggcacuggagcagcagcugagaaauuacauagagaaagaagcagagaagacccuggaaacagcgaagacccuugaaaucucaaaccccuacugugugcucacuccccacacaguaauaauaccuccuccaacaaggccacaccuccuucccaaacaguccuacuaacuggggaccaauuauuaaacauaggagcuuaugaggacuacucuuuuuuuuuuuaagauuuauuuauuuaauguauaugaguacacuguaguugucuucagacacacaagaagaaggcaucagaucccauuacagaugguugugagccaccauguggugguugcugggaauugaacucaggaccucuggaagagcagucagugcucuuaaccacugagccaacucuucagcccacgagggcuuuuuuuuuuuuuuauauuuuuauuagguauuuuccucauuuacauuuccaaugcuaucccaaaagucccccauaccccccccccacucgccuacccacccacucccacuuuuuggcccuggcauuccccucuacuggggcauauaaaguuugcaaguccaaugggccucucuuugcagugauggccaacuaggccaucuucugcuacauaugcagcuagagucaagagcuccgggguacugguuaguucauaauguuguuccaccuauaggguugcagaucccuuuagcuccuuggguacuuucucuagcuccuccauugggggcccugugauccauccaauagcugacugugagcauccacuucuguguuugcuaggccccggcauagucucacaagagagaucuauaucugggucacaagggcuauucuuauugagaccuccacuaccucaaguggauucaaucucaguagcaggaaaaaaaaaguccugcaaucauagaguuaagguaaaaaaaaaaaucugugguauacuaaacauggucagaugaucaucauugucauuauuccagaaauaguguaaaauggcuggauacauaguugcauuguuauuugauacuuuaagaaaccaagaacuguuuaaaguauuggcaaguacugccuuguuccauauaagcgauuugagaacaggcaacuuuuggcauaugagcacuauucuguaaccgaccccagcaggagcugagggagcaaccgugggcucuaagcaaaaguccuuccugugggucucacauggugaugcaacucagaucccagucuuacuuuuucucucccucuuccuccuuguuguuuagaguuggaagggcugcuggguaaguucggacaggauucgcaaagaauugaagauucggugcugguugggugcuccgagcagcaggaagcaugguuugcuuuggaucuaggucugaagagugccuccuccagccgugguauguccccccucuccugacaggcucuccccugcugcccucagacuucagggucuuguggaaugucaacucaaggaaacuuuuacacauacaagcacauuaucagcuuuccuccuuaaauaaggauauaaaaauacuaauacccgguaucaucacuaugaaguguucaauggccugaaacuugcucuguagcccaggcuggccuccaguccagcccuucugccucagccucccacgugcugggauaacggacauguacugccuuaccuggauaaaaaucaagggcaucauaauggcuucuuuccaaguggugacagcacacuugcuucuuauuccccauacaguuauacaucuuauauuuuaacuauuuaauaaauauuuuaaaauucacaucuuuaaaacugaguauggcaguauguaaucccaguugaacaaaacaaaauuaaacaaaaacaaaaaagcaaaacaacaauaacccccccacccccgcaaagaaaauccaaaacaacaaacaacucaaaacaacaacaacaaccagagcagagcaaaagcuugccagcguagcacauucuugcaauccuagagcuugaaaagugaaacaggagaaucacggguucaagcucacccucggcuacagagagcacgaggccaggcuggcuacacaacacucugucucaaaaaacaaacaaaaucuugcuaucguuuuuucauaaaaauguuccgguggaguggcugugggcccucagcucugcacugcagagcuggcugacccuggccauggauccuaccaugugcucuccucucuucagugucgggguguaagugugguggugggugaguuagacccccauuuuaucuuucccaaggacaaguaucgcugcuccagcagcuugacugcuguaaagaggaucuggagaaauacugugcuacgcuugccaagcuaaccugagagucaccuaaguacucguuaaaaguguuuucacucuuccaacauucagguguggggacccagagcaccuauuccauguaacacacauucuugugcaugcauauucucccucucccucucccucucccucucccucucccucucuuucucuuucucuuucuccccccucacucucucccuccccucuuccccuccccucccccuuccucccucuccacccuuccucacccccagguagaagcuugggaaccuaugucauuucccgaaaccuagaugagucucuugggcaaguuuggggagcagugcucugacggauggacugcacagaggcaaagcugguuggcccuuuaauugcauucucuuuucuaauuuuuuagccuccuugccgaaaucugaaauggaagcagagcugggagguucuuucaucaagcugaggcaggcucuuuuccagcugaacucgguggacuccuccuugcuguucacgguaguucccguuccucaguucugugggaaguauaauaacgcugugugcaugugugucaucuuggggugaugugguuucuccauucacuguuccuugauuugcuuuuggcagagcugcugugaaaguuuaccuccuaaggacauggcaacagagucuaucagucuccuaaaaguuuuuaaaagguuuuauuuuuaaucgugcgugcauguaugccugcgugcagguaugugcauaugaguguuggugucuucagaggccagaaggggccacuggcuuguuaugugugguugugaacagcaaucagaagucauacgugccgggaacugaacucuggucuucaugcacucaagagcagcaugcacucuuagccacucagucaucucuccaggcaaccucauaaauauuuuuaacuucacagcauauauacacauuauguuauauuuuacguugcuuuaauaacuugaucucauagcuuuagauuucaauuauuuuauuuuuauuguugacuuguaaauucuuuucugagacaggguuuuauccuuuuuauuccaugcaggaccccagcccacgauauggucucagacacaauuagagugggucuucucagcucaguuaaacuaaucuagaucaccuuucucggauaugcucaaggauuuguuuccauggagauucuaaauccuaccaaguuaauaggacuuaccaucauaccagucuuuaauguuuuguuuuguuuucauuuuaaaggcaugccuucagcuugcuguauagcugaggguagccuggagcguccguugccccagggcuggggccucaggcaccgcuacacagguaccaccacaccuggaugcuguggccuugauugccuguucuaaauuaaaccaaaaccccuaagacuuuuuuaguugaaaaaagaaaaaucacaaguugagcuggggaaaggcucagugggugaaagcgcacggcacagaccugacgggaguuccacccgggcgcccacaucaaagccagaggcugugcugugcuccuggaaucccaguaguccuagggcaagaucugaggcagaggcagggaacggcugaaaguucagggaccacuaacauggagcacgcuacacagcaaagucauuaggacugucaucaagguggaaggcaagaacggcuucccaaaguuauccucugaccuacacacacacacacacacacacacacacacacaccacaauuuaaaaaaaaaucaugacuucacugaggaauaaauauaaaagaaauacuuaacucuaauggaaauugaaauguuuccuucuuaauuugggucauguuucaugggucuguauuauguuacuguauauucuguuuuauauuauacuuauauuuuguguauguauauauuauauauacuuauauauauuuguuguauauuauauuuuaaacgauucauacugcauuucaaaauacuguuuaggcuagggauauagcucaauagauuacuuccuacuauaugugaagauguagagucccaccucccccccaaaaaaaauuaaaauuaaaaacauaaaauauguuuccuuuuagguuuuugaugcuaggaaaauauauuuagaucauuuccuuauuuuauaguuuaaagccacuugaaguaagugugcuaggaccagugagaugguccagcagguaaaggugcuugccauacaagccugguggccugggacggugucuauaaagguggaccgggaggccagcucugcaaaguucucuucugagccauccaugcacguuggcacauguaccacgccccccaaccccauuaaaaacacaauuaaauaacuuuuuuuaaaguaagugagcucagccagccccgccuuugugucugcaggcucaggcucuucuccgcuggcaugacggucaucaguucugcagcaaaagugggcagcccacccagaagaacguggcgggcagcaagcgagugugucccuccaguaaaaucaucuauuauccacaggugaggcccguggggguggaggugaagguagccugggcuacaugagguacucgcacacaaaaaaacaaacaaaaaacaacaacaacaaaaaaaaaacaaaacaaggggcuggagagauggcucagcaguuaagagcacuggcucuucuggggguuugauuccuagcaaccacauggcagcuugcaauccucuguaacuccaguuccaggggauccaaugcccucuucuggccuccccagguaccaggcaugcacaucgugcacauacacacaugcaggggagcauucauacauuuaaaguaaaaaugaacagccagacacugugcucagcaccugggaggcagaagcagguggucuccaugauagugaguuccaggacagccagggcuguguagagaaaccuugucaauaaauaaauaaauaaaaauuaaucucaauuuuuuucucucccuuugcuuuuugaacgagggucucuaugucacccuggcucuccuagaauuugcaauguaaaacaaaaagagaagaaacagaaaguagccagguggugguggcacacgccuuuaaucccagcacucaggaggcagaggcagauggauuucugaguuugaggccagccuggucuacaaagugaguuccaggacagccagggcuacacagagaaacccugucucgauuaaaaaaagaagaagaagaagaagaagaaaagaaaagaaacagaaaguuggggacaguaguccgagaaggcuguugcuacucugucauggggaaggauugcccucuaagccccaaagugccagaaugucaacuuccacucuucuguccuagauggcgcccguagugaucacacuggugucagauggggcccgcugccuacuugcccgccagaguuccuuucccaagggguuauauucugcccuggcagguuucugugacauagguaaggaguuuaggagagagcugccagugacgcuggaaaaaauaacacaccucuccuacugccaccaugcuuagagucacaagcauccaucccucucaugucccagaaaaguauccuggaauuacauauaguuuccugcauaacagggggcacaaucucgaacaugcaacauagcuggaagaauuaauuauacacugaaugccucuacacccacugccucauuucugugaucuuuaauacacuuuucuccucucugcaucuuucucacugcccugccaucagcccaucuuauuuuucugaugaacaaauagcguacuucucccugagucuuucaguacacacauuuucccucagacucuuuucuucuuuaguuuucagggggaguccacagauggugaaaagcagcagagucccacagccaggcgagggcagcaguagccucucucacugcuucacugcuccacuccccugcauuauagcuaacccgcacugcuccacuccccugcauuauagcuaacccgcacugcuccacuccccugcauuauagcuaacccgcacugcuccacuccccugcauuauagcuaacccgcuacacuugagcacuugauagacucaggaucugauucuuggugcugggaacugagacuugggaugcucccaggagaaucaggaugcagauagauaauauacgauuuuccugcuccagggcugucuggaauuaaucugagcauuugcaggugaaaguguggaagaaacuguccaucgagaaguugcggaagaggugggccuggaaguggaaaacauacaguacucugcgucccagcacuggcccuuucccaauagcucacucaugaucgcuugucacgcaaccgugaaaccaggacacacagagguaaagucuuaacuuucccuuguacugcucuguccccuuuguccgacagcauguauuuuuugagcacuugucuuggggaguaaugucuggguuauguggugauuuagaaggaauuugcauuugagaaggaaacagguagcugucauuauguaucaguuaugaaucacugacuucucuuccagcugcuuuguugaaguauaacgaacacagaguauguccugagcugggguguagcucagcugguagagugcuagcauaacaaacaaagccagggguuccaucuucagcaccauauaaacccagccuggcaauacccacuuacagccccaacacuugggagguggaggcaggagaucagaaguuugggaccagccuagacuacaggagacccuguuuuguuuuguuuuguuuuguuuuguuuuguuuuguuuuguaagacaugucuacaggugucuguagacaucuaaugcaucuaaccugcuggguuuggagauaagcauguaucaggaaccaaugauaagucauuacuagcuggaaccuucuuccaucagacauuacuaucagugucauaagcuuacucauuacuuuccaugcucccccauuaccucugugcuaagagcauuuaacauaguaguaguuugcccauuauuuucugcaccccccaccuuuccucugugcuaagagcauuucacauaagcaguagcuuaauguacuuaacacaauguugcuagcuguagauguuauacaggccuccaaaacuuacuauguuaagugaaacuuuguauccuuuauucgcuacuucuccauuccccucuuuucuucccuugggaacaggcauuccacucuugcuucuuuguguuugacaauuuuagaguaccccugcugcagcgaccuugcacaauuugcaucaggcuuuuuucuacugagcaugucuuccaggcccaucaccuuauuauaaauguacaauuccccuucauuuaaaaaaauuuaguaaugccagccagaguaacaaguacccguuaccucaguacuugggaagcugaggaaguaagauccaggaguuccaggccagcucugaaugacauagcaaguuggagguagccuagaacuacauuaggaccucaccaaacacagcaacaacgacauccucagugcuaguuugugauauguaucugugacacuuucuucuuuaacagacauccagacuguuuuccuaucaugggugcugugaaugguguugcagugacaguaggaauagagaggaauggugcugcaguggcaguaggaauagagaggaacggugcugcaguggcuguaggaauagagaggaacggugcugcaguggcaguaggaauagagaggaacuugugagucccagacugcagugcacuuggauauaggcuuggaaguggggucgcuggaucaaaugauaguucuacuuuuuaaaguuuuauuuugagagaggauuucacaguguaucccuggugggccugaaauucacuauguagaccaggcuggccucaaacuuccagacauccuccugccucugccuccccaaugcugggauugaaagugugugucaccuuauuuauuauuaugacuucaauaguucuccauaguggcugcacaaauuuacauuucagccaauaauguguuauaguccccuauuuucagaaccuauuuuugagucguggacuuauugucuguaacucaggcuagccuucaauuuacuaugucacucuggcuugccgcaaauuuaggauccuccugcuucaacuucccaggugcugggauuacagaugugugccaucaugccaggcuucuucgcuugguuuguuuugguuuguacaggguuucucuauauagaccuggcuguccuggagcuugcccuguagaccaggcuggccuugaacucagagauccaucugccucugccccccaccccccaggugcugggauuaaaagcaugugccacuaugcccaggcuuguuuuuuuaugguagccaucugauuuaguuacuuuucuauuguugugaagagauacuaaaacaacuuauaaaagaaagcaauuaaucagggacuuacuuaacaguuugagacagugagaacaucaccaucaccaccaucagaggaaaccacggcagcaggcgggcagauaggcauggcacuggggaaauagcugagggauuacaucugauucauaaaaaggagggagggagagaggaagggagggagggagggagggaagagaaagaaagagagagagagagagagagagagagagagagagaauauaugaccuagacuuugaaacucaagaccacccuccaguggcaugccuccuaauccuuucuaaacaguucugggggcuggagaaauggcucagcgguuaagagcacugacugcucuuccagagguucugagucccagcaaccacaugguggcucacaaccaucuguaaugggaucugauguucuccucuggugugucugaagagagcaaugguguacuccucuacagaaaauaaaaauaaauaaaucuuuaaaaacaaaaacagaacaaaaaaauccaccaccuccaacaguuccaccagcugggaaccaagcauugaaaccuaugagccuacagagaccgcucucacucacacugccacaccaucuuaguggguaagcggggccucucacacugaugcucugaauuucccugaucacugacacuugguacuucauuacacauuuguugaccauauauuucuucuccuccuccuccucuuccuccuuuucuuccucuuccuucuccucuucuuccucuuuccccuccccccuccuuucuuuauuuuuugagauaugguuucucugugugguacgcgccuugaaucccaagcacugaggcaggugaaugucugaguucaaggccagcguggucuucaaagggaguugaaggacaggcggagcuacacagagaaacccugucucaaaaacaaaaccaaaaaguuauaaacaauuucuucuuuuaagagccaucuguuggagugcuuuugucuuuuuccagugcuagggacuggacgcagaaccucaaaggugccuggucccgcugagcuccgacacaucccgucugugcuguugagcugcaaagaauccuuauggauuuugggcauuaauucuuuauauuuguucugcaaaccuucucucaccuuauaagugcuuuuguguucugugcuugcuuugcugucuagguuuuuauucugaccucacccugucuacuuuagcguuuccugccuuuacuuuuaaagccacaucuauaaaaaggcagugcccaguccacuaucacaacuccuacacgcauuuaaucuuuaauccauuuugcguuggauuuugguacaaagaguccagcuucacucuuuggcguguguauccaugugccaacuccauguaugcugcgauuuauuuuucaccgucaguuuuuaacaguuccuuacauagaaauagaaugcacauaccuaccucacuuaacaguuugggauugguguuccugcccaaggacuuggggauguuggggacuggugauauaaaacuauaggaaccucuggcugacagggacuuugaugucuuaccuaaauucacccugcuuguuuguggcaugucugacagauggaagucaccgaaugcccugccuggcuugccuguucuguccucugauuuuuaugggcucucuaaucugcuuccacuuccugggacagucuguguuuacuuugcuucuugcuuucaguuaucauuaaccuuuauccuuuaaagagaauagcauuuguaugaauguugauucuuuaaaaaaaauugccuguauuuguguguggacauauauggacauccaagacaaguuucaggagucuguccucuccuuuggucacaugcacccugaggaccacgcucagauugacagcaagcgccuguacccacugagccaucccacugacccugcagcuccuuuuuaauugaaaggguuauauacuugaugcgacacacucacucaugccuugccacucgauaguuuaagugucugcuuuaggauuuuauguguguguacacuggggacugaauccgggcuuaacaaaugccaucagccuuggacaagaaggauuuuuuuuuuaauuauaacuauuguacaaauaggauaaaauuuuuaaaaauuuaucuuuuuuagaacuauuucaaaauacauuuaauucucuguucaguuucugaacauuaucuagaacugauuuuaaccuagccauuggucccagguguucccaucuaagacugcaccguucuguaugaauuuucucacuuuggccgugguguuuuauauuucauaguuccuaacuuuaccccuacccuauaccccuuccuugucuuucagauucaggugaacuugaaggaacuagaggcagccgccugguucagucuugaugaggugaccacagcccugaggagaaagggcuccuuggcucugcagccgagugaggcuuccccacuguugcugccucccaaguuagccauugcccaccacuugauuaagaaguggguggagacgcggagcuguucuucccuggcugcuuagcucaaauggagccgucuggaucccuccugggcauugcugcagggcacucuggagaugaccugcgaagggaggugacaaagccuucccgggcagaggcucucugagaaguuccacugccuaaagccuucuaaugcuccaccaaaaauguuggugugaacuggauagagcagcuuguaccuguacuugucccagcuaccauggaggcggaggcagaggcgagagcgucacuuuugcccaggacaacgggggcaacauauuagacaccgucacuuaaaaagaaaauaaaaacuguaaggagaagaguugacugaugagaugcuaacagugcaaagcugaggggagguugcugauuggcuugaguguagcccaaggcuguaggaacaaacauccucuggccuggacuggcugauguuggauuuauaggaacugccaaaugugccagggugauuuaucuuacugccaaaauauuaacaguucucaacucacauuugaguugcuucuguccucacagaaaaauaacauuuuauaugcuuucgaauucgugugaagguauauuuuuuauguuauuauuauuugcauaaguauuugccuguguguaugucucugcacaacaugcaugccuaguuccuguggaggccaaaagagggugugggucccuggaacugaagcuagacuuuggugagcugccaaaugggugcugggaaucaagccugggucuuccagaugagcagcaccgagccaucucuccaacaccuacagacacgcacucccguguguggcagucaaagguugacuuuuuaguagccguuguugcugcagaucaaaccuagggcuuccugcuugauagagacaugcucuaccauggaggcgcauccucagcgcaaaaguuaggguucuguuuuuguuuuuaagcucugaagggaugagggaagugggagcauaggucuuccuuggaguauucugcaggcgaccagagguggcguucuuuugaaguagcuaaaucccagaagggugcaagauaauuuaugauuuauacugucuuuccuucucuugcucacucaguuugugaccuagggaaaaagacuaaacaugaaacacacacacacacugagggcgcugcuucaaugaggaauuagugaggauaggcaagcacuaagccugaagccugaagccugagucgggauuccuucccacaaauaugacccugcacccccuucccuucccauuguacuagaugcagaccucaugcaucuaggccagccugucacugaccuguauccuagacccgugucaucuguaccuugccacuguaagggagaaguuucucuggaggaauuaaauuucaaugccuuuauucag

SEQ ID NO: 7286 - RNA, 629 nt, Mus musculus
uuuuuuuuuuuuuuuuugauucgaugacccaaaguuuggaaaacgagaguggggggggggggaugggaaaagaccuuuguguguaacgguaaaauauuuaaguuuaaauuuccaggaaaaugugcagacgaaaccaucagagagucaguugggaagaguggcuggggcaaguccuaacuucagguaauggcaccaacugauggcuaaaaggcaaaagacccaaccacccucagcuuacacaguagagccccacaacaccaggcagaaguuucuggaagugaaaaagucaaagcuuugaauuuccuuugagcauccugcagucagaaaacagcucagggucugugugcacugccaguccaugccacaaaggggguguguucagggucugugugcacugccaguccaugcuacaaaggggguguguucagggucugugugcacugccaguccaugcuaugaaggggguguguucagagucugugugcacugccaguccaugcuaugaaggggguguauuuguauuugugagccauguaucccagucugaaaucacuggcagaaagaggagaaaguguucgaacuccugacuguuugcuuuuugauaaaccugauuuaaaaaaaaaaaaaag

SEQ ID NO: 7287 - RNA, 35344 nt, Mus musculus
caggucggaagacuauagagugggaacucugggagguggcgguccggaaucuaagcgacggggcgagacggggcgagacggggccgguagguggcaggagggggccgggccggagccggcgggagggccaggccccgaggcccccgcccuggcuugcccgcccuggccgcagaggagaaaaaggaggaugaucuccagauacacucggaaggccgugccgcagagcguggagcugugaguggauugcucugcucgcccagcuugggccgccggagcucaagggaccuuauaaggcccguccucuccuuucccgucccagacauagggagggaaaauacuaucccggauucucaccucccagcccugguggaagcugccuuuugucuuugggucaccagcuuagggugugccuuugggacuguuagguccugaauugagggagugcugcauccguuguucccacagugcuuuugaccccacugaagauaauagcuuaaaugcuacaauaacguugaacgugucuaguucagaacaccaugcaaagcuguuugcuugaaugcaauagcgaaaucagguugagaccaacuuugcacauccuacaaauaaagaucacaggucuaaagguuguaucuagaagguggugcagcucagacguacaaaccaagggucaauccgauuguaaagccuguugucaagcaauucacacauugccgucacacccccugcaaauaaugcuaaaaagcaagcacuuugguaguuuaaaaaccugcuuuguacccuuaguaaaguguaacauagagccuuauaucuacugacugguacuuugcaauuucaaaagaaccugcaguuucuugguccuuucagcaguucugaaagauugcuguaacuagcuucuguugcucagauaaaauuagaaagcuuccacaucugaacccaauagggccugaacguuuaaaccaagucccauugguccuccucauugaaguaagcaauuucaacagccauacacuuauuaugcauuccaauaacauucauuuaaagucacaccugagauuuuuagauggauacuuuucuugccacuuagcuuuuaggaaauuuaacuagaucugggccuuccugucuauguauacaacuaagauguacaaguauaccuaaaaugaugacguagggcugguacauaauagauccucaauaagugauagcacuacuuucuucuucccgccuuuacuugguaaaagagccauacaaagaagagaaccucuccuugcuuuucagaagcauguuaucuauuaaggaauauguuauuugcacaacagcaaaucagauaauaagcuccuuagggaauaaaacuaagaaauaaucauuuccccaaagugagaaggauuuaacuuaaaaucugcuuuuaauuuuuaaaauuccauuuaguguaucaugcacaugcgcgugcaccauagcacacauuuguuuuuuugauuuuuuuuuuuuuuuuuuuuuuuuugguuuuuugagacaggguuucucugcgcaguccuggcuguccuggaacucacucuuuagaccaugcuggucuugaacucagaaauccaccugccucugccucccaagugcugggauuacaggugugcgccaccacugcccggcccauagcacacauuuggagguuaguagacagcuuccaagagucacucauuccauuaugugagucuuguugauugaacucaggucaugaggcuugguggcaaguaccuuuauuuacugggccaucuuaucagccccagauuugcuuuuauaauuauuucuaaccagagauguuaaaaauacauguuguaugaagacacucuggauaggcaucuccugagcugaaauuucugacccuguguauuguacuacuuguucuugaugcuguuuuuuauaguuccuaaaaauagccuuucccaaagggaaucauaauagagugagcaaugaggauuaaaugcauagaaaugauaguguauuuaaaugaauguuuaauguuagcuguuacagagcccauccauuuugaaguaguagcauucuuuagcaguuacuaguuauagauguuaaaaagggguuagcaagguugauugucucaguguagucucccacacccuuuuuugguucugagaaaugaacuuaguaccucagauaugcuaggaaguaccacugcuaagcuauauuuccagccuugacuuucauuuaaaauuuguauuuacacauauaagcaaggugugagguuugugugugugugugaccaccucaaaauguaaaacauucauaauuuuuuaaucaucuaccugcugggcacuacuccucuggagucuauuuucugcuggggcuugucugcuggaauaaacaauacauuaguuauucuaucuuccagacauaguuaucuagagcaggcauuguuuccccacaaaauugucuagucagacauacccaggagacaagguagguuaaacagaggcuuacaaguuucucugcccacacaucaugaaucccuagugcaugcguuucacuuaaaacagaauuaaauaacugcuuaugauguaugauuagcuaagugagagucaguguuaaaucuaaguggucuggcuccaaacauucucaguggaggugagcauuccgagauuuuacugaauuguauuguauuuauuuguaaaguuaagaauguacgcuugaauuuuuuucucuagugguagacaugauuuaaaaguauaugguagggcugaaaagguggcucaaaaguuaagaauacuuauuguucuugucgaggaucugaguuuaguuccaaacaggggcucacaguugccuguaacucaaaguccagaucugacauccuuugugcaugugguacauaugaagcauagacaccuacacaugauuuuuuuaaaaaauguuaaaguauguucacuaggggcuaacaagaugguuagcauguaaaaguacuugccaccaaggcugacaaccaaguucaguuucaggacucacaaaguggaaggagagaaccaacucucacagguuggucgcagucuucacauacacaccauggcaugcguguacauguacaauacuguaagugugacuucuuuacaggaaauguaaaauauaaagacagcuuuauuauccuucccaggaaaggacuaacaaagcacgcucuuaaccaccacccccuuccagagcgacuggaugacauuuccucuaccaacaacagccauggaaaagauacaaguucucacagguacugccacacagcaugcgugcuugcuuguugcacuugcuaauggcaaaggguuuguucauucggaccacaccugugcucgugagaccaaacaagaaauguuaucucugugagagccuaaggcuggaggcuugcugaagcuuggacuuguaaagcgcucccccccuuuguggugugugugugugugugugugugugugugugugugugugagagagagagagagagagagagagagagagagagagagagagagagaacacgcuuguacagacaccuguaggugcacagagaggcuagaguucucugugugugugcaugugcacgcaugccacgagcugcccauggugcugagagaugaacuugggccaacuuguaaaauaguucaugcucuaacuuuagagacagcucugcagcccaccagaaguaauauguagcuaaguagguaaauuaaaaaauggaucagauacgugauuuuaauucuguuccuggcauuuauuaguugaguaccauugggcaagugaaauacuggauaaugaauagaaaaauaauaaucagaaguuggugcuuuggaagcuagucaguaaaagugacaaaucuuuaguugcuuugaccaagaagaaaagacacagaugccaucuuuuuuauggucuuguggcucuaaaucagacaaaguauguaaagguucacgcagugcugucauacagugagugcaaagucaguaaucauugcaguuaccaagcagggggcucugaggagcagcgugcugucauaggaaagacuggaaaggcaauaucuagggucaaaccuggggauaaagcucagauuccgagcaaggcuggagagauggcucagagguuaagagcacugacugaucuugcagagguccuggguucaauucgcagcaaccacaugguggcucacaaccaucuuuacugagaucugaugcccucuucuggugugucugaagacagcugcaguguacucacauacauuaaauaaauaaauaaaucuuuuaaaaaaaaacaaaacagagauuccuggaguuuuaaggacaguuaauuagaccugcacuggcagccuacaguggcguggguuaaaugacaggcauuauuuaacacagcugacauccauucuauacagaauccugguuuuuacagggcgcuuggauuccaaguuuaccuuuaccucuacugauauauuguauacaugcuuaccaccugauaaguugcugaguaaacauaagaauuuucuuuuuuucuccccuuuucucaaauuguccauuuagugaaucugacaucacccaagaaucacccauuacaucaacugacacugggaauucgaauucgcguucugcuuuuccaagcuacgcaggcacaggggucucaacagaaggcagcuccgacuucucuuggggauauggugugaguugucugcuaaucguuagccgcuguucuggggacugagggaccaucaucccgccagucucugccccgugugcgugcgugcgugcgugcgugcgugugugugugcgugugucuguguguguguguguaguguguacacgugcgugugcgugcgugcgugcgugugcgugcgugcgugugugugcgcgugcgugcgugugugugcgugugucuguguguguguguguaguguguacacgugugugugcacacgagugugugugugcgcgugugugugugcgugcgugugugugguguguacacguguggaugugugugugugcgugugcguagaaauaugcuugccuuguaaacaagucuggaggucagaggacaacauuaggugauuuucuugaucacuuuuuaccuuauuuacuuauuuaucuauauauuguuuuuugagacuagguauuuuuguguaacuucagguaucuugaaauucacuaaguagacuaggcuggccucaaacucacagagauccauacgccacuuccuccccagcgcuggaauuaaaggcgggcaccuccaugcccagguauuuuacucagcauccaugcuucaagacaagguuccacuagguagcauuagcugucuuggaacuuguuauagagaccagacugaccucagucucauaaagaccugccuaucucuugcuccuaagugcugagauuaaaagcaugugccacucuacauggcuuauuuauuuuuucaguuuaauuuuaaaagcauugugcaugcaugcaugcauauuauguguggguggggcugguaccacuguccguguguggaagucauaggaccacuuugugaagucacuggacucaggguaaggcuugcaggcuagcaucuuaauccacugagccaacuguccagcuccaaccauagugauuucauuuuauuauuuuaagauuuauuuauuuuauguauaugaguacacuguagcuguacagguaguugugauccuucaugugguuguugggaauugaauuuuuaggaccucugcucgcuccagucaaccccgcucacuccaguuggucccgcucucucuggcccaaagauuuauuuauuauuauacauaaguacacuauagcugucuucagacacuccagaucucauuaugggugguugugagccaccauguauuugaugggauuugaacucaggaccuuuggaagagcagucagugcucuuacccacugagccaucucgccagcccuccaccauauugauuuuaagcaauauaguuagcugcucucuuuauagagaauccugauuguuuuaaaucuauuguuauuaccauuaaucacuuucuaauaguuuuucauguaucuauaguucccuuaguuacuaugcauguguguacuauuuuguagucuccuuuugucauuuaccauuguuaauguugauguuuauuauugccuccauaucugccagcuagaauaguauauauacuaguucuugguguuaacauauuguaauaugaucauucccguauuuauuguuuggguuuucagguuuuguuaguuucuucaaggaauauuuugaguguaucuaucuguugcaguuguuacuuuagggugagacuuucauaguucaguagucuagugaggagacuaacaaggacguaagguacagagagugacaaagugcucuagcauugugcuaaaacaggauguaacaaggaguauuuacuuagacucuagaguguaucguaggcugagacuuaggacucaagggguaaucaugugaagaaagagaaaaagggacuuucagacagauaaaugucggggcggggggcuggcaaaauggcucagugguuaaauaucacugguaccagagucuagaucccagcacucauauaacaaguuggaugcuccccccaacccccagugccuguaaucucaagauugcuggugcuugcuggcucccagccuagcugagacucaagccccagacucgggaagagauccugccucaggaacaggagagaagaaaaccuaaugugcuaggccaugcuggccucacacagacacauguacccuuaaaauagaagagucugaagaggagaagaaacuagcauuuuacagguaaacauuguuggaacugaagagaagguggguggguagaugagaucuaagauggugaaucuggggaggacguacaaaugauauggagcaggugagcaggacucuaucuaaagaccucagaggugggggcgggcaucaaacuauccccggugaauuaaucugaugcuuuaucaggaggguucagugagcuggcuaaacagucccaucaccucugaguugucaucagucuucuuagguucuaaguguuacguacauguuuccuaucccuuccauuccuuucagcauuuaguguacagugaacacaugaaaaauuacuuuaaaaauccuuuucuguaaguuguccuuaccacaaaaagaaaagaaacaucugaaaauuccuugagauaugaaagcuuucuaacuuagcuuuccuuuuauauaaacaugguaucucaaaugaacuuuuuuuuuuucuuuuuuuugguuuuucgagacaggguuucucgguguagcucuggcugucauggaauucauucuguagaccaggcuggccucgaacauagaaauccuccugccucugccuccuaagugcugggauucaaggcgugcaccaccaccgccugacuucaaaugaacucuuuagaacaaaccaaaauaugauuacuuuuauuuuuauuuugcagugguggagauugaaauauucccuccccucauguguaucugucuguguguauguaugugcaugugugugucugucuguuuguguaugcaugcaucugugccugugaguguguguuuguguguguaucugugucuguaugugugugugucuguguuggggacacacaacuauacaaaugcuaugguaugaauguagaguucagaagacaacuuaugggggcuggaaggguggucaguggauaagagcacuggcuguugugcagaggacccaguuucaauucccacacagcaguucauaccugucugucacaccaguuccaggggaucugccacucuugcaugcaagcaaaacaucacauaaaaauaaaucaaucuuuuuuuuuaauuaaaaaagaaugacaacuugugaguacaaguugacuuaaauauagaaaccucagugguauuaucuacugguacucauucuguacagauuuuuuuuuaauuaaaacuuauauagaauuauaaagaauuugcccaaaaaaagcacacaccaaaguuaguccggcccgaagcauguccaucucagugacucguaaguacguaaacagacuuggugagaaugcaugaagugguguaaagcgccaggccuucagaacugcucgucugaccguagagaagcucaccggcugcaguuagagcucaucuaaguguugggcauggccuuguuuguuuguuuguuucuaggaacuugaccagaaugccacugagaaagugcaggccauguuuacagccaucgacgagcuccuguaugagcagcagcugagcgcacacacacagggccugcagaaagagugccagcagugggcggccagcuucccucaccucagguagcacgccugcuucccaaaccuucaggagcccgagggguuuucuucuuugagacagagucucacugugaaacauuggcugaggaggagcucacucuguagcccagacuggccuuggcccacgaagguccuccucucugucuccagagggcugggacuuaaggcucaccuggccuaagcaugucuuuuguuuugccuuaugauuugguuuuucuuuguuauugguugguugguuuuuguuuuuugaggcaggguuucucuguguagcugugacuguccuggaauucacuuuguagaccaggcuggccucgaacucaaaauuccaccugccucugccucccgagugcugggauuaaaggcguacgccaccacgcccggcuugguuuguuuuuaauguacaggauuuugaugaaauuaucaaagccauguguguaaagccucagcugaaagaaaacucaaguuaguacaaguuuauuggaccucuccuaacaccaugaaauucuaauugaacauuuuuuuuuuuuuuuuggagacagggccucacuguguauaacaggcuggcuuucaacucauuuaucugccugccucuaccuccuuggugcaugggccaccacaucuagcuaugaguaaaacuguuuuuugaaugugccuguguacguaugacaaaagaucucaggaagcccagguuggccuugacauuuuuuaaaaaaauauuuuuccuuaggcuggguaugaugucacaugccuuuagucccagcauuucagaguuagguagaucucugugaguuuggggccaaccugaucuacauaguaguaucuaggacaaccagagcuauauaguguaaccagucucaaaaaaaaaaaaccuccuuauauguuauaaauguuuugccaaaauguauauaaauguacuguacauguaccuggugcccacggagcaugucugauccucugaaacuggaguuagaugcaguugugaacugccauguggguguuggaaacugagccugguccucugcaagagcagaaagugcuuuuaaccucugagauauacaucucuccagacccaagcauuguacucugcauuugagcugaugaucuugaacuccagaucuuccucuagccucuaccuccugggacugcagacaugagcuaucaugucaccagccaaguaaaauagaucaguagcuggcuuuugagugucagucgggacauuccagagaaccuuucuuuugaaaggugugugugggugagcgugugggguaugugcuggggaugaacccagagccuugucaagcuaggcagguucuaccacugcacugcaucccugacuuuucuuggacgugaaguuccuggacgauggcuuucucuuuuccauaaauauucuaucaaagggaagagccauucuuaaccagcguccggccgaauccaggcuuuccauggagaaccgucagacuuguugauaaaaugcuuagcuuuuacaugcgugccaagugaagguacuucacucuguguucuguuugaaggauucuggguaggcagauaauuacuccgagugaaggcuauggauuguacccucgauccccuucugcugugucagcuucacaugaagcaaccuugucucaagaaagagagucuaccauguaaguauuuuaugaugcaagcacaccagucaguccucuaacuugcaguaauggcuccuuuggaagguuggugacacagaagagcaaagccuagguucucagaugugugugcuaguugugcucuuugaccacauuuuguucuuggagguaucagagaaguguguccugaguaaaaguguuuuagaucagcguagcagguuaccauuaaauaagguuuaccaauggcuaaagucucuacaaaaauccuaucaauuugccacauugcauuaaaaaagcuuccaauagauuuccauugccuuuaaaauaaaauauaaaauguauaagcuggccuugccugcagcucuauuacagcagcuggcccugccugcagcucuauuacaugucauuuucuugucucucacucagcaaucuucccaaugcuggcuguuccucauaucuuaaauacguuaagauugcguuggucuacuuucaguucuggaaguguucuuagacugggaggaagccacacauaagcaauuuaguaauuaucuguaugucagacugacacacacuacaaugccugggauaccacugacauucuucaacuuccuuuauguuuuuuuuuuaaucuaaaugagaaaauaacauguuuucaugauaauagaauacaccaaaaagcagacuaauguauaaauugagauuaaaguugucuucaacauaaaugguaguguguaggucaaaaugguagcccaggaaguuaaagcauaagccagaaaagaaggagaguaggaaggaaggagagaaggaaggaaagaaggaaggaaagaugaaaaguugagucugcagggauaaaacuaugcauucuucugcuucagguuaauuuaagaguugugucuagauaggguuucacuauggcccugucugacuuauaauucacuauagagagcaagauagucucaaauucacagagauccaccugccucugcuucuuagaugcugggauuaaaggcguauuccaugauacccaacuauauuuauuauaaauacaaauuccaacagcgucuguugauagcaaugcugugggggaacuagaucccaccuccuagguaacaacaucagcccuuaccauggugugcacagaacagcagcccuacagugaagcacagggcaaacuuccacaacacuggcuuuacagugacuucuaggacauaauauaggcaacaucaaaacuagucaaauuccugaaugcagauaaugaccagaaggagagaauaggauaaaggauaaaguguuggcaaagcuagaaggacauccaacagcgcaaagcuaaaaacagccuaacugaaggugggcagaggauauaaauggacaguucucuaaacgcaugugaauggccaucaggugugugaaaagacgcucuguguuaucaucagaaaagaacugcaacucagagccaggcaguaucaccuagcaugccaagguacugagucugauaccccugacacuggaaaaaaauuagaauaauuuaggaaaguauuaccaggacaaagaggacuuguuccaaaaguuauguuacuuguugugugggagcuauuuuaauaugucauuaauacugcuuuuucuucccuugccaagauuugguauaaggggaaagaaguuacauuuuucaucuucuuauaaaccaucccccaccaucaaagccuccggcuugugugcaguuggaggagaggaggcagacuguauaaucuuuucugaagggguaaucgaggaguaccuagcuuuugaccacacggauaugugaguacugccuuuuaagauuuuacucugguuuauguauuagcagcuacuuuuuuugaaacugcacuauugauaucaccuauaaguagauuuguaacaauuuggacucuguuuccaguuagcuccaacauacagagcucccacacaccaagagucccuccauaccuuccuccuucacuuacauuuugccuuuuccuacaaacaaagauuuuuaaaugacuaauuuuaucuaccuaauuugauuuuauccuuuuacaaauuaucaccaguggaaacagaaacaucaaagaguaguugaagagaugugaacuuuguuuacuuaaaauaaacuuucuuacuuuguuauucuaguuucaagacaguauuucacucuguagucuuggcuggccuugaacucauagaaauccaccuuccucugccuucuaaauucgagggcuaaagaugugcgccaccauggccaucuaauucuuacuguaaaaggauacauaguugaucaguuaauaauguuuauuaauaucuacuuguauucugauaguagacauagaucagauguuaccuggagaugggacaggugagacccagagugcuuaagugaccugucugaggcaaaguuaagccaaaaccucauucagcugcuaaccucagcgcuuucaccaugccgcaugcuaccugucugaaauguaaacugcuugucuaagucuuuaaaaguuguagaauuacugagauguggcucaauugguaaauugucuuccuaacaaaugcaaagcucuggguucagucccuagcauccgggaaacugggaagaguggcucuugccuguaaucccaguagucagagguaguaauagaaucagagguuccauccucagcuacagaggagauuaaagacaagucugggcuauguaagacucugucucagaaaaaaaaaaagaaaaaggccuaaggagauggcucgguggguaaagugcaugucauacaaaccugacagacugauucagauccuuaggacccacagaagcuuaaugcaguagcacagaugacugucaguccagauuuuuuuuguacagggaauugagaggcagagccgagacaaucuccaaaagcugauggagcaauuagcaugguauaccuacuagugaacaagagaaaucccaucucaaaaaagacagauggcaaagacugauaccuaagguuguccucuacuuguguaccauggcaugcacacauccacauucacacucacacacacacauacacacacacacacacacacacacacacacacacgcauagcacacacaaaaauaguuaauggggaaugaccccuuauuuaaaacaauaauauuuccggaaccaauaguuauaacagcauaucuggaagugccugcaugguguuaggcugugggguugccucuggugauugugucauaugcuuauagacaucucuucuuccugugguauuuucuacagccauguccacuccugugcucacugcugugcacacugcccuacagccagcaaacaggcagacugcuguaccacacaccacugagcuagcucugugugugaggggauuggaauuaguguguuugauuuuuccagagacccccuccuucccuggucuuucucaucuacuucugucugguuuuucucaaaucaaaagucugccccuuugguccuuccuccuaaguuaugaagaaugaagcugacugacugacuuaaaaugugauacaaauggcgggcaugugccccuagggcaccuugccuuuguucugaugagaguaaaccgaagugagucuucagguaaugugggcaagacuuugaaaguucagcagccuuauuagauauguuaccaaaauauauucuuguaaagugacacaauagguggaccuuuagaauguuacuaacuaaaguuggccuucuagaacaggccuguaaucacaguuauucaggaaacggagccgaggagagucacagguucaaagccagccugaguuauaaagugagaucaggccagcuuauacaacuuggggagacacugccucaaaauaaaaaguuaaaaggcuagcgcuauauaucucagugguaaaaaaaaaaaaaaacuugcccaacaugcagaagaucuugggcugaaacuccagaaccaugggggaaaauguugcaaacugaagauauugauguucacacauaaaugagaaugccugcaggaaaugaguauaugugauagcuuuagcaagcagcuucuaacaaauagagacaccuccaggaaaaagucacauuccuaauuuaaucuuucuacaguuuuuuuguuuuuguuuuucgagacaggguuucucuguguagcccugguuguucuggaacucacuuuguagaccaggcuggccuugaacucagaaauccaccugccucugccucccaagugccgggauuaaaggugugcgccaucacugcccagccccuuucuacaaauauaaauuuaaauuuaaauauaaauuucacacauaaaauuuguauuaucugaucaaaucauauagguucaaugaauauggaaguguuuguuuguuugugacaagggcucacuauauagcccuuucuggccuggaacuugauauauagacaguguuggcuuugaacucacaaagauccaccuuccuucccagugcuggaauuaaaauuaugugccacuauuuuaguguucaaaugcauuuuuaaaaaccuaauacaaaaucuuugagucauauaagaaguucuuaaaugaugauauuagguggcauuucugcauaggaaaaagaaacacaaagucaaaaacagugacaaaugaggcaaaaauguaugcacuacguucauagaguuaauuugcuuaaaauauacaucaauaagaaaagaacuaaggauuaaucaggaaaaggaagacaaacagaaaguucuuaugugcagaacaagcauuuaaauucaugaagauauaaaaugucagacagugaugagcuacugugcgaucuaucagggugaaaggaaagcagguguauccuuacuaccugauucaauggcguauucuuucccugguggaauagagaagcucuugagaagaugguggaccuggucgcucacauugcaaagcaggugcccucacuaauuguacuuacaggagucuacucuacagaugucaagaaggaacccagguuuuucaagugagaacuccuuuaccucacaaggcagcuucaggugcugcgcuagcugaggggaggagggcggagcaggcgcaccaagcacauuuccgagugucacggacagugguggugcuuaggggagaauaaucaugaagucuuucccucuugcuucuauuccagggaagagggauuucauggaaacaaaucagaagcagcuacagagaaacagaaguuaggguacccucccauugcgccauuucacugcaugaaagaggauguucuugcucauguguuugacaacguguggagcaaggcugugggcuguauggagcaguugacgcguagucacugggagggaugugcuucugguaaggauccucaugacaccagugugaaaauaacuauugaugacuuacagaccccagucagucauuuguaugugugugcugcugcucaaacccagcacccuguguguacuaggcaaacacuaccaccaaguuacaacacaaccccucuucugcuuuuuaauuuugagacaagguuucucugaguuaggcaggcaggccuugaacuuaugacccccugcuucagccucuugaguagcuggcauugaccagccuguacuaucaggucuggcucuaagacgucagggcuuaaaugcuuuacuagagcagugcuuagagaggagagagagcgaaaccauucuuucuuuccugucugcacacacauaaacacacacacacacacacacacacaccacaacacuucuaacacuaaguguauagggguauccccacacuuacuuaauagacucugauacaccaucugagugcccucuugcucaguucucauacugucuagaagaagcuuuagauccaaggguucagucccacagcuuagccaucccaccucguaccucgugugacacuuugaagccucaagcucugaucugggcuucucgucaagcauuagaagucacgggaacccuuucuuagguuugaucaauuugcuggagugguguacagaacucagaaacguaggcuugcuggcuuguaaagaauaccacaaagaauauggaugaacagccaaacaagaggugcaaaggacaguaagggagacagaaaggguguauccauaccacccuccaagcaccuucaaguguugaguagucuggaaggccuuuauuuggguuuuuacaauccucauuauguaaacaugacugacuaaauaauuggccauugaucaguucaaccuucacaggucaggggaauagggcuaaaagcuccaaaccugaacacacgguugguucccacugucaauuaacucucucccuugucacuaaccugaaacucuucaaacucucccaaccaccauccauauuuucagaacauaggaagauacuauugcauugaagacuccaaggguuuuaggaacuaugugccagaaacuagguagagaccagauaaguuuuuuuuuuuuuauaucaaauaagucugauuaaaguugguguuucucacagagacuagcaaagaacuuaguaaauauuugagcguggguagaggaguaaugaggccucaucuguggucaucagaguuuguacuuucuccuccgacacaucugugaggaggccauguaaguagugcgugcuucucagacugucugagugaagaguaguuaacacacgugacaccucacguacaugaaguggaaaguuugggaaguucuguucuauguaguauauaccugugaagcccucaccacagucaguacagugaccauccaucacucccaaaaguucauguccuuuauaagccccuguuucugucauuauauguuguauauguucccaaaaaaaugcuucugcugagagaagccagacagaauauauggugguuuggaugaaaauggcccccagaggcucagaggaaguggcauuaguugaaaggauuaggacuuguggccuuguuggaguacauguggcauuguuagaggaaauguaucauuggggguggucuuuggaguuucaaaugcuuaaagccaggccucuuccuguugucugccaauccagauggagaacucucagcuccuucuucagcacuaugcuugccugcgcacugccauguuucccaccaugaugguaauaaaccugugaacuguaagacagcaccaguuaaauguucuccucuguuagaguugcuguggccauggugucucuucacagcaguaacacccuaacgaauacagaggacacaccacauaacuccauucucacagacaucuacaaaagcugacuaauuugcagugacagaaauuagaugacuccucuguuagguucuuccauuucagcauaaggauuugagauuuagcuaccuugcuuugugcaucuguaauuccuuuuauugcuggguguuauuucaugaagccacaguuuaucaauuuaccuuuugaugggcauuugaauugcuuuccacuuuagcugguacaaacacuauaauguacaagaauuuagggguacauuuuucuguuucucuagguaaaugacuaauacuagaaugacuggguuauaugguaagauauauaaauauuuuguuacaaauuauguuucucuuuaccacucaaacuauuucagaccucacaguuuuaaauaacacauaauauuaucuuacacauuuguggauuagaaagacuagaacaacuuaaugaguccuuugcuuaggaucucacaagacugaggucaagauaguggccaaugcuauguuuuccuguggaggcuaaacuaagaaaggguccucuucuauuucuguguauacaaggauuguauacaaauccuugugacugauuuucauggcaaguuuauuuuucaaagacagccagucaaaaacagaguuaagcaauucauuuauuuauaacaucaguuucaggaggagucucaugcccgcuacugaacuccacaggcacuucaugcacauuguacacggacaccuaaaauaaacauaaauaauaucuuuaugucucuaauuauccuccucuuccuuuuauacugccaguuuccuagccuacuaaaaauguuuagggauaaaaauuaacucuagaaauggaagagguguguacugaaacaaacaaaaacucaccauaugaaauuacagaagaccaaaaccuaaagcagcgugggaaagaucgcccguguccauggguuggaagacgucacacuguugaggugacaguacuuccaaguagaucuguaggucuaguguggucccuaucaaaacuccaacgccugagcggagcugggagugugaacagacagaugcugagagagugcuuggcucucagaugcagaaccaguccagcggcguguuuggggaaauaggcaagcagcugcugacguccucuggagcugcucagacccuccaccgccaaaacaguagugagaaagaacaaagucaggaacucacuuuuugaauuuuaaaauacuuaaaauacgucuuuuauuaagacuagcaaaggaagagagagagagaaaaaaaagacuaccaggggacagauauauccaugugguaaaaacaaacaaaccccaacaccuacucugaaggauuuuaacagggcugccuccggagauuagucagugcaggugacgccuucccgauaaaugcagcuggagcaaguggaucccauacagaaaaaaaagucaccuuggacccucacaccccauuauuuacaaaagcuaacucaaaaguggauaagcaggccauggaacacucaguggcuaagggcgcuugcccaucaggccugacaaccggaggucaguccuuggaagcuauauaaaggagagaaacaaaucuagcacgguguccuuugacuuccacacuugagcgguggcacauguauguccacaaacauuaagauggugaaagacaaaccacauacgauauaugauuauaauacauauguauaauuauaauaauauaccugauuaggagcugguauccagaggagagaaagaacugcaacuuaauuuuuaaaaaggacacaacccaguuuauaaaacugggcaaaugccuucaacagauauuucaccaaagaucuaaaaauggucagaagucauaugaaaagaugguguagaucaauuaaucauuaggggaaugcagauaaaaaacacagugaaaugccucauuguccucgcuagggugugugugugcucgcgagugugugugcgugcguauaugugugcauguauguggggggugggguagguaagagaugacuuuuacuaaaaugugaaucuuuuaagaauaaacaaaauggggaaagaauugcaaaaauggagcccucuugaauugcugguggaaauuaaagauauacagccauuguggaaaguuccuaaaacguuaaauuaccauauaaccuaggaauuccucuacaaaguauauuaccaaggggacugagaacccuguuuacacaagaaccuccacauguguguucauagaggcacugucagaaaaagaccuaaaguggaaacucagguguccaucagcuaauggagaaacacaguguuacauaugcauguguuauaggguaaauugugugcccucuaaagguccccuguugacacucuagcccucagugugcuuuuaggguaucuagugagguacuugaggcuaagugaggccgugggauagcagcaccauaagucaguaggcugguguccuuauaagaaaaugaagagacaccagagaucucuuucucuuuccacacaugcacagagaagaggccgaaugagaacacagcaagcagguggccaucugcaagccagaaagaagccauaagagagcccagcccugauggcagcuugaucuuggaccccagaacugugagaaaauaagugucuauuguguaugccacgcagccugugaucuuguuaaagcaacccugagagacuaguacaccacacagcagaacauuauucauccauaaaaaggaauugaguacccauccauuauuacaacaugggugagccuugaaaaucuaccaaaugaaaggagacagacagucacauauauuauuaauguauuguuuaauucauguaagacauucagagcagacaaaagcacagacauaaaguugcaggagauggaaaaagaaggggcuuggcgugaugaggguuucuaaauggcacugagugcuagggaaacugccauaacacacacucacacacucacacacacaugcacgcacgcaccauacacacacacacaccucaccuggggcuggagaggaggcucagugguuaagaguauuugcuguucuugcaaagaguugagaucuuagugcccacaugguaagugguucacaaucauuuguaacuccaguuccagaggaucuuacgcccucuucuggccucccuguuuacuacaugcauguggugcacaaacauguagacacucaaacauauaaaaaaauuaauaaaauauuugaaagacuagucugaauauguucuuuaauauuauuugggcacagaucugcuaguuuuucuuuuuguauuuaaauuuccucuagucuaucaacaguuuaccuccuaguacuuuaaagauacugucuauggccuucugcuuugcauuacuucuaacaagacaccugaugucaucugucccuauauaucugccaagacuuggguuggagggcacacaucaccacacucagccuuuggucacuugcaauauuuucuccuuauugcuagugucaagaaguuugaugauguacugugauguaguuuucuuucuguuucuucuggguggaaguggcuggauuuccuguuucuguacauccaagacgcuuucauugacauuuucagcuauuauuucuuuauguuuuuccuuuuucuaaucgucugucaugacuuggggcacuuagaaguggaucugucucauuacagagcccucaaauaauuuaggccauccucucugaagcucaugcugcccuggguauguguaccacugugcuuuuguugugucugucugccuggaauagccucugucucucuccuccucccccuuaaugcccauacucaaaucuauauuaauaaaauuauuuuuaauaaaccccaaccuugcuugaaauuucuuuuuuccccuuuguuuucucugugacccugcaugcugugccuucucauucaucggucucgucugcgcuuuaagcuacuaacuuuauucacuguacgucacuggugugagcucagaguugaccuguaggaucuuuauacuuccaugccuccaucucauaauuugaaacaauagaauaaugcuggguguuuuauuacacgccuguauugccaauacucaaaggcugaaguagaaggaugcugaguucaagaccaaccuggacuauguagugagacccuggcaaaaggugggagguagaggaacuugaaaucugucacuaccugcggucuucugacacccucucacugugagcuguaguuuccugucuuuuacuuuugaguuuuugaucuuggaaauuaucuuaggcaauuguaggccguaucuuauuuguuuacauuuccaggauuuguugcauuguuauccauuguccacuguaugagcgcacgcccguguuucauggcuuuauuggcuguuguaagcaagugagugaguaaagccugucacuguugcaucuuguccaggagcaaacgucuagcaaauagguuuuugaaaccauacagaucgggcucaaauugacuagguagcaggguacaaguacucuuaguugcugagccaucuuuccagccucaaaucgaauacuuuugaaguggggauguagcucaguguuagagcacuuuccuagcacgugcuagguucugaguucaauaccaaauacugcauacaaauaaaauaauuuuaaaguagauauuccugaaugaacagcauccaaauccagaauagaaugcuaccgacacuccagaagccccucuugacuuccaacaccacagauuaauuuuguuuuaaauuuauguaagaauaagccaggcgugaugguauaugcauaugaucccagcauaagaggcaaaggaggggaaucgggaguuucaacccacuuaacuacauagaacccaacacuucccaaagcuaggaguggugacauaccccuuuaaucccaccacuugggaggcagaagaucgaagccagccuggucuacagaaugaguuccaggacagucagggcuauacagagaaacccugucccuccucccuccaaaaugaacaaacaaaaagaaaccauuucccuaaaccagguauagagggacacaccuuuacuucucaguacuugggagacagagacaggagaaucucugcgaauucaaggauacaaagauacuaucucaaaaauaaaagagagagagagagagagaaaaggaaaagaaaaaaaaaccuucccucaguuauuuggguaguugaugguuuuuguguauacacacacacauagaauugguaggucaugugauaaacuaugccaauaucaguagcaucuccccccagauuuuucuaaugugacuuuauuuaugcauacucucucagcuauugugaauuccaguuguccaaccuuugcuguguuuguuguugucuauguguauucccuucugagauccaagagaacagaacuaauacucuucauuuaaugaccuggucagggccagugagagggcucagcagguagaaauguuugugugcaagccugauaaccuuuguccaaucccccaaucucaugauggggcaagaaagagcugacuccuuaacguugcucucugaccucugcgcaugccuacgcacucgccuuggcaugugcacacgcucacuuccccaccccuucauagacaaacccagugggagauaaagcagcugcuuagcuuguaguggcgcacaccuagaucuuagcacuuugguggaggaaggaagaugaggaacugaaaaucaggccuggcaacauaaaacgcuauuucuaaaauauaaauucagugaguugacuuaaaggcccugaaagagagugcccuuuugucacacagagccagacaaacccuuuuccuuuuuuuuuuuuuuuuuuuuuuuuuuuuugguuuuuugagacaggguuucucuguguagcucuggcuguccuggaauucacuuuguagaccaggcuggccucgaacucagaaauccgccugccucugccucccaagugcugggauuaaaggcgugcgccaccacacccggcugacaaacccuuuucaaggacaguuauucauucucagugccacuuugcucugcccuccagacuaaaggaagcugggaacagccuguaaaagaacacucccguacuuggugcaaagauaacacuugcaugcagggcucccauagaccaaguggcucuuugcaugagagcaaacuggccuggaacaaaccaauagagugacaucuucucccaguacagaaggagggaagcuaaucuaguuugcuuuuguugcugugauaaacaccaugaccaaaggcaacuuggggaagaaaggguggaauuuguccuggucuuagucaccagggaaaacaagguaggaacugaagcaaaagccauggaguagugcugccuucugguuuguucuccauagcuuguucaaccuuucuuuccccuuuuuuuuuuuaagauuauuuuuauuuuauuuuuauguguacauguauuugccugcaugcaugucuaugcaccauuugcaugcaauauuuguagaggccaggaagguggugugagacccccugagacuagaguuauaagcaauuuugagccaucuagcagucuuaaccuacuuucuuauacaccccagaaucauuuguccagggguagcaccacccacaucaaucauuaauccaaaaaaaugcugcagauccauaucuauaaaccagucauauggaagcaguuccucaauugaguucccucuuuccaggugacccuaaauuguguugacaaaaaaacuagccugcaguuuagucacgugacaaucuguucugcuuuauguuugucuguaagccaaaaguguauaaaacugaguagugcaaccagugguuuuuaugugcauuaguuuuuugucugcauaugucuguguaagggugucagauccccuggaauuagaguuaaagacaagugugagcugcuguguggguguuaggaauugaacccaggugcucuggaagagcagccagugcucuuaaccacugaaccaucuuuccagcccauaaccgguguucuuaccgcucacaagugcagauggauaagaagggccucaguuucuugcaggagcuucagcauuuguuugcacauaaaacuuaauucccugccauccucacccagggcacuuuggcucagccaugcuaaagauacacagagcuaacuagagcccucggaggccucagagcuucuguuuguuacaguucucaaucacuaggaagaaaauacuuagcuuuaaaucauuaccauggcuugacccugacuugcuaauggggaacaagguucacugcuaauuguuuauaaagagauggaccaccucugaguuagauagugaaccaaaugaugauaauggaaacgauuuagaggcagggaagacuacaagaguucauacugguuucacugggaaacaugauuuguccucaagcucauuuuuaauuauacuuaauguugaaaagugcagaaaucccaguucaugguggugaggcucugagaguaaaggagcuugcugccaaggcugccagccugagugugaguccccagagcccaccuggugaaaggagccagcugucaagguguccucugauaggacucccuaggagccccacgguacagguacaugcauacaaagaaauggaaugcaaaacaguucuugguuuguuuuuuccagacaggguuucucuguguaacccuggcuuuccuggaauucacucuguagaccaggcuggccucgaacucacagagaucugccugccucugccucccaauugcugggacuuguaccacuaccaccccagcugaacuacaaaaauuuugaauaccaguuuguuuuuaaaauagugcaauguaauuuggcaguuaacgacauuaaugcugugaacauccuuacacauuucuuuacauguguaaagugcgcuuaccaagguggaggguuggucacuguucaguagacaacaguuauccaaagugauggugacucuagugccacugcucggacacaaguucugugcucagucuugucaaucuucuucuucuagcucuaauuuuuuuguuuguguauaaaaagauauuuuugugcacguuuuaaaacuaagguauaauuugcauacagaagaaacuuucagcauuuacuuaagauugucccuuuuuuacauuugugugugugugugugugugcgcgcgcgugcaagugcauaugcuggcgcugcagagccccaggagguugagaccccuagagcugugguuucaggugcuuguaagcugccugaugugggugcugggagccaaacucuggguccucuuagagagcagcagguguugcuaacuauggagcugucucugcagccccagauuucaugucuuuaacccucugcucacauuuuuguuuaggggguuuuguagauuuauuguguuuucuaaaauuugcuuuuuauaguuugcacuuacucauauauucaggguguuaugguuuuguuuuguuuuuuuuuuuuccaguugguugguuugugagacagucuuugguguacauuuggugucuguccagagcugauagugcuauggcgcaugcccuguuuccagggcacuugcucuccuuguagaaaacaugauuuuuaacgcucucuaguuucauuggcauugucugugggaccugaagucaggauuaaugaucucaagguucuagaguuagacugcugcauacagcauuuuaagagucccaugguauugccgcuuauggccaccacauugggcagcacugauguaaaacguuccaaagguugucauagaucucagcuuacccucugcuugguaccaccagccauugucagcacggaaccacuuuaaacugcacucugagcuugcggguuauaacuacacggguguaugcaggugagcugcagaucuaagggaagccuuucuugagacuacuuagcugucagggagauuuuucucucagaacuuuacaucagaagaugccuauggauaauagauccuguuccuuugcucagaugaugagaguaacguugaaauuaccagacuggauucaggaagucccuaugugcugaacgaacagcauccuuuggucuuaccucgagugccgcagucuaaagugccgucuaucaccucaaguccgguaagccccagagcggauugugagaauccagcacuguucuugccacaggaagcuugcuuggguguuugccuugguugccuuauuucuagccagaaauuucauaacaacauacuuauuugagagaggguuucauuguguagcccauccuugaacucacaaucccccugccucagcuucucaagugcugggauuagaagugguuacugcuaguuuuugagagaaagaaggaaaaaauauuuaagacaaaagaggugacauuagaacaacuggaauuuagguuauuaaauaggccauggggagacaugcaccuugaacuucuggcuacugucagauggcugguacaggaagauuaccugagccaucgcuucaagccagccugugcaacacagagagacacugucauaaaaauuuaaaaauacaaaagcaaaaaagcccaaccaaccaaccaaaaagagagagagagagagagagagagagagagagagagaaagagagagaaagagaaagaaaacucagaaagaacagugacuggaaccagugcuccaggcuaguuaaaaguaaguaagaguucaggacaugcgcagauaaaaaagaccauuacuuugcacuuauuuuuuuuuuuuuuuuuuugguuuugcgagacaggguuucucuguguagcccuggcuguccuggaacucacuuuguagaccaggcuagccucgaacucagaaauccgccugccucuggcacuuauuuuuucuauuguuccaaauuuugcuugugauuuacuauucagguuuucuuuucccuuguaagcaauaauaauguuccucucuccccugagagugaccauuaagugcucucaucugaauugaugagcuuucacuuagaaauacagaacaacaaagaacccuguucucuugacagugcccucugggggcuacuggccaacucuucuaaaaguuaaggcacaaggcgggggauggauaaauaaccuaacuggaaacacuaacuuugcaaacuuagcaaaucgagcagguaucuucaccaaccacugucugcuuuugacauagaugaguuucugucaagcaagcggucaucagccaaacgugaguggccucuugauucaugggaugccucuacagccaaggaaucucucccugauggacaagcuccuguaagaagcucaaguuggaacacauucagagcuuaaguagaaugcugaggaaaagggaaagcagcucgguuaucucugcgccgccaagugccagacacauccagggagaacacauuuaaggggcaaggucucucugccugagaacugguaacuggguacccgaccuguccucauacagccucguguggcuaagagucacgugagagcugcccggauggagugcuguguagucccaaaggagaagacucucugaugagucugugucuagggauucagaugaucaagaguuggagaugggaauuauuaaauacuuaggaagaagcagaccguuuugguuuagaaguguaagaugucagaacuuaagugcuugguggccagagggaucgcuuagugacuauaggugcccacuaccaagccugacaaccugaguuugguucuggggaccuacaugauggaaggaaacuggcuuucaaagaaguauucuccgaccacacacacacacugacaugugcaugcccacacacagaaaaggaauuuuuugugggggcgggggagagacuguuucucuauguagcuuuggcuguccuggaacucacucuauagacuaggauggccucuacucagauccaccuguuucugccuccugaguuguagaauuaaaggcauacaccaacacaucuggcucacaaaaaaguaauuuuuuuagaacuucaaugcuuccaaucaaagaucaucgacaauauuguuagauuauuauuuaugaauaaaugugaucagcugugaaugucacauugguacuuguccauguguuguacaugaccacuguaauugggcaucauaauuuacgcuguguucacuagguuaccucuggguuggguuuacuaugcagaaaggcacuauauguauuuugcauaggucauuuuugaggacauauagucauauuucucuugagucaauaccuagaagcaagaagaugccaaacaggugugugcuuaauauuugagaaacugccaaaguacccaacagucucaccagcaaagcuagcuucaucuggggaccaugcauuaggggcugaggcagacuccagucagaaggaacggagaguaaggaacacaccagaacucaggcaagagcuguggggucugcagucagcacuagugcaggaucacagcggagcucgugaucucucucaagcauuccauccccaccauucaaaggaggacgaaggacggggaauagcagauaauguagcaacaggaaucaaaguaaaaacaugaauuccaagcucaggacauuuguuuuaugggaaauaugaguuucuuuuggguucuguuuugaguaaugggccaccuagagagaauguggaagagaccagauucggcgacugacuuaaaggucaccuagcaagagauggcaguugaacccacagacagaagaggaggcgacagagugggacauugauggagagcagcuacuuccugcagggauccacugcucugcuccuauugggcagcauguggcugggaccuuuugauuguucccagcuucaaggcuccagacuaaacuguaauuagguuccaaugagccagcaguuuagacguuucucuuaucuguguguuuaaaugguuuguuuccaccaugugugcaguguccacagaacucagaggaggguuuuggauccccgccaacuuaacucacuauccucaauaugagaaugagagcuacagugacgccucaguaucuaacccugaagauacuuugucagcucagaaagugcuucccauccuguaggccccugagucagaagcacugagucagccuugccuuuccuagaacugaacaagugacugugcaagugggucaugggcgcuuucccaaaucuccauccuaggaagcuagaguuaaaacaggucauugucauggacagacacacuacaauccaugcacuugacaggccagcagaaggaucucaaauuccagccuggccuaggcuguguaacaagcccccacaucuuaaaaacagccucucacucugaaucuuagguaagcuucuggaagccaguuugcccuuuucuucccugaaugucucaggcucuuuacccugagcccugucuucuucuacauagugauuuucauuguggguuucugauuuugccacuagagaucuugaugacaagcuacuuacgaggccuggguccaguuccguccuuucaaaccgaaauuggccaaaccgugccauggagcuuaguacaucaucuuugucauauacaacgcagucugccaggaggcgcaaucccccaccacguacccuucauccgaucagcacaagccacucacgcgcuggaacaccauggccuguagaagaaauccucagaggaccccggguguagguuucaaaugcagacucugggaaccugguaaagcuagugucaguaauugugagaaucgucauagaacaggcuucaguagaagacuagacugaggcugugcccaaaacuaagaccacgcagucauacagugugcugucugcagguuuaguccaacucagaguuuuacuuaaguuuuggugaaauacaaaacuggaugagauuauucuguugauacagcugaagaguuauauuugugaaauuuaagagagaaagggaaaaaucccucuuugcugccccuauucugaaaaucuggguggcuucaagccuccugagcacacugacuuuacuaaguuucucaucacuuuguguuguuacaacuuuacuuuugcauaucgguuuugcugcugggaucuucaguccagugacagcagacacacugucuucucccucuccaaugaccuugggucggaacaaucugcugccaccuauuggaacaguugaaguagaacaccugagcgccauggggccacagcggccaacaguaagccuuucaccccgccuucccgggcuuacucugagcucucaccagcaguaguucuguaggacuuaccuugaaccacacucuccucugacaaaaacaaaccggguucuaggccauggcagcgaaguuggagcugcuuaggaguggguaccacagcagcugauguugggccaggguuacuauggaacaggugcagcucccaggacacagcuguuucugugacuuucgucuccucugcagaaaucccauggugacuccagccgagcccgaagugcagugguagacgagccuaaccagcagccccaagagaggcuccuuuugccugucuucucuagacccaacacaacucagucguuucugguaaagugcuuccuguuuaucugguuuggagggguugacacagugucucagacagcccaugcugcucuugaacuccuaauccugccucaagcuccuauuugucuuugauaauuugggaaagaaggggggggguauguuuggcaaacuuaggacuuaucuaguggcuugauuaacucaaauaguuggauguucuaaugauaaaauaccauucuagguauaucuuccuaaaauucuaaguggugcccugccucauucuuuuggugguaaaaugcccuacuuauaaaauaaaaaucucagcagcauacucugaacauaagcacacuacaagcaccacugcccccugcucuaccugccugugcuguccucccugcuccuguacacuuuacacaguaaaguggggucagguggaggacucggagugugagcugaguugacccucuuucugauggcuguguuaaaugcugacgcuugccuucucaauugucgugcacuuacaagcccuuuuacuuuuaaggaaguacuugaaaaauuccugaggacuggggccaugugaccuugcacaccuguaggucaguacgugguuccuaccucaucugcuuuguggcaagagggcuugccaagcacagggaaaugauugagcucacaccgagugcuuagccagggauucuguguccugcuccaguuugcagaauggcaacaucuguagcucauguacccaaccugacccuuggaccaucuacuaacaguggugggagcuuguauuucuauguuuuacaggguucccacaacaaaugaccacaacgugggcagccaaaacaacagaaauguaucacucuuacaguaacagaaacugggagcucucuguaagcuuuagcgaaccuuucuugccucucuaaagcuucugugguugccugcaaugcuugggcagccuagccuaauagauaaaccccagaucucagugagaaacccuguugccaaaacaaggugggcagcuccugagaaccacaccaaaggugggacccugccaugugcacucgugugggcacacacucacacugcucauaggcacaaagaggaaguaauuuuaaaaacaguugggguuagagagcuagcucagugguuaagacauuugggguuagagcuagcuaaaugguuaaaaaauuguguuuucgauucucagcacccacauggcagcucacaauguaacuuccuggugauacaugcagucaacauguuuauuacaauaaaauaaaaaugaaaagauagcagccauugaauuuauaguccacucuaaaacaguaguucaccuugauuacucaugcgaagaaauggguuuccaaaaauagucacauucacaaguuccaagaugaugugaguuuugaagggcacuauucaacucagaauuuccugacgcuugaguuaggcggaaaggcacagaaaaagccaaaagagaaacgaagcccuggcccauagguucacuguaaauccuggaagccuaagagcaucugaacggucucauaauuagagucagaacauuuguuaagccguguuuauguucuauauguucuuuccuuucaaaauuuaauuuuaguugccuuaggaauaaaacugaacauaugaaaacacuucaaagucucuuuaaaaaauaaguuuauuauaacaguaaaaauugccugccuuagcaucauuuuccccauguccuaccauaaagauuaaguagcagcucgauauaacugaaaguaugcgugcugagccuuaggccuggagcuguuggcuauaaccuuguuccuuggugcuuuugucuaggcucggagucaguaaaccucagcccaugagcccuggaagggcuacugccugguuuugaaaauaaagcuuuauugaagaaaagucaccaagcuucuacuuuuuacuuuuucgacagccauguuaagccgcuccaaucacuaccauguggucccuaaagcaaucugcuaaucucucaucuuucuguuguuuuggcugcccacguuguggucauuuguuaugggagcccugugaaacagacaacuacaagcucccaccacuguuaguagauaguucaagggucagguuggguacaugagcuacagaugcugccauucugaaaacugcugcagaagauggacucucuagguacuuuccccucacaacaguguugauucuauuuaaauggcacccuguaaccuccgauggcauuaucuugaccagcuaugguguugcaaaccugcaaucccaacacaguggagucaaaauaaaauaucuuuuucuaucugauugcaacauuacaccauauggauuuguaaaugcuaacguuuucuuaaagacgaaguaauacaguuguaguacaugaaguuccuacaaguuagcaaauugcuuugugaccaucuaucuagcuuggaguacucggaauucaauacagguuggcagaugaguuuuucauuguuaacguuaagguuuuccucuguguggugguuugagugagauguuccccauaaucuacggcauuugaguacuuugucccuagccagugaggcuauuugggcaguugagguauggccugucuggaggaaguuuuaucaacugagggugugugagaguuuaagacucccaccaauugcuagauagaugucugcuuccagcuugcaguugaagauguggcuucucagcuguuccugccaccaugcuuucugcuucucugccuugauggacucaacaaacuguuccuucuuuuggucgcuuugcucaugguguuuuaacaaagcagcagaaaaggaaggaauauacucuguaagccucagacaaguaucuuuugagcuacauccuaagaugccuuuucucuucuuuuagccagacacacaguaccgaaguucaugugcaucugaguauccucaucaggcccgaccuggcaggggcucugcagguacagaugggcugcagcucuugcuuuuaucuucuuuauuccuacauaucuuccuuuccugcaggcuucucuagacuuaguugucccccaucuagggaaaucaucuuagcaucauaauggguauaaaagaaaggccaacugcucaaagacaaaaaaguuccugauuucuguuuuguuuuuaauaacaaguaaguugaucuuuaagguaaauacuguuuguuuuuaacaaaaauauuugagggaccagaaaaaaaaauagcucagugguuuuaagagcacuuguucuuccagagagccuaagguucuagcauccaugucaggcaacucacauccaccugcacguccaguuccgagagcucagacucccucuucuggcacccacaccuguaccuguacacaaguggcauacacucacaggcacacacacauaugcauaaguaaauuuuuuuuuuuuuuuugauuuucaagacaggcuuucacuguguagccuggcuguccuggaacucauucuguggaccagguuggcuggccucugccuccugagugcuagaauuaaaggcauaugccaccacuauccagcaucuuuuuuuuuuuuuuuaagcuuccaaucuaguuacuauauucagcuacacuuugaguaagauguuaauuaguuuuaacaccuaaguuguugaaaugagcaucucaguuuuuaaugaguagguucucagcaaaacuaggcuacagcuuugguuuuguuuugagacaaagucucaauuauucaguccugacagcccuggaacaacuaugcagaccaggcuggccuugaaauagcaagagaucuuccugccucugccuccccagugcugagacuaaaaguaugugacaccacacucagcuuucuuuuacuucuuagacucuagcaguuuucuaaauagggugaacuguguaaacaugguuuuuaaugucuuggugaauacacacuucucaguacuuagagaccauauccaacuuuaacauccaacuacuacuuuauguaaaaguccacggcaugugauguuuuauuaucaaauauagacuauuuacuguuauucugugcaauucuguauccgacagguccucagucacaugggucuacaaaaccucagagcagagguggacccaucucuagaaccaggcaaugaccacagggcaagugagaaccugcaagguugcagcagacuugggagcacauggaggcuuuucaugccccagcauucaggcaccggaugaugcacagcuccugcaaacagcagcuugguccgucaaguuaucuugguacaaguguccgagaaauacuacagaguaucugccaaagacugcacugguaacuaacuguucugcaugcaguuacugucuucuuucagcuuuaguuaaccuacuccauggggcaguaaagauuguacccaaagacuugacaauggaaaaccaccccaaaucacugcucauguugucuguaacuaaucaccaguucaauucuuguacaauucagugagauuacauacacacaaaugauucagaucacuggguucagaauauuucuguuuauauugauuccuggagaacugcacucaguuuuaacauauuuuuaggagaaagugcugccaacaaucugauauauucaucaaauaaaugucauuccuaaacuuuaaguucuuuauuaca

SEQ ID NO: 7288 - RNA, 14312 nt, Mus musculus
ucaaauaagucugauuaaaguugguguuucucacagagacuagcaaagaacuuaguaaauauuugagcguggguagaggaguaaugaggccucaucuguggucaucagaguuuguacuuucuccuccgacacaucugugaggaggccauguaaguagugcgugcuucucagacugucugagugaagaguaguuaacacacgugacaccucacguacaugaaguggaaaguuugggaaguucuguucuauguaguauauaccugugaagcccucaccacagucaguacagugaccauccaucacucccaaaaguucauguccuuuauaagccccuguuucugucauuauauguuguauauguucccaaaaaaaugcuucugcugagagaagccagacagaauauauggugguuuggaugaaaauggcccccagaggcucagaggaaguggcauuaguugaaaggauuaggacuuguggccuuguuggaguacauguggcauuguuagaggaaauguaucauuggggguggucuuuggaguuucaaaugcuuaaagccaggccucuuccuguugucugccaauccagauggagaacucucagcuccuucuucagcacuaugcuugccugcgcacugccauguuucccaccaugaugguaauaaaccugugaacuguaagacagcaccaguuaaauguucuccucuguuagaguugcuguggccauggugucucuucacagcaguaacacccuaacgaauacagaggacacaccacauaacuccauucucacagacaucuacaaaagcugacuaauuugcagugacagaaauuagaugacuccucuguuagguucuuccauuucagcauaaggauuugagauuuagcuaccuugcuuugugcaucuguaauuccuuuuauugcuggguguuauuucaugaagccacaguuuaucaauuuaccuuuugaugggcauuugaauugcuuuccacuuuagcugguacaaacacuauaauguacaagaauuuagggguacauuuuucuguuucucuagguaaaugacuaauacuagaaugacuggguuauaugguaagauauauaaauauuuuguuacaaauuauguuucucuuuaccacucaaacuauuucagaccucacaguuuuaaauaacacauaauauuaucuuacacauuuguggauuagaaagacuagaacaacuuaaugaguccuuugcuuaggaucucacaagacugaggucaagauaguggccaaugcuauguuuuccuguggaggcuaaacuaagaaaggguccucuucuauuucuguguauacaaggauuguauacaaauccuugugacugauuuucauggcaaguuuauuuuucaaagacagccagucaaaaacagaguuaagcaauucauuuauuuauaacaucaguuucaggaggagucucaugcccgcuacugaacuccacaggcacuucaugcacauuguacacggacaccuaaaauaaacauaaauaauaucuuuaugucucuaauuauccuccucuuccuuuuauacugccaguuuccuagccuacuaaaaauguuuagggauaaaaauuaacucuagaaauggaagagguguguacugaaacaaacaaaaacucaccauaugaaauuacagaagaccaaaaccuaaagcagcgugggaaagaucgcccguguccauggguuggaagacgucacacuguugaggugacaguacuuccaaguagaucuguaggucuaguguggucccuaucaaaacuccaacgccugagcggagcugggagugugaacagacagaugcugagagagugcuuggcucucagaugcagaaccaguccagcggcguguuuggggaaauaggcaagcagcugcugacguccucuggagcugcucagacccuccaccgccaaaacaguagugagaaagaacaaagucaggaacucacuuuuugaauuuuaaaauacuuaaaauacgucuuuuauuaagacuagcaaaggaagagagagagagaaaaaaaagacuaccaggggacagauauauccaugugguaaaaacaaacaaaccccaacaccuacucugaaggauuuuaacagggcugccuccggagauuagucagugcaggugacgccuucccgauaaaugcagcuggagcaaguggaucccauacagaaaaaaaagucaccuuggacccucacaccccauuauuuacaaaagcuaacucaaaaguggauaagcaggccauggaacacucaguggcuaagggcgcuugcccaucaggccugacaaccggaggucaguccuuggaagcuauauaaaggagagaaacaaaucuagcacgguguccuuugacuuccacacuugagcgguggcacauguauguccacaaacauuaagauggugaaagacaaaccacauacgauauaugauuauaauacauauguauaauuauaauaauauaccugauuaggagcugguauccagaggagagaaagaacugcaacuuaauuuuuaaaaaggacacaacccaguuuauaaaacugggcaaaugccuucaacagauauuucaccaaagaucuaaaaauggucagaagucauaugaaaagaugguguagaucaauuaaucauuaggggaaugcagauaaaaaacacagugaaaugccucauuguccucgcuagggugugugugugcucgcgagugugugugcgugcguauaugugugcauguauguggggggugggguagguaagagaugacuuuuacuaaaaugugaaucuuuuaagaauaaacaaaauggggaaagaauugcaaaaauggagcccucuugaauugcugguggaaauuaaagauauacagccauuguggaaaguuccuaaaacguuaaauuaccauauaaccuaggaauuccucuacaaaguauauuaccaaggggacugagaacccuguuuacacaagaaccuccacauguguguucauagaggcacugucagaaaaagaccuaaaguggaaacucagguguccaucagcuaauggagaaacacaguguuacauaugcauguguuauaggguaaauugugugcccucuaaagguccccuguugacacucuagcccucagugugcuuuuaggguaucuagugagguacuugaggcuaagugaggccgugggauagcagcaccauaagucaguaggcugguguccuuauaagaaaaugaagagacaccagagaucucuuucucuuuccacacaugcacagagaagaggccgaaugagaacacagcaagcagguggccaucugcaagccagaaagaagccauaagagagcccagcccugauggcagcuugaucuuggaccccagaacugugagaaaauaagugucuauuguguaugccacgcagccugugaucuuguuaaagcaacccugagagacuaguacaccacacagcagaacauuauucauccauaaaaaggaauugaguacccauccauuauuacaacaugggugagccuugaaaaucuaccaaaugaaaggagacagacagucacauauauuauuaauguauuguuuaauucauguaagacauucagagcagacaaaagcacagacauaaaguugcaggagauggaaaaagaaggggcuuggcgugaugaggguuucuaaauggcacugagugcuagggaaacugccauaacacacacucacacacucacacacacaugcacgcacgcaccauacacacacacacaccucaccuggggcuggagaggaggcucagugguuaagaguauuugcuguucuugcaaagaguugagaucuuagugcccacaugguaagugguucacaaucauuuguaacuccaguuccagaggaucuuacgcccucuucuggccucccuguuuacuacaugcauguggugcacaaacauguagacacucaaacauauaaaaaaauuaauaaaauauuugaaagacuagucugaauauguucuuuaauauuauuugggcacagaucugcuaguuuuucuuuuuguauuuaaauuuccucuagucuaucaacaguuuaccuccuaguacuuuaaagauacugucuauggccuucugcuuugcauuacuucuaacaagacaccugaugucaucugucccuauauaucugccaagacuuggguuggagggcacacaucaccacacucagccuuuggucacuugcaauauuuucuccuuauugcuagugucaagaaguuugaugauguacugugauguaguuuucuuucuguuucuucuggguggaaguggcuggauuuccuguuucuguacauccaagacgcuuucauugacauuuucagcuauuauuucuuuauguuuuuccuuuuucuaaucgucugucaugacuuggggcacuuagaaguggaucugucucauuacagagcccucaaauaauuuaggccauccucucugaagcucaugcugcccuggguauguguaccacugugcuuuuguugugucugucugccuggaauagccucugucucucuccuccucccccuuaaugcccauacucaaaucuauauuaauaaaauuauuuuuaauaaaccccaaccuugcuugaaauuucuuuuuuccccuuuguuuucucugugacccugcaugcugugccuucucauucaucggucucgucugcgcuuuaagcuacuaacuuuauucacuguacgucacuggugugagcucagaguugaccuguaggaucuuuauacuuccaugccuccaucucauaauuugaaacaauagaauaaugcuggguguuuuauuacacgccuguauugccaauacucaaaggcugaaguagaaggaugcugaguucaagaccaaccuggacuauguagugagacccuggcaaaaggugggagguagaggaacuugaaaucugucacuaccugcggucuucugacacccucucacugugagcuguaguuuccugucuuuuacuuuugaguuuuugaucuuggaaauuaucuuaggcaauuguaggccguaucuuauuuguuuacauuuccaggauuuguugcauuguuauccauuguccacuguaugagcgcacgcccguguuucauggcuuuauuggcuguuguaagcaagugagugaguaaagccugucacuguugcaucuuguccaggagcaaacgucuagcaaauagguuuuugaaaccauacagaucgggcucaaauugacuagguagcaggguacaaguacucuuaguugcugagccaucuuuccagccucaaaucgaauacuuuugaaguggggauguagcucaguguuagagcacuuuccuagcacgugcuagguucugaguucaauaccaaauacugcauacaaauaaaauaauuuuaaaguagauauuccugaaugaacagcauccaaauccagaauagaaugcuaccgacacuccagaagccccucuugacuuccaacaccacagauuaauuuuguuuuaaauuuauguaagaauaagccaggcgugaugguauaugcauaugaucccagcauaagaggcaaaggaggggaaucgggaguuucaacccacuuaacuacauagaacccaacacuucccaaagcuaggaguggugacauaccccuuuaaucccaccacuugggaggcagaagaucgaagccagccuggucuacagaaugaguuccaggacagucagggcuauacagagaaacccugucccuccucccuccaaaaugaacaaacaaaaagaaaccauuucccuaaaccagguauagagggacacaccuuuacuucucaguacuugggagacagagacaggagaaucucugcgaauucaaggauacaaagauacuaucucaaaaauaaaagagagagagagagagagaaaaggaaaagaaaaaaaaaccuucccucaguuauuuggguaguugaugguuuuuguguauacacacacacauagaauugguaggucaugugauaaacuaugccaauaucaguagcaucuccccccagauuuuucuaaugugacuuuauuuaugcauacucucucagcuauugugaauuccaguuguccaaccuuugcuguguuuguuguugucuauguguauucccuucugagauccaagagaacagaacuaauacucuucauuuaaugaccuggucagggccagugagagggcucagcagguagaaauguuugugugcaagccugauaaccuuuguccaaucccccaaucucaugauggggcaagaaagagcugacuccuuaacguugcucucugaccucugcgcaugccuacgcacucgccuuggcaugugcacacgcucacuuccccaccccuucauagacaaacccagugggagauaaagcagcugcuuagcuuguaguggcgcacaccuagaucuuagcacuuugguggaggaaggaagaugaggaacugaaaaucaggccuggcaacauaaaacgcuauuucuaaaauauaaauucagugaguugacuuaaaggcccugaaagagagugcccuuuugucacacagagccagacaaacccuuuuccuuuuuuuuuuuuuuuuuuuuuuuuuuuuugguuuuuugagacaggguuucucuguguagcucuggcuguccuggaauucacuuuguagaccaggcuggccucgaacucagaaauccgccugccucugccucccaagugcugggauuaaaggcgugcgccaccacacccggcugacaaacccuuuucaaggacaguuauucauucucagugccacuuugcucugcccuccagacuaaaggaagcugggaacagccuguaaaagaacacucccguacuuggugcaaagauaacacuugcaugcagggcucccauagaccaaguggcucuuugcaugagagcaaacuggccuggaacaaaccaauagagugacaucuucucccaguacagaaggagggaagcuaaucuaguuugcuuuuguugcugugauaaacaccaugaccaaaggcaacuuggggaagaaaggguggaauuuguccuggucuuagucaccagggaaaacaagguaggaacugaagcaaaagccauggaguagugcugccuucugguuuguucuccauagcuuguucaaccuuucuuuccccuuuuuuuuuuuaagauuauuuuuauuuuauuuuuauguguacauguauuugccugcaugcaugucuaugcaccauuugcaugcaauauuuguagaggccaggaagguggugugagacccccugagacuagaguuauaagcaauuuugagccaucuagcagucuuaaccuacuuucuuauacaccccagaaucauuuguccagggguagcaccacccacaucaaucauuaauccaaaaaaaugcugcagauccauaucuauaaaccagucauauggaagcaguuccucaauugaguucccucuuuccaggugacccuaaauuguguugacaaaaaaacuagccugcaguuuagucacgugacaaucuguucugcuuuauguuugucuguaagccaaaaguguauaaaacugaguagugcaaccagugguuuuuaugugcauuaguuuuuugucugcauaugucuguguaagggugucagauccccuggaauuagaguuaaagacaagugugagcugcuguguggguguuaggaauugaacccaggugcucuggaagagcagccagugcucuuaaccacugaaccaucuuuccagcccauaaccgguguucuuaccgcucacaagugcagauggauaagaagggccucaguuucuugcaggagcuucagcauuuguuugcacauaaaacuuaauucccugccauccucacccagggcacuuuggcucagccaugcuaaagauacacagagcuaacuagagcccucggaggccucagagcuucuguuuguuacaguucucaaucacuaggaagaaaauacuuagcuuuaaaucauuaccauggcuugacccugacuugcuaauggggaacaagguucacugcuaauuguuuauaaagagauggaccaccucugaguuagauagugaaccaaaugaugauaauggaaacgauuuagaggcagggaagacuacaagaguucauacugguuucacugggaaacaugauuuguccucaagcucauuuuuaauuauacuuaauguugaaaagugcagaaaucccaguucaugguggugaggcucugagaguaaaggagcuugcugccaaggcugccagccugagugugaguccccagagcccaccuggugaaaggagccagcugucaagguguccucugauaggacucccuaggagccccacgguacagguacaugcauacaaagaaauggaaugcaaaacaguucuugguuuguuuuuuccagacaggguuucucuguguaacccuggcuuuccuggaauucacucuguagaccaggcuggccucgaacucacagagaucugccugccucugccucccaauugcugggacuuguaccacuaccaccccagcugaacuacaaaaauuuugaauaccaguuuguuuuuaaaauagugcaauguaauuuggcaguuaacgacauuaaugcugugaacauccuuacacauuucuuuacauguguaaagugcgcuuaccaagguggaggguuggucacuguucaguagacaacaguuauccaaagugauggugacucuagugccacugcucggacacaaguucugugcucagucuugucaaucuucuucuucuagcucuaauuuuuuuguuuguguauaaaaagauauuuuugugcacguuuuaaaacuaagguauaauuugcauacagaagaaacuuucagcauuuacuuaagauugucccuuuuuuacauuugugugugugugugugugugcgcgcgcgugcaagugcauaugcuggcgcugcagagccccaggagguugagaccccuagagcugugguuucaggugcuuguaagcugccugaugugggugcugggagccaaacucuggguccucuuagagagcagcagguguugcuaacuauggagcugucucugcagccccagauuucaugucuuuaacccucugcucacauuuuuguuuaggggguuuuguagauuuauuguguuuucuaaaauuugcuuuuuauaguuugcacuuacucauauauucaggguguuaugguuuuguuuuguuuuuuuuuuuuccaguugguugguuugugagacagucuuugguguacauuuggugucuguccagagcugauagugcuauggcgcaugcccuguuuccagggcacuugcucuccuuguagaaaacaugauuuuuaacgcucucuaguuucauuggcauugucugugggaccugaagucaggauuaaugaucucaagguucuagaguuagacugcugcauacagcauuuuaagagucccaugguauugccgcuuauggccaccacauugggcagcacugauguaaaacguuccaaagguugucauagaucucagcuuacccucugcuugguaccaccagccauugucagcacggaaccacuuuaaacugcacucugagcuugcggguuauaacuacacggguguaugcaggugagcugcagaucuaagggaagccuuucuugagacuacuuagcugucagggagauuuuucucucagaacuuuacaucagaagaugccuauggauaauagauccuguuccuuugcucagaugaugagaguaacguugaaauuaccagacuggauucaggaagucccuaugugcugaacgaacagcauccuuuggucuuaccucgagugccgcagucuaaagugccgucuaucaccucaaguccgguaagccccagagcggauugugagaauccagcacuguucuugccacaggaagcuugcuuggguguuugccuugguugccuuauuucuagccagaaauuucauaacaacauacuuauuugagagaggguuucauuguguagcccauccuugaacucacaaucccccugccucagcuucucaagugcugggauuagaagugguuacugcuaguuuuugagagaaagaaggaaaaaauauuuaagacaaaagaggugacauuagaacaacuggaauuuagguuauuaaauaggccauggggagacaugcaccuugaacuucuggcuacugucagauggcugguacaggaagauuaccugagccaucgcuucaagccagccugugcaacacagagagacacugucauaaaaauuuaaaaauacaaaagcaaaaaagcccaaccaaccaaccaaaaagagagagagagagagagagagagagagagagagagaaagagagagaaagagaaagaaaacucagaaagaacagugacuggaaccagugcuccaggcuaguuaaaaguaaguaagaguucaggacaugcgcagauaaaaaagaccauuacuuugcacuuauuuuuuuuuuuuuuuuuuugguuuugcgagacaggguuucucuguguagcccuggcuguccuggaacucacuuuguagaccaggcuagccucgaacucagaaauccgccugccucuggcacuuauuuuuucuauuguuccaaauuuugcuugugauuuacuauucagguuuucuuuucccuuguaagcaauaauaauguuccucucuccccugagagugaccauuaagugcucucaucugaauugaugagcuuucacuuagaaauacagaacaacaaagaacccuguucucuugacagugcccucugggggcuacuggccaacucuucuaaaaguuaaggcacaaggcgggggauggauaaauaaccuaacuggaaacacuaacuuugcaaacuuagcaaaucgagcagguaucuucaccaaccacugucugcuuuugacauagaugaguuucugucaagcaagcggucaucagccaaacgugaguggccucuugauucaugggaugccucuacagccaaggaaucucucccugauggacaagcuccuguaagaagcucaaguuggaacacauucagagcuuaaguagaaugcugaggaaaagggaaagcagcucgguuaucucugcgccgccaagugccagacacauccagggagaacacauuuaaggggcaaggucucucugccugagaacugguaacuggguacccgaccuguccucauacagccucguguggcuaagagucacgugagagcugcccggauggagugcuguguagucccaaaggagaagacucucugaugagucugugucuagggauucagaugaucaagaguuggagaugggaauuauuaaauacuuaggaagaagcagaccguuuugguuuagaaguguaagaugucagaacuuaagugcuugguggccagagggaucgcuuagugacuauaggugcccacuaccaagccugacaaccugaguuugguucuggggaccuacaugauggaaggaaacuggcuuucaaagaaguauucuccgaccacacacacacacugacaugugcaugcccacacacagaaaaggaauuuuuugugggggcgggggagagacuguuucucuauguagcuuuggcuguccuggaacucacucuauagacuaggauggccucuacucagauccaccuguuucugccuccugaguuguagaauuaaaggcauacaccaacacaucuggcucacaaaaaaguaauuuuuuuagaacuucaaugcuuccaaucaaagaucaucgacaauauuguuagauuauuauuuaugaauaaaugugaucagcugugaaugucacauugguacuuguccauguguuguacaugaccacuguaauugggcaucauaauuuacgcuguguucacuagguuaccucuggguuggguuuacuaugcagaaaggcacuauauguauuuugcauaggucauuuuugaggacauauagucauauuucucuugagucaauaccuagaagcaagaagaugccaaacaggugugugcuuaauauuugagaaacugccaaaguacccaacagucucaccagcaaagcuagcuucaucuggggaccaugcauuaggggcugaggcagacuccagucagaaggaacggagaguaaggaacacaccagaacucaggcaagagcuguggggucugcagucagcacuagugcaggaucacagcggagcucgugaucucucucaagcauuccauccccaccauucaaaggaggacgaaggacggggaauagcagauaauguagcaacaggaaucaaaguaaaaacaugaauuccaagcucaggacauuuguuuuaugggaaauaugaguuucuuuuggguucuguuuugaguaaugggccaccuagagagaauguggaagagaccagauucggcgacugacuuaaaggucaccuagcaagagauggcaguugaacccacagacagaagaggaggcgacagagugggacauugauggagagcagcuacuuccugcagggauccacugcucugcuccuauugggcagcauguggcugggaccuuuugauuguucccagcuucaaggcuccagacuaaacuguaauuagguuccaaugagccagcaguuuagacguuucucuuaucuguguguuuaaaugguuuguuuccaccaugugugcaguguccacagaacucagaggaggguuuuggauccccgccaacuuaacucacuauccucaauaugagaaugagagcuacagugacgccucaguaucuaacccugaagauacuuugucagcucagaaagugcuucccauccuguaggccccugagucagaagcacugagucagccuugccuuuccuagaacugaacaagugacugugcaagugggucaugggcgcuuucccaaaucuccauccuaggaagcuagaguuaaaacaggucauugucauggacagacacacuacaauccaugcacuugacaggccagcagaaggaucucaaauuccagccuggccuaggcuguguaacaagcccccacaucuuaaaaacagccucucacucugaaucuuagguaagcuucuggaagccaguuugcccuuuucuucccugaaugucucaggcucuuuacccugagcccugucuucuucuacauagugauuuucauuguggguuucugauuuugccacuagagaucuugaugacaagcuacuuacgaggccuggguccaguuccguccuuucaaaccgaaauuggccaaaccgugccauggagcuuaguacaucaucuuugucauauacaacgcagucugccaggaggcgcaaucccccaccacguacccuucauccgaucagcacaagccacucacgcgcuggaacaccauggccuguagaagaaauccucagaggaccccggguguagguuucaaaugcagacucugggaaccugguaaagcuagugucaguaauugugagaaucgucauagaacaggcuucaguagaagacuagacugaggcugugcccaaaacuaagaccacgcagucauacagugugcugucugcagguuuaguccaacucagaguuuuacuuaaguuuuggugaaauacaaaacuggaugagauuauucuguugauacagcugaagaguuauauuugugaaauuuaagagagaaagggaaaaaucccucuuugcugccccuauucugaaaaucuggguggcuucaagccuccugagcacacugacuuuacuaaguuucucaucacuuuguguuguuacaacuuuacuuuugcauaucgguuuugcugcugggaucuucaguccagugacagcagacacacugucuucucccucuccaaugaccuugggucggaacaaucugcugccaccuauuggaacaguugaaguagaacaccugagcgccauggggccacagcggccaacaguaagccuuucaccccgccuucccgggcuuacucugagcucucaccagcaguaguucuguaggacuuaccuugaaccacacucuccucugacaaaaacaaaccggguucuaggccauggcagcgaaguuggagcugcuuaggaguggguaccacagcagcugauguugggccaggguuacuauggaacaggugcagcucccaggacacagcuguuucugugacuuucgucuccucugcagaaaucccauggugacuccagccgagcccgaagugcagugguagacgagccuaaccagcagccccaagagaggcuccuuuugccugucuucucuagacccaacacaacucagucg

SEQ ID NO: 7289 - RNA, 5387 nt, Mus musculus
guaugaauggcggggaggaguauagucagugcugaacuaagaucaucgaacuuggcggggugggaaugggaucggugccuuuaucugaugaacaaccuugcuagccaagccuuuucguuaaaaagcagaaugaauuaagaccuaacuaaaggugucaacacugguguaaacuaauguuucuucccuagaucagccucacaucagguuugugugcucauguuugcaauugugugugcgugcauguauaggccagagaucacugggugcccuuccuaauuguuucucauguuuugagauaggaucucucacugaacuuggagauccucauuugugcgcaaagacagguuuguuuugcuuugucagugguaugaacucggucuucauacuuguaagcacuucacugagccaguuuuccauucaaagagcaguggaacuggagggcuuccucuaguagcaccaacagcuccucaagcgcugggaacgcagcagugguguuaacuguggcuugagucugucuuauuaaaaugccacuauugccuuaauuaucacaccacuuugacauuacugauuuucaaaguggcuaaauucaaaugguuguccacugaaggugacuuaaaccauuccaaguucuuaugccaugaaauagauguuucaaauaacccacacugaguuauauauuaaauacuucuauuguacuugugaucacaaacuaaaugugugauguguccaccuuaaauuauaaugcucaauggaaagaggcuuauuacuugcacgauacaaaugaagacuugaacagucuuaacaaauauaccacauacuauagugaacaguuaucaacucaagauguaaugagcaucuuucucagaagucuguacaaugaauacacuguuaucagaucuacauucguggccuuucugagcagcuaugacucagaguacccucaggucauuagccuaguuccuuacccuuuuguguauguguccccuuaaagcuaguuaguauucaucuucaaaaaaccugauuauaguuuacauagcaaaucgcaggcuagcuagagcuacauagagagacucaucugaagccacacaaaacaguucaaaacacauaaaaauccugcuguacuuaauaaaugcaauuuaaugaauuuggcucucacucuuguagauaaaaaguucaaaagaggccagugaaaugccuaagccugugaccugcaaagacaggaugugugccaaagccagccugucuguuacaaugcugacuagguuacuuaaguccuuuaaauaaaacacuuuaucuucauagaccaauggagucauuuaaauaauccaccagaccuuugucauuucuucuuuauuuagcauauacagucuuaugaaaaguuugcaauaauaugaacacugacgucuccuacugcaaggacagaagacaaaaccuaacaguagaccaagaaaagaagauccguguaggauuaagacccaaaagcacgguagcauuuauuuagaagucagcgguucagcaaguguucugaggauguucuccauagguggaguguuucucgucagugcaugcacagcagcaagagaaacuaauauucuaaauaggggcccacaaaagcaaaugucagacccacccucccaacuaucaccacuacacauccuucacaugaaacccucacacaguguuaggcgaauucuagaaacuacuaagaucaggucgaugaacccugcucggcuuaggcgggacagacaacuccucucaaagguuacauuaauggcugucaucauuuugucuacacuguaccacugacacauaaggacucaggaagagaaaaacuccaucauuucuuuuccuucuugagugcuguucuuuucccuccuuuggaagguuugcaguauuuugcuuccauuugagccagaaaacuguccauuuccuuuugccgauccuuuugucugcucuguuugagaaguuaaaauauagcuuucaauaugcaacacugagacaaagcauuucaucauuaggagggguuggaguaaagcaccccagugacuaacaauggcuacgggcuuccucugugguggugacagcuguacagcuuggagcggggguggcaauucucugacuuguacauucucaaaccccaaaaagaugcuauaaauuauguguaaguguaccuuaaaggaaaaacaaagcaaaaacaaaaaaauccugaaauacauuccaaacaguguacaaauaacugugagaggggccugugaggggagccugccaccuuuaccuggaugagugcuuucaaguuauccacuccuucuuccagucccagcuccuuucugcucaacucugcuucuuuagccucuuccugagccuagacagaagcuuuuaucagacuccauggcaaucaagaaguaagaaauacguuuuuucuaccccuuaaagacaacauuagccccuuccuagagcuggaggucuaggaacugcucauggaagcagucuuacuccaggaaguccuucuauguuauccccauucuacuuccuaaaucuagagcacaaguacgucagcaucucaaaccauaugaugacacaaaggaaccuacuaggggacccaaagggucacauagccaaggacagcgucaaaacggaugccagguaccaggcacuucaggaucuucaucugaaaccccauuuuguacacagcagccuagugagcugcaaugauuuaaaggcuuucucuggagcuggauagcuggcccagcuguuagcacuucuugcucuuccagaggccaugcgcagcauccacaccagguugucugucacucuagcuccagggaaucaacagcucugagggcacccacacucaugcacucacaaacgcaggcacaaacacaugcaaauacacacaacacaaauuuaaaauguuuucugaguagucagaaaaaaacauuagcaaacucaguuuuagccuuucuuuaccugauuucaaagcuaucuucauuuaacaaaauuugccaaaauaccacaacagcuaacagcaagaacugugaggcccuaacucauuguaaaaauuuccaaaucaccacugggaauaaggauaaauugggaucuuguuauuccagaacaaaaaacaaguuuuguucuauuaucgucucuuaaaauucagcauuccucaaucccuuuacacagcuuucaaacugucauuuccccucuaacuccaaguuucucaaaccaaaauccugaucuaauacagcuguucuguuuuacaugcgaaaaugauuagcaagcaacagcugugacuccaagccaugaaaaaggcauagcagucucuucucuguaaagcaggcccuuaaacucaccccaaacacuaaaguuaguuuuucucucugcauguucuuguacuaaaagcuccaggucuuugcccauccacuugagccacacaaaagacaacucaaguacccaccagacaccuaacaucuuaaauugccagcucuccagucagcuccaaucgugaaagccaagacgaagcaaccauugcuuuaccagcagucugggguaacuuucccaaagagcguaagcaggguuguuugcuuccuucaacuccucagcuaacauccccacucuuccugguuagacagggaugaagggaugaagaaucaaccgcaagucccaauccucaaguguaggcaauuguguuccucagaguggggacaggagagaccacccagugguuacauggaaaccggaggugucaaaucuuugggagcuggaguuacagacgguugugagccacaacacccaaccuugguccugaaaguugaacuugggucucuguaagaggaguacaugcccacugagccaucucuccauccccuugugugugugugugugugugugugugugugaaauaacuauauguauuuacagaauuuuuuuuaauuuuuguuuucucccccucuucugggcaguuuuggagaauuagggaccucccacguacuagacaaccaaugcagcacggauccacacagcgcagccugaccucaaaaguggcaauccucaguuagcuuccucagugcucaaguacugggagcaccaccccgccauucuacauguuuaacagcacacaaucacugccaucuucuaccuguucaauaaccacacaaggcccacagccuuguaaccaggcuccauacagcaaagcuacaaggacugccucgugugaaaaguuuuucagaaucacuugagggugacuucaaacaguccauaaaguggaaucauuuucagcacaacauaccaaaguaaucagggcuuucuuccuggucaucuaguuagaucaaugcugcaggucaagcagucauaucgcagcagucuauuuccgucgcugugaauacagcgagacccuuuuuugaagcagcugagaugugcuaggaacaacacuacuuacccuccuuuuccuugcauucaucuuuuguuuagacucuuugacgaaggcgcuguaggcuggaaucucuuuggauucaauagcuuuuugaaugauguuucuuauccuggguucaucuguguacuguacacaaaguacagacuccaugaucugguccaugucgcccuugaaguccagauaggccugcuuaauaucguuuagcucuucuucggagccuuuguaugucuuuucaaaagcuuggauauccucuagcgauaucuaauaacaaagaagauugcuuuaacuucgcgaauuguucuuguggacugaaugaugagaauuagucaaagccacuaaagcucuuuaccuuuuuaaagaguaaucuccaauaugcaucccagucccggucuugguugaggccagcagagucuucguccacuguccccuguucaucguacacugcuuucuguuccuugucacucagaaccgcguagacucuucccaagaucuguaagcagaguauccaaaagucauccugaaccucccaccgaaacagggcagcuagaaaagcugaaaaaugccaggccgaggaucagcagugcgcuguccuaggagcaggggccccgcgagagcacaaguccgggcagcaguccgaacgcgggcccacaaaccuggaagcggcggguggcguccucuuucugguccuccucuacucggucggggugcacuugcagggacacuuugugguagccgcgucggaccucgccguccgaagccucgcgccgcacgcccagcacuugguagaggucggcggugccaaacaccugcucgcacagcuccagcagccccaugccagggaagaggcugcuccgcgaacccggggaagcuguagccacagccgcucugcuggacagcggaccgccggccgccuuuucccgcccaaauaacucugggcgccugcgucacaggagaagcgccg

SEQ ID NO: 7290 - RNA, 5387 nt, Mus musculus
cggcgcuucuccugugacgcaggcgcccagaguuauuugggcgggaaaaggcggccggcgguccgcuguccagcagagcggcuguggcuacagcuuccccggguucgcggagcagccucuucccuggcauggggcugcuggagcugugcgagcagguguuuggcaccgccgaccucuaccaagugcugggcgugcggcgcgaggcuucggacggcgagguccgacgcggcuaccacaaagugucccugcaagugcaccccgaccgaguagaggaggaccagaaagaggacgccacccgccgcuuccagguuugugggcccgcguucggacugcugcccggacuugugcucucgcggggccccugcuccuaggacagcgcacugcugauccucggccuggcauuuuucagcuuuucuagcugcccuguuucggugggagguucaggaugacuuuuggauacucugcuuacagaucuugggaagagucuacgcgguucugagugacaaggaacagaaagcaguguacgaugaacaggggacaguggacgaagacucugcuggccucaaccaagaccgggacugggaugcauauuggagauuacucuuuaaaaagguaaagagcuuuaguggcuuugacuaauucucaucauucaguccacaagaacaauucgcgaaguuaaagcaaucuucuuuguuauuagauaucgcuagaggauauccaagcuuuugaaaagacauacaaaggcuccgaagaagagcuaaacgauauuaagcaggccuaucuggacuucaagggcgacauggaccagaucauggagucuguacuuuguguacaguacacagaugaacccaggauaagaaacaucauucaaaaagcuauugaauccaaagagauuccagccuacagcgccuucgucaaagagucuaaacaaaagaugaaugcaaggaaaaggaggguaaguaguguuguuccuagcacaucucagcugcuucaaaaaagggucucgcuguauucacagcgacggaaauagacugcugcgauaugacugcuugaccugcagcauugaucuaacuagaugaccaggaagaaagcccugauuacuuugguauguugugcugaaaaugauuccacuuuauggacuguuugaagucacccucaagugauucugaaaaacuuuucacacgaggcaguccuuguagcuuugcuguauggagccugguuacaaggcugugggccuugugugguuauugaacagguagaagauggcagugauugugugcuguuaaacauguagaauggcgggguggugcucccaguacuugagcacugaggaagcuaacugaggauugccacuuuugaggucaggcugcgcuguguggauccgugcugcauugguugucuaguacgugggaggucccuaauucuccaaaacugcccagaagagggggagaaaacaaaaauuaaaaaaaauucuguaaauacauauaguuauuucacacacacacacacacacacacacacacaaggggauggagagauggcucagugggcauguacuccucuuacagagacccaaguucaacuuucaggaccaagguuggguguuguggcucacaaccgucuguaacuccagcucccaaagauuugacaccuccgguuuccauguaaccacuggguggucucuccuguccccacucugaggaacacaauugccuacacuugaggauugggacuugcgguugauucuucaucccuucaucccugucuaaccaggaagaguggggauguuagcugaggaguugaaggaagcaaacaacccugcuuacgcucuuugggaaaguuaccccagacugcugguaaagcaaugguugcuucgucuuggcuuucacgauuggagcugacuggagagcuggcaauuuaagauguuaggugucugguggguacuugaguugucuuuuguguggcucaaguggaugggcaaagaccuggagcuuuuaguacaagaacaugcagagagaaaaacuaacuuuaguguuuggggugaguuuaagggccugcuuuacagagaagagacugcuaugccuuuuucauggcuuggagucacagcuguugcuugcuaaucauuuucgcauguaaaacagaacagcuguauuagaucaggauuuugguuugagaaacuuggaguuagaggggaaaugacaguuugaaagcuguguaaagggauugaggaaugcugaauuuuaagagacgauaauagaacaaaacuuguuuuuuguucuggaauaacaagaucccaauuuauccuuauucccaguggugauuuggaaauuuuuacaaugaguuagggccucacaguucuugcuguuagcuguugugguauuuuggcaaauuuuguuaaaugaagauagcuuugaaaucagguaaagaaaggcuaaaacugaguuugcuaauguuuuuuucugacuacucagaaaacauuuuaaauuuguguuguguguauuugcauguguuugugccugcguuugugagugcaugagugugggugcccucagagcuguugauucccuggagcuagagugacagacaaccugguguggaugcugcgcauggccucuggaagagcaagaagugcuaacagcugggccagcuauccagcuccagagaaagccuuuaaaucauugcagcucacuaggcugcuguguacaaaaugggguuucagaugaagauccugaagugccugguaccuggcauccguuuugacgcuguccuuggcuaugugacccuuuggguccccuaguagguuccuuugugucaucauaugguuugagaugcugacguacuugugcucuagauuuaggaaguagaauggggauaacauagaaggacuuccuggaguaagacugcuuccaugagcaguuccuagaccuccagcucuaggaaggggcuaauguugucuuuaagggguagaaaaaacguauuucuuacuucuugauugccauggagucugauaaaagcuucugucuaggcucaggaagaggcuaaagaagcagaguugagcagaaaggagcugggacuggaagaaggaguggauaacuugaaagcacucauccagguaaagguggcaggcuccccucacaggccccucucacaguuauuuguacacuguuuggaauguauuucaggauuuuuuuguuuuugcuuuguuuuuccuuuaagguacacuuacacauaauuuauagcaucuuuuugggguuugagaauguacaagucagagaauugccacccccgcuccaagcuguacagcugucaccaccacagaggaagcccguagccauuguuagucacuggggugcuuuacuccaaccccuccuaaugaugaaaugcuuugucucaguguugcauauugaaagcuauauuuuaacuucucaaacagagcagacaaaaggaucggcaaaaggaaauggacaguuuucuggcucaaauggaagcaaaauacugcaaaccuuccaaaggagggaaaagaacagcacucaagaaggaaaagaaaugauggaguuuuucucuuccugaguccuuaugugucagugguacaguguagacaaaaugaugacagccauuaauguaaccuuugagaggaguugucugucccgccuaagccgagcaggguucaucgaccugaucuuaguaguuucuagaauucgccuaacacugugugaggguuucaugugaaggauguguaguggugauaguugggagggugggucugacauuugcuuuugugggccccuauuuagaauauuaguuucucuugcugcugugcaugcacugacgagaaacacuccaccuauggagaacauccucagaacacuugcugaaccgcugacuucuaaauaaaugcuaccgugcuuuugggucuuaauccuacacggaucuucuuuucuuggucuacuguuagguuuugucuucuguccuugcaguaggagacgucaguguucauauuauugcaaacuuuucauaagacuguauaugcuaaauaaagaagaaaugacaaaggucugguggauuauuuaaaugacuccauuggucuaugaagauaaaguguuuuauuuaaaggacuuaaguaaccuagucagcauuguaacagacaggcuggcuuuggcacacauccugucuuugcaggucacaggcuuaggcauuucacuggccucuuuugaacuuuuuaucuacaagagugagagccaaauucauuaaauugcauuuauuaaguacagcaggauuuuuauguguuuugaacuguuuuguguggcuucagaugagucucucuauguagcucuagcuagccugcgauuugcuauguaaacuauaaucagguuuuuugaagaugaauacuaacuagcuuuaaggggacacauacacaaaaggguaaggaacuaggcuaaugaccugaggguacucugagucauagcugcucagaaaggccacgaauguagaucugauaacaguguauucauuguacagacuucugagaaagaugcucauuacaucuugaguugauaacuguucacuauaguaugugguauauuuguuaagacuguucaagucuucauuuguaucgugcaaguaauaagccucuuuccauugagcauuauaauuuaagguggacacaucacacauuuaguuugugaucacaaguacaauagaaguauuuaauauauaacucaguguggguuauuugaaacaucuauuucauggcauaagaacuuggaaugguuuaagucaccuucaguggacaaccauuugaauuuagccacuuugaaaaucaguaaugucaaaguggugugauaauuaaggcaauaguggcauuuuaauaagacagacucaagccacaguuaacaccacugcugcguucccagcgcuugaggagcuguuggugcuacuagaggaagcccuccaguuccacugcucuuugaauggaaaacuggcucagugaagugcuuacaaguaugaagaccgaguucauaccacugacaaagcaaaacaaaccugucuuugcgcacaaaugaggaucuccaaguucagugagagauccuaucucaaaacaugagaaacaauuaggaagggcacccagugaucucuggccuauacaugcacgcacacacaauugcaaacaugagcacacaaaccugaugugaggcugaucuagggaagaaacauuaguuuacaccaguguugacaccuuuaguuaggucuuaauucauucugcuuuuuaacgaaaaggcuuggcuagcaagguuguucaucagauaaaggcaccgaucccauucccaccccgccaaguucgaugaucuuaguucagcacugacuauacuccuccccgccauucauac

SEQ ID NO: 7291 - RNA, 14040 nt, Mus musculus
agagucuugagcccucuuggcagagaauaagagucagaaagagaacuccagcagguguccagguccugacuugucucguuagggagaauucauccuugucugucugguuggcagggcacguuagucacugagacccagcauuucagcaguuugcagaaaaagugaugugaacagacagcugcaagugagacacagccuaggucugaagagaugaagcauuuacuucacuuggaggaaagagaaggaaggaagccuagggcuuaacaggguaaguuacuuuccaucaaucugucuacuuaguucauuuuauaauuccguaaaguauuuaucacucaaggggguguuaaucacugacuaagcagcuaaugugguuagaauagcaauguucuaaagguacucaaccucuauccccuuaccuucuccccacauuuggggguuuuauucuuuggcuucugagauauccagacugggcucccuaugaucauccugccucagcuucccgaguccuggaacaaauguucaucaccaugcgagccuucuccuauccuguucaaggagcccaguaaccauuucugcuucccugugucuucccaccuucauccaaaagauguuuuguauuugcugauggacuugagaaacuuuagugggaucuccuggucuggagacagugcaaauaugacuguaucuuaugugaaauauggaacuuuguuaaugaggaaggagaaagagaagagugugcuguuuaacauaggugaauguuuuaggguagacuuuggggaugaaggguaagaauuuuucuaggagcuagcuuucacuucuguaguuaguguuuucugaaagucaucagggauggcuuaaaguaggcugaacucugggaaguucugagugcuuaccaaagcucuuucugguuucacccuuccauguccuuugggucuccccucccccacuuugcuuuucucaguuuguaccccucgaacuuggaagagcuugggacucugggaaagcuaaaacuagggucugggucugugauagccaaauucagaaaugauuacacacuugcacacaaacacaaguguaaagacccaucuucucauucguauauucucacuuccugucagaaagucaguauacucauaacuuaggacaucagugugcucugaguguagacgaguuugugauauucgacguucaucagaaccaccuuuucuuucaaguggugugcugcuuuugauuucugucuaguuauauacuaccuuccuacacacagagaaguuuaugacccaccuucagcuacacaguucaaggccagccuggacuacaugaaaccuuaucucuaaauaaacaaagcaaugguagguagacuggggguuuugcuuagugguggacuauuugcuucguauaggccuagauuugaucccuagcaucauggaaggaaguauaacuuaaaggcauaaucaagucaguucauggaaaugggguuccgaagaaugaagacagagaaucuacucuuuggaacagggacaugacuguuaaagcuaaagacuguguuuucacuagguccaauguccucacugguauuaguauagagaauacagaagaacuuucaauaucucugcuuuacggacauucacucagagguugagaagagacaacgguggauagaaacauaaggaugaggagaaagaaagugcaagagaauaauagaaggugauuccucuauuaacuucaggccauggauuuauaagaacagcauuuaagaguuagcuaugacuacucuugcagcccauuaugaacugacaaaauuagaagguucuuugaucuagaaaaagaaauagagaugaguaugagcuugauaauucuggaaagagauuuguugauuuugcuaccuguguacauuuuauagcugcaugaugauucuguaaaguuuccuuuaacaaaucucauugaaacggaucaaaugucaggccauuuuuauaacaaaacaugaucccuaaugugaacccuguuaccuuguuugcaauagaaccagcugcugccaguguuuuuauccucuauccuuuccuugucccuggcgacaguaaaccuggauauuaauaacuuuagccucucugugucuauagauauuuuuauuucuuagguuuuucagguugaggaaaauuuuuacauaugagugaaacauuuuaaacuuagcaauaaaauggcauuuagugcucucuguguguaguguugauacucuccugguguguauggagcccugguuugauucucauccuucauaaauccagcauaguaguauauauuuguaauuggaacacucaugagauagaggcagaagaaucagauacgaaacucauucucaccucauaggaaguuugauaucaguuugggauacuugaaacccugucucaaaaguuuuaauuaauuaaaaaauguuaaauauauucacgauguuauauaaccuuuguaucuagaucugaaacauuuucauuccuaaaagaaaacucaucugaggcaguuaucccucauuuacuucuauccagucccugacaacuaucaaucuacuuguccuucuccaaguuuacuccucuccaacucuucuuuccucuccuuauaaaucccaguguguucauuguucauuuuuauuggaccuuuaguuucuuguugacuauucugaacaguguuguucugaacaugcacaucagaacauuuuuuuagaaaaccauuuucaguuauuuggaggugcauacacaagaaugaaauugcuuugacauguaguaauucuaugguuuuucuuuuguuuuguuuuuuugguuuuugguuuuucgagacaggguuucuuuguauaguccuggcuguacuggaacucacucuguagaagaccaggcuggucuugaacucagaaauccaccugccucugccucccaagugcugggauuaaaggcguguaccaccacugcccagcuaauucuauguuuuuuuuauuuccuuccuuucuuuucuuuuauugagacacuguauuccugacuagucucaaaauuacuguauagucuuggcaggucuagaaucuauggcauucuuccugccucucacguauugagauucugagugagauccauaaauguccuuuuuuuuuuccuucuuuuuugacagccaucuuuauggggggaugacauucuauuucauuaauuuuuuuuuuauuggaaaccaguggguauguguucuucuguuuauuuuccuuuugcauauauucuuuuuaaaaugucuacuuaaauaucuucucccuuuucaauauauuuucuuaauuuuugagaauuccaggcaugcauauaauauauuuugaucaaauauaccucuuauucuucccuuuaacuucuuuuggauacuacacauguauacacauacaacauagcccacucccaaauuuacuucuuccugaaauaacccuuugaguccaguuagugguaccuguauguguauaggcauguaccauccauuggaacauaagcaacuucccagggaccacaggcccaucaauugucaguacucuucauaggguucagaccuccugaaugcuuucccacucaugcuggaauuuugacuagcuuggucuuuuguggaucuugaacaggucagguaaccacacucugugguuuuaugacuacaauaccgugucauguccaggagucggcauuuuauggcauaucuuugcuucguccgguuuuuauaaccucaugccccagucaguguucccugaaucuugguggugcacauuguaacauagaugauaguugucccguuuaggccugagcacucaaagucaccuauuuuuugccacuuugaccaguuagagauuuuuguauuaacuauugugcaaugcaaaaagaagcuucucugaccaggguugggcaguacagauugguggguaugaaugcagucauuuagaaaacggcuugauaaugugggcauguagcaaacaacaaacaguacuagguuccccuggggccuaugaauaccugacucaggcuuuucacaagaguuacagucccaggcaugaaguccuuccuguggagcuggccucaaauacaaucagaaaguacuugguuaccuucuagugguuaugcuacuguuuuacccucagugagcacaucuugccugggaaggucaguauuuuagcauucagagcccaacacuggguaaggcuuuuggugucuucucccccagcagauagcauagcaccucugggacuaugaaagcuagcaaccagagagaacauugcuaaggcaguucuuuauaucuuguaaccaaaauauguauuguuuucagcuguagggcuucaacaccaaguuaggauauacuuugucuagaagauggguaguaguguuaagacaguucucccuauguagcccuggccugacuauagaccaggcuggcaugaaacucacagagaucaaccugucucugccuucuaagugcuauaauuaaaggcauguaccuccaugacuguguuuaauucuuuggguuguuuuuuucacacuauugauaguaucuauacuauuuuaucuuuuuuuuuagauuuauguguauaaaugcuuugccuacacauuugcaccacauuuaugccuggugcacaaggaggucagaagagaguguuggauccucaaacuggaguuagcaauguuguacgcugcuguguaggugauaggaaucaaaccugauggauccucuggaagaguauuuaguguucuuaaucacagagccaucacuccagcccucaagucauuuugucauuaguucucagauuauuucugucaguauucuauaguaauccucuucuuuguauucaaauuuucuuuucccugacuacuugcauucagaguauucccaucucucaaggucaguucuaacugcuuucaucuuaugcuuucucauuagugcuuucuagaagauuucauggugacuuacaguuucugucugauaaucaccauagaugaaauauauaaauuucuuccuguuuucagaugacuuuuuucaaguuacuuuuuuguugccuaacucaucucaagcuugagauauucccaccuuaaccuuuuacugaggucuacauuccccaaaauauacacuuuuucauauuugucucaauauaguauuuugcaaaugacuuuaccuguuuaucaauaaguaugcauugagugagugauguuuuauuuuuuuccaauaugauccuuuguggcacagguaaaagacaaggcaaaaaagauacuuggguaucacauccaacuaaauuaauggguggauauggccuuaauuuuacuucaagauuaguaggucuuagaaauuuucuuuauaauuuaucugacuuuucuuuuucagauaaagugacuuuuuacauuuuuauuuuauuuuucuccuugauaggcuaaacucauuuuuaaauuagcauuuacuauuccaguuuuaguaugugugcuucuaaagcguguuugaauauauauuguuuaauuauuuuauuuucaugugcauuguuguuuugccuguguguaugcuuguaugaggguguuagauauucuggaguuacaaaaauuuuguucuuaauuacauuuauuuguguccauaugcauacacauguguguaggcucacauguucacagagaucagagaacaaccuucagaaacuggcuuuccuuccuuccaucacauagguucccagaaucagacuauaguugucaucucuacuuacugagccaccuugcuggguguacuggcugguuuugugugucagcuugacacaagcuggaguuaucacagagaaaggcgcuucaguuggggaagugccuccaugagaaccagcugcaaggcauuuucucaauuagugaucaagggagaagggccccuugugggugggaccaucucugggcucauagucuuggguucuauaagagagcaggcugagcaagccaggggaagcaagccaguaaguaacaucccuccauggccucugcaucagcuccugcuuccugaccugccugaguuccaguccugacuuccuucagugaugaacaucaauguggaagugcaagcugaauaaacccuuuccuccccaacugcuucuuggucaugauguuugugcaggaauagaaacccugacuaagaaacugggucuaucuacuauuuuuuuuuucuuuaaaagcaaaacaaaacaaugccucuacuccaaauaaauuaugauuuuaaaaaaaaaaaaaaggcagguaaaaagauggcucagcaacacuuaacugcugucuucuggaggacuccaguuguaguuuucagcacacacauggcuacucagaacuaucuaacuucaacucaaagggauaugacacccuauucugaucuccauggcaccaggcaugaacaugacaccuguauaugaauaugugcagaaugaauacuuauaaacauaaaaauaaaucuucuaaagaaaccucaugagguggcucuguggguaaaauugcuuaucuggcaagcccugaugaccuaaauuuuccuggaauccaauucuauaguacacgucuguaguuucauugcucuuaugccaaguggggagguagagagaaaaagauugccuagaaaguuguggaccacuuagccuggguugcaugaugagauauaaauaacaagaaauauccuuccucaaacaagguagaaggcaaccaacaacuccaggaguuguucugugaauucaacauacacaguacaauaugcaugugucugcauccauacccauacuuguaaaauaaagaucaauaugagauuagucccauuuaucuuaagccuugguauuguuuggaugacaagcaucagccagauaucaugguauguaauagaucccaguugguuaauauuuuccauuucuaaaccaucauuaaagaaaauccuagaagaaggaagaccaaacuguggacacuuagauccuucuuagaagggggaacaaaauacccauggaaggaguuacagaaacaaaguucggugcagagacugaaggaacaagcauccagagacugccccaccuggggauccagcccauaaacaaccaccaaacccagacacuauugcagaugccaacaagagcuugcugacaggacccugauauagcuacucuucugaggcuauuucagugccugacuaauacagaaguggaugcucacagucauccaguagauggagcacagaguccccaaugaaggagcuagagaaaguacccauggagucgaaggggcuugcagcccccuaggaggaacaaugauaugaacuaaccaguaaucccacagcucccugggaguaaaccaccaaccaaagaaaacaaauggugggacucaugucucuagcugcauauguagcagaggauggccugauggguuaucaaugggaggagaguccuuugguccugugaagguucuaugcuccuguacaggggaaugccugggccaggaagcaggaguggguggguuggggagcaaggggagaggauaggggauuuucagaggggaaacuaggaagguauaacauuugaaauguaaauaaagagaauaucuaauuuuaaaaaaaagauaaaaacaaaaaagaaacauaauauuggcuagaagccaauaaaaaauaaaaaaauaaagugcuguuaaaaaaagaaagaaagaaaauccuaucuagagucacaucaucuuuuauguuaggacugaaacccugccacuuugauucauauguucccaguggaaaacugguauuuaacuuacccuagauguguuucauucauucugcaucccugacaaaaagauuuugcaauguuuugacucuguuccucucaguugcuguugaguggguucauauaaucuuugauauacuugaagacuuuuuuucaugaagcugguucaugacuaucaacagcagugauuauuaugcucuaaauaucuuugugggggccuugagcagaggcauuuccaccuuuguccugcccaccuccaggcauaugucacaggacagcucaucauagccugugagguccuaguggaugauugugaaggugacuagagccaugccacuaguuuagaagggcggagaggggauccaguggaacaggcuggccaaaaguuaaauuucauguuuuauauucacagcuagguuagauuagccaauuuugcuccugcugguaacuuuggauagccaaaacuuguauugcuuauucuuccuuuuuaaguuaauuuaacauccugugugcugagacagauuugguagcacacagcuaggcuacauaagacaaaaaagacaaaaaagaguaugucuuaacaaacuaccaaaacuucucuguucuccaucuuggaauguaguucacuugauagagugcuugccuaacauucauagauaugguccuaauacuugaggaucaggaauugaaaguccuccucagcaacagaaugauuagggacuguccuagucuacaggaacuguccccuccugccuccccaaaaaaucaaagucuugaggcuauuuugaucaacccaguucuuaaccacugcccuuuuaaggauuucuuaauuucuuacuuuguacauuuauuuaccaguagguagaacuucacauaucacacaauacauaaauuauaaguaauuaaucucuuguguuugcuucagacagagucuugcuauacaaacaaggcuggucuggaacucuauauguauuccauagucuccugaauacuaguauagaaaugagcuaccaggcuggugagauggcucaguggauaagagcaccgacuacucuucuaaagguccugaguucaaaucccagcaaccacaugguggcuuacaaccauccauaauaagaucugaugcccucuucuggugugucugaggacaacuacaguauacuuacaugucauaauaaaucuaugggccggagugagcagagguccugaucucaauucccagcaaccacaugaaggcucacaaccaucuguacagcuacaauguacucauauacauuaaauaaauaaaucuuuuuuaaaaaaugagcuaccaugugcccaguggucuccucuaauuuuuauaaguguuaauaucaguaaguaaucuauaauggauaaaucuucugauaguugggccuuagagagacuugaaugugaaauaaaaugccaggcaucugaagauuugcauucauuuugucaaauuccauuccuauuuagcacugguccccaaguucauuggucauggcuccucguucacggcggcgaaagcacaagaaacccccaccagugauucccaugauugaaaucccacccacagaagugucuccaguaucuccagcccucucaaaaccuggcccuagcauugaugcacuuggcuucauuuccuuggacaauaauguaccaggucugucccaguugauccuccaaaagcugaacaugaaaaacuaugaagaauacaagugagugaccaguucuguggaaaaggcaguaucuuugguacuaguuaugucagaagguuggaugaguaaaauuuagcaauuucucauucugaccuuugucagucauguuacuauagaagaaacaguuugcuuaagaaaaauggcuguaggauacauuuaagauuacaaaaaaaaaaaaaaaauccauacaaggcagaggaagcacagaagagguuuggaagaugcucaucccuguugcaccuucuuccauacucucucuacagguuggugauaaaugggggaaccccaguaucaagcuuuggauuucgaugucaacaagaaauguuccagaagauggaggacacauucagauucugugcuuauuguaaagugcucccucauggccuuuccaauugcaagguucuccggcacuguaagaggugacguguagggaccagugggggaacauuuaggaauaacccuauacuaaguccucauuccaagaggaauaacacuaaggguuuuuguuugguugguuuugcuugguuuuuuguuguguuuugagaauuaauaguuccuuauuuugugugaucccaguuuuagucuuguuuauuuugguauugugggagauaaaauagcagucuuccugcuccuuucuugagaacauagaugacauuuguucugagaaggcugaagaugaggcaugccugguaaggaaaacaucagcaaaugucuaggguuuuuugguucauucuucuuuucuuucuuuaugaaagaggugggguuuuuuguuuuuucgagacaggguuuuucuguguagcccuggcuguccuggaacucacucuguagaccaggcuggccucgaacucagaaauccaucugccucugccucccaagugcugggauuaaaggcgugugccaccaugcccagcugagauuuuuaaaaaucaaaaaccuagguuauuuuagauugguggaaaugggagcagcacucugucuuaagaaugacuauauuccuaaucuguuuacuucgucugucgaauagcuucuacauuuggguuguuacugucgaucucccuaccuuccucaccucuugcuagccuuucuuuguaggugcaggcauccagacacuucccuggacacuaagauaucuuugugacauaggaccauguuucuuugguucauucucucaggugcagaaaugucuauuacugugauacagagugccagaggucagauuggccagcacauaggaagguuugucgagagcuccgucuuguggcuguagaucgugucauggaauggcuucuggucacagguagaguagaggucacagguagagcauuaggauauuguacuauaauagcauuugaugauuuuagauguaacuaaauaaaagcauguuauuuuuaggggaaaaugagaaacugugagaaggaaugcagauacuuauaguuaaagguuggcagaauaaauauggaggaauuacugaggagagaauuuugaacccaagaaaggauuugauauuucuuuauuuuuuuuccuuuuuauuagguauuuuccucauuuacauuuccaaugcuaucccaaaagucccccauaccuucccauccacuccccuacccacccacucccccuuuuuggcccuggcauuccacuguacuggggcauauaaaguuugcguguccaaugggccucucuuuccagugauggccgccuaggccaucuuuugauacauaugcagcuagagucaagagcuccgggguacugguuaguucauaauguuuuuccaccuauaggguuacagaucccuuuagcuccuuggcuacuuucucuagcuccuccauugggggcccugugauccauccaauagcugacugugagcauccacuucuguguuugcuaggccccggccuagucucacaagagacagcuacaucuggguccuuucagcaaaaucuugcuaguauauacaauugugucagcguuuggaagcugaauaugggauggaacccuggauauggcaggcucuagaugguccauccuuuugacacagcuccucuuuauuuuuuaaaauuauggguuuucacacaugagaucagugccucccaaggcuagaagaggacauggggucuucuagaacuugaauuacaggagaugugaauugcccaauaaggcugcugagaacuaaacucagguucuuuccaggagcagugugcccucuucucuccagccauguuuauuaacucuuucugccccacaggugauuuuguccuacccucaggaccuuggccauggcuaccugaagauauacagaauugggauaccugguuuucuaugagggguuuacagcuagaaucuacauugaaugcucuucuggguagucacucuaugaccaugcuuugggcaagucuaggaaggccacggccagacccagaugucuugcauggcucuuugaagcgguugaugacagauguucugucacggcccuugacccugggcuuagggcuucggacuguggcaauagauguugggaagacuggaggaagcacauugcaugugguuggugcuucccacguagagacauuucuuauucguucuggagauuaugaugagcuuggcuacauguuuccugaacaccuuggcuuucaugugaucaugguggguguggauguggcuacugaccuuuuacagaguucuucaucuuuauccuuggagccuggaacaauucagcuuaguggccacagggcccuguaucaugacuucugggaggagcaaauagagacugggauucuggcccauccagauuugguggcugcauuccauccagguaagaacuguucauccagaggaaugcugaggagcugauaauuuuccauccugcacuuauguccuaguuaggauuucuaucacugugaugaaacaucaaaaucaaaagacaauuggggaggaaaggauuuauucaguucacacuuccacauuguaguccaucacugaaggaagucaggguaggaacucaaacagggcaggaaccuggaggugggagcugaugcagagaccaugguuggguuguucuuacuggauugcuucucauggguugcucagucugcguuauuauagcauccaguccaggaauggcaccgccuaaaauggauugggcccucccccaucaaucacuuucuuaguugggguuuuauugcugugaagggacaccaugaccaaggcaguucuuauaaagggaaauguuuaauuggggcuggcuuacagugucauguaucauggugggauacaugacaguguccaggaagacauggugcuggagaaggugcugagaguucuacaucuugguuauuagcaggcagcauaaaggggacuguguugugugucauaagacaugucucgucauagcuugagcauauaagaccucaaaaccugccccugcagugacccaccuccuccaacaggccacacuuucuaauaaugccacucccuauaggccaagcacccauacacaugauucuauuggggccaaaccuauucaaaccaccacaaucauuaguuaagaaaugcccaaagcugggucuuagggcggcauuuucuaagacauguuggucgucauuaaauacagacuagugaugagcuugguuggucacugcccaugcauguuaccuugggucagaauuuuuuacugaaguuccugauggugagaacuggggaugaucaaugugaggguugagcagauaacaucaaagaaauguccugcucuuaggcugugcucagcuuuucuucccucucuucccauuuccauucuuguucuucagguuuccaugccuccccaggcuugauggaagcuugguuacccacccugcugcuacuucgugacuaugagauuccaacauugauuacuguuuacagguuuuuacuuauuucuguuucugauccuuuuuggacucacuuuuuccuauauacagaugcacucauuuugauuccccauaccuguuugucuuaggaagauguucuuccuuccugcacguaguuguuuaaaaaaaaaucugggaauaguccuuugcuaaucagggauuuggugagacauuugggaggaaaauaauaguccuugcuuaguacagcuuuagauaauuugggggauugaucaugaauugccuugcacuuggcaauuucuguucucacacuaagucgagggauuuuccuuuucucuuccauagccaacaggaacuggaagccucuuugcagauucuggugaacuuggauacacacaucauugcuuguggagcuaauccuuucgcaucccucaaaccagaacaagucuauucuaaucccaacaagcaaccaguauacagcagugccuacuacaucauguuucuuggaaguuccccugccaauuagauaagaagcaacgagaaggaaaaaaaaaaaaaacaaaaccagaugauuuuucaguaauugaaccaagucuuuacugaaugccuggaaaaugaaagcuuaaucaacuuacccuguugaugucagauuuuugccagcuuugaacccugugguaugcuaaaccuuauucacaguucaaauaaagauguuuaaaccaaugga

SEQ ID NO: 7292 - RNA, 6729 nt, Mus musculus
uguagccccagagcucugucugucauccauccaguccuugcgugucugccagcgcccuuccgcugcagucaccggugagugcuguuggucugaagcaagccuagcgggaugaggcagccagggcucccgcaugccucccuucccacuaccuuggcuggcggaacugugggcaaggucaccacuccagcccuucgcgccccucuacagagagguuccaugguguugugcggauucagagcccgcagaggggagagacugcccggcuuggggagguuggucacugauggcuugccccgcaggacaccuggaguggcuucccuuggucuguaguaacucugccaccuucaagcugcuccgcuucuuguccugacuucuccuuccuuugcagaacugcugucuagagcccagcggcacuaccaugaaagucuggcuggcgagccuguuccucugcgccuugguggugaaaaacucugaagugaguggucucgcugcuuuagcaccaucaggaaggggcuugcaggaucccuuaagcagcaucaggggaaaaaugggggcugcacggggaacuuaggcaucaaaggcagguccaggcuuucccaggaaauaggacaauguaucagcggagggcuugugcacccaaagagguuugcacuaucuggcaagggaggaagaagccacggggagugccuuagcccaagggcaccugguuugugugaaguuugcuugagucaguccaugucugggugcuggcuaguaauaaacagaaaggggagagacagacagggguggggugggagaaagagagagagagagagagagagagagagagagagagagagagagagagaauauuaugagugaaugaauaucacuggaagggauuuugagguggggaccuguuuauccugaacaugaauucccuagagcaugucaccuucaucucuugcaggguggcaguguacuuggagcuccugaugaaugugaguaucugcuuccuugcacaauaguuggcugcacagagacccuugaaaaaccuuaggagacauacccucccugucccugcugaaaggcuggcuccccacuugauccuugcuuaccccuccuuugcauuugcuagcaaacuguggcugucagaacggagguguaugcguguccuacaaguacuucuccagaauucgccgaugcagcugcccaaggaaauuccagggggagcacugugagauagguauggggauuuggacuuggaaugugggagugggggaggaccagagaucuuagaacagggacagaugggugggaugcagaagcaggcagaagcuggccuuggaggugugggucuguuaccccagcacuuaggaggagacugaagccuggccuccauaguaaguccuugucucaaaaggcgggcgaggcgcagcuagagagacagcuuagugauuaagaacacuggcugcucuucuagacauccuauaguuugaguuucagcacccauagagguggguuacagccaucuguacccccagucccagagaaucugaugcccucuucugaccucuuccagcccaagugacauacaugguguacagauauacauggaggaaaaacacucauacacauaaaauaagcaaacaaacaaacaaaacaggcagcagaaguugggagucacacacacacacacacacacacacacacacacacacacacacucaugaaguaguggcuauacaagugugaaaaaaaagggugaaucucccucauaucaccugacaggucugaaaccgugucaccucugaaaugccuguccaaaccgccucccuuuucuaauacucugcacuccucaaaucauuucuagaugcaucaaaaaccugcuaucauggaaauggugacucuuaccgaggaaaggccaacacugauaccaaaggucggcccugccuggccuggaaugcgccugcuguccuucagaaacccuacaaugcccacagaccugaugcuauuagccuaggccuggggaaacacaauuacugcagguagguggugacugaguaccaagaauccuucccaagggggauagggagguggcucagcaguuaagagcacagacugccuuuccagagcaccuaguuugauucccagcaucuacagggcagcucgugacagucuuuaacaccuguucuagaggauccgauacccucuucuggccucacugggcaggcaugcacugucaugaauauaggaaaacacuuauacacauuaaaaacaacaacaucccuucccccaucguggccucuuagaaaccuuuguuaucaccaugguauaccugggaugggaauccuggcacaagaauccaggucucuggcugagccuuuguuggaagggagaauacagagaagacauucgggcuuggcaugacauucccuaucucuuuguguuaccaggaacccugacaaccagaagcgacccuggugcuaugugcagauuggccuaaggcaguuuguccaagaaugcauggugcaugacugcucucuuagugagugucgcugacugcuuaugacaacggggugggaagagacaaacucuauugucacugcaggagggaugagaagugaggugugccucagagacuucuucaucauugcugucucccccaaacaugugucucuuucuuuucuaggcaaaaagccuucuucgucuguagaccaacaaggcuuccaguguggccagaaggcucuaaggccccgcuuuaagauuguugggggagaauucacugagguggagaaccagcccugguucgcagccaucuaccagaagaacaagggaggaaguccucccuccuuuaaauguggugggagucucaucaguccuugcuggguggccagugccgcacacugcuucauguacguccaucccuuugucccuucucucugacucuuccacccaaccccaagacuguccuuccuccuucccuauggacgguuacaaugucauucuccugcuaacccucuaaccaugcagcuuguggucuuggguacaaguaauacuuugaggccucugggguggaguggagagagugaccggacuuugugagaccaggcugacauguuucauuucucacagucaacucccaaagaaggaaaacuacguugucuaccugggucagucgaaggagagcuccuauaauccuggagagaugaaguuugagguggagcagcucaucuugcacgaauacuacagggaagacagccuggccuaccauaaugauauuggugagcagaaagcuuaguuaccagaaaggcuaaaguaguggugggaaauguggggggacuugaagcccgggauuuauauaacgagauggaugaggaagagugcagaaugagauacaugagaagcugagggguguagggauccucuguggagaccuugaauuucccaaaaagauagauucuucuaaguagaaacaaucuuacaggcauacggcuuaggcugagaaugcccuguuuguacaaaguaggauggaugcuucuucucuguauaccagaauauagaauguauaaagcaaagccuuggcuggauuucagcucagcucccucagcaggaaacaaccuguucagcuguauaugguggauuuuguugccugaacaucugucaucugaugaaauaaagcauuuggagaauguggcaggggaggcuucaggguaacaagauaccagcagaccuuuuggaucucugugacucccaugccacgaguauagaucaaugcucagcauugguaggggagagaugaugaccaucugacacagugauaaccuuuccccuuugaccuuucccuuccccacccagccuugcugaagauacguaccagcacgggccaaugugcacagccauccagguccauacagaccaucugccugcccccaagguuuacugaugcuccguuugguucagacugugagaucacuggcuuuggaaaagagucugaaaguaagugacagaugaagcucacugagagagucugggggaguguuacgguccagaguaaagagcagacuaucaaaggaagacuguggaaacaggacuggaaacauuauggagggccagggauagaguagggggagaugggcaagcaagucaaacagggugugaacaauugugagugaaguaaaagacucagauuggagaaacaagaacaagagcuuuucauagcugggauauguuuuuuaucuucaccccugcagagagucucauuuauagacacaucuuaaugcaaacaucuguuucuuccaucuaggugacuaucucuauccaaagaaccugaaaauguccgucguaaagcuuguuucucaugaacaguguaugcagccccacuacuauggcucugaaauuaauuauaaaaugcugugugcugcggacccagaguggaaaacagauuccugcaagguaagacucucaagcaccccucuuuaucacccccaacuccccagagcucuuggauuugaucuaacaacccuggggagucucuuuccagccaacaaucuaagaaucaaggacuuaggucuuugggagcuugucccaauacuuauagguucaaacguugggcaugagucccugugcuauaugcguuuuagacuaaaagggaccaagacugcuaaaaaaaaauaacccagacaugguagagcauaccuauaaccuagcacucuuagcauuuugaaagcugagacaggaggaucaugaguuuaaggccagcccaaacuacagagugagaauucaaggccugugccacauagcaagauccuuucucaaauaaaacaaggaaagcacaaaccauaaaaaccaagacaauagcaacaaagggaugggugccuagcucagugguuuagugcuugcuuacuaugcucaaaguccugaguucaagucucaacucagggacuggagaucauaagaaaaacuaagagucuggggacguggcuuaguugguagaguacuuacccagcaugaaagaagcccuggauccaguccucggcacuguauguaaugacccaggccugcaguaucagcccuugagggagucagaaucaguuuauaaguucuucaguuacagagugaguucaaagccagccugaaagacaugggcuuaugagacucugucccaaucugaaagaacacaaccaaccaaccaaccaccaccaccaacagcaaaauauagauacuauucaaaucacuucugggccuuuggcuaagacaagugaaaucaacauaauucuauuguucaggaucgcagugaauuaccaaagaucagguaggaaaggaaggagaagucuuaaagagacuaugaacugguaaauaaagagacggaaggaaaaaggaagcaugugucaguuggaaaaaacaaaacuaagacugagcaugcugugugccaaggcgaggaauagcagggucugggaaagcacuggagagugggagaggaaagcuaagacuuuuuacucuugauucgguagaaaauggggaguugcgaaugucucugacucugggagccucuccccguucucucccguggcuggguaguggcccuucccucaguucuuccagggcuucaccucuuuaucuuuggcuucccagggcgauucuggaggaccgcuuaucuguaacaucgaaggccgcccaacucugagugggauugugagcuggggccgaggaugugcagagaaaaacaagcccggugucuacacgagggucucacacuuccuggacuggauucaaucccacauuggagaagagaaaggucuggccuucugauggcccucagguagcugagggaagaaacagaugggucacuuguucccaugcugaccguccucucugcaacagagucgucaaauggagggaagaagcugaaaagacagguuuugcauugauccucugcugugcugcccaccagggugagcgccaauagcauuacccucagacacaggccugggugcuggccauccagacccucccgaccaggauggaaaguugguccugacucaggaugcuauagaccaggaguugccuuuuuauggacuaaagccaucugcaguuuagaaaacaucuccugggcaaguguaggaggagagcuguuucccuuaaugggucauucaugagaucugcuguugggaaauaaaugauuucccaauuaggaagugcaacagcugagguauugugagggugcuuguccaauaugagaacgguagcuugaggaguagagacacuaacggcuugagggaacagcucuagcaucccaugaauggaucaggaaauguuauauuuguguguauguuuguucacucugcacaggcugugaguauaagccugagcaaaagcugguguauuucuguaucuaacugcaagucuagguauuucccuaacuccagacugugaugcggggccauuuggucuuccaugugaugcuccacgugaauguaucauucccgggcgugacccgugacuagcacuaaaugucgguuucacuuuuuauauagauguccacuucuuggccaguuaucuuuuuuuuuuuuuuuuuuuuuuuuuuuuuuuuuuuuuuacuaauuagccuaguucauccaauccucacugggugggguaaggaccacuucuacauacuuaauauuuaauaauuauguucugcuauuuuuauuuauaucuauuuuuauaauucugaguaaaggugaucaauaaaugugauuuuucugaaga

SEQ ID NO: 7293 - RNA, 107288 nt, Mus musculus
gagggcggggcgccuguggggcuaguuacgccgagggaagcccggacucuagucgccgcuccgagucagucacucgccgccggcucccggcccuacggaucccaguuuucuguugcccgcgguacgccgccccgcuagccgccgcgaugccgguguuucacacgcguacgaucgagagcauccuggagccgguggcgcagcagaucucgcaccuggugauuaugcacgaggagggcgagguggacggcaaagccauuccugaccucaccgcgcccguagccgccgugcaggcggccgucagcaaccucguccgggugagcgcgccgggccugggacgggagcgcgggcgggagaaguccccagggucccgguccgccucgcugcuugcauucgcaggcgcuuggagcgucggguggacuccagggcaggugccgugguuucgaaugccgauuucucugggcugugaccuugagcaagccacugagccugucggggaccucaguuuccucaucuauaaaaugggacacuugugugagaaauccugccuuggggcugugcugugaagagucagcgagcuuuuaguugugaagugccuagggugugugugcccguaguaggcgcccaagaaauggucguuagguugucucacggucccuccccugggcaggcucgcgucacuugcguugaguaccuugcucuuagcuccuuuuuaggccucuccucuccaaccugugggugguuucucuuauggucucccugcccuaacuuccaaggauucuuauuugcaccgggcugcucgccuuucuaauacuucuguccccugagacccaccugcccaacccuccccugggauccuggugucugucgcuucuacccaacugcuuggcuucuuccucucucugucgccgccuccuuuccuucggggcauuuugcucacaccuccggggacucuuagcaccuuuagacaguaauucauaaccaggagcccugcuugcccucugccugaccccauggccgucauuuuauuccuuccaugaagcugucuauccaucuuuacugcugucaaauggcuuucuuucacuggggccuuuccagauuuggggggccuccuccucugccccuccuucuggcaggaagcaagauggagcugcugugagaggccuguggaaucugggaucugcagccccugccugaggggaaggcuagggcguucuuugccaguccacacuuuucugccugccccuagcuauuuaucgaucuuuguagcccacuucugaaaugggaaaagagauagagagacuagucucguaacuguacccuggcuaaugucacacuugcuccaggcugggugugacucagacugcuguucccugugaagaacaacucaggaaaaaguucauacugcuuuccgaaccaagcuguguaaauggugugucaggguaguugauagguaacugucugucggguggggcuuguguuauuuaucggauuauaggacuuuaacgcaugaaaugacuuccugggucuucaggggccugggacugucucaggcauuuuaggagaccuguggcagcaaguaggagggggagggggaggggagaggagggagggagagaagggagggcggaacuagggacugaaauuucuguucuucuguacugauuaaguaagaaacuauugaguaggagcaguguacucauucagacugucuaucuuguucuuguucucuuuguagcuaauuuuaaucuuagaccccagaguacauucuuauguaguguugucugacauggcugcauuccaggccucugguuuuucaacaaaugggaaacaauguaaagagacaagguaauggugucccuccauguagcacuugaggauaggaaaucuuaaacccacauguugcacuuggaacacagcugguguagucaagggcuugguugauaucugguuaggcuauuuagagagaagucauuuaugagcucccaggccaugaauuaguaagcacugaaugugugcuguauaaagagcauuggaaugaauuaguggcccucagggugugcaugagaaucaccaauggggcuuuguagauaggacuguuuccaguucccaucccagacuuacugaaggaucuccaggaguaaagguuuucuguuuuuuaaaguagcuccauaggugguuaugauggucauaguuaggagacauacaaaagaaacaagggcagauauaagauggaaaaaaaauacauguaguugcauacuuccuaacuauaaaagguauuuaaaguugaauccguggaggggauugggcugauaaauagucauaaacaaaggugcuaccagguuucacuaaguagauugucuugauugcagguuaaagaaaucagacucgaagccagugaaugguauauggguaguuuagcagaaggucuuauuuaauaagaugcacaaguugguugggagugggagggaagaauggugugugaggaagaacaugggcucuagggaggccugaggacccaucaacuguuuucauaaauguauggauccucuacacaucucaaguuccuaacuccugucaggaaaacacaauguaaguggaacuuuuuuuccucuucccuaguuccagucuucagcguugacacacagauugguuaauaauaaauagaggguuaaaggaagaggaaccaugugaaguuaggcuaggaggcucauaaggcugcacgaagacuagaaaaggaauuaacuauaaacacaguagagaaauaauaguaacuggauaauaaaacucuaggguugcaaaacucaugucgugucuauaaaauaauggaacuaaguuuugagcaaauauuggaauccaucuaaucagaauguuucuugcagguuacuuuaggaggcuauauccuugcuccagugcuucucuucuggaauuucucucagaugauuuauauauguaugccaaauuagucuuacuuugguccagaaaauguauauuuugagugaaauuaagcccaucuacuuggcauagcaucuguggucuaagacacggcuucuuaagcuauuucuacuugugauuccuuuuggcuugagaaauuuuuacucauccuuagcuauauagauacauaaaauaggcauauaaaacaaacaguuaucaauaaauuauaaguuuauuuuaaaacauuucuuugguauggacagaacuuuaccauuaauaaaagaugcaaguaaauuugccuaguauaaugggguaguugugcuaguuuguuugcgugucaagaauuaacucuuggcugaauauuuggcacuucagugauacagagcaucuuuaguguuuuucagcguugaugaguauuuugauuuuauaaucugcaauuuugagggcuuagcuucacauaaauauguggcacaaacugcauauaagggccauuucagaaauuguuggaaaucuuguccuucucccaagccagaauuccauguaaugauuuucuuuuuuuaugcaacuugucagcaacuuagacagcaucuuuaaaaaaaaucaaucaucugaauauaauacaaucuaaggucauucuaacuugauacuuacaugcuugggaaugaugguaagaaaauauuagacgucuuugcuuuucuguaauuaaacauuuauacuucuagaaguguaaaaaacugugugugcacagcaaaaacacugcaguuuaucacugaugguaguugugaaucugaguggagguguuucugauaaggccaugcauagugcaaaugcauguuauauguucagguucauaguuaugaugaaguuguuccaugcagcaugugcgaagguggccagaaacaauuuugauuuauggccauaguuuaggagccuuuuacuagugucacauaauuuauccuucccacauuccagguugugacccuaugagaucaugaccuaccauuuaagaagcuggugucuaaaugacaucugcauauuuccgaaguuaaauuuauuggaggaagaugaaacucugacuuguugaacaugguuauucauuuauaaaacagaaauuuauugaaauccuccuugaauguuaagacaguaagaaugauccugaauagagugguuguucuauuagauugaaaguuagagguggcaaaucacugcaaguucagaggaaggagagaugacuugaugggagaauuggaggcuucauggaagauauaacaugugagcuggucguuuaagacagaggauaggaacaucuaaaguugugagaauaaaugccuuacaaauggaagaaacuacuuaggcaaaagugcagaauuuuuaagcauucaaaaaacaaguuucaauuugaacugcuuuugggggagcaggacucauuuggauuuggaguucugguaucuuuuuuuuggacaaggucuuacuguguauguagaucuaccugacuuggaacucacagagcucuuccuaccucucucuccucaaugcaaacuggaauuaaagguguaugccacuauguccagccauaguaauccgaaacauaguaguuuggucacuguaucuagcaucugguuuuuguuuuuugagacaggguuuguuuguagcucuggcuuuucugguacucacucuguagaccagacuggacuuaaacuuaaaagauccacuugcuacugccuccuguguucugggauuaaaggugugugccaccaccaccuggcuaaaguguagcuuuacuaccuguucauaggucuguuucucucucucucaaugguuuauuuacauguauguaugagggugucagaucuucuggcaucagaauuacaguuuugaccugcuguaugggugcugggacuugaaccuggguccucucuaggaaaguagacaguaagugcucuuaacugcugagccaucucuucagucccugaauugucauuuuuguuccacacuugagaucagcuggaaaauuuaaaaagauguuuucucuuuccccauuucguguguguguguguguguguguguguguguguguauucauacuguguggguauauaugacuuuucaugcgguaguccaagauugacguugagaaucauccucaauuguucuuccaccuuguucauuuauugaguuagggucucucaaucaaagcaauccagauugcuucuuggaggaccaccugucuccugcuuucuaaugcuggaauuacaggcaggcugccacacccaucuagcauuuauguggguucagugggucugaauuacugagccucucacuuguacagguuuaacugugaaguuaucucccaugguccacuuaaaacaauuuuuuuuuugcuugauuuuuuuugagucagagauucauuguggcucucuagaugauuuagaaguuucucuguaucucuuguuagacuugaacuugugauuuuccugccuuugccucccaagugcuuacugguauacacuaccaugccugguuaugucuuguuuucugaccaggauccugaauaagaccauguuuuugaacaguuuuauugauauaauucccacaugauacaguucauucauuuaauguauacuguuaguugcuuuuuuguaauauuauuguuguacuauuacuacaaccaaauuuuagaacaguuuauuuaagauuucuauuagcauguauuuuacauaauaaugggcuuuauaauuucuauguguacaugauuuauaaccucuguuauaaucuuuucuuguccaccacacauuuauccucuuuuagagcaguuuugacuacucagaaagaacucagaugcccauuuacauuccucuuguauuguuuccuguauccuuuuaccugcaugaccccuuuccuuuccuuuccuuuccuuuccuuuccuuuccuuuccuuuccuuuccuuuccuuuccuuucuuuuccuuuccuuucuuuuccuuuccuagcuccuggauuugccucuucuggacauuucauauaaauggaaucagacaguguguggcuucucuccccggcuucucuucacuuugcauauuauuuuucaggguuuauccauaguguaguaguguaguaugucucagaacuuuauucucucacucuuucuuucucucucucucucucuguugcugcuaaauaauaguucauuguauggaaaucauuucaaacacaaaaagcaaauucagugcauuaguaaagcaaaggaggagguagaaaagggauggaugggaaacaggaauaaagaggagggacacaaguucucagaaggguggggcuuagcaaucaguguagaaaagucagaggccuaggccaucucauagcaccauaugcaaauuuuucuuuuucuuuucucauugaagugaccuauagugagucuuugaugugaccaguacagccaugucaguuuuauugauggggcuucauucagaugcuucaucuccccucgcaucugaggucauguguugaaacuauuacuuggacucaugaaauauuuauuuauuucuguggccuugacuuuuaugugccucacucacauaucauaaguucuugggacaauagcauugucuucucauuagguggauagaugggaaagucugcuuugcucuuuaaaagagaccaguaauuaauuuugucacuuguaguuacuguauuaacaucugaacuuaguuuugcuguaguuuccuuugguuuguguuagguuuaucucacucaguucaggcaguaacaacgucugagugauaggucuguggguaauaucuuuuaaaaaauguuuuuguauuuuuuaauuuaaaaaacaaacagaaccauuaauaaaguaaauaaggacauuuguauagccauuuauaccucauaaaauuuuuuuuuucuguaugugcgugguauauguguguguuugugugugugugcauuuguauaagccugcauuugcacauguguguguguucuuggccuguguguauuuuauuuuggaggccagagguugaggcuggcaugcccuucucagcugcuuuuccacuuuaauuuuugacagaguuucucauugagccagagcuuacagguucagcuagacuggcuugucagugagcccuggagaucugucuucacccuagggcuacugauggacaguuccgaggacagcuuuguacaugaauaguggagagcugaugcuugcucagaaaacacaaagugccuaugaaauacuuucauguuggugagccugcaacaauccuguggguagauguugugagguccuuauuuuauagauuaacuguguuuuagagaaacacuguuucccuauagauaguuagcuuggacuuagauucuugcucucugacuccagaugcucuggucuuauaccuccauuguuccucaucugcuuagaucaugguuguuaaguaucaguggaaaaguuccaccuggaacuagaagcagcaagaaugguguuagucacacauuuccauuuguccugggccuggcagcagugucugcagagucuggcuuuggcaugaccaucauggggggugaugugauguggauuggagcuucacccccagccucagcauacuccccguuccuucuucccucccuuuucuaucucaggaauuaaagaguaggugcagaucagccucuaaauacuuuauuaaguaaguauauaaaguauuuauaaagauacuuuauuaaaguauuuaaaacagauuaaggcuuuaggaaagucauauauguauauguauauguaauugcuuagcuugaacccuauuaaaacuaaguaauauuugaaauaaaauuauauguauucuuugggagaucaugaaauuuccuuuaaaaaacuuugucccagaucaaaggguauuuaaugggacugaugugaaccuuauucugauaauuagcacuccuguaucugagauuacagaagguuucuggaaauuguguauauuucuguaacuauauuuguaauuuuaauggagccuaacuuaaauguuuguuuauaucuacaaaguaggaaguuagcuguuauauaaauagcauugagcuaauucuaaauaggcacagcaagagucaacaguaguaacuuugguuugaccccuccccacccccauuauuguuaugaagaaagauggcauuagggaaaauaccuuuauggagcuaggacucacuuggguauuaauacaauacuucuugucuguuugcuuaaagauaaagcaggcuaggagcuggagaaauggcucaguggcuacgugcacuuguugcgcucauaaaggacuuggguuugguuuccagcacccacgugguggucauucauaauuccaguuccagggaucugacaccuucuucugaccuccaugaguaccaggcacacuuugguacacauacauacauguagucauauaaguaaaacacucauauaauacaaguaaacauagagcagccuguuuuuuauguauuuauuuaaccacugcucauuuauccauguauacgauauguguguguguguguguguguguguguguguguguguauguguguauauguguauauguaugcgugcguacacuguauacuguaccuguauacugagagggcaaucauuuaaaagcugagggccagcaagauugcuuagcaaguaaaggugcuuguugccaaaccugacaaguuuggucccuggaacauacauuauggaaggagagaacugacucuuacaagcuguuuucugccugacacauguacuacccccccccaacuguaugaaaaauaaaaaaggaaaguacauauguuaaacaaaauaaaagccuuccgacagguucuuaguaauguacaccuuuugggaaggguaaaugggaauucgcacacuaucuauauacugcagucuaacaggucauguauaugcucuggugaaauacucaccuuaguuaaggcguuucucuuuucugguaacuuuuagggcuaugucugcucuugucauagacuuaaaguacaaauuuuuaaauuuaaaugaaucugcauaguauucauuuuaauguauacaacauuaggaaucaauguauaguuaguacuucuagucucuagcuuucaaacauccuguauagccacguuuaaagcuucaccaaauuuauaauguucuuuggcuaauacaggucaaauauguacuaagggaggaguggauggcugauugccuguuguuugagauaacaaaaguguucaggcuauuuugaguugugguuucucuguuuaggagucauuucagcuaugcaggccacuuacuaaauucauagcucaagacucugccuccuaucuggaagaggcaugggauuuugcauucucuuuuugggagugccuuuaaaaaauuuaacgauuuagaccagguguuccucuauuauuuggagcccugcugguuacagugcagccucauacuaugagucauggauuccacauuaaagagcuguauuucuuugaaccauauggcaggagacaaagauuucaaguugaucugcuguuuugcuuucuggcugauucaaauccaaccucuuuuauucaggucgucaugaaagugaaucugugugugugugugucugucugucugucugucuuucucuuucuacacacacacacacacacacacacacacaccacacacacacacacacacacacuuuaucucauacagcuccauauuuuauacuucaagauuucaacaagccugccagacagaggaaguagaaagauaaaugaaagcuuuuaaagagaaguccuuccucuaauacaccaauuucucuuguguuuuagaaauuagaaccagcacuuggugcuaccaaaaagaguagcagucuuuaggaaguaucagagagaagcugauuuuauaggugucuuuggaauaaagcucuguguugaggacuccugaugagaagaguauucugucagauaacuguuccucucagcuaacucuaaccuuuuucgcacuuuaggccuuccuauagguguuauauauaggacuagaagaagaaaacggguuucuccuugaccucuauccuucccaacacuguucuucaaaacauuguuuugcugugguuuaggcuuucuuggacuggcuguguagcccaggcuggccuugaacucaagaucuuuucuccugccucagacuccuauagcuuggccuaguuucaaacuugaugaccuugaacugaauccaguuaccaccuccuuaguucugcuaaaacacuuagcuaaaacuuuucuuguugcagauuauauguguguguguguguguguauguguauauguauauauauuuggagacaggguuuuacuauguagcccagggugucuggacucaaaauacuccugacucugccaccuuacaugcuggaauuacaggaaugcacuaucaugccugguauaaauuguauuuucauuauugaaaaguuagcagauuuuuauauuucucaguguuucauguauauauguauauauguguauauacacacacacauacacacacacacaccauuuuuaucuuucucucucuuuuuuuuuuacuauuaaugaaaagugcaaacaaaaccaagaaccaccccuaaugcacuauucuguuuauaaauuugcaaugaaagcuggcucuaggauauagaccuuuaauucuagcauaugggaggcaaaggcaggccugauaacacagaagauuccaagucagccagagcuauguagugagaauauguguuuauuaaaaaaaaaaaaagauaaaaaagggaggagacccaaucacuuuguaccccuuugagacuuucucuuccauacgcugucuaggaagcuaggcuguaguuaccuggcugcacuuccagcaagugcagaaaggaaaaacuucagaguaagcagcuagauccucugagaccuuguauacugacauguuuuucaagacaugcugucaaagucucauugauuaaauuuguuuaaauguguguauuacaugcagagaugauauguugaugauaggguacugagugaaaggggacuuucacaauuagacauaggaaauggagggugcauuggcuucuuucccuuaguaagacugucaaguuuguacuuccuaugcugggccaucaggccuggaugauuugacugaaguucgucuccugcuucccuacuucuccugggugugucucuucaggaccagggcucuguaguucccuccuuaaguguguuguucuuugauauuugguguuucuggugucauguuaggcuauuucaugaugaggaggauagcuuucuuuuggaaggcuuggugguucucuuguccuguccccaagugucacucuaguuuaaaugccuguacaaacacaaagagagaaggauuaguaaaggauagcauauuauacuggauacggauauuggacauuugauuccaaaaaauuuguucucucuucuaugagaagucaggcuuuccuuggguuggugugagcgugggcugcauauguaugugcauaaggagggagagcugaaaauuagaacuaacaguauuuugagacucauuggggugcagauaauagagucauuggcccuuagagaacuucccacugagaaaaucuccaguugagugacuuuuaagaggaaagugguuguguuugcugcaguucuuagcacaguuggccaccauccagguuaaagucauuccuucuuuugaauguagcuuaaauuauuuccacaaguaagcuuucuguaaagaaagaaaaauggcaugccuguucuuagaguugaaaguugauggucuuguauuaucuaccuucccaacguuuuuagucuucuuugacuucccacccuggaauacucacuguuuaccagguggaaaguacauuuuuauucauauaguuaagguaagggguugggagaaguugggcauggcaguguacaucuuucauuccaguucucuggaggcagagacagaauuaucucuaagguugaggauagccuagucuauguagggaguuccaggccagccagugcuauguauuaauaccccaucucaauaaaaugaauaaaauaaguuggauaagugggcaagugaauuauauacccauucuauaaugcuuuccaaauauugauguuauauacuaaacgguaacugugugcauuauuggguauugcgaucaaugcuaggauauuuaagauauagaaaucauggcaugcaaauacaaccauccaguucauguugaauaaauucuaggcacaaucccagugugcauauggagacaauccugucacugucuccuggacgcuguaggcaccugcacuguuguguaccuccccccacaaugaaaaguaaacuaagccuuaauccuccugaccauuggcuauuuggugauagguaccauuggagaaauuauuuaguuccuaauuccuccucuguaaaacagagguaaaaauaaggugugccucuuuaguguuguuuguauuaaaaugaguuuacaaaacuauuuagagcuauuauugacacauaguuaagagcuuagucuguauuagauuuuaucacuaauauucuucccugugauuuuaaguaacauuucaaauguuaaucuggugaaaagacuguugauuuuuuuaaaaaaugccuaagcauagcucuuaacuuuuauucaacaaggcaaaaugccaaugaaagcuuucaguagaauuccauauguuguggaauauacaguuuuaccaacugugggaaaaauauuacagcuuagguaguugaaccuuugauuuccagauucccaugauuaaaggcagucucauauuuuccuuuuuuuuuuggagguuggagugggggauuaaauugauuaaacccagggcuuuauaucugcuaggcaaaagcuauaccacugaacuacacucguuuauucuaaccacuuauuuccccccucccuucguucuucuuuccuucuguuuuuaagauaggguuuugcuauguugcccaagcuggucuaaaauuccuaaauucaaauaaucuuuuuagcuucccaaguagcaagauuucaagaauggaccuggcuuaguuuuuuuuuuuuuuuuuuuuuuuuuccagugaguugggagauggggguggguucaagacuggauuucucuguguagcccuggcuguccuggaacucacucuguagaccaggcuggacucagggaucugccuguuuuugccucccaagugcugggauuaaaggugugugccaucaccacccagcccugguuuaaauauuucuuuguuuauauauuuggcuuuuugagacaggguuucucgguguaacagagcccuagcaauccuggacuugcuuuuguagaccaggcuggucucaaacucaccugggaucaaaggccugcgccuggcucugguuugaauuuuuaauugcugucuucugauuggaaugacagcaaggaaaaaguguuccagucuacuccugauugaaagcaagaguugagguuuaggauuugaucaguuagcuaaaguauucuugucuuaccuuucuucugucccacuuuucccucaauuauguuucucucucucccucucccucucccucucccucucucucucucucucucucucucucucucucucucucucucucccucucccucucccucccccuccccucucucucucugugugaguuaggugcugcuggugcccuggaucugguugugugcuacuagauagggcuaggaaucaaacuuggguccucugccagaauaauauaaacuuuuaaccucuaagccaucuuccuagucccuuucuuauuuauuugugguucaagcugauuuugaacuuauguagccuaggauggcuuugcacaccugauccucuugccccugugucucaaguacuaugauuauaggugggugccaccauauucugcguuauugccuuauuucauuaacaaagaagcaaacaaacugucuggagaaguaguuuagcauguaagagcacuucuugcuuuuccagagccccuaaguucagucccuagcaccuucuucagguggcuuacaaugaaguaccguugacuccagcuccaggauaccuacugccccuucaugccucagugguacccgaacacaaugcauacauauacacagacauacauaaguaagaauaaaaaauacaaucugauuaagaaacaacugaaggguagccaggccacccagugaaguaaccuggggucagcgcugugggcagagcugagguauugcaucuaugaacaguagaacacaucaguuuaguaugguggauacugugauuaccuacagacugaaguagcuucauaguucuuauuuaaaaagggacaaucuucuucaaaggcccuaucaauugaaagaguaacagacuucaaaugugacucaggagacagcaacugccuguuuggaaguuauauacauuauuucuagucucuuuuaugguuuuucuagacuuaaaagucauagcaguaacuucaaagucuuuuaaaaauauuuauauuauuuuauguauaugaguguuuugccauaugaugguguaccaccugugugucuggugccugugaaggccugaagaggguguggaauccccauggugagcugccaugugaguucugggagccaaaccuaggaccuuugcaagaguaauuaaaugcuucauuuuugacucuuauuccuuaaucauacuuuaaauaccaauacugauaacauuguuuuaaucagaagcauuucgaaguacggagaccucuaggguuuacuacuauauuuguaaaaucugcaaugucagaauuauauuuuaucuugagaguguagaagucuuugguucucuccacggccugccucucucucucucucucucucucucucucucucucucucucucucucucucucucucuuucucucucucccucucucucccucccucccccccucucucuguguguguguucuuaugauagccaaugguucauaugauuucuucaaccauccuccacuuuauuuuuggagacaugaucuuuccuuggauauggaacuuuuggauucaguuaaaauggcuggccagcaacuuccagagauccucugguaugcacuuccccaacucugggguuacaggugugggcugccauacccagcuuuuuuuaaaaaauguggguccugagauccuaacucagguuuucaugcuucuguggcaacuccuuugcugagugagcuuucugagucaucaucucagcccuguauuugguucuuaauuuuuuuauucaguugugguaaaaugugcuaaauauuuuacaauuuuuacauauacaguuuugugguauaacauacauuuauauuguauguuauaauauuuauaucauauguuacauuauauauuauauuaauuauauuaauauaaauguauauuauauuauacauuuauauuguauguuauaauauuuauaucauauguuacauuauauauauuauauuaauuauauuaauauaaauguauauuauaucauacauuuauauuguauguuauaauauuuauauuguauguuauaauguauauaauauacauuauauuguugagaaaccacauaucuuuuuccuagcuauuggcauauaccauuauuuuuugucuuagugaauuugacuuuugcuaccuuuggaauuaugcaguaucgucuuuuuaauuuuugcagugcuguagauugaauccaaagcuuuauaugcauccuaggcaagcauucuaccuacaggacugcauccugagccccacaauguuuaugcuuuagugacuguugucuucagggcucuuuuuggcaaguguuagaauuuuuucauuuugaagacugaauuauauuuuguuguuaauauauaauacuuauauuuaaauaauuuaaacuacauugugugggugugugugcacacaagcauguaugccuucaugcauguggagaucagaggacauuuuuguaaugucaaaucucucucuaccaugugauucucaggccaucaagcuugguggcaugcaccuuuaccccacggaacuaucugauugggcuaccauauuuagcuucauugcucaucucuugauagauuuuggguugcauaugucuauggauauuaaaaaguaaugcugcuguuucaucauaguuuuagugccuuaagaaauuuggacucuguuccugauggguauaaaguucugguggacucgggcugggacugugaacuggucucagaggcuagagaguacacaugcaaucaaaaguaggccaaaggcuguuuuggggaauguggugggaagacaagaagggaaguuuguuuaacuuuauggaggcuauuuuugaaauaugagggaauuagccugagaaaauggggaaaucuauugcaagagaacauagagaagaguguaaauguauaguuaggaguagggaaggguuaacaaugagacuacuaaggcagaucaggucugcuagggaaggaacuuuuuugccauauacacuagucauaaagaaagaaaagaaaagcugauuuaugaauacaucaaacagucauuuaauuuaaaacguaaaaggugaaaggauuagggucgaaaggaccuucucauccuggguucccucuguccucuuaggaaagcaagaccauaggaaacaguguuuuaggagugcuuggagagaguuuagguacaugucagaaauauagucuccuugucauacugucuuaguccaacuuuuccaccgucauauuuuauagaauacuuauuaguacuuagaacucuaugaguuugaggccagccuagucuaggucaaguuccaggacaaggagggccggccguauaaaaagauacuugucuuacaaaaaaaaaaaaaaaaaagaaaaagaaaagauaguccaguguuuuccccaccuuuuaguacucccacugccuggauuacacuuccugucuuguuaggaugagcucagcauacauacugcucuaugaaguuauucaucugcuuggugugucugcaagacuuggcucugguucuuauuaaaccaucuuacaaguuagaacuccuuguguuccuguguaucugucuuuccuucugacgucuggcauccggcuuugagcucuagaaggagucuaguacuccucauugagugagugggguguugauacuuuaauucagcuguuguauuugcagcacuauugaauuaguuuguuuguucucucuuuccuuccuuccuuuguucuuucccccugcucaucaucagagcaagaagauauauauaauauauauauguauauauacacacauauguacauauacauguguauacauauauacauauauaucuuuuuaaaaauuauuuauuauauuuaaguacacuguagcugucuuccaacacaccauaagagggcauagaucucauuauggaugguugugagccaucaugugguuucugggauuugaacucaggacuuuuggaagagcagucagugcucuuaacugcugagccaucucuccagcccauauaucuucuuauauauuguguguguacauaaguauauauacauauauauaccuauauacacacauauauacacacacauacuuauacaucacauguacauguacacaaauaaaaauaaauucugacccauacuagcagagugauuuaauacuuccgagggcaaugauguguuguuguauaugugcuaaauguuauuuccuaauuugagaugucuccugagugaagaagcuauaagucacugaacaucaucucuguugcaucuccaaaaccaacauuuuaauguuacauuuuacuugaugcauacagaagacugaauggaaguuccagccuggucuggaacuucagcuucuaucaaaaggcgguguacuggcuaguuuugugucaacuugacacagcuggaguuaucacagagaaaggagcuucaguugagaaaaugccuccaugagauccaacuguaaggcauuuucuuaauuagugaucaggggggaaaggccccccugugggugggaccaucucugggcugguagucuugguucuauaagagagcaggcugagcaagccaggggaagcaagccaguaaagaacaucccuccauggccucugaaucagcuccugcuuccugaucugcuugaguuccaguccugacuuccuuggugaugaacagcaguauggaaguguaagccgaauaaacccuuuccuccccagcuugcuucuuggucaugauguuuguacaggaauagaaacccugacuaggacaggcggauuccuuugauuccugagucaugcuacuccaggaaggaaaaagagaaauagcucuuuucucacacuucuugccuggaaauggagccuuuaaacuuagguuuagcaaugaaauaaaguuugcauuuuucucaauaacauuugaccaaucguucuuucagauuuuucuuuucuaucuucaaagcuacuaguucguauuaaguuaauuuggucuuuauuucucccucaaguaaaucuuuuuaaguguaauucugaucucaacaucuuucugcugagaaaucugcuaagcuuccuccacagugucuucuaguguaauauaaauauuuuucuuuuaguuucuuuuuuuuuccuuuuuuucuuguauuugcaauccauuaaccuucauggcauuccuguaucacuaucuuaggaguuugaucuauaagaacuuuuaauccacacacacaaucaagggguuugaaaaugaauaaauauugacaugugaguauauguuaaagcccuuauagauagcauaaaggagacuaaauaucugaaaaguuaguuugcuaacugcaaugguaauuuuauagaaaagaauauuucugaaaauugaagguguauacuuucaugacucuggcacuuugaaaauaauauggccugagaauuaaaaagaaagaaagaaagaaagaaagaaagaaagaaagaaaagaaagaaaaaaagguacugaacaguuccagaaugcaagucagcuacauauacucaagcacaaaauggcauguggagcaacagacuacuucugugcagauucuccccuaaccaauuacgucucacguguucuuaggcacauuauaaccuuuucacaagcuucacuguuguuacuuaugaauugugauaaugacuguugaacgggcacaguuuuuuuuaauuagguauuuauuucauuuacauuuccaaugcuaucccaaaaguccccccccacacucccacacccacuccuccacccacacccacucccauuuuuuggcccuggcguuccccuguacugaggcagaugaaguuugcaggaccaaugggccucucuuuucacugauggccgauuaggccaucuucugauacauaugcagcuagagacaugagcucugggggguacuggguaguucauauuguuguuccaccuauaggguugcagaucccuuuagcuccuuggauacuuucucugauccauccaauagcugacugugagcauccacuucuguguuugcuaggccccggcauagucucacaagagacagcuauaucuggguccuuucagcaaaaucuugccaguguaugcaauggugucagcguuuggaagcugauuaugggauggaucccuagauauggcagucucuagaugguccauccuuucgucucagcuccaaacugugucucuguaacuccuuccauggguguuuuguucccaauucuaagaaggggcaaagugcccauacuuuggucuuuguucuucuugaguuucauguguuuagcaaauuguaucuuacaucuuggguauccuaaguuucugggcuaauauccacuuaucagugaguacauauugugugaguucuuuugugauuggguuaccucacucagaaugaugcccuccagguccauccauuugccuaggaaugucauaaauucauucuuuuuaauagcugaguaguacuucauuguguaaauguacuacauuuucuguauucauuccucuguugaggggcaucuggauucuuuccagcuucuggcuauuauaaauaaggcugcuaugaacauaguggaguauguguccuucuuccgguuggaauaucuucuggauauauguccaggggagguauugcaggauccuccaguaguacuauguccaauuuucugaggaaccgcaagacugauuuccagagugguuguacaagcuugcaaucccaccaacaauggaggaguauuccuuuuucuccacauccucaccagcaucuguugucaccugaauuuuugaucuuagccauucugacuggugugagguggaaucucaguguuguuuugauuugcauuucccugacgauuaaggacgcuucaggugcuucgcagccauuugguauuccucgggugagaauucuuuguucagcucugaggcccauuuuuuaaugggguuauuugauuuucuggaguccaccuucuugaguuauauauauauauauauauauauauauauauauacauauauauauauauauacauauauuuauauuuauauuggauauuaggccuuuuugucuuauugacggugucuuuugccuugcagaagcuuugcaauuuuaugaggucccauuugucgauucucaaucuuacagcacaagccauugcuguucuauucaggaauuuuuuuccccuauauccauaucuuugaggauuuucccuauuuucuccucuauaaguuucaaugucucugguuuuaugugaaguuccuuaauucaccuagauuugaccuuaguacaaggagauaggaauggaucaauucccauucuucuacaugauaaccgccaguugugccagcaccauuuguugaaaaugcugucuuuuuuccacuggauggguuuugcucccuugucaaauaucaagugaccauagguguguggguucuucaauucuauuccauuggucuacuugucuguugcuauaccaguaccaugcaguuuuuaucacaauugcucuguaguacagcuuuaggucaggcauggugauuccaccagagguucuuuuauccuugagaagaguuuuugcuauccuagguuuuuugugauuccagaugaauuugcagauugcccuuucuaauucguugaagaauugaguuggaauuuugaugggaauugcauuucaucuguagauugcuuuuggcaagauagccauuuuuacuauauugauccugccaauccaugagcaugggagaucuuuccgucuucugagaucaucuuuaauuucuuucuucagagacuuaucauacagauaaguucuuaucauacagaucuuucacuuccuuaguuagugucaugccaagguauuuuauauuauuugugacuauugagaaggguguuguuucccuaauuucuuucucagccuguuuauccuuuauguagagaaaggccauugacuuguuugaguuaauuuuauauccagcuacuucauugaagcuguuuaucagguuuaggaguucucugguggaauuuuuagggucacuuauauauacuaauauaucauauguaaaaagugauauuuugacuucuuccuuuccaauuuguauccccuugaucuccuuuuguugucuaauugcucuggcuaggacuucgaguacaauguugaauagguaggaagaaagugggcagccuugucuagucccugauuuuagugggauugcuuccagcuucucaccauuuacuuugauguuggcuacugguuugcuguagauugcuuuuaucauguuuagguaugggccuugaauuccugaucuuuccaagauuuuuaucaggaauggguguugcauuuugucaaaugcuuucuccgcaucuaaugagaugaucaugugguuuuugucuuugaguuuguuuauauaauggauuacguugauggauuuccauauauugaaccaucccugcaucccugggaugaaaccuacuuggucaggauuguuuugauguguucuuggauucgguuagcgagaacuuuauugaggauuuuugcaucgauauucauaagggaaauuggucugaaguucucuaucuuuguugggccuuucugugguuuagguaucagaguaauuguggcuucauagaaugaguuggguagaguaccuucugcuucuauuuuguggaauaguuugugaagaacugggauuagaucuucuuugaaggucugauagaacucugcacuaaacccaucugguccugggcuuuuuuugguugggagacuauugaugacugcuucuauuucuuuaggggauauaggacuguuuagaucauuaaccugaucuugauuuaacuuugguaccaagucuagaaacuuguccauuucauccagguucucuaguuuuguugaguauagccuuuuguagaaggaucugaugguauuuuggauuucuucaggaucuguuguuaugucucccuuuucauuucugauuuuguuaauuaggaugcuuucccugugcccucuagugagucuggcuaaggguuuaucuaucuuguugauuuucucaaagaaccagcuccucauuuguuugauucuuugaaaaguucuuguuuccacuugguugauuucgccccugaauuugauuauuuccugccgucuacuucucgugggugaauuuucuuccuuuuguucuagagcuuuuagguguguugucaagcugcuagugugugcugucucuaguuucuuuuuggaggcacucagagcuaugaguuuaccucuuagaaaugcuuucauugugucccauaaguuuggguauguuguggcuucauuuucauuaaacucuaaaaaaaguccuuaauuucuuucuuuauuccuuccuugaccaagguaucauugagaagaguguuguucaguuucuaugugaauguugacuuucuauuauuuauuuuguuauugaagaucagccuuaauccauggugaucugauaggaugcaugggacaauuucaauauuuuuguaucuguugaggcuuguuuugugaccaauuauguggucaauuuuggagaagguaccaugaagugcugagaagaagguauauccuuuuguuuuaggauaaaauguucuguagauaucuguuagaucuauuuguuucauaacuucuguuucacugugucccuguuuaguuucuguuuccaugaucuguccauuggugaaaguggugugcugaagucucccacuauuauugugugaggugcaaugugugcuuugagcuuuacuaaaguuucuuuaaugaguguggcugcccuuauauuuuuagcauagauauucagaauugagaguuccucuuggaagauuuuaccuuugaugaguaugaagugccccuccuugucuuuuuugaugacuuuggguuggaagucaauuuuauuagauauuagaauggcuacuccagcuuguuucuucagaccauuugcuuggaaaauuguuuuccagccuuucauucugagguagugucugucuuuuucccugagauggguuuccuguaagcagcaaaauguuggguccuguuuguguagccaguuuguuagucuacgucuuuuuaauggggaguugaguccauugauauuaagagauauuaaagaaaaguaauuauugcuuucuauuauuuuuguuguuaacauuggcauucuguucuuguggcugucuucuuuuagguuaguugaaggauuacuuucuugcuuuuucuaggaugugguuucuguccuuguauuuucuuuucuuucuguuauuauccuuugaagggcuggauucguggaaagauaaugugugaauuugguucggucguggaauacuuugguuucuccaucuacgguaauugaaaguuuggcuggguauaauagccugggcuggcauuuuuguucucuuagugucuguauaacaucuguccaggcucuucuggcuuucauagucacuggugaaaaaucugguguaauucugauaggcuugccuuuauauguuacuugaccuuuuucccuuacugcuuuuaauagucuaucuuuauuuaguacauuuguuguucugauuauuauguguugggaggaaauuuuuuucuggucgagucuauuugaaauucugcaggcuucuuguauguucaugggcaucucuuucuuuagguuugggaaguuuucuucuauaauuuuguugaagauauuugcuggcccuuugaguugaaaaucuucauucucaucuacuccuauuaucuguagguuuggucuucucauuguguccuggauuuccuggauguuuugagauaggaucuuucugcauuuuguauuuucuuugauuguugugccaauguucucuauggaaucuucugcaccugagauucucucuuccaucucuuguauucuguugcugaugcucuaugguuccagauuucuuuccuaggguuucuaucuccagcguugccucacuuuggguuuucuuuauugugucaacuucccuuuuuaggucuaguaugguuuuguucauucgaaucaucuguuuggauguguuuuccuguuuuucuauaaggacuugcaacucuuuagcaguguuuuccuguauuucuuuaagugaguuauuaaagaccuucuugaugucuucuaccaucaucaugagauaugccuuuaaauccaggucuagguuuucggggguguuggggugcccucgacuggcugaugugggaguacuggguucugaugauggugaguggucuugguuuuuguuaguaagauucuuaggucugccuuucaccaucugguaaacucuggagucaguuguuauaguugucucugguuagagcuuguuccucucaugauucuguuaugcucuaccagcagaucagggagacuagcucuuuccugaguuucaguggucagagcacucucugcaggcaggcucuccucuuucaggaaagguucacagauaucuggcauucaggcuugccuccuggcagaagaugaaggcccgaaacaggaccugucccagaagcuguuagcuucuggaguacacacucucaccuguguagacuagucuugguggaguccaggaaccaagaugucucccgcagaugcucagguaaagcucucccaggccaggcggacaccuauccucuggcagggaaggugcccggaugucuggagcccgaaaagggggcugccucagaagcucuguggcucccgccuguccccgaagcuguuagcuucuguagucuacacucucaccugugcagaguagccucgguggagucugggauccaagaugucucccgcagaugcucaggcaaagcccucucgggccggggccuucuuuuaguuucuuaaauuuuauguuuaugaauguuuuccaugaugaauguacagcauaugcaugucugguacccagacaagucagaagaugguguccagucaucuagaacuggaguuacaggcugagcuacuguguugaugcugagaauugaagcccagagaccauggauuguugaccacugaaccauccaucucucaggcccucuucuagcucuugagauuacugcaaucgcuuucuucucuucuucuuuuuuuuuuuuuuuuuuuucuuuuuuuugucuguagcucccuggcuuuccuggaacucacucuguagaccaggcuggccucgaacuuagaaauccgccugccucugccucacaagugcugggauuaaaggcgugcgccaccacugccuggcucugcucuuauuucuuauugagaacaagguucagcuaacuguaaacucugccaaauuuuuauuguccaggggcuaacaauaauauuuacauuucuggcuaaccuugaacuccaggcuguccaccugccucagcuucuugggugcuuauuauaugcauccugaacuauaugccugaggaggcuagaggaggugucacaucccuggaauugcauggaguuauagaugguugugagucucccuguaggugcuggguauuugaaccugaguccuuugaaagagcaaccagagcucuuaauggcugagucaucucuccagcccucugaagccuuuuuuuuuuuuaaacaacaaaguaauggacuguuuauucucucaauucuuucuaauucaguccucacuuugcccucugggaauagucauuugagauaguaggguuggaguauccuaaugguucaguuaucucugacaaauguucaauauuuagauugcgguauugauauuuuguacuguaagcaaagaaaacaagcuuaauauuccuacaagucuuucucuuggcuaguccagugcuauguuaauguuacaugaggagcaaggauaagauguacaucugcagaaggcacaaacucaggcagcaccgcuggggauggcuguggcuuucuucugucaguacaucuuggcuaguuugguccugagguacagcacuguucuccuauuucacauuucagcauguuugcaacugagucugugcucugccuauauuguuucacacuggauuguguuugcauuuguugaaaaaauaaaacuaucuagaagagaucucaguggguaaaaguacuuguuguacgagccugaugaucugaguucgauccccagaacccacauuaaggugggaggagagaagcaagucuauucuguaagcuucuucugaccccccuuccccuagcuaaacagaacaacacagaagaagaagaaaaagccuuaaagauacaacuuugggcauuuauuuaguguagauaauccugagagucucuuuuuugggggggcauuuuaauuggcagcuugucauuugauuccuguauuuuacagaaaagaauuuugagcucuggcugcuuaugagaaauugaggcuugaguacugcuuguccacuaacaaagaaauagugaaauguugcuuuggcccugauuuaaugggucagaguguuuauuguggccuggagccaaauucaauuauuguauuguaaaaggacucugaauaaucuccaauuagcaaguggaaugacucuuagcauuaauaaaaacauuuaaagacuugccacuggguuacuauuucagauuuuggcaccaguuauuaauuaaaaagaaaaaggccuauauuguagguuagucuugguucaacuuuaaaagcuaguugaagccagguuaucuguguguguacacuuuugugcgcgcacgcacacacguauuccuguguuguacaccugaucuguagguggaagccagaggcugauguuggauauuuuccuuaguaguugacaccuuaauuuuugguguaggaucuuuuugcuaaauuuggagcucucugacuggcuagaugguuggccagaguaccugugggauaccuucugucucuguaagacacacgcugcugcuaccagcuuuuauguagaugccaggggcucuuagccucuacucaguugauaguuccuaagugaauaacaguuaagauuaaggacacggagcccaaaugaaccugacugaccuagccuaugggaagaaaccaggacaguugucuaucaguuagacugcauccugguccuacauccuauugacucauugucaaccucaaguuuuccuguucuugccaugccauacauuuuuauaagauuauaggaucaugaaagauaacuucaggaagcaucagacaucauugaaacccacuuugucauguaaagaggcacuaauagcagcuucuauucugcugggauuaguuaggauuagagcauggaucuguguagaugaacgucacaaucugagggacuuuuuaggcaaaucaauuaacuccuugaaaaaugagaaaauauguuguauccaccuucuguagcuguuauaaagauuuaaaauaauaaguccugacaugaagcaugugcuauauuaaauuuuuauucauucauuaauuuauuuucaagauuuucaagacagaguuucucuguguaguucuggcuguucuugaacucgauuuguagaccaugcuggccuugaauucagggaucuaccugccucuuccucccaagugcugggauuaaaggaauguaccacacugccuggaaaaauuuauuuauuuauauuuuugugcaugccuuguaacccuaggaguaaagaaguugaggcagaaaaauagccacaaauguguuggccaacauagccaguucuaggucagccagggcuacauugcaagacccugucucaaauccucccccucccaaauacaagcaaauaaaaauaaaggcaaaauacaaccacccacccccaccgccccccugaaaauguuuuggugguaguuacacuguuuggcuacaguguuuuuuaaauucugcauauuugugaacuuaaaacuguuaaggaaaaaauguguuuguaauucuagcuaauaaaacagaaaaaaaccccacacguguaaguuuuuguggaagacuuuagaaaaaguggguuugauuagaaggcagcagugagaaaggcggagcuuggauuuuggugguggaguuucugggggccgguuuaaggcauuaggcaugaaugguacauucucacggauuacuucccuuuccuugaucaggcuuaugacacgacagaugguaaugucaacugaacuucuuccaguauuuagcuuuucuacucuaauuucauauucauauuguauuuuaguggcauaggggauccuagcuggucaucuuaauacaguuauagaauguuagaguuucuagaucuauugaagaagaaaugaaaauaaaagaaagguuuucuuaguuguacacaaauuaggaggaguagaggaauuagagaguaagugugggcagauaagauguuaguagaauuaaauaccaacaggcccggcuccucacuuuaauuuuuuuccuguuucagugagcaguucuuuucugaguucuuacucugugccagucacugugucauggcugugagggaaaaaccauucuuagaccugaagucacaauuucccuaaggaauuugcacuaugcuugaaacacuuauuaaaaauagcaucaggucauccaaagaucuuuccuuccucaucaguauuuaugaguaugcaauaauuacuuaauuguaaucauuggggaaugcuacugaguucuccucuaaguagucuuuuuaauaccagaaaccaaagcaaaccaaaaaauccuuuuuuguuuuccuauaguuagugcuugauuuaauauuagagguaggacuaagcuugggacuugggggaucuagaauucaccuaguagguacauguguuuguaguauuuggugggccuuuaaguuucuuaagagaaauaacuuuugcaaaucucauuguucuccuccacuucccucccuuucucucucucucucucucucucucucucccucucucucucucccucuucuccuuuccccucuuuuucuuucuccugggaauugaaugcauggccuggcacgugcuaggcagguacuccaccaccaagcuacaucuccagaccuagagcuucauucuugaaaugagauaucuggaauaaaacugcuauauucuuucucaccccacaauacccaauucaugaaguggaagaggccuaguuugaguuucuuugagggaauugguaggaaaguggguggugaggaauaucuaagcauguauuguggucuguuuuccuguuaacuugguggcucucuagaagacagcuguaagugguuguaaagccuauggaagaauuuugaguugagagaggaugaaguauuugcacguggaaggaagucuuugcacguuggaagccuaaucacagugccuucuuaaauagggucuagugaaccaagcugcucugcuaacauuuauccagccuuaaugaaugcaugcaaucucaguuguuggguagcauaaacagcugcugccaaggcagcuuaacuugaguuccaggaaacuaugguguuggaugagcuuguugauguuacaaguugccauuaacaugguucaccugccauuuggcucacaugauuguguucuuauuugugcacauauauauuaguuuauugaaauuuguuacaaguugaaacuuucaguacuaacaguuucuuacauucuauaaauuguuaugugccaaaggauauuguugauaaaguauggguuuuccuuuccuuucuuuuucuucuaagucaaaguauuacuaugugugucauguuggcuucaaacucuguaaccuugagcuugcuuuguauuccagguuggccuuagaccuacaguccuuuugucuuaaccuccuuuguacugagauuauaggcaugugccaucaugcuuggccagcacuuuggaauuuccuaauuaugaaggcaaugcauauucaucugcccuucuuccuaucuggaagguaccaaaaauaauuaauaagaaaauaaaucaucugaaauuauauuuuccaugaugugucuuucucuauccaguuuucuuuuuuuuuucuguuuagauaaauaauugggggacaauagaccguuucaucauuagggaaauaggcguuuugaguaaaguccaugcuauuagggagcuagucuaauucacuguacugaucaaaauuaaaucuuguuugguagcauuaggaaacacaacugcugccugcugcagccuagugguuagugagugaaucaggacagcuacaggacucuaaggagauaugaggacugggguauuuaaaacaguguagucccuaacaaguuauuacaaucuccaguuuauugucauguggaacuaggacuuaaugauaaucagauuuccccaauuuucaaggaagcccgcaggucugaauuacuuguuaauaugaaaaauuucccauuguuuagaggcuauuucagcccauaguauuacauacaggacuuuucauggcgugacuucuuuaugguucuguaauuuccuaaccuuuucacauuucuucucugcucaguaccccauguuucuucccuguagaucugugcuuucuaaacuggcuaugcucucauguaugauacccagugauuagaaagcccucuuuuccguuucuccuggagaaucgucaguuggccugaacgccuuuuucucucuaguguuuuauaagucauggaaacguggauguaacccuggucgagcacacaagauuugcuuaagcauuugucuugucuaagaagguuaugggguagauucacuuaacuuguaucccauggugauguacacagugcuuaccauauaggaagugcuuagugcaugcuugauucaaugaaugacuaaauuggaaagcagaguggauuccuguccuaguuuuucuggauguaugacuuuuaaacacccgaugggcuguccaguuaggagugauugucaaagguuuucagugaagagguugggugaaaugcaaaucuaucuucauuauagaagacagugcugauggcaggucacaaacauuauuaucagauggccugaaccuggcauuggguacguuuauaugucacaaugacuuuucuguauaauggguugcucaggcuaacagugucauuaaagacugauuugagcuagaguacuauuucaugcccgagucugaucuugauugguugcucauaaaugauugcccuuguggacuguggcaguguaaaggcuuagaguaagauccuauugucuagcugaguaugauggcacacacccuuaaucccaccacuccaaagguagagggcagggggaucucugugauaucaagaucaugguggucgcaaggcuacgcaaaucuauuuagugaggucuagaccagccagaacuacauagugagagcuuguauguaaaagaaaggaaggaaggaagaaaagaaaaagaaagaaaaccuaauguuuaaacauggucuuacuuuacagccuggccuggauucuuccuucacaguccugcucauuuaagacuaugaggguaacagcacgcagcgccaugucugccacccugccaccuuuuguaaagcccuguagucaccacuuauacuacacaaacugcugauacaaauccucucugcuguguuuuguccuaaccauuuucuuacccuuagugaagcuaagggagacaucuauuaacauaguuuucagucuagguaggaaccuggcuagcaccuccccacucuccuuuuccccuggaagaaagcaaucauucuacauuuuagaacuugaguaggucgugaugaaaagauuaauaauaacaauaguggaagacaaaagccuucuuauauagaauuuuugauuugaaagucacauauugaacaaaggauauuuaaauuaacuacagagcaaaguaagagccuucagaagaaacaaggcuuccuuccaaguccccugaagcugcucccaggccuguuucucauucacuaccacuauuucaguguaugugaccaaggauguguucuuucuuuuucuuuuccuaccaccuaggcgacacauaguuggcagggagcacuugauuuuggauugaauauaaaucaggucuuaagagcacuggcuagcagugaaugaaucuggguacuacagagcaauagaauugacauuuugcaguuauaacugauuuaaaacagugaccagacaacuugcucagaaccucauguaauuaagaaccauuuguuaauauuucuuugcuuuuaaauuuuaaaaauuauuuuuaaucauguguauguaucuguguguggauaaaugcacacaagggcaggugugcacagagaccagaggugucagagaccuggagcuggagauacaagugguugugagcaacuggaugcggcuaaugagagcugaacuuaggaucucugaaagaacaacaaacuuauacuuaacugcugugcuaucuuucaagaucccaaauuuguuuuucaguagaaaauuucuguuuauuugcuuucauuuauaagaauuacaguaguauugcuguaauuuauugaaaaauauuugguucauuacauugcaguccaaaaauaauucauucacuuuaauucuuucuuuguuauuaauaaguuauuagaguccaucaaaaguuuaccaacuuauugcuacauuuuaucccuuuaauuaaaaguccuauuauuauuauuauuauuauuauuauuauuauuauuauuauuauuauguguguuugugugugugagcuagaggccagaagagggaauuggagccucuggagcuggagucauuaguggcucugaaauuguugacaaagauacuggaauguggacuuggguccuuuggaugaggagacagugcucuuaaucacugagcuaucaccucauccccuaaggcacuuaggucacagcguuggaaagaguaauuaaaaggaaaaguaucugaggucacagcuguuuauugacuaaucuggaacaauaaaugagguaccagacucuauccuguaucagccuuuggcuuaacaggccagguguuuugugauguggugcugcacaggugugagacacauuacugaccuauugggaauaauaaaccuaacacugaacuucuaacccugaacauuaaucuucuaaaacuacuugucuccugacccuaauaacucauucuucuguuacucaucaacuuuguuuguuuuuuuuuuuuuuuuuuugccuuuaccaaaugacuucuucacaaaagaaauagcuagaccuggaacuuguagguggugaagcaaaggaucagccagaaaaauuagcacaggaagggcuuaguaugauggguuugaauacaugguuugcugaaucggaagcacaggcuggaggggcuucagcuaaggaaaugguuuagaaaggacaguuaggcuaucuugaccugcaggucuguugaagagcugucaucucuguugaacuucuggacaguuccauguuauugcauaaguuucuagcauccagggcauucagagaagccaguuucuaaggguauaauggaccagaaugauaucaucuacugguuuguaaacaacugauaaaaaguccagacaaaccaaagacaaaacuuuggguuuugaagccaccaagcaagagaugacaaguaauguuuucuccagccuucccauguccauguagagaguuuuuauaguacucauguuuuauaaauguaaauucaggggcuggagagauggcucagugguuaagagcacugacugcucuuucgaaggucuugaguucaaaucccagcaaccacaugguggcucacaaccauccguaaugagaucugacgcccucuucuggugcaucugaaaacagcuacaguguacuuagauauaauaauaaauaaaucuuuaaaagaauuaaaaaaaaaaagaaaauacaacaaaacaaacaaggagacuaguucccuagauacuguguuaacugaugggaaccugcaaugguuauagguagaauagguuuaugcuuuugacccagcaucucacuggguuauucaggguggccuagaacuugcaaucuuccuucucuggucuucugaguagcauggucacuggguccagaucuuuaggaugagaguuuccuccuuggcuuagaagucuuggcucuaguauuauuucuuuagaacaaacgguuuugucugcuuuuauguuuauuuuaaaauuucacuuuaugugugugaguguuucccuguguguguacaucaguguaccgcgccucugccuucugaguguugcaccacuccuggguuaugcagugcugaggaucaaaccugggacuucccacaugcuuggccagcgcucuaccuuccugcaugcuaggcagcagucuagcaacugagccucaaccucagcucuauuuauuugugacuuucugugcaaccuuacuagaauguaauuuccauaucggcaggaaacuuacuaucugcuucaucuuuacuaccuagagcccugucugacauucuuucucacuuccuuucuucuuccuccucuguuuccuguuucuccaucuccugcucccuauguauacuuuaaaagggcucuccauguuucuuaacugugauuguucuuuuaaguccauucuuaguaugaacuggugacuucacgccugaacuucguccuuuacuucaugaaaucaugacccacagcuuuuugaaugguugguuucagccugcaaacauagugaacaauacaucuggaaauauucugucauauuuuaucugagaaacucuuaaagcagcugcugauuugaaaggcuuuuauuaugcuacagucagucuauugucugugggagugcuggcucuuacacagcacuguguguugcucuuucugagcuauuaacuugauagaaaaaaaaacucgucuucaguaauuuauguguggcuuguauucucuaagaauaguauauuguagccuuuucuuuagcugauuuauugugcauuuagggauuuucuuacucacuuuuuuucuuuaagccuaaaucacaaguuaaauggccaaguaggauuaagauguucccuaacccgggcuuaagaaauuuuacauuucugcacugugaaguaguuuaaccucaugacugagcauaccuaaggagauugaugcugauagagugggugaguuucacugcuuacaguguugccucucgaagugguuucucaagcuuuugguaaugucagauguauaguucaccuccuuggcagauuagauagugaggauacaaggggauaauauuggacaucuaaccuuugcacaggaaugauuuuugaaaagaauaaggaagauuauaauuugugguauaauacuuagacaaguacuuauacagucuaguuaguaugacuuaauauuuuuuccauuuacuuauuuauucacuuuacaucuugaucacagcuacccucuccucccagagccccucucacacagccccuuacaucaucccugcuucccucuucugagaagagggaaguccccuuggguaccaauccacccuggcacauucaaaucacugcagcauuggggacaucucccacugaagccagacuaggcaacccaguuaggagaacaggauccacagguaggcaacagaguuagggauaugugcacccccccccucccgccuagccaucccaguugagggaccaacaugaauaccaagcugcacaucugcuauguguauguguguggagggagggggaggguggguaacuggguccagcuuaugaaugcucuuugguugguuguucagugacuuaauauuuugacaauuuuuguggugcugaggaugauaaguuuuauuugcuaauucaaaucuuauuauuaguuacuaguugugauauguguguaugcauacacauauguagguacaugugccuacagguacaugagcauuugcauguggaggccagaggucauggcaggcgguguucucaagaagcugucuuaucuuauuuuuugauacacggucucauuggaauuggaaguuugccaguuagucuagacuagcagccugucucccuauucccagcaaaacgauuauaagcaugugcuaccacaccuggcuuuuucacacgaguucuagaacuuagggucugguucucguguguuccaggcaaguaccaacuaagcuagcuccccagucauaauuuuguuuuuaaugcaucauguauuuuuuguuuuuuagauaaaguuucacucuguagcucaggcuuuccucgagcucaguguauaacccaggguaacuucaaacccauggugauuuucucucagccuccuaggugccaaaacaacaugugugaaccagccuggcagggcgggcggugguggcgcucgccuuuaaucccagcacuugggaggcagaggcaggcagcuuucugaguuugagguuagccuggucuacaaagugagcuccaggacagccagggcuacacagagaaacccugucucaaaaaaaacaaaacaaaaaacaacaacaacaaaaauaauaugugugaaccagcacacauggcuuaguguuaacaaucuaaagauuauauuuuauaaauuauuuuuaauuuauuuuuggaggggagcugggaauugaucccaagacauguauguaccaggccaguguaacagugagcuguuguuccagaccgguuuugugauuuuaaacuggccuggaguucacucuguacccagguuuuauacacuugucacccugcugcugagguuguagguaugagcuaccacauguagcugucguucuucaacgggaaauguaaggucagaaguaguuucccacagcauugagucuuuauaaccauauugaccuucccuugaauuaagaugugcuuuaauuugcuuaacuguuucuguuggugaauuauuuuaaaaguacuuugguuguuaugauuaacaugguagugaacacuuuugugauauuguaacuauuacuuuuggugauauugcuucuaagaucuggaaaagaauguuauuuucacacacacacauauguguguguguauauauauaucuaucuauaucuauaucuauaucuaucuaucuauauauacucacacauauauaugcauauaucauacuaagguuucauguuuuaauguuugauuucuaguaucagagucagaauuucauuagauuuuuucccaucuuucuccuacucucauccccacacauauauuugugugcaugauauuuuauauauucauuuuacuguuuaaguuguugagagauguuuuucaguguagcauaugcauguguauuuuuaacagguuucucuauuuucucacuuuucucagugaugccuccgaguuucuuuaaagaaugguaacagcacuguuuugacuucauguuguucucuaauuauuuugugaaaacaugauaugggaaugauccuuuuuuuuuuuuuuuuuccuuuugagacaaguucuccugccucugcuggcuuugaccucacuauguaaauguauguaaaugaccucacuauguaaauguauguaaaugaccucacuauguaaauguauguaaaugaccucacuauguaaauguauguaaaugaagauggugcugagcugcucauccuccugcuuccuucuccgaaguauugcuuacagcugggugccacuaugccugguuugagugaucuuaauaauugaaaaaucccucacuuuugaaacuagauuguggagguauuuuguuuguuguucuuuugauagguacuaaaugcuggccucaaacugguaacaauguugacucagccucuagagugaucagauuguggguaugugcuaccaugccuguguuucagacaugcguaagugaagguaacagucugagaauugauguuugacucaugccuuccucuuguagguuggaaaagagacuguucagaccacugaggaucagauucugaagagagauaugccaccagccuuuauuaagugaguaacuaacaauuuguuacuaaauagaauaguauucuugauagaaagaaaaaguaauuaaucccaagaguuacuuccccucucucucucucucucucucucucucucucucucucucucucucucucccucccucccucccucccucccucccucccucuguguguguguguguguucauguguauguggaggucaaaaauaaaauaaauccuauaacaaacaacaccccgcaccgcccugccccgcccccuguagauuacccuuggugguaacuaggguagcaauccuuuagcaacuggaaauaaaaaaaauaaacuuuucuccugcuauucuuguauaaaguuuauuucagaguuacuuuguagcccuauuugaugaggagaaugugaacuguaaauauggaagaaaugauagaaggucaucauuguauauauuucagugaacaugggaaaaccaguguguuaggaugaacugaaaauuacugagccguuuauuuaaaaaguguaucacuuaauuagcuccaccaaaaucuuacuguagcuuaaagcccaaacaagauguaugugguugucugcucuggaggcaaguaaauucucuacauuugaaacacaaugguuaugcuuuucuugcuuuucuuuagguuguaaggaagcagaaaauagaugucuuggcugugcgggaaagggacagagggaaacaaauggaagcaguuaauuccaucccuggaauuguggaguaggacauucuuuggggcuauuugguggauguuuggauguuuccagggcauuacugaccuuugcugccucugaagucuguguuacauggaucucaguagugacugcucuuuaggcagcacaaggaaggaaauaaguuuuaggaacuuacucuuagguuuccuuucuagacugugaggaugcuaagacuacaggaagcagaaggcucuugggcauggcuagguucauauucagaucauccuguauauauuuaaaaggguuucagggaaggauaugccauuucaggguuugagguagucucaaaaucaaauuauagguuuacuuguaaacaauucagggaauauugaaaaguggguuuaauauuaauuaaaagugacacacagguugaacauucuaguaaaacaaacaaacaaacaaacccugauccccccggcccccaaacccuuaaaaucagaauuauuucugaucucaagcauuuuaguuuugauauggacuauucaaacugaguuuauguuguaauugccauggaaggacuugcagugcucaggauguuccuucuucucaaagaccuguuaaaggcuggguacagugacagacaucuuuaaccucaacacucaggaggcaaagacaggcagacaggcagauuuuugugaguuccgggccggucuggccuacaaauugaguuccuaaacagccaggguuacauaguaagacuccuguuuugaaaaagaaaaaacauaaacaaaaccaaaaacaaacaaacaaaaccagagcaaaccaaaacaaugacauuuuaauacagaaaaaaauuugcaggacccagcaaggcuuucuuuguguggguggaacaaguuauuuggucucugacugcacuggaaaaugaguucacaguucacuaaguuuacccaagauuugaaucauagccacacugcuuaauaguugccauagaaacuguuuugauccucauaaacuuuaggagagcaguagccaugaugggcuauugaaauguuagacuugccuccugagaagugguuuuguccuuuagaaacugucagcaggcauugcggcucuuucaucccauguuuauauuuuuaauuuucaucaaucaucaucagucagcugagcacuaauuaauauuuauauauaauugauugauuaauagccuagacauacucauuggcuaauuauuuauugcacucuauuugucuagcaugcucauugcuacauagaauagcaguucauagcaguauacagugaaaaauccccugugaaagguauuauaaguaguuuauuaauaguaauaaacuacaauauuuacugauacuuuaaagaaauugaaggaugacaagauggcuuagcagguuagaggauggcugcucuucuaaaggaacuggauuugguucccaguacucacgcuguagcacacagccaccuauaccuccacugcagggcguuagaaccucuucuggcucccacaggcaccaggcagcguaugcauauacuacacagacaugccgaccaaacacccacauauauaagauuaagagaaaaaauuaaaauaaguccauugaaacuggccaagaggucggaguagguguuguuggaaagaaaagaaaaugaagacuauucaaucacacgucccucaucucugcuuucuguuguuuucuuacacuuucacugaaguguaguagacugcuuugcuuuuuacuauguuuuuuguuguuguuguuguucuuauuggaaaaggaaugaguggaguuacagcucuuaugucugggaauugcacguaguucuagucacacacaugggggcaugcuggggcgugucauauauaugaacugucuuuuguuuuucuuuuucaaagaaaaaaagaaaaagucucacacuuagcucaucuggcaucaaauucaagauccuucugccugagcucccugagcuagauggauuacagguuucuuuuucuauguaucaaagagaaacaaaagguggagauauucugagaacuuucaaaauucaggauacaauggacuuuaauagaacugucagaguaggcgugacuaguagaaggagguggugucauguucagugugugacuugggagaacagagaaggcaagcuaguguggaugcaguaagacguggauguaagucauggagguguacgaggaaagggcuggugauggcagagguggcaggaacugagccucgugcaguaggcugggcccagggaugaaaguccuugaaagccuggcuggggaauuuccagcuggcaggaaagaagcuuuguaguuuuagagccacaggaugacagcacgaacgugguuuuuuagcaagguucauaaccagauucacaguggauaguagguggcagugcuaaaaugaagaauaaguuguguguccaacuggcuagcuucauuuucugucaguauggacuuugauuccuuugauccacauugauuccuugcaggugagacauguuucugaugaauuguuugaauuuuucuuggcaaaaaauuaccuuuguaguauauaguagaaucuuauucuuuaaacagauuuuuuuuuuuuuuuugagacagaguuucacuguguagcccuggcuauccugaacuacuuauauagaccucacacagagguucaccugccucauucuuauuucuuggccccaucuaaggcugcucagugcccggcaguguucucaggcaaucacuugcgguccugugcaugaagucccuguaaggagcagagugcgcacguucugcugcaggcuggcaaaugcucuugcacagggacuggaacguguuaccuucugccucgcugcugcucucaacagcuugcugggaacugucaaagcucugguugauuugccagcuuggauuguuucugaagcauauugggcucucuaggccugcagaauaaaacaauguucugagagugcugugugaaagagagcucggugcgccauccauucgcuguguuuccccgggaagcaccuugcccucauccuuauugaacacucuuaguucagcaucauuuuggcacauaccuguacaauuuuaacacaguuuauauuuauguauaacaaauacauuuuaaagguauuaaaacauaacuagaucuaauuuaggucuuuuuuggccuaagguaaauaguguuuuguuuuauauuauuaguacuuauaaauagcuuuuguuuucuuuugaucuuaagcacgcaaacaauugucuugggauuuguauuuuuaaacccacugguugguuaaagugcauaggauuuuugauuuuuagaauuuuuugaaaaaucauaucauucaaugccauuuguuugccuggggcuaauguaugcuucugauguuuuagggugguuuguuuuauucuuucauuguuguuguuuugucugguuuuuaacuugagauuuuugugauccuuuccauugcuauuuuaagaagacuuuugucucuucaacugaauggccaaauuucaugagauaaugcugccugacugcauuuuugacacagagcaagcacucuugauuuuaaauagcuccccuuuggacuugcuguaccaaacauggcugcauacugccauuuuggauuuacuuccuuaaaaauaacuugaccccacccagggaucuauccaauaaucagccaccaaacccagacacuauugcauaugccagcaagauuuugcugaagggacccuguuauagcugucuuguaugaggcuaugcaagugccuggcaaauacagaaguggaugcucacagucaucuauaagauggaacacaggguucccaauggagaagcuagagaaagcacccaaggagcugaaggggucugcagccauauagguggaacaaccauaugaacuaaccaguacccucagagcucgugucucuagcugcauauauagcagaagauggccuugucagccaucacugggaagagaggcuccuugguauugcaaacuuuauaugccccaguacagggggaugccagggccaagaagugugaguggguggguaggggagcagggcgggggggaggguauagggaacuuucaggauagcauuugaaauguguauaaagaaaauaucuaauuaaaaauaacuugaaucuucucaguaauaagcagacucaguuuauuaauuugcagacaaggucuaaauagguugauggauuaaaucuuguuuacuuuauguacccuucaauuagaaaugagcaaauaaaacauuaggcuugugucacuuguguuccauugucuacagaguaaucacaagguugaaaagagcucagagggcccagggagaucacauauacauuacuagcauguauauacauaauauuaccauguuugcuggcuagucuuaugucaacuugacacaaaaacuaguuaccuaaaaggagggacauuaacugagaaagugccuccauaagaucuggcuguaaggcauuuucuuaguuaguaauugaugggggagguucuagucuauuguggguaguaccucccuggucuggugauacuggguucuauaagaaagcaggcugagcaagucaugagagcaagccaaaaaggaggcaccccuccaugucuucuucaucaacucuugccuguuccuguccugauuuccuucaguaaugagaaacaauguggacuugugagccaaauaaauccuuuccuccaaaacuuacuacuggucaugguuuuugucgcagcaauaaaacccugacuaagacaccauguaauucugagaaugccaauguaaagauucugcucauuuaaaauaagcucucacauuugaggcagagucucaugcggccuaaguuaacuuugagcugcauauauagccaaagcuggccuaaaauccugaucccaagauugcagguguacaccaucaguaauaaacucauuauauagauaaaaagaccaauccuugacaaaccaacucacccaagaucacccuguuacuuucuuauugcagauuucaugguuucugaagguauguucauuuuauagucagguucuccagaaagaagugugacucucggacaguaaugacuuguuuugcuuugagagacaguuucacuauguagaccaagcugacuucuuuaaauuuaaauucaccugucucuggcuccugagaugagggauuaaaguuguguacuauuuuuagaagauaacaguuuauucuuuuccuaaguguuucaaaaaggagaaaaguacagauguaaucugugauauauuucacugucuuaauaauucuuguuuauuuguuauguuucuauguaugugguuuauggucuaugugagggugcaggcaugugcuugcccuaauguggcugugaggucggaggauaacuuccaggacuugguuuucucugcuauugaggcuggguuaccuuuuguuucuguccuguugcuguucuugugagcuuuggugauucuucugauagauguaagcugcaccucaucuagcucuuguggguuccaaggauauuaacucaggcugccagacuugcacagcaaguccuguacuacacuaagccauccccuuggcuccuuugucuuaaaaugugccaacuguaaagaaugaaaguacuaagcuuuuacagauucagggaucacacauacuauugacuaagugacucaucccauagguauauagagacuguugacugccacagguuuuuccuggacaaacaggccugggaagaugacucacugcagaaaguaccugcuguguaagcaugagggugugaguuuggaucccuagcaccugcagaaaagguuggguauaucacuauacccagugauauguaccuguaaccccaacauugggggccaggggguaggguggagucuggagaguccuggugguuuacccacuggguagccagucuaguugaauuugauugaggaagacacucaaugaguuaagacuuuacuaugugcacaugaauacacacacacacacacacacacacacacacacacacacacucucucucucucucucucucauccccccauacaaacauacacuuacacaugcgcuuacucacucucgcacacacacaugcacacacauacgaauaaguuaaacaggacgaaaggcagauagaaacacuauuccuuuauuacccugacuuuuccaauauaguucaaaucucaaaugaauaaaugcauuauuaaaguguaaagauuauauguugcuuuuccuuaaauuguuucagauuuuuauuguucuucccagaguagagccaaggaacccaugaaacagcucuauuucuuaaauuccauguguggacugcuuguuauuuaauccacuucauuuuguucacgaggcagcagaggcucagaagcucaguaacuuguugaaaguaacugagcccagggauggcagaagauccuaacccaagacugucugacugcaaggccugugcuaagucacacucucccucuccuuugugagaaugcuggcugauaguaggcuaguuucuucaaggcauccaugaaugauaauagagguaaaacuaucuagaggggaggagguuugcugaugguccacuccugccacagacucucucucucuuuuuuuuuaaaauuacuuucuuaaauaaacucagcuacuuuaaaaacauuaugauagucguuucuuuccuccagucuauauuucugcucaugguaagauuuuauuuauauuuauauuuauuuauauuucugcucaugguaagacuuacuuguugugcuggagaucagacccagggucuuaagguuuuagacaguuaucuucagcugaauuauacacacacacacacacacacacacacacacacacacacacaaauagcuuguauuuguuuaauguuuuuuuucaguauccauugagacaaucacacaguuuuuuccuuuauuguauuaugguaaccaguaguccacuacaugaauguacauuuucugauaaugaaccaugcuugcauuuuuuuuugguggauaaauuguauuugguuaugauuuuaaaaagcauuaacagggaguugggacacacuuaggggguugaaagcuggacgauugcuaguuugaggccauccugagcuacaaaggcugcgugggcugcauagcaagaucuucuugcccaaccaaacagcagugcugaguuggguuaggauggugugccccaccccauuuuuaagacugaaucucaccguaugguccugacugaccucagauucccucuccccuuccuccugcuacaguugucugagugcugggguuacagcuguaagccgucauaccagauuuaauuaucugacauuuaauguuuuuguuauauguauuucauuguguguguauguuuauggaggucagaaguuagauagacccugcaagaaucauuucuucccuuuccaccaaguggguucuaagauugguggcaagcaccuaucaauugagccaucucugucccuaaguagcuaaaauauuaaaagguuuuugcuucuuuguucaugaagaaccuuguugaauaauuuucuuguucuguucuugaacaaguuuauaucaagguuauuuaauuuucauaaaauagguucuuuuccuggucuuuaaaaugguuaccuaagguaaagauuauuuacuguugaaaguuugacaaaaugucuaaagcucucuguguccacuggcugcagcagucuugauuacucaugguuacuuauuacuauuaccuuuucuuuuugugguaccaggguccaacucauagcuguucuuacugcuuguguguaggaacuguugguuuaugauugaaauauguuaaaauuuucuaugcuaauuuucuacuuaguuuuagguauaagcuuuauauauuucuaaaugauacuguuaagcugguuuuaaaguuugugguucuccuagauucuaaauucuguuggugaugugcucuuuaguaccuguuuuuuaguuaaugcuaugaugucagccauguagcuccagacuuuguucuuuuuuuaaaguccacaugacaguuaaugguagcugcuuuauuuuuuuaaagggaaaguauucccucacuguauuugccccauuuuacuuuguguuuaggcaauuuaagcuucuacaucauugauuacauuaugauguagaauagugacuaucaacuuuuuuccacaggaccuucaaguaauaauaacagugagacuuuaacuauuagucaauuaaaagaauauauuagaacaagaagguaaaaaggguuuaauaauguuuaaaaauaauuuuuacauuacauaguaucagcauacauuugaaaacucugggugcuuauaaaauacauuugcuuguauguucauucugucucuacgcuaacccugacuugagagagaaaaggacaguagaguccaugacuuaugggucauggaguuuuucauggaaccuugcaaaguuuagaaucccuuuucugugcacuggugccagauuugaaaagggguggaggaaggagagagauggagugggagagagaacuugacaugcuaaggauucaaagguaugacucacaggauuucaaguuugcuguuuaucaacacuuggacacacagccuggauggcugggauguuuauaauagucccauucccagaauacugcuuccucuuguguuaucucuugggggaagccaaaacugucugcaggguuagcugaucucaucggaaauaaaggaaauuagggaacagcucucucucucucucucucucucucucucuguguguguguguguguguaggggggugauuuagcuuuguuuguacauacucuauuuagagaaggguucauuuacuauugcuuuuaaaaaacaguuuugauaauuuuuaauaugcuuacuacucuuccagaggacccacauucaguucucagcaccauugucaggggcugucugaaucuaaaggcuuugacacuugcucuggucuccacaaguuguguauauguguggcauucacuuccauagauguagauacauacucauaaaugaacuaaaacaaaacaaaacaaaaccaaacccaccuuaucccuuagcuuuauuguggucagaguuuucauuuugaguguauacgugcaguuagagguuaggaguauguauugcucuaguugguuuccaguaccaugucaggcaguucacaaccaccugcagcuccaguuccaguggauuugacuccguccccccacccccauacacacguaacuaaaauaaaccuuagagugagaaagcugcuuuguauuguguuguacuugggaaauugguacagggaaagggggaguuuauggauuucacggaugagaacaauaaaaacacaggggguuggaauguguuuuuaccauuaucaugcagcauaagauaggguggguuggggcugugcacuugcuacuugaacuagauaguaugucucuuuuuguacucuguguucccuacuccuuucuaaaaacugcuacugugccuguggccuucacucagguuucuagaugacuaauggcugaggauccuugaccuuucaaaauggcaaccccaggaugcaaugcauauuagcuguuguugagaugcuacacaagagugagucuuaauuucuguuguuuuaaaauaaaguuggacaucaagccugugccacacaucuguaaccccaggccucuggaggcucaggaagaagaacguucaagagagagcuacuugaaaaggaucucaaagagacacuggagacuggccuuugugacuugugcugagugguagcgugagugauagauaacaugaaugucugauacccagcaugcauuaggaaaaaaaagugaagcucaaaacagcuugauuagagauaauuaaagucucugaggacuaaggaacuuagacccuucuuuuaucauauuuuacacggggcgguauucugugcgaaggagggauuuagucacgagugaguguguuaagaauuccacaaaacuaucaucggucuguuugaucuaacccacaagcacugguugaagacuuaaaggcagagaagccucagcuugcacuaguugauugcuuuaaguucucuaaaugaauauuauuagggcauagucagguuaugagauuguuuaggaaagugaucuuauuccaagucauucccuacaauuuagguuucuauuucaaaguggaagaucacuuuaagaggcaggcaggcaggcagacagaaugcuuaaauaaaaguaacauugccaccgacaugauucacuccuccuguuucugauugcugguuaaucauagugggauuuguuugucuuuuaugaaugcgauuaaauuuuaauguacugaccagauaaucuuauuguaguaaaaaauggcacagugucuauucugccuaucauuuuaucacacaagagaaccauuaguguggaaucaauuugauucuuggcaagccuuuuccauuuuauuuucccauccugccagguuuucucuccauaaguuauuccuggcauuuaaaauucuuuuuucaaguuugaagauuguauacaguaacuggauuuuugugaguagaucuagcucaggaauugcauucugugaugcauguuuauuuucuauauuuucauccaggaucaaguuccuuugaaguaaaaccaaguuugggacuauuuaacaauuuucugcuagacauggugauacaugccugcaaucccuuugcaggggagauggaaauaagugaaucaugagcuccaggccagccuaggcuacaaguccaaaacuaguguggacuauaugggaaaauucugucucaaaaaaugcuaaacaaauaaauauaaugauuuccuuggcucagaugauuuuaaguuucuuuucuugguaaaaauguauucaucaaagacuuacugagcaguuuuuauuuguacaguguuaugucugugaguuuuuaaggugaauuguuaagguaauuguuaaggugaaugagauguuuauguugcugugcugaauuuacaaaguuaugagagaaaguugagaaguucugugggaacacaagacaccuguagauuugagagacaaguaacaguucccuaaaggaaaagacuuaaaacugagcacuggaaggggaggccaaucaaguaaagaaaggugggagauagauagcaccugagguagcagaaaggaucauguaaggagucuuugacuuguggucuucaaugaacaauuggcuauuccuacgcugcuuuugaaauuauuccuuuuagucuaguugaguuuucuuuuaaauacuuuauuucaaacagcuuacuuacuuuuugugggugggaacguggagaucagaggacagcuuuggagaguugguuuucuccuuccaccaaguggguccuaguuugguauuaagggccuuauuaagucauuucaucagcucaugaccuaaacuaacuaguuaauuaauuacuuaauuuugagacagggccuuaguauauagcuuuggcuggucugggacucgccaaguagacugggcuaggauuaaaggugugcacuaccauauccagcaaguuuuuugguuuuuguugguuuuugguuuuuuuguuuguuucuuuuuggaaaugaucuuuuccucagccuggaguuuacugauucuguuagguugguuggccagugggauccagggguccuaaugucugcuuccaaagugcugggguuaaagauauccacuacugugccuggcccuuuuauggcuauaggggacugaacucagguccucaagugugcuuuaauggcaagcacucuacugaaucaucuccccaaucccccagugguggcguaugccuuuaauaccagcacucaggagacagaggcaggagaaucauuauuuguuagaggacagccaaggcuacacagagaaacccuuucuccuuccccugccucgaaacaaacaaaaguguuacagguuuuaaguaauuccacuguuauuuccuuaguguaguuuuuuuuuuuuuuuuuuuuugcuucuuucuccuuaaauucuaaaguuuuuauuuauuuauuuuuaauuuuauucuuuacauauguuuguuuguuguugaugauguaaauauuguuucugcccucucauccauugugguggaaaugugaguucauaugacuuuuguggauggcuguauaccugcauauuaaaauuacagcacucgcuccuuugauugagcagcuaguggauacacacucauaaugagcuuucggggcaguucauuguaguaggcuaauaaaucaugaguuauuauauagcuguauaaaagaaugaaguggcucuuuauguaucuuuaaaauuuuguuuagaucuauuuuaauuuuauguguguguauguuuuacuacacuugaucuuagccaaaaggccgagaagcgauguguguauguuuuacuugcauguauguguuucuggugcucuuggaggucagaagaggguuuguaguuucuuggaggaaaauuauagccgguugugaacuaccugauguggguucugggaacugaaucuccaucuuuuucaauaguaacaaguucucuuaacugcugagccaccucuccagguccaggccugagguuauuaagacuuaucaacagccacaucacauuauugguggugugugccuguaauccuaacacugcauggaagauggaggcuggaggagcacaaguucaaaaccaggcagggcuacacaauggguucaaggcuagccugaaguacauaguaagaguagaagagcuggggauagggguagagggauuaagguagggcaggcaggcauaguaggucuuuguuucucacuagacuuauuagguacugcuuugugguaccaguguuuauggcucaguuuaauaaaguguguuuuuugaauuauaacaauacuuuuuacaucuuucauagccuaguuuuuuuuuauuauguugaaauuuucauauugguuuaguucuuccuguuagcaguaacacuucuuuuuuuuuuaaagauuuauuuaguuuauguaugcgaguacaccaacacucuccucagacacaccagaagggggcgucagaucccaucacagaugguugugagccaccaugugguugcugggaauugaacuauaaccucuggaagagcagucaguguucuuaagugaugagccaucucuccagcccucaguaaugcuucuuuauacuuguggaaauuuuuguauuguuucauuugauccacaaaagaaugcuaugaguagggccuuuuuuuuuuuuuuaauuuaagugagaauguuuuuaaguaauuuguuucuuuucucuuuaaguuacucaaugaaaacaaugggucuauugaacugagauuagaggagauaacccacucacucuuuuuaugaaugaauaauugaaugaaugaaugaaugaaugaaugaauauauuuuaguaaguagggucaaggaauauacuugauuuaugcauuuugaguuccucugucaaaugaguuucccccucccccaccaaauucauggcugacuuaguggucuauaauaaacugaacuaguaguaaacugcuaguuacugguucaguuauuaaugccauugaucuuuuaacuaacaacauaguuuuauagaauugcuuaacucaaauccacugagcaagaugaguauaaaauaugcaucuuauuuuauucuuucuccuuuuaccccuauuccuuuguuuugucugauuauauaacgccuagcacuugaaggcagagacagauggagcuuugacuucaaggugaaucuggucuacauaaugauuucuacacuaccuggggccacauaguaggacucuugucucaaaagaaaagaauaaaaaucacuacauaauacuuuagggcuuaugugaagucugacaguacuacagguguuuuucagucuuuuauguaaauaucgggugugggauagggagaaguaaagaagcaaaaauuccagcaaaagaguuacaaagauacagccauguaaaguaaaggugucaaaugugcucuuacuuuuuagagccaagaaauaacaaagaacaaguuauucacaagccuagugcacagagugaaugaacugccacuagcagcaaauuuugagauuucaaaggccaaguccuguuauaaauuggccuuggcuaucuaccauauagaaaaauaaauagauucacauguauucauuuuuuguguuuucguaucauggucuucuauuugcuuucacuaaggaguuaacccauauucuucccccuaggguugaaaaugcuugcaccaagcuuguucaggcagcccagaugcuucagucagacccauacucgguuccugcgcgggauuaccucauugacggcucuaggggaauccuuucuggcacaucugaccuacugcuuaccuucgaugaggcugagguaggcaauaugaggcucauaaagaccucccuuagacagaagccuaguuuuagauuuauuuguauguguguguaugugcacacguguguaugugcucauauaugcuuguuuaugggugcccauggaaaucagaagaagguaucauauuccuaaggccagaguuauaggcaguugugagccaccuguugugggugccaagaaccaaacggggguccuuuggaagaacaucaugaguucuugaccuggagucaucucuccagccucuaaagugcaauuuuaacgguaauaauggaagccagacauaguggcacacaccuuuaaucccaguacucaggagguggaggcaggagggucucugugaguuugaggccagccuggucuacagagugaguucccaggacagccaaggcuacacagugaaacccugucuccaaaaaccaaaauuaaaaagaaaggguaaacaaacaaacaaacaaacaaacauccucaaacaaacaaacaaaacaaaacaaaacaaaacaagaucaugcaaaccaauacuggaugguuguuuuagaaugcuaacauauuaaaaagcuuuauaucucuagugccauuuucuauguguuauucacuaaucuaaguccuuaaauauauuuuucagguucguaaaauuauuaggguuugcaaaggaauuuuggaauaucuuacaguggcagagguaguggaaacuauggaagacuuggucacuuacacaaagaaucuugggccaggugagcaaaacccauuuuuuuuuuuaaauagacaacgauaaccaucuuaucaccucuauuccuuuugaaaauuauuuuauuuuauuacauuuuuuuaguugugcguaugugcacaugcauauauauauuuuuaaagauucauuuauuuauuauauguaaguaaacuguagcuguuuucagacacaccagaagagggccucugaucucauuauagaugguugugagccaccguguguuugcuaggauuugaacucaggaccuugggaagagcagucagugcucuuaacugcugagccaucucuccagccccacaaaacccaaauuuuauauuaaaaguucuaugaauuuacuguguuaauucaagaggaaagaauacucuuuccuugcagaaaaugggguggaguugaugauggguuucugcugaggauauguugcugucucugaagucuguuaucuacuuccugcaagucucagcccugucaaaaucauugaaccagauuugugaaugcugaugagggagaugaaggaaauacuuuucuacuacuguaaugcugaaggccacccuuaauccugaccucccauucugcaguacacagcauuccuucacugucugccagcuggccggucgcccuuuaugacuucuuaguuugcuaauuagcugccuacuauuguggacuuaugccauagcucaaggcugcagagaucugaucaggccucaaaggagagaggagugguuguagcuaaucauuuugaaaugauuauuuagggaucugaguauugaauauucaaaauacacagaugccagcauuuggucuuauagauauaacguauccucgagaguccauaaaguauggauaagguuaaugaagaggcuuaauagguuuuagcuugauguuuauagcccugugaauuauuuuuaaauugaaauguugguguuuauuuaacaaugucuuucugagguccaguguaguuguuccuugaacuuacuccuuuucugaguugaggaucaccugggaauggccuuuuuucauggcuuagaggugugcuggggaauggcugggauauguuugggaguguuggagaugaacacaggcuaagugcaugguaggcgagugggacaccccuagccaagaccuguauucugcuuuccucaggugccuuuaugcgaaucuaacagaguuaaaggugcucagggugaagcagaagcaguccaucuuucugccucuccuuggucuugauggucuguaaaaccuuaugaaauccuaggggugauuugaaacaccaaagcugaaaacaaaaaucauauagcuagccagugagauuauaaaagcacuuggagccaagccugccaaccugaggucuaucccaggagccacauaguagaagagaacugaccccuaaguuguccacugaccucuacacguacacugugacacgaguguguguccucacauaacacauauccgucaauaaaugaaugcaauucaaaaauuacagagcacuuuugaauaaugaccaaaguaaacaaaguacuaacagauugauuccaaaacaccagaugguuaaaaagcuguacuuuuuauaauauuucuauuuugauucuaauuuuaauauuauuuugaaucaacuugaaaauucagaaacauauuaccaagguaaaggcucauuagguaaagauucuugccaagucugcccgagcuccauucucagaaccaacaugguaaaaggagagaagcaguuccuucaagcuauccucugaccucuguccagagaugcaccuugccacacauguguucucccaauacacaaauaaaugaaugccaaacaaacaaacauacaaacaaaaccaaaaacaucuaacccaguccaacccacuguucuuagaaugcuuucccugagauucuugugcaauaugaagucuguauguauacaauaugaaaacgauuacauuuaggauugcuuuuuaguaaauuaccuucacugcaaacuguaacauuacauaaaugcuaguuaguuagcaaugucugucuuuaaguagguagauaguagguuaggaguuuuguaguaauucucaauggauuuaggccgaaaaggccagauucugguuuguuuccuugcucacccugcauaauugcuucuuugugccccaggaaugacuaagauggccaaaaugauugaugagagacagcaggaguugacucaccaggaacaccgugugauguuggugaacucaaugaacacugucaaagagcugcuuccuguucucauuucagguacuuccugcuuuauuuauagggcagggggaguuaugaguucuggcucagaaggccguucuccuuugccucccugguacauguccuuuagacugggugaagauuugaguguuaaauguuaacccuauagucaccaucuugaauguucuuucucucuuucugcuuuaacugacaaaagaaauuugugcuuacggaguguccguaugugccaguacuucccugauuauguguauauuagucugguuguggguuacuuaguuuaauucuuagaagauggccguauuuaaauuucuaugaaguauguuauugucacgcuucagugccuucaguuccaggccccaauacccucuucuggucucuagggacaccuguacauauuugacgcacaaucacacauacauacacauaaauaagaaaaauauuuuuauuaaaaaauuuaauuaaaaaccuuuuucuuuuuuuggggagugggaaggauuguuuuuugauacaugguuucuuauguagcccuagguguccuggaauucacuauguagaccaggguggccucaaacucacaggaauagugcugagauuaaaggugugugccacaauucucugauauaaaaaaacccaauaaauccuaaaaacaaaauggaauggaaggaaaggaagaaaggaaggaggaagauagagaagucacugguguccacugagaacuccuggaagacauaccgaugucuuuggggccuaccauagugucaggggagcagguuacccaacaguucuauugguguuuguuauucugucccauuagguuugccgggucuggaggccaugcuauacucacgaugcugcugauugagaaggauauuaagcacuuugugauuguagaucaucucucuguguuaaauuaguuccccaaugauguguggugcucccuuuguauuuucaauuugcuauacaaugaaagcugcugauauuggaacuuuaucaucagguuugcagugauuguuuuauauauucuuuuaaagacaucagaagaucaaaauauauguugaaaguauagaagaucaccugugaguaguauuaagcaacaagauucaauguaucagagacugccuaggcccacucaaauggucaaagagaaauaacccccaccuuccugccucugaucuccacaucaauuuuuaaaagaucaaauuaugaucacuuguuuauuuuuauagcuaugaagauuuuuguuacaaccaaaaacucaaaaaaccaaggaauagaagaagcuuugaaaaaucgaaauuuuacuguagaaaagaugagugcugaaauuaacgagaucauucguguguuacaacucacuuccugggaugaagaugccugggccagcaagguaagucuuacuggaggagaaaucaugagaaaugucaaauucucaucuccugggagacuuugauuauugacuauuauuuuguagaaauacacagauauuauggacauaauuauuuuaucaauugccugucaccauuauacauuuccuuuguuccaagguggacagaauaggcauguaggauaaauacugguagaaagcugaaguguguagccuuccuucaggcuuaauucucauugguugggcuggugggggaauugguaucauacuuccuugggugagcuccuugcuuuuuacaugggugauuguugccagggaacuuaagaaagccagcgaacaugccuauaauuauguauuucaugcaaggccuagccuuagccaaccuuugauuaagagaguggacagaggaaacucuagaauuuuuagauguguucuugaucacuguuuuuuccuaaggaaaguguaauuaaaauauuggucuugguauuugucaguuaguuuaccaauuccuuugccuucucuagguacucagacugcaaagggagcccauuaugugcuuccuuuuagagccuauggguagugguuuggagugguugccgcucuggucuacuauuccuaugcaaggguaaagcuuccaggucuggugaagccaaggcauuuugcuuuauacuugccuuagagaagugcaggauguaggcagucgugguaaaugccucgacuccagggucuagcuuucccacguaugaccaaaaugcugucaccaaggucacccagcugguuguuaacaaugacuuuauaauuugacuuuguugggugcucauuagggcugcuuuucccuuccuucaggaccucagagaagguaaggucaaaucuggggccuaacaucgccaguccuccugcuguucagaaagcuaauuuaacaggauauaaucaguuuacuuuuaaguauaguauagauucauucacagagguguucccucauuaauaguauguucucuaacgggcuguaaaacuauauuuuaaguuuuuaugauaaaaucaucuuaaguucuugauauuugauuuugcuuuugcgugauaacuuuacuucccaaugacuucuuugugcaucuucuuuuuguuguuguucucuuguuuguuuuauucuuuuucucgagcuuagaagguaagcuuucucuugcccuuuaguucccuuuuugcuuaaaaagagaaaaagcaugucugugaggcuuucucgugccgugugccaugccuuauuucgugugccgguguguaacacugugcucggauaugugccagaaucugacuuaauguggaaaucugggcugugcugggcagauugacuuugugucuuauugaguugguguuuugggguggaugggacaagauagaaaagacugcuauggauaucaggcuuucuauauuugguaggugcuuuuguuucuuugagcagggccucuaagaacauuuuuuacccauucaucccaguggccucauuggaaaggcacauuuuccuacguagcugggccaguuaugugggacccagcucuugggaaagaagacuugaagugaugcaucucugugccucuccuaucagccaucucugugggccuucacauuuugcuuuuugaagguuuugcugacaacaaaaauggguaggcuagagagcuguccugcuucuacuaccaaagcaaaagaggacaggaaguaaagaauagugguuuuuuuuuuccccuuaccuugaguuggugacuuucugcauguucuguugccuaagcugugagucagccauaauucagugauuucauguuccccuaaccaaaucucuuuccuuugcuuccaguggaugagaaacuaguaaggaagaacaggcauuuaauuguaacguuucucuguuuuggggggaaaagugaucucucaguuuaaaguaaacauacguuacugaguuuauuuucugcaaccaccaucaagaaaugcuucuuaaagaacaaacaagcaaaacccagauaaguuuaguugguuucaguaauaggaucauagacuugggcaggauagacgagggaaauagaccugcuccuuaccagcugccuugaaucugucccauauucauuugcccuggaugaagcugguuaaucaggauaaagcaaaauuaacuucuucaagagugagaauaaauuaagucugcucggccaaaagaagcucaaauacauagauagcauuugagugaacgagaggaacuuauuaaucugccugcuuuuguuguguuguuuuguuuuguacauuuacuugacucaaaaaucaaaauaguauaaaaagauacacaugacgagccacucccagcccugcugccuucccaguucaccuccauuuaacccuauguguaaacucuuuagugguuauaagaauauuuagaaaaagaaauuuuacccugaaaauggacuguguuaacuagggaagugcuuuuuuuuuaaaauuaaaaacacuguauuuuauuuuucguagaauuccaaaucuuucuuuucugaaguguaaacaguaaaguagucagaucuggggucugucuguugccaccagauucccauccuguucaaugcaguuuucaguaccuccgucccuacccauaaguaauuaacuuugucuucccguacuuguuucaugcuuccccauuggugcaguacucuucuggaaagugaagguuccucuagaaaagugggggaagaaaguaaguggaacaaauucuugauaaaaauacgucuucugaauaaguucagauuucgacgaggcaaugcauagcugcauaguguaccuguuaaaccuacauucaacucucagguucacacauuuaauauuaauuuuacguacuucauuucuguugaaaggaaaaacuaucccuuaaaucaagagucauuuagagugaucauuaaagugaagccagcauuuuuuccugggacaauguuaugaaucaauacaacucuuacuuuacucugcaaauuuagaacucuguacuuagucuuuuaaaaaauuauuuauauuacguauauuuugauacauguugggagaugagagacaaauaaaagcauuuuaucgcucacgguuuuuuugagccuuacagagguagcuuuucaugcugagccaucagauacugugacucaugauugguucuuguggugagucuccugcuggggucuaggcuggugaugggcagugacugacuaggaugccuuccacaugagauuauugcucuuuucaacaagaaggaaauacuguuagauuuugcuguccugugacauccucacugcagaccauuaggauuuaaggguugaauuuaauuuugauuacuuuaaaaaagaucagguuguauguaagcuuagaacauguuuuugaguauucucagguuuuguuuuagcccucaauaaauaagacauuuaucuauaggaguuuggcuaaguaguuaacucaggcauuugugauguuuuguuuaccucucaaggagggaauccgcaaaugcuaaaggaauugguguuucccaucugaucuagguuaucuuuagcugguccaccugucaguucugcucauaaaugguguagguauuuagaauugugaagcuuuuaucagggaggagaaaccaaggguagagaaggcaacuuugucaucggucaauuuguucuucccugaaacaucuguguucagagcauuggugcuuguagaaauggagucagaagugaggagggauggggugacaaguauuaguagaagaaaggaaagagggcugggcaggaguuuccauauuuagaauucguaacuuaaaaguacuagcauuguaggacucugcuuuucuuccuaaauuuauuuauuauuauuugagacagggucucucuauguaguccugacuguacuggaacuuucuauauagaacaggugggcuuagaacuuacagaaauccuccugcuucagccuccagaguucugaacuccacuuuucuaacugugguuauucuugauggccucccgggagaaucucaguaccauucacagguguucuugaagccugaauguguauuaaagcuuaagagucuguuaguucuuucccaaaauguuccuuguuuuuguuuuggauguccuuccuccaccccuaguauacaguagugacugcuaggacacugaaguuuugauccugagcaacacacacacacacacacacacacacacacacacacacacacacacacauuucuccaaacugacuucuaggcuuagugcuuauggaaucuauuuauauuauaucugcugcuaguacauuuucauugcucaagacaugaugcccuuuaaaaauauacgugagauuuuuuuggagacaaaaaguaucuauacaugugucuaugaacacauuuguuuuuaacaacaaugacuaaacugugaucacuagcagcucuggucaaaaaaagaacuuaaggucuauuaaguaacuuauaaauuuuuauaacugucuaaaucacaggcuuuaaaaaucagagugauagaaagaugacucagagggugaaugcacgugucugcuggucugaugaucuaaguuugaucccuggaacucacauugucacagagcauugacuccaguaaacuguccuuugaccuucacaggugugcugugauacauugucacccacucacauacacaaauauaauauagaagaauauaacagcagcagcagcagcaacaacaacaacaaaaaccaaccuagaaacuaacaacaacaacaacaacaacaacaacaacaacaaaaccaaccuugaaacuaacugcaauucccagguuuaaaaaugcagcuucaggacuggaguggcucagugggucagaacauugucuacucuuucugaagaccccuguucaguuccuagcacccacguggcaguucagcaccgccuguaacuccagugccaggggaucugaugcccucuucuggccuccauaagcaccagacaugcacacagugcacaaacauacgugcaaggaaaacauccaaauaacauuuaaaaaaauugcagcuucauuucauauuugcccuugguucagaguuggggaaacaagcaucugcuaauuuuaauuuccugguguugucagagcugcucagaagaaaauuacccucuuccugagaaucacaguuucucuucauggugaaggggcuguugaguuuacuagagaaaaaagaaaugauuuuugaggaugcugauuagcgcaaagcuuguuuuugcauuguguuucaaaccguuuugggacacguuggagaaucaaagcagccauuucugcuagcgcagauuguaagucugagcucuggagcuucucuucugagaagcauuaggcggaacccauacugacgaggugaagaugugcugacuggugccgaaaguuugugccauauuugccaacuuucuuuggaagaaaagaaaaagaaauugaguuucaugugauauaaaauaagagguuggauucagcaagcuuaaggucagauggucccaagucguuguuucuuaaguuguaagauaaaguuacauugcaccuugagauucacugaaguaacugaagggaaacuggcuaagauagcaucuacccuguaggaaacuggacugaaguuaccuuccuaacuaguagccauuacugcuagauuagugcuaaaaucugucugacuuucugaaaauauguucuauucuuuggaauuuagauuuugaaauguaggugucuauuaguuuucucaccaaaauuaaaaguaucacagagguguuuauuaacagaauuuuaaauuuuacauugacacaauuucuuuuuuccaagguaggcacauauuuuuucaagaaaaagcuuauguuauuauaaacaaauauauauguaggcaaauuguaaaaucuuauaaguuaugguagguaaauacugaaagcuauccaguuuuuugagguuaggaguuaccugagagucuauccauuuaggccuuucucauuugaaauucagcucugggagcaaaucuuguuguauaaauuauuguacaacaaagcaacaaaguagaagaaagaaacagauuuaagcaauauuauuaaguguacuuaugaguggacuuuggacuagauuuuccugauguugccuaacauugguagcugucauaauucauguaacuuaguaacuuuucacccuacccuaccacccagcgggagugcacuuuuuuuguugcuguggcugagaauaaaguuaggaugagagcacacucucuaucuuuuuagaugaaagaaaagggggguccuaaagcagcguccaucauuugaguagacauuucagaagcaucaggguucagcugcugcugaguuuucagccuguucuuuuuguguuauagugaugacucugacuuggaaguagggaugugcucagugcccccuuguggaagcuugaugguacaacccugguaggacuggaaauaagaaaguuuaggaauaagggcaugcgaagaauuuuagaaguuaacauuaugcuuugauggauugacucucugggagucaguucucuagugcaaaaaaaggagacagaauguuuuuuaagauguuaaguagagauggccagacuagggccagauguagcacauaccuuuaauccuagaaguugaggcagaagcagaucacuggaaagccagccuggucugugugaugaguuccagggaacuagggcuacacaguuauacccuuggaggugggagaaugggggcagagguguagagacagagacagagacagagagagagacagagagagagagagagagagagagagagagagagagagagagaagaggaggggaggagaggggaggggaggggagaagaagaaggaggaggaggaagaggaggaggaagaagagaaagaggaagagagggagagagagacuguauaaucucccaguucuaaagauuggcacauggauauuuguuucacuguuauuuuuuauguauuauaaauuaagcugggagucauggcacauaccuuuuuuaaucagacaauuuuauguuaacagaccagccugguugacauagcaaauuuugucuagccagagcuacauaaagagacccugucucaaaaaaauuuuuuuuucucuuauuugguuguuuucuagugacauccuagcagauucuguguuaguuuuaugcuuaucauccugaguccugguuauaagcaauacauugagauccauuuguuaggguggggggggggaaaucuaaggacgaggagugaagaacagcagggaaggccagcagugcgcuuccuucuuguaaaacuuuuugugguuuauuuugagaacuaaaacaaaaugguuacauuaauacuauuuauuuuuuccaaugaguaacucuuuaaguuuuuugauuuauuuaauauagugaaauaccaucugguguuugugcgugugcauuuuaaaauaagagauaaaaggacugugcuuuguggcaccacauacuaauaaggcuugccuagagcagggagggcucuggcaaggcuuccacuugauguugaggcuccacaaguuuccuaccggauggcgaccauuaggaaagcugauaaugaaguaugagcagcagggcuccuuccugcuggagacauuaggcauuuuuuuggcuugagcaguuuuuuaagcuuuuugcaauuuuagcauugaagacaccaggaggcagaauagaauuaacugaagauuugcaugcaagauguugcauuuugacagacacaagacuugugguguggugagauuauuuaaggcuguuguaggacuaccugagcuguuguguguuagugcuguaacuacugcucuguaaaaauuaagagaccauguuacaaaacacacaagaacuguggcauuucucuuccaaaggacacugaagccaugaagagagcgcuggcguccauagacuccaaauugaaccaggccaaagguuggcuccgugaccccaaugccuccccagguaacucugcaguaaaaaacucuguuuucugaacaauaaacaguuaaaaucaaaucaaaugaaggaaugggaggaauccuuccauaaucucaccauccugagguaacuguggcauccugccauaguucugagaaauugaaacaucccuggccuuaaaggaugaaggcauaaaaucucucauuucucaccaugaauaaauaaaccaaguuaagccggugucuuugaaaaguuacugcuucgcccauccccugaagcagaaagguuauuauuuugaauaaacacccuuuuuugcuaguucuguuuggaagcuggugccauuuaugucagcaaaguacuuaguuaaguagauuguacagugaucuuaauguaagauauauaaaaguugaauauauaaagauaagacccaacaaggcuuuuggcuuuucuaauuuaauauuuauuccacuucagauuguuugagcaaaugugaaaagccuaauggaaguuggagguccuaaguccuguugaauuaugagacuacuuuucaucagccacauacuuauggccacugcauaucuccaagcagauaugguacaacauaucuuccuucacagggccugugguuaagccucgccuuaugucuauggggcaguguguggcugucaggucuuguauuccuucaugaacggaaugacuugugaugggaucucucuggauaauugauguguucaugguguagauauugacuaucucacuauuuuaggggaugcuggagagcaggccaucaggcagaucuuagaugaagcuggaaaaguuggugaacuuugugcaggcaaggaacgcagggagauccuaggaaccugcaaaaugcuagggcagaugacugaccaaguggcugaccuccgagccagguaaggguccucuccuuuucuuaacccgugcugaacagcucacuccugaggaggugauucagagcacagguccacgccgauuguauugaacuguccuuugcuaauaacagagcuuuaaaauauucaaagucuaauaaaguuagagcucauuauauaauuauuagguuuuuuuauggauggguagauagaaaauuccaguagggcuggagauauaccccaguugagagauugcuugcuuaguauguguguaacucugggcuuaguuccuagaacccauuagccagcaaggagcaggugccucgaaucccuagaacucuggagguggaggcaggaggacccgauuucagugucauccucagcuaucugcuguacugaaggccagccugagcuacauguguaacaauacuuuuuuaaauauaaauccugccauccaccccaauguuuauacauuccuaaaugaaagacauacacucagccuuugcauuuugauaugccuuaaauagugugagaguugggcuaccuucuaaccuccaugucguuaaucugccuccuguugauaagcccgagucauuacuuacaagauucuacauucugccuuggcugcccuggagccagagggccgcacucucccagccucuucacggcugcccaugccucccugucccccacuccucaggcauggcgucuuuccucaccuucuccuggcaugguggaucucuuccuuccuccucucucuccaugccaagcccaggaaauucucacauccugccucuguccugcggagucauuggcugccggcaucuuuauuuaccaaucaaaaccaauuggggacagggccccucaguguuuucuguaaggcacuccuguaaccaauuuuggggaccaaaauuaacauuauaauacaaguagcguuaggccacacccacuacaacaugagauacuagguuuuuuuuuuucauuuuguguuuauuacuguguacauuuauuuuaaaaauuguuaauauuuuaacacuauucuuguguguacaccuguacucagagccaucucacagagccccuuauaauuuguuuaaccuucccuuuauccuccucaaaucuuuguuuucagagcaccuaccccuaaauaaguacacuuaguuugcuauugaaauaaugcaguagaauguagauuaaaaaauacuccuaugggguuaaugaauauauuuauagacauugagaggauugaauugagcugaaguuccuaaaggagaugagauugcuuuugcuuugagaauguccugaaauuccuugaucacuguuguccauagcauaccguuucuuuagggcacagaaacaaaccucagcaugcuaugugauccaaaguguauccaagcuaacuauagcuuauaaaaguacuucuuuuggaccacaugaaauuuuuauucuuaugaaaccauucaucuuuaccuaaagcaaugcagauaucuauauaguauuagggagucuuuuguggaguuuuagauguguuguacccauaggcgccccauggcuuuuggagugugugucuccuugggagagggcacagcucugugcagucucaugggucucacugagcccguuucccagugagaacagcccuccuugucgggagcauggcaagaacuuugcagaagggacaaaauaaguuuuguucccauuuggaaaaaugccaaugcaguuugacaagauucuuggcucuucuaauuuuucauuguuggcucuuugguucugcaucccuuucacaguguggcaggcaauuuucacuuggaauucugaaaaacacagcugugaauauaagcaaaagaaugaaguaguugucugggaaagaccguuaaucuguuaagagaaaaggcuagaacagggaugaguaacugguccugccucacacuggagccugcauuauccuuucaugauaaaagauuagaaagcuaucuucccauuguuuguuuguuuuuaaaaugugcccagcagcuauuuuaucauuuugauggcugaagcacaguaauacuucaagcuucuggguuucaugaauacauuuuuaacucuauaagucucaauacaaauuuguuuuguuuuguuugguuugguuuuauuugguuugguuuggucuuuugagauaggguuucuuuguguagccuuggauguccuggaacuggcuuuguagaucagacuagccucaaacucccagagguccacucgcuucugccuccugaguggcaggaucaaaguugugcaccaccacugccucgcugaccuuaauaaacuuuuuaguuugaguuuggcucauauauauuuuuaccuuucacaguuagauucauauaucagaaccauugaaagaaaccauggacaguguuuccucagucuuccuuccauuuucuuagguuguaggaaggccucaagugugagacaccuggcaguauguuuacagagcucauuccauaugguguugguauagguggauuuuuaaaagagggcagaaggguuggguacauuguucagccaguaaaguacuugccaauaagugcgaaggucucuagaaucuguuaaaaagucagaccucaugacacucuggggucuauaauuccaguccagugagguagagacagccguauuccugggguucauuguccagcuagccuuagucuaaucagcaaguucuagacucccaagagacccugucugauuaaacaagguggaugacagcugagaaacaacacucacacacuggcaucuacacauggaugcaaacaugcacaugaacacauacacacagaaaaaaaaaaaauacacguggggcucagugagguaagagcacuggcugcucuuccagaggaccuggguucgguuccuagcauccauaugguagcuuccaacuaucgguagcucuaguucuagaagcuuugauguccucugcaggcacugcaagcacauggugcacagacauacaugugggcaaaacacccauacagaucaaauaaggauaaaugcuaucucaagauaaaaauguuguuuucaugguuuuagagcuuuauuguagaaaagcagagagagagagagagaggaguaaagaagcagagggaggccauggucauguggagagaggggagaaggggaggggagagagggagcaagagggcuagagagaaagcaagagaggcaagagcauaaaauuuuaaauaguuaauaauagacucguuuuacucuuaagggaaacaaggauguuuuggaguuuauccuaaacuuagaagcucagauucaaucaugccauucuauaaaaugaugaaauugucacaccugugauugaauuuauuagucuagguggcuaaaaauaauccgaguuuguaaaaagauggcaagucuuacuuucuggccuggaacguuauuuuaaggaaucaggucucuacuaaguccuaucauuuuucacagaagcagacuacguuucugagcgagggaaaugcaugagucuuuaagacuucauggggagcagugagcucuuuucaucccucaguacuaaccugcuguguuguuuguagguugcaugguaauggaagauacaugucaggauucccuagguucaucauagcaguggugauaguuuaguuagauuaguaauuuauaaacuuguauucucaauguauuuucaaguauauuuucucuuucuuucuuucccauauuucccuuuccuuucuguuccccacccucaacccgcuuugggcuggggauugaacucuggaccucacaaauugaggcaagcugucuacaacugagagccauacuucagcccuguauauuaccgucacagucccuuucccuucccaguguuggugauccaacucuuaugcagucuaggcaagcagucuaauacugagcuaagaguguguuuccgaguauauuguccugacccuuuuagccacucuguuuaauaaauaacuaauacagggcaaacgcugccuugcuaucagccuucacuuuaugucacuuuaauuuuauaagugagaaagagaagcugugagcuguggugacacaguccuuuaauuucuauacuugggaggcaaagacagguggauauuugagaguuugaaaccagccuagcccuaauaaugaguuccaggccagccagugccacauaggaggcuuugucuccaaaacaaaacaacaagauccccuaaaccaaauaaacucugaagccccaaaauguuaaacaugagaacaaacauuccaacggggccaaaagucaggaguuagaaacauagauuuaauugauuucaaugugguauacuuucuuauacuguauaugcuauguucucaaauaauuuaaguauaugauuccccauaaauaagacaagcuaaugggcuacucauuucuaaagcacacaguacuauaguagcaaagcccucuguaacaguaagaucuccaucaaaacuuccuacggaagcuuauguuuguuauauaaucaagaauaauuauuauuggggcuggagagauggcccagugauuaagagcacugacugcucuuccagaagugcugaguacaauucccagcaaccacaugguggcucacagccaucuguaaugggaucugauguccucuucugcugugucugaagacaguuacaguguacucauauaaguaaaaauaaauaaaccuuaaaaaaaauaagcucuguucaaaaaaaaaaaaauucaucauuaaaauuugcuggccuggcuucucagugguuaaauaguccccagaagcuaauaugaguuggacauagcagugcggguuuauaauucuauuacuugagaaagaagcuggaagaugagguguucguucagagccagcuacaguuagauaaguccuggucucuaaaaacaaaacaaaacaaaacaaaacaaaacaaaacaaaacaaaacaaaacaaaacaaaacaaaaucaaacaaaagcguguuuuuuaaaacaaaagagaaaguaggugguuuggauguuuuucuuuuuucuguuuucuugugcugucugaacuuauuggggaaauagacagaggcacacaugcuaaugaaaauuacacauacuagguaaaugaauauuuguguuaaguauuugagaggauguaaugaccauaucugucgugcugaauagaggacaaggagcuuccccaguggccaugcagaaggcccagcaagugucucaggggcucgacgugcuuaccgccaaaguggagaaugcagcucggaagcuggaagccaugacgaacucaaagcagagcauugcaaagaagauugaugcugcccagguaagggugguucucaggagggccaggacagagagaggaagagaagggcuccuauguauccugcaucucuucugcacuguccuuugucacccucuccuguggguagauaauggaugcuccuuagugaugaucaguuuccagcagucucccauaccauccuaggugcagacucaugucuauauuuugaauuaaagaucuucauuuucgguacuucaaguaguuaaaaggucugaguacgacaaaauccuagauuuugaaacagguuccuggcuuagaauucacuacuguauguaguaagaaauauuaaaaauccuagccugguguuucaaccccaccuuugguuauugaguuccuggauaaaaacacacacagccauuaugguauuuuuuuuguuuuuuugagacaggguuucucuguguagcccuggcugucuuggaacucacuuuguagaccagacuggccucgaacucagaaauccgccugccucugccuccugagugcugggauuaaaggcgugugcccagcaaccccauuauguuuuuaauaagccugaugcagcacauuagcuggguagcugccuagccuccauacuguuagacucaacuuuucuauugauaaccccaaguuauuacuuauuauuuacuauguuccaucugggcugcucuuaacgcuaauugggaagcccuaaguucacacucucuugacccuuaucccaugguggcuuccuuucuccucuccaguacauuuuucuucugcuucauggcagcuggcuucuccuuucuucuuuucuuugugguccucuuuccucaaguucaugaaaccucaaccuauaucucuucugcccagcuauuggcugucagcaucuuuauuuaccacucauaguuaacugggggaaggaucacuaguaucuguguacagacuccaggucuugggggucugcacuuagcauuauaauagacaguaaaagacaaaaccucaaugacuauauuaggccauagugguauucaaauuucagauucuuucuguacaaaauauuuuucaagcauuuaauaaauacaaaugcuugaaaaacuugaaaaaaaaagucauuaauuaaaagagugggauaaaacuuacaaagauauuuuauuccuuuuugucguuauuuaccuuuuuucuuucaguuuggauaucaaacucagggcauugugcuuuuauuuuuuugguuuuacgagacaggguuucucuguguagcccuggcuguccuggaacucacucuguagaccaggcuggccucgaacucagagaucgcuugccuuugcuugccuugugcuuguuagucaagcauuguacuauuaagcuaaaaccccagccugggaacuuuauuuuaauuuuaacacaucuggaaguauagcucagugguaagaauguaugggggauauaacaugaugguaucuagaaaagaaaagauggagugauuugaucuuaccugagcuaagaaccuucauaaaaugaucagaauuagcacucuaaaaaacaagugcuaggagccgggcaugguggugcacgccuuuaaucccagcacucuggaggcagaggcaggcggauuucugaguucgaggccagccgggucuacagaaugaguuccaggacagccagggcuauacagauaaacccugucucgaaaaaccaaaaccaaccaaccaaccaaccaaccaaccaacaaacaaacaaagugccaguauguggugugacuacauuagagacauuucugauggcuaaguuuaaauguguuuccuggguagauuacauugucuguuuugguauauagaauuggcuggcggauccaaaugguggaccugagggagaagaacagauucgaggggcuuuggcugaagcucggaagauugcagaauuaugugaugauccuaaggagagagaugacauccuccgcucccuuggagagauagcugcucugaccucuaaacuaggagacuugcgaagacaguacguaccugacuucuuagucucacgcuaguuagugucucuucauuucacggcccacucucucucccucucuuauuuuacucuaggagcagaaagaguugacuccccauagguuaaaugcauauuuaauccucaaaaugcagaucuuuggacccuaccucagacaugaugcauguuaaaugcauaggcuacauagguuugugacagggcuaggucagauguuaccucuguaacaucugauguacagauuuacaauguacagugauguaauugaacuuuacugauuuguugcugaucaaauggcuuuaaacgaauauaucuagauauauucuucugagaacucauguuuaagcucuauuuuuauauacuacgacguuccuugcuguauucuguuuguuacauggcuguccucgacacaaggaaaaugaguguuuaguuagcugugaaaagacuccucuguauaugugugugugugugugugugagagagagagagagagagagagagagagagagagagagagagucaggaggcauaagaaggcacuuucuccuucccagcagugcuauuucuugaguagcaauuacauaaaggauucuuaaauuacauuuccuggaugauuguuccuguaauaacauccuugccacagcuuccucucuuaaaggcuuucaucgcaccuacuuugauuauauagaaaagaguuauuccuuuguucugacaaauauauugcucucuuuaaaaaucacaucaacaacagcaccaugggcuggggauacagcuuaaucgguagaguucuuguguagggcuggguuuggucaccagcauuuccuaaaauaaggcauggaggaagauaucuauaaucccggaaacugggaaguagagacaagaucagaaauucaaguucuccucugguuccaucaugaauuugauaugagacccuguuugaagaaaccaagccaaagcaaaccaaagcaaaccaaagcaccauuuccuagaacguucuacaguaggaauugaggaggcuacaauaggaugugaggaggcuacaguaggaugugaggaggcuacaguaggaugugaggaggcuacaguaggaugugaggaggcuacaguaggaugugaggaggcuacaguaggaugugaggaggcuacaguaggaugugaggaggcuacaguaggaugugaggaggcuacaguaggaugugaggaggguggucuggcuggcccaucuggugucugagguuggugcccuugccauccuucacugcuccauguuuaucucuccagaauaguuccuuuguucaugaggauagccuucugagagcuagaggagggccaauguuggucagggguguaguauaguggcugcacuccccuugccagaacuucucaaccugcccucagcaaaguuacagagggauugaugggaaagaaguggcucuuuucuaccacaguccugcagcacuauuuuccaaggauaaccaaagucaaacaucugggaauauuccauuucuuccacuuaacuuauauguucuauuucuguuugucugugagaaaaaugccuauuuuuauccucccaaaguaagagauucauuagaaucuucugacgagggcauugcuggcucagaaagcaaaaagacagagacugugaauuccuaggaccuaacacaguuuaucacauagacaucuggaaugauuuuaggugacuaagagauaacuacugguaauggugauaacaguagaccuucauguagaccacgaaugcagucaucaugcuuaucauuguaacauaaacagacaugcacacaacuacccagcagcgguacuagccaugggaaaaccaugguaaacaugguguuaagaggggagauuagagaaccuuuaaauaauaaagaaauuuuuaaaauaagucauuuugucagauggguugauuuuuuuuuuuuuuuccuccccgugagauaaaacuucucuguaacaucccuggcuguccuggaacccucuacagaccaggcugaccucaaacuuagagaucugcugccucugcuccaaagugcuagcuagcauuaaaggcaugugccaccaccaccugcauuguauuuucauauuuauagaugagccagaugaagguacuuuuuugugacaauaauuucaagguauaaaguugacuggauucuuuguguuuucuuuucuuucucaaauuguuacuuacuuuauguuguauggguguuugucuggacaucacaugcaugucuggugcuuacagaggucagaagacccugccacuggaguugcaaauaguugugagccaccauguggaugcugggaauugaaccugagcccucugaaagagcaaccagugaucguaacugcugagccaucucagccccaucuuuuccuuuucuuaauggucagagucacauuuuuggaauuaguucuuuugggacaguuuuuauucuugagacuaaugugguuuuuuuguuuguuuuauuucugugucaauucacuaguucaaguucucuggcugcuagaucaaguacuaagugaaggguuauugaaaauauauaaggaagcuacuagaaggccagccugaacuguggccaagucuagaagucacuaggagcucucauucucuuucagugucuuagacgacaaauggauccugugugucugugcacucuuucuguuuacuuugcugggggcgcuuccuuagguuugacuuaggccccaggucuaacaugauuuucuagcuccagaggcucugcuaguugacugaaaaaucuuucuuaaguauggaccaaggauuaccugcaaauuuuguuuaaaauguggaccuuuaucucauccuagacauaacuuaucagggucucuuuuugauaguggacuuaacuaucugaaucuauaagucccagauaucuuucauacuauacuuugagaaacacuagaaucuaguuaaguguaauuugugacugcaggguuuuuuuuuguuuuuuuuguuuuuuuuguuuuuuuuuuuuuuuugaguagagaccacccaguucaaucaauuauggcagagaauggggguuauaugauacuacaauaugguaauauaggugguagcuuaagauugagcauucuaagccggguggcaguacacaccuuuaaucuuagcucuugggaagcagagacaggcaggauucugugaguugggggccagcuugguuuacagagggaguuccagguuggccagggcuucacagagaaacccugucucagguaaaauacaaaaucaaaaccaaauagaaaagugugcccucuaaacucauagggcuggauuugaacccugacucuauugaauuaagugaugggaucuuauucaccuugcacauugguuuuguauuuuggcuuauacuguucuuuauaggguugaugugaggauuaaaugaugaaaggggagagcuuguagcauaccugggaaaauuaggacucaaauacagcuucaugacuaguuguguuauuacugauacugcuucuacuacugacaugguuaucuaggcacaccuaguuccucauugugcuugugauuuuacacauggcagagugagagugcaggcaaucuagagguaagugagugaacucaguuaauaugaccugguauaacugugaagacugacucaagcuaggagaaaauaaugugaauuuaaacuauuuucauauuuaugggcuaaauaaaucauuucaaaucaguuugguaaucauuagcaauuuccauucucauuaacauucauuaacaguuaaaugaucucaacauaaaucaugucuacaauguaaauuauagcgggacggucaucuguacuucuuuagggggaaaggagacucgccagaggcucgagccuuggcuaaacaaguggcgacggcacuacagaaccugcagaccaaaaccaacagggccguggccaacagcagaccugccaaagcagcuguccaccucgagggcaagauugaacaggcgcagcgguggauugauaaccccacaguagaugaccguggagucgguaagggcaggucucagugcagaugugcaggucacugccacauuuacuugauuauuggugauaaggugcugaaaggguucucuagcuaccaggaagucacuuuucaguguggcuccauuuccaaauguggccaguaagauuucuaugauuuaauugagaaguauuagagaguaaaaaaaugugcuguggacaaacagaaagagcuucauaauugaaacuuugaacuaauuacuaucaauccuauacauauuuucauucuguaguauuucuguuuuuauaguccuuaccaaguacccaauuaaacauauauauauauaucuauaucuauaucuauauauauauauauauauuuuuuuuggugagggaguggggugggggaaugacaauaaaagguauauaauguccucaaagcauccuguaaaaauuuaaauauuuuuguuguuguugguuugguuuuuuuuuaauuuuauuuuuuuaaauuuuuuuagacauggucucuguguagcucuggcuauccuggaacuuacuaccuaggccagauuagccuugaacucacagagauucaucuggcucuugaguacaggcauuaaaggcguguaccacaaugccuaguugaaaguugaaaauuuuauaaccuaaaaguuugauuuuaagaagacccaagaauagguguguauaguuuguuuuaugauugcuuggcacguuugcugagccugaaagauaacgcucaccuuuccuacauucacuggguaagaugaguguuuaaguuaaugaugccuagugucagugaggggcuagagaaugggcagauguguaacuggguauaggacugaaauaacauaaacacugagucucgaguucuaugcacagugcuguuaaacucuucauaccuacugcgucuguaguuugauuuuaggagugauuuuuuuuucuauuaauucauuucuaaguuacuaucagaauguauguaaacuaugaauauucaguaauauguaguaagcagucagauaguuaugguuaauauaauaacauguaaccucgugccuggagagauggcucagugguuaagagcacuggcugcucuuccaggagccagguucaaugugcagcaccuccauggcagcucacagcuaucuguguacaucaggcaaaauacuaauguacauaaacuaaaaauaaagaaaugauuuaaaaauauauaacauuuuuagguuauauuuuuguuuuuguuacuuuuauaaugcuaggaaaguagucugccauuaugucacacuccccauccauagaccaugcuuucaaaaaaagauauuuaguaaauggaagcugcucauugggaagaaugggagucaaggaauaaagguuaggcuugguuauaggucaguguuagauaugugugagguaccccccccccaaaaguuagugcauaguguauuccaaagaguuauguuuacuagggaaccccauaccccuauuaaaugcuaucuaaaaaaucuggaguggcagcauaguugucucccuggcucuguguaaagcucaguguuuuccuuuugguuuaggucaggcugccauccguggacuuguggcugaggggcaucggcuggccaaugucaugaugggaccuuaucgccaagaucuucuugccaaaugugaccguguagaccagcuaacagcucagcuggcugaccuggcugcccgaggggagggggagaguccucaggcgagagcacuugcaucccagcuucaggacuccuuaaagguauacuuucugaugccuuaguguugagaaacaacagacagaagagauuucugugcagugggugugcaugcauguggaggucagaggauaacucagaugucaggcaccaucuacccuuagguuuugagacagggcaucucauuguucugggacuugcagaguaggguaggccagugagccccuggggaccugccugucagcacuucuccagugccagcauuguuaaugggagcuuuggagcucacauacagguucucaugugguaaggcaagcacuuuacugacugagcugccccaucuuggccugaggcuugagauuuuuggguuuagggaaaauuaaaacgagacaagaauaauagaaaaucagaguuuauuaggagaaagccaaguggcaacaauuaacauuuuucuaacucacauuuaauuaagagaucugucaugauuuugcucuaugcugauaucauuuuacuguuauuuagucaguguuuauuuagauaggguaucucacucuguggcccagacuggccuugagcucuuggcaaucuucauggcaggacuuucugauugcagcaauuauacccauguagcuagaggucauugaauuucucuauaaacauuauucccauuuuuaauuuuuuuauuuuaauuucuuucaagauaaugaacuauuuagaaauuuuguacugagucuucuaaguaguuaauauagcuaucaccaggccuggcuaaaucuggaaauggugaggaccucuuuuucauccuagagccugcucugugcucagaccugagguuuugucguuucauaguguccaucgagaaaggaaucauaucugagcuuuguacacauuugauauucaagaaauaguucugaagguaaaugagugaaagaaagaacaaauaggucaguggagucagggcauaacagauguggcuucagggcauugcuauacauuuucacuuauaaacuauauuuuuaaggaucuuaaagcccagaugcaggaagcuaugacucaagagguauccgauguuuucagcgauacuacaacuccuaucaagcuguuggcaguagccgccacugcuccuccugaugcacccaauagggaagagguagguaucugaaguacagaggaugcuuguggacaaaagauggaaguaaaaaagaggggaguguucuaguucaccaaguguguuagcuauaucugucuuuaagugaauguuguagcguauguggucauuagguuaaagcaagugggguugcuuuucaucacauaccaagaagcacgacagaaguaaauguuuuuggcgucuguuaaaaaacaaaacaaaacaaacaauuggcuccucugugguuuucuugguggcuguucucauggggaggcaucaaucacugcagucaggaagaagugagggaugaggguuacuuaggccacagcuuucuuuuuuuuucuuuuuuuuuuuuuuccuaaauaaacuuuguaauuuguuuuccuuugaguuugauuugacaguuagguuaaacccagauuugggggaaaaugauuuugaugcuacuuggcaaugccuuugaaauacauuauguguugccacagaauuuacacgaucaacauuuagaugucaccagagagacauacauccuugcacagugauagacauuaucaggcacucuugaaguagcagcagcuauucacauugaacuucaagaggcaaccgaggaaaugucaggaagcauugcauuuuuggaagucggaagcccaggcuuugcauuuugaaugugcauucaagugaccagcaagaguuuuaugaguaggauuccaaaucuguuuuccuagcacuugagaggcagagacaagagguugaucacauguucaaggacagcgugguauggaguccucauuuugauuuucagcaccaauuggauauggugcucuuccuaaaagaaacaguucccacuuggggauauguucuucuacugaugcccaguaacgagucucaagagaaagcaucgaaggcugugggugugggauaagcuuggucugaaaagccuccucugcagcaucuauguccugcaagagucggagguuucuucuagaagcagucucaguggcuuggaggagagaugcccuuucuguguuuucaucuccaaauuuguuuuucauuuucugaaguaacauuaaucuuugugauacuauuucuucaugucuuuuagaaaggugaauuucuugaguaaacaaggaagccaucuuuaaucaaagcugagcuauaaguuuucugcucugagcucuucccaggccacagcuuucugaacuacacuuuagacucaacacaagucaggacaauuuuuuuuuuuuuuuuuuugagacaagguuucucuguguagcccuggcuguccuggaacucacucuguagucccggcugccuggaacucagaaaucugucugccucugccucccaagugcugggaucaaaggcgugcaccaccacugcccagcuaggacaauuuuuuaaacucauuugauguaauuauucugugcaaacccuucuguugacuccucuuugucccugagugaagccagaauuguuacaguagauagcagaccagugaugugcugguaagcuaauucuucagaauagaauccaaaaggccugauuuguaaauuaaauguugcuuggauuuuuauuauguagauacucucauauguuguauuguauuuuugagacaagaucuuguuuacauauccuaggcuggccuugaauuugugacuccucccaucuccaucucccaaauauugagauuguagauguguaccacuauccccagcuacuauagcuguuuuaauguaaaacuguugaaagcaaagcuguaaagagaugggacguauuugacaccuguaaauuaguguagagcuguacaaguggcuuaacuacugaagucuggucccuaacuaccucuucaaccucauggugacacuauucacccucuucaauuccucuauucacauggaccuuaaauaccuguaguguuccuugaauguguguauguucuacgcaagcccuugacacuugcuuuccuuuucacaaauuauauuuauucacucuuuucaccuuucuguugaaaucucacuguugugugacuauacauaaaaacaaacaaacaaacaaacaaacaaacaaacaaacggacccaccccucaucccugggaguucgugauauucauauccuacuuuucuucuuagaaguuacuaauguuugaugggcuggggcuauagcucgcuuugccgagugcuugcuuagcacaaagacuccagcgcugcagaagcuggugagggggaauccuagugcucaggagguggggacagaaggauuagaaguugaaggucauccuugacacacacacacacacacacacacacacacacacacacacacacacacacacacacagagcauugucucuuuguuggucuauuugacucaugucaucaugaaaguuccauguggauagggcuuugcuuugucaguaauugaggcccaguucucuaagcagugucagucaagccaggauuggugccgaauggaacucuuggagagaacgucacaguaucucgaugucuagacugucacacagcaugugaaaggaccaaggacaagaagcgugugcuuuuguagccuuuauuuaguagcagaggagaaaaauuuggagggccauccaguguguauuauuuuggguaaauguuguguucuugcuucuuagugacucuccuuucucuuucuggcugagguuagaagguguucaguuccgggucuccuuacacuagggugauuugcuaccuucucaucccaggcuucugaauuucagacuccuaaauuucagcuaucugcuugucuugucuauuuaggaucuagauuuauagguuccuuagcauauggugaauuuuucuuugagauuguuuguuucuagugucuuuuccuaguccuuuaauaccaacagguaacucaggcauauuaauuuuauaucacaaucauuuugaauccuaucauauugccacaguuuaaauccuauucuuguucuccacucccuaacugguugcuuagcucuguugccuuugaaucauuuacuaagccaccaauugggagagaggagaguucaugaagcccugaucuccugaucucucaguggcaccaggauaaagauggagcuuugugauagggccuuuuuuuuuuuuuuaaauguuuguuuguuaucauguaccccaggcuaaccuuggagucugaggauagccuugagccuccuggucauccucagggcuggccucauagauugugccauaauagcuggcuugugggaguuguggaucagauccaggacuucaugcacgcuaggcaagcacucuaccaaugugcuaugucccggagccccuguggucuggcucuugcuguucuuuguauguugguuucaucuaggcugcaggcucuuacuccaugcugcugcaguaacuacgugucuggaauaaugccuguauacuuggcccuucuguguccuugcuuccucccccuaauuucuuccagcuucuuuucugcgugguuccucucccuucuuuauuguuuucuuugcuuucuggauagguuaagugccucuucuuuuacacccauaagauugauguguagcuuugcuaauucacacaguggcaccauuauuacaaauacccuguccuuuccuuuccuuuguuuuguuuuuguuuuuaucaagacaggguuucucuguguaacagccuuggcuguucuagaauucacuuuguagacuaggcugaccucgaacuccgagaucugccugcuucugccucccaagagcugggauuaauggcaugugucaaccaacacugcuuggcuaggaagcugaaucaaaacaaaagaucagaaugagucaagggaccucaggugguggauguagaacauuggaacgagaguggagcuugcuaucaaacuacaaaaccuuuacagauugucugacuugagucagaguuagacaccaaguauggaaguggcacucucaauuaucgucaguaggacauuuaaaaaaaaaaggaaguauucugcuaggcuccuggcaggcucuauauguagcauaaaacugacccagugcugucugguagacguuguuuuccagauacugauccuaaugucacucaaacaaauagaaacuuuuuugucauuuguaaguuaguuuuuuuuuuuuuuaaaauuagagucucuaaugauaucccugagggaaagaaaaguuaacuuuuuaaacgagagaaccauuuugcauuuagaacuaauaaaaaucaccuauccuugccucuguguucugucugguaugagcacaagcuaucguuuuucccauugaggucaagggcagaguuuuuacaacauuaaugguaaugggauacauuagaggaggcuggagucagguaaggacucuuuguggauacuuggggauuguaaugcacccgguugucuaugguagagccuggagggguuuaucguucucuucaaaguaagaaggccuuuggggaaugaaauuauuuagucuuugcauuugugaacuuguuguaaaguauauaguccugugugugcucuugguaaguagguuuaaacgaagauuuggggaugugccucuuuguguaugaugcuuaagacugaaccucugaggaaauacauaaaggucaagauuugccauuugauuauuguuuuaguaauaagaucuuugagcaguugcagaaucagauuaaaaagaccuuucuucagguuuccugaugcauuauauggaaauacauuuccuuaaugucuuuauuuuauuuuuuucucaagguauuugaugaaagggcagccaauuuugaaaaccauucaggaaggcuuggagccacagcagagaaggcggcugcuguugguacugccaauaaaucgacaguggaaggcauucaggcaucugugaagacagcccgagaacucacuccccagguuagcuuuugcucacuuuuccuuucagcaucauaguguaauauucaggaaaugaaaucaauuauagaugcuuuguuaagaucacauauuaaaaaaaaaagaguauguugggggaugggacauaggaugacugcugaguuaucguaaaggcucuuccagaggaccacacuuugguucccagccuccaugucaugcggcucacaagugccugugauucugucuccaauucuucugaucuucaugggcaccugcacucaugugcacauacccauauacaauacacauacccacacauaauuacaaauaauaaaaauaaaucuuaaaaacaugcauguggaucuagggaaauagcucagcagagaaaguacuugccacauaauuuugugcacuggagccugaauccccagaacucauguaaaagccagucaugguaggauaugucugucauauggugcuccucagaggagaugguggguggaggcaggagaagcccugggauucucaggccagcgaggcuggcauauugauucaggaacaacaaagagaccaacgucuccaacaaguugcaaggugaggaccaacacuaaaguccuccauacacauacuuugaccuccauacacauuugugcuacacauguacccacucacacauauaaaugcuuguaugcacauccacaucauauauacacacacauugcacaacacacacacacacacacacaaacacacacacacacacacacacacacacacacacacacuacacacacauaccccacaugcauauuuauauaauauucauugggucaaacuuggugaccgcuaggauuuuuaacaaaacuuugaacuuuauacauuuuugcaguguuugaauuuuuaaguaauggucaguauucuuucaaaagcaaaagacaagagguaaagcagccuucuucccuaucacacauguauaauaagaaaauauuuggauaauauuaagagaaaguuuauuuaguuucuaucuuuucacagcaucucuuugaagagauuaaaaaaaaauagguguuuccauugcuuauuuuucuuuuguaucuaacugcauagcuaacucagguauaguuucuaucuaacugcauagcuaacucagguauaguuucuauuuaacugcauagcuaacucagguauaguuugguauccaucauuauggaaccaaacuauagccaggaaguugggaaacaaaaggcuggaaaugagaguucugauaaaucagccagcuuccccuucccucucaaaccccucuuuucugaagcaggcuucugauuuguagucacacuggacuaaaaugaucuaaugcgaggacuacagguguacuaaaccacaccuggcuagcuuccuuagacacauuagcucagcauucagugugagguuuugcagacuugcuuuucccccaucuauuaauacagagaaaucuuacugggaguucugcugggcuguauaagucugugauucuagcuuuuuuuuuuuuuuuuuaaagauuuuauuuauuuauuuuguguauaugaguacaccauugcucucuucagacacaucagaaaagggcaucagaccccauuacagaugguugugagccaccaugugguugcugagaauugaacucaggaacucuagaagagcagucggugcucuuaacugcugagccaucucuccagcccccugauucuagcuuuuguugaacuucucuggggaggggagggaaauggucugugugugugcccauguugccuguuucucugguuuccuucccuuucucuuucccaucauuaggaauggaacucaaggcaaaaauaccuuccaccaccauggaguuacaugccucaguccauguggaaaagucacacucguuuaauaaaaaacaaaaacguuguuaagaguggaucuuguuaugaagcccaggcuggucuugaacucacaccauuuccucuaguguugggauggaggcaugugccacuaugcuggcuuuaucuagccuuuucagaaaauuucauaaaauacgaacuuuuuuuccuguuuuuaccaucuauuagcauaacacacaugcaaacccauaugcagcgcccucuggcugagggcacagaagagaaugucaucaguucagguuguaaaagcugauuuauuuauuauauuguucaaauguucuuucuuuuuuuuauuaaagagauuuucucuaaaacaaaucuucauuuuuuuuuauguguaugaguacacuguagcugucuucagacauaccagaagagggcaucggaugccauugcagaugguugugagcugccaugugguugcugggaauugaacucuggaccucuguaagaacagucaguucucuuaacugcugagccaucucucagaacaaaagugagauuaaaaacaacaacaacaacaacaaaaaccagaaaaacaaacaacaacaacaacaacacccccagaaagacagaaguuuaagggcuacagucauuugggcacaauaagucuccuccuuuucugaauuauucagaaaaaucaacuuuuccuuuacuuuuuucuaccucuauuccaacauguuuucuuuaacacuuugggcuuuccugccaauauuuugguuuugcuuuuuuucuaaagcaccucuccuucccaugugcugcuugucucccauguguuugaccucucugccagcuuagauggcuucugucuucuccuucguucgacuccuccagguagcugcugguuuuacagcuugccugugcugugcuuuuuguuuuaaacuauaauacaguugucuuugugcuuccaaaaacaaaaaccaaugcagaaaacuagaccuaaaacucccgcuuuggaaagaucgaggacuucagagacagaucugggcucagaugucuccuagcuucuccuucugugaugcuuacuccuucacagugcaaaguuugaggaauaaacacacacguguaugcacuaugcacugccaggcacucaggauuucuucccccaacaccgacacugacugccugggaaccucuugggugucuugauuuuuguaguuuggaagagaagauguuaaccuaccucaccucucaugggguuguaguaaagauuccguauguaugaaugugaaagcaguuugugaaagcagauauuuuaguuaauguuauucuaaaagaauuuugaguaauugguuaauuguguauuuuaaucacuauuauucauuaaucaauuugaauaauguuuuguugcacgcugauauucuauuuuauagacaagguuuuacuaugaagccccaauggccuggaauuucacuguguagaauggauuggucgugaacucagaguucugccugccugucuccccagugcaaggauuaaaagcauguguacagcccccagcaaucaaucaaucaauuaaucaaucaaccaauuaauaucucucucucucucucucucuuuuucccucuucccucuccccucucucuccccuccccuucuucccucuggccuugguauguagauuguccaggcuaccauuucaguuuggaguccuucagccugcuuucacuuccaagugcugacauuuaggggauuauaccaccacauucaguuuuuuuuuuuuuuuuuuuaagauuuauuuauuuauuauaugugaguacacuauagcugucuucagacacuccagaagagggugucagaucucauuauggaugguugugagcuaccaugugguugcugggaauugaacucaggaccuuuggaagagcagucagugcucuuaacugcugagucaucucuccagcccccacauucaguuuuuuaacacaaauuuugccuaggcugcauuuugaacuugaaaauccccugccucaagcuggaaauuacaggauugaaguaccuugucuaaccacauuuauauuuuuuaagaugaaagaguugauaucaagacaucaacuauuaaguauaugccaguuuuguuguucuucugaaauauuaaaugaaugcucauuuacuuugacaccuuauuuuuuucuuagaacuagggaagggcccacucugggguaugcucauggcaucagacuuaaugcauuuagccugacgaggcuugccaauuuugguuuucuggugccaucuauaggugaaauggagaaaagcuuuacucuggguuuguauuuggacugugcuggcacccuggaauuugaaaauugcuuuguuauugacaggucaucuccgcugcucggaucuuacugaggaacccugguaaccaggcugcuuaugaacauuuugagaccaugaagaaccaguggauugauaauguugaaaaaaugacagguagaguucugcagaaugccuuugggcugaugcaugaguucugaggaccucaagcaggaccgguuauaucagcuguaauuggauaaagggacagucagagcuugacagugugcugggcucugauuaggcuguugagcaguggcggcuucucauucaagcucugcuacuuuguuggaugagaggcugugugagcgucuuuauuugagaaccgcccuccggugugauguucauuguuauagccccuaucuucucuuugaauagugucuuugcucagucccagcuagaguuugguuucagaggcugggaggcgguguuuguggauacaguaagugucccugucauuuucagaggguucacauuucaaggaaccacaauagcuaccauuuaacccagcuugucucagaguuuccuccaacuuaucaacuacauaguucuaaaaaaaaaaaaaaagaggagacaucugugccuguacgacugcagaagugccucugaguucucuguagagggacaggacagaaaggcagaaaugaggaguguaggcucuucgcugucccuguagaaccugcugucaggggucuacagcagucagugaugaaagcggagcucccaaagugucgaaagcuagguaacagaaguaagaaacaggcuguuagguuacuggaguccuccguguggcucgucuugggcacuucaagcugccaacaaucaacaggugguggagagugagcccggaagggagagaguguuauuagcagauacugugcuggggaugcggugaagguuuuagacucaguccgguuccuccugaugucuuugcgugucugcuugucugugguggauuuaagagggccagugaccacggucaguauaacuccugaggccaaaugaccuucugggcuguacugcuugcacuucuguuuuuuaaaguuauuuuguucucuugaaagcucucaauuuuguaguaagagcuuugaacugagaagagaauucugaguguuguacuuucucaugagaugcaaacagacaacaguguuuucaaaucuuuguucuucuaaaagcaaauucagcuccauuucuguucuccugacagggcugguggacgaggcuauugauaccaagucucuguuggaugcuucugaagaagcaauuaaaaaagaccuggacaaguguaagguagccauggccaauauucagccucagaugcuggucgcuggagcaaccaguauugcucgucgggccaaccggauucugcugguugcuaagagggagguagagaacucugaggacccgaaguuccgagaggcugugaaagcugccucugaugaacugagcaaaacaaucucccccauggugauggaugccaaggcuguggcuggaaacaucucugacccugguaaggaacagugcauggugccuuucauuccaauugcuaggcuaacucgguggaaauaggaaaagaguagcuauccacaaccaggguauauaaaaucggggagggaacauauggacagugcgugguuuggugcucucucucuugucaucucaacacccaggaggcugaagcagaagaauagcugucaguuugaggucagucagggcagaguuacaaaaugaguuacagaaugcagacauuuagguuuucuucuguucaauauuuuuacggucuugucaggccuuucaguuucugaaucagguucucuaccauuuccugauauugucugacuugcuaucccugcugauaguccuaauuuuggaaacuuuaaaauaaaugcuaguuaucugccaaccauuuaguucaugaaguugcuaccacgucucuuuuacuuuucuugcauauaaugaucuuucucuuuucucuguagagaauuuuguuuuugucagaucuagagagcuucaagcaacuuuggccucuuaggcccuacaugagagaauuugaauuuucuucagcuacauuuugaccauaguuuuaguaccaccaaaggaguuaauaguugcagccacuucuuuggguugcaaaucauguauauuccuuucuuuuuggaaagcaacauuuuccaucucaucagugagaaucuaggcugcuagacucacuucuggccucagcagacucuuccucaaauucccaguccuccaucucuguggauggauuuugucuccuccuuggaguuucucauagcuuagcaguucaagauaaggguuaacacgcugaacgccaacuagagcacagauguagacagaaaggugagauggacucuggggaguuaggaaccuaaucugaaacugccaucucccaugcucugcacuccucagaccuaucucaugaccgccucaucauaagagaagugauggguacugcccaagccaagcauucacacccagcguucuccaagaacucguuacuuuuacaguccaaaggcauccucaccacuguaagagcagccauccugugacacuuccucagggccucugacuuguccuccuuccuuuuuccaugcccaugauuccccccggcagcuccacauccaaccuuguuagugggaaccaguucuucugcuggacaggcagugcucugggcacugaccuacccagcugaaaaugagugucuuguguuuaggccugcaaaagagcuuccuggacucaggauaucggauccugggagcuguggccaaggucagagaagccuuccaaccucaggagccugacuucccgccuccuccaccagaccuugaacagcuacgaguaaguaagcgcagagagauggggagaauugagcagcaaguggcagcaugugugagaggcaggucugcuuuuacagucuccauuuccagguggcuucuguagcuuuuaugugauuaacuagaggcaggucuugauuuucauuccuaaguugaguggaaucauaagccagcacuugugcaugaaauuccaugaaauuagccugugugacagacaggcugagaauggaggagagguaagugcaguugggaugaauugaugagaugugacuuguaguaaauaguuuguacaugcguggugagacuugcuaaggagaaaauugcagaauuagaaccuuguuagguucuugccuuucucucucuuaguaacaaaaguaguauuuacuccuaaaaauuauuuaaaaauuguguaugugugcacucucucucucucucucucucucucucacacacacacacacacacacacacacacacacacacacagaaguacauuuucuugaggaagacagaggucaacuuggguauugucccucaggagccauccacauuaguuuuggagccaggaugucucacugggaugcagggcuugccauuuuuuggguagguuagcuggccagugagcccaagagauuugcuugucucugccuccucaauuauaagcacauacugccaugcuggguugcugcuuuuguuuuuuuuuuuguuuuuguuuuuuuuugagucagaguuucucuacaucgucuugguuguccuggaacuuaacuguagaccaggcuggccuugaguucacagagauccaccugucucuaccuccugagugcuggaauuaaaggcaugcgccaccauugcuggcccaugaugaguguuuuacuugggugcucaggaucaacuagggucuucaugcuggcauggcaaguacucuccugucuccuuagaccaagaaaugguucuguguuuuuaaaucugauucgaauuucaaauuuuuaaaacuuaaaaaaaaauuuaugcguauggaugcgucgcacugcucguaugccuagugcccucagaacccagaagaggguauuggaugcccuggaaccgcaguuguagaugguugugagcagccauguggaugcugggaauuugaacccauaguuucuggcggagcaacaagugcucuuaacugcucagccaucucucuaggcccucaaaucuuuucguaauucuuucccaucaaguagcaugaauacauuuaucauguaucaucuuucccaugauguacuuggggaguaucuuuuaguuauagauccuagaaacaaaaacauuguguaaugaucauguacacaaguauuuacuccaaguaauaagucuagaaacacguuaagacaagaauuauauuuacuuccuuugguauguuuucuuauuuaaugucaguaaaagaagucagguugguuaaugacuaaauugggucacuauacauaaguaggauuggugguuccaguuuucaacauuucuuuacacuuuccaaugaggcuuuugaugaugagauuccugguaaguggcuucuuugagucaugacauuuagaauuagggacauugagaucacauggcagauguagaacuugaggcuccagugggaaguuacugacucucauuugcccuuugacaaccagaaccagaaccaggucuuaaaucuucuauggggauuggcuuugggaaucgcugaucugguaauguuauguaugccuccuaugggauaugagcaacacauagcugcugguuucuuauagagaaaaaaguuuuuauugauauugcacagauguccucaugguucaguguugauggucuuacaugguguuuuuauugauauugcacagaugucgucaugguucaguguugguggucuuacauggugucuacgugggcccauuuccuaggcugguuuugguaguagcuuccugggcuuuacugacaaccugcuuuauucacauuuguagcuaacugaugagcuggcuccuccuaagccaccucugccugagggugaagucccuccacccaggcccccaccaccagaagagaaggaugaagaguucccugagcagaaagcuggugaggugauuaaccagccaaugaugauggccgccaggcagcuccacgaugaagcucggaaauggucuagcaagguaagccccgggacuuucuuuccuugcuggggaugcgugccuuuucagaaaggacggagaacaccccaggaagaaguccaugugaucacuuugcuucuugcucaguuccuucauuucaggcaguggguuuuuaccagcgauuuagugagaagucucuaguguuugauggcuugccuuugccugggcagagguaaaagcugagaugucaguggcuaaagaagagagucuggccccuuuguccaguagagugucagcuguacugauccugacaucuggggucuuuuuuagaaacuguuuauccuuucucagaaucaucuugugcuuuuucucuacuuaggaaugcuccagguuauguucagcucugauuauuuaaaauucuaacuauuccuguggcugagaucugggugcaauccaguucuacugcaugcucaccuuuucccaucacuggaaaugaguaguugguuuuuuuugcuuagagcaaaauccugcugcucaucugccaaugaggauaugguucuuagcucgagacuguaaggaaucagaaaucuagcucuucauucccacuauauuccuuuauauucaucuuaacagaauauacuucccagaggaaguuaaucuuguguuguuguuggauuuuuucuucaggcugagaaauugaccuugguuuguucuauuuuguuuguuucuuguuuuguuuuucaagacaugguuuuucuguguagcucuggcuacccuagaacucaaccuguacaccaggcuggccuggaacucaagagaucccgccugccucuuuuccugagugcugagauuaaaggcaagugccaccacugccaauguuaccuuggagcccagucugguguuggaucugaccaguggaauuauuuauaauggugucucuccaacacucccaggaucauguagcauaauccuacugugaauggacaaugggugacaauaggguugauuucccccaaagaaaaugcaaauguaguuauaaugagccugcacauauugugaaaauguauguggaauauaaagggucagacagcacuggcccauauaguugccccacuaugcucaguguguucauaaguccuggccagaaggucugauuucaugaguuccccgacuuuugacuuguacaaagcuaggaacuauaugaacuauauaugcuuugggaagguauauguguuuguaucugucgcucugacuuugggcagcuuguuacucugaauguuagcagcagucaacuggucuuuccuucaaggaauggggaggagccuugguuguggcaguuuaggugaaaggauuggugguuaccuaaccccuuguuggcccugugucuuccaauuugauugcuacuuugagguggauuuuguguuuaggauaaaauuuguuuguuuguuuguuugauuuugccugcguguaugucugugcaccacaugugugcaaugcccauggaagccagaaggugucagauccccuggaauuggaguuagagaugguugugaaccaucaugggggaggugggaacuaaauccaggucccugaggacaguaguccaugcucuuaaccacugugcuaucuuucuagcccccagaauuucuguuguuacuuuaaaaguuuuucuguuucuugagacagucucaugacucauugcucuccaaccuggucuuuuugccucugccucuggaguacuguuaggauaacacuuuugggaaccuuaaauaacauucuguauaaacauucauuuccuccuggucacagauucuugguguaaaccuuuuuucaccagucuuuuuuauaaauggcucggcuucauuagagcaauuccuuuucuuuccacuccagcuuguuuuuagcaucuguuuuaucuuccuagccucuuagaaucccuguuuuugguacaaaacucacuuucuuuccuucuugguuccugucuuucauaagcaaccacuuggguucauaugaggcuccucugagcuuagccucauuuaguugccaaguccauguguuaccugaucuguguaccaguaagcugaguuuggggugagaagcuguuuucaacaaaggagagaguuaggcuguacuuacacgguggcacuuucaguugcugcagugagauacuuuggaagaguugucucugaagacauuuuuaaggaggaagacaguccgagguguaggguuuucacugcucuaggaacuagaugagugucuucuugggccccuuagagcuagcugggugguuguaggguauuugguaaaccucuucacuuuugucuccugguuugcuaccuuugacauaccauuucuaacguagaacuucugaucccugaaggaaauaaggagagucugggagcugcagagcugugugcuccuggaugauggaauagugauuuaggaggaugcucaguuuuuccuuccaaacagcuuacaugacugugcucacuuuucuccucuagagucucuguaaagguaauggcuacuggguuguuuggcuccccaaacaugugauuguggucaaauuuaacuucagcagcaaguauauagccccugcccucuguggaaacauuuugcuggaucaaauuucuccacuuaucucaaggagacuuagguuggaggcugaguuccugucuuugaaucuugguucccauggcuccuggagagcaugccauuuucuuucccaucccaggcaagcuuugguaacuaaaccagcugaagcuucguucccgaguccuguuguucuuacuaacacuaucccuguuucucacccuucccgccaucgacaaagccggguaucccagccgcucagguggguauaggaguuguagcugaggcaaaugcggcugaugcuguuggguucccuuuccccucugacauggaagacgauuacgaaccugagcugcuguuaaugccaucuaaucagccggucaaccagcccauucuggccgcggcucaguccuugcaccgggaagcuaccaaguggucuaguaagguacugaucgguacccccaguugggggcugcuccaaaugcauccggccaugugcagccuugacaccuugcaucacucauuaucugugcggguccugugagucugagccgggcgggcaauugucugucugcaccuuguuguuaggacuggcuucacaaguuuaauagguuugcuaaugcccaacugaauugcauuuauguuuguggaauacaaggauaugggggucacuuuccaaagaauucaucccccccccuuuuguggccaauacuggagcuauaaacuccuugggaagcuguagcugcaucucuuggugacuucuaggucaggagccauuggggacacucuugaguuccccuagcuugaccacugagcuuugcuuggcucccacugaccucucacugauggcucagcagaguugaucagagcaagcagcagcuuuaucuggcagacucaggaggacugcuugcugcccugcaccuggcugugugacagaugcuggcccucaugggagcccacaggugucucagaggcauuggaaguggccacagggacagcucaaguuaggugacagagccuuggguucauuuggagagcugaggcauagaagugaucauguuuauuuccucuuuaaagauggcauguugcaagaaagagccugaagaugguggguuaauaacuaacucuggcauugugcugucuucuaaccaaugucauguaauccuaaauuacaucaggucuaugcuggaaguuuguccagagggcuucaucuaacacaagccucuccccaugacuuccucccaaaccuguguucucuugccucaguuuaauucccgagacauuuuauacuuucaaagcacuaaugaugagccaguucauggugccuuucgagcucuugcaagaguacccugaguggcaugguuugugugugccucacugcauuauauagaaaucgaaaagcaugaggggaaaaaugaguggggccuggccauucagguaguuuuaaauaguguaguugcuauaaggauauaaauuacucaaauauuuccuuacuuauaauccacgagaguuuuaagugaaccaauugccaaauuucagauaaacugccauuaauaagaggagguuccauuuacagccugacucaggcuuauuuauuugauuccucccucagcauccuaggugaacauuccuuaauuggaggcuucaugaagcugaugggacagaacaauugauuuguuaccuuuuaaaaugugggaugauuaaaauaguaugacaggucaagaggcaguagagggcaaaguagucuagaugaaaaacuauuccaguucucuuguguuucucacuuaggcugagaaucauuaccugggguuuuaagaucuagugaaguugcacaaguccuuggcugcuuuuuacaagagcaaagaugaagaggaugcuuucagcaucuggaaagaugaagaggaugcuuucagcaccuggaaagccuccucugcguucucccucucuggccgccuccccugcuuucuccccuauuauagaagugaagacgccuguaugagcggcuccuuggcucuggcccuauguuauugacacaauuaaccuggagaugcucaagugcuuguccagugcugugccugggacacccauguugcccuuucagacuaauaucugggucuuguuuucagccaggauauucucucaugagugcuggggcaagagcccugucucucucuucugcuucuccagugcuuucuaguaccccaaacaguacucuccccguuuccuguccuuccagagggcugcuagagcagcaggcuuccucccgguuuucuacuuuccuuaacuuggcugguguguaggcagagcucaugcuguaucuaugcuucucucuagggcaaugacaucauugcagcagccaagcgcauggcucugcugauggcagagaugucucggcugguaagagggggcagugguaccaagcgggcacuuauucagugugccaaggauaucgccaaggccucugaugaggugacgagguuggccaaggagguugccaagcagugcacagauaagcggauuagaaccaaucucuuacagguacuugggaaauaggcuguguguguguguccaugguggugggggaugggaugagaggagagagagaacgaguggggagggagggaacaagagagacagcaccuacgugggaagcucggaugaugacugugagggaaacaguagagggaaguggguuacuaggaagaggcacucaagaagggaaagcaacagcauuaagggcaguguggggauacaaaguuuuauuucuuaacccaguagaauuucaaccauauggucaggacugaugguagggauuagaacuacugcauuugugcugcucuuuuauugaguacuuucugcauguuaucaacuggaaauggaguuggcuaugaacuugugggcaagagagccaacaaacgucaaaugaaacuuucucuuuagguaugcgagcgaaucccaacuauaagcacccagcucaaaauccuauccacagugaaggccacuaugcugggccggaccaacaucagugaugaggagucugagcagguaugugcugcugcucuggagucucugucucaagcuucuuugcugcuuaauuucagcuuuaggacaaacuuaccucuaaauugagaauucagcaacccucucuugccuuaccuccccuugggugggccuuacugagucacacgccugauuguaugguagagagcacaucuugguagcacugcguacagaggacccaucauuauuuuaaaaguuaaaaugagagagauagucaauccccacuagguagaccagccgcucugagcgcuacagaggcuacggguacccucgaaacagggaggauaugcuuccugcugcugacacugccauuacuucaguccaguagcucucaucuucauuaccaugggagcuucaucaaaaucccuaccuuccauauauuguaagcagaauuggguccuggauugcuuuccuugguagggugucuuguuccuaaagauaggagaaguugggaaaugaaaggcaggacuaggauuaaugcuaaaucacaucaagcuaauuaaucacaucauguauguugggacuauguguuuaaugaaauuaaaaaaaaaagccuguguagacuggaacaaacugaggauauaagugaaaagucuugagcuggacccugacuuuguuguaugaguuugccuggcaaggauauaagccuuuccgggccugagaccuuuccuaagaaggaagcggaccaauguuuggaauuuagacuguagguacuucucccagagcccucuguauuuuaugcauacauuucacucaugggauacauuuccccgcuuagggaaacucuauggucuuccuuaaauccucaaaagaucuaugacuuacagcuaguuugcugucuuaaagaaugaaguaguugggcuguagagauggcucagcggguaagagcacuggcuguucuuccauagguccugagugcaauucccagcaaccacaugauggcucacaaccaucuguaaugagaucugaugaccucuucuagccuguaggcauacaugcaggcagaacacuguauacauaauaaauacaucuuaaaaaaauacuugaguugucugggugugaguagacagccaacuagauccccaucuucuaguuugguguuuugaaaaauaauguaccauuuuuaagggucgauuagcuugauuauuuucauucauugcuuuugaaaugcauccuguacuaaauaguggagagcagugaaaaaacuaacaaaaaucucugcccuauggagcuuaaagaauacagacagauaaauuaaacuaaacuacccccucccccaaacaccaaaagcaaaugccaacuaagaaaaaaacucccacccccaagcaaucuagguauaauauauagcauaaauuuaugauggauuuuaugaagaaaaauaucuucaaguaaagaaugcuuggacacuggagggggagucuggcauacuuggaagaaaaguguuacagguagaggacauagcaggaguccuaaaagaacaccaccuuucaaaaccagugcaugcugucagccauacaaagacacagugcagucauugauauacaagccaaauuguauaaacauugcuguuuauguaguuaaacuacugguggagcagggggaucggguauagggcuuaacugcagcccacuccuggcagcgagugcugcguuaggggcuauaguaacagggcucuccuauugcaggccacagagaugcugguucauaaugcccagaaccucaugcagucugugaaggagacugugcgagaggcugaagcugcuucaaucaaaauccgaacagaugcuggcuuuacucugcgcugggucagaaagacucccugguaccaguaggcaccucgucaaaucuggcugguacauacaccucugcuaaagagaagagaaccaucuugaguuccagaagccauucagaguugucaggaauggaaacaucaaucccuggcuucacacaccagaaaggaacauuuauacucuugucaugggcacuuugaaaugugucucucuauaaacccuguacuuucaguuacuaugcgcacucucucccauggauuuuacagcagcucagaauaagcgugaacacuagccggaagcccugcucugccccgggggucauuucuguguuuacgguucaccaacucccuuuccccacuauaggcucucaagaccuagagcugaggcaagucuaaauaacugugcuuccaaaguuauuuuggguuucccccccugcugcugacccugccuaccuucucugggcugugcaucauugcugcaggaaaaaguggucucuggagaguucuagcuugugcggccuggauucauuuccugcuuucucccaguguaacccuaguuccucacaaugggaaaccaacuuucacuguugugaggaaaucauuauuucuguuuuuaccaugccacuaacuaguauguguuauggaaacuuccugucucacauccugccuuguuugguugccaagguaaccauccuguaaacacacuggugcucugucacuagaggaacagagucacugggguguuauccugcccauccucccaguggggccacucccagauuuucuaugcuuugucacugccaguagaugucugugcugaggccuuggcauucauucuucgcccuuauuuucuuuaauuucugagcugaagugcugcauuuacuuuuaaccaaaucauccuaggcuuuggcagucuucuucuguaugcuucuuuaaacaagacuuuaaagauacauagguauguguuugucuguaaucccuccaucccccacuuuuuucuuuuuuuuaaauuuugagacugggucucuuuauguuguccaggcuagucuugaacuuauggauucaagugaucuaccugugucagccuguuagcuccuaccaccacacuugacuuugcuuguaacuuugaaagguucauucaaaauugagacuuaagaauuagggcuugcuccuuaagagacuugaauggaaaggcaaucuugucugggagacuagcauuugcagauuauacuucuggugcuucuagggaaaaaucaguaggaacuauuauaguucccaguugcuuuuaaucaacuacaaccaagcauuuuucauccuuccauaaauacgaaguauucaagaauaaugaguaugguaucuauuuaucagaaaggcauguuuccuauugggcaaaguuaguguaaaagugacuuuccuuuuuuuuugcauuuauccuggcuguauaagcauuucccaguauacaaaugcuucuuucagaaaucaggaaccagacgaauacaggagugaggccuucuuccuggauguucuucccacaucuaguauguccaaucccaacacugaacuuguaaaucuuaaguugacccugaauacucaggcucccccuauuucuuuuugcugauaaaagauucuuuucaaagcucucagcagaucuguauaguugcuuaccugauauaaaugcauaucaaugccuuuaaaguaugaaucuaugccaaagaucauuuuuugucuuacuaaagauuucuuagaggaacuaagaagaaucauguuuauucuccaaguuccuucaguucuggagacacauguccaccagaugugcuuucuagugucagugcuuacaguacaaggaggcaaaaggaaacagucccugaaugacguguuagagaugccaccacuaaaaacuauguuuauaagcuaggacuuauauguaaauguuucugccucuucuuuuguucuguuuaaaacaauaaaguacauuuauaugaauaaugcucuaauugagguuauuuuacuaacaacuuuaggucagacuuauuuuguauugaagcuaauucucaaggucuggaaaccaacagcuuuauucaauccauaaaggaguuauauaauaguguaguuacguaagagggucugcgugaucaagaacaaucuuggcaacaauucuagcuaauguauucuuauacauuagaaggagaagaaaucacaaguuaccagugggcaaagcagccaaauguaggucaccuccuggcuagagacacccuaauuuuaguagagaccaccagugucccuuaaaaagcugaaguugugaaaugugagggacacuuuuguuuguucccaaccccaguacauagcuaugggugugaggcagaacuagcuuugaggacauaguccuccucuuguuugaggaaacacugacuaaaauaaaaaaacaaacaaacaugcuuuuuugccuaauuuucuagaacugaagaagaaaaagaaaagguuaaauaauaccacaggguaaacuuuccauugcauugacuuacagaauggauggcagccuguguucacggcugcugaauagacuuggaaaucccugcagccucuauuugcuguucaccuuguucaccggaacugugugccgcagacucugcaguuaguuguauuuuuaagcaguugcuuuuaaggacaacauuaccagcaucuuuccaguguucuucuguagcaccuuuaggaaaugaggcuaccagccgaauuccacugggggguggggguggggcuaccucacccagacaauaaguaucuguuuuauuuacucuuagauuaugauuucuuaagaacaacagaaaaaaggagaauaugguggcuuacccagaacucuguuuaaaaaaucuuuugauacuggguuuuccugggucuauauugaagugguaaggaagauagcuuugaucauuuuuaucacguggucuguuaccagaagaugaaugguuguaaauaugcucuauucaggaagaggccucuucaauguucuucaagcaacuguaacauuuuaugauacagaagaaacugauccagugcagccugcauuaauacagccugaauaugagaauauuccaucaacaaucaaacuuuaaaaaucauuugguugcucauauauuuauugacaugauagccagaacuagagaaagggcuuauuagggucugucaaauuaauaaauacaacaauuuaacaguaaaagaauucagucugcuuagcuacuuuagcagaaaucccuggagacaagaaacuuagacaagaagaugcacaggaaggaagcugugcggucuagguauggucgugagauaaaggauggugaagaacuaaaacuuaugugcuugcuuuugagguaaaagaacaagauacuaaaacuagaacuagaucuuagucaaagggaauauuuuauguuuuuacuuaaaauauaauugucaaucugagauucguuacucaagaaaagucuacuugaaguuuugcaacaguuggccucccuauuagaugggggccacggcggcacugcugcugcaucguuggcacgccaacguggagugagccuaggacaugaccuagcaugguaaggagggacaaaggaugacaaggcagcuaggaagggcaagcacuuuugucuuccuccauuuucuuuugucauugaacaaggauuuccaagugaaagaugcagaauggccugagucacagacuggcuuuucaggaguaaagaccaauuaguauaaaugguuacugaggacucuguccuuccgugaaugguucuuccacguacgcaguacggcaaagacacuuaagugcuucacucgaauuugauaggaguuuggagaaggugucaucacaauggccuggagauauauguaguauggaaaggcgcucccccaaaugaagggcacacaagcaaauucaacuauuuaaacacacaaagauugaaaagagcaacauagugaaacucaugauuuccuucuuuagcuaaacuaggguuucaagcuaauuagguuaguggcauuaaauaaagcuuuaauaaaacaugagaauggcaaagguuuugcuugauuuucucuuuuacuacuuuaauuuguuuaaaagcacaaacagcugugccugcaguaacucgcuaacaacagaaguaguguucccuuucguugucuuaauaaaguauuugcccuuuugaugcaaaugauuugacugugcuaucuuaacagcugaacuaguggcacaagauugauggaauauuuacugcagcaagguccuuguaaaucaaaaucugagcuuuacauaaaaaucuuauuuauaaaaaauauaauaccaaguacagugagaauggagcacggagcuguagugcucccugccagggccauguggaaguggcuuuugcuacagugcuugcuuaauggcacaagugaaaagcugaguaaggcaaacacuugaagaggcaguuuucuguaaacuucuugggguggggcaaucuccucucuugggacagacacugagauggcuaagaucagaaggugugacacuuggcugcaccugacacaucacagacugagacaguuccugcugguagaugagaccaguuggcuugcuuuaggagagaggauaucacuguagccuucugcuuugacuguuagaaugugcagcauucagcugguagcccccauggaagaaaucaucuaaaccuuuuccuaagugaaaagauacaaaauaagcuaagucuuuagaaaacuuuccuuagcuuaaagcuccguaagaacccuacaucaauuacuaagcaacuuuguuagcaggguagcuugacacaaaugcuguauauuauucccacccacuugguaccuaauaguaauaaauugcaaugacacuugaaaaaacaaacugaucuugagcaaguuuggccucuucucauguccucacuuggaacuucccagccuuugugacauauuugacuccuuuaaauggcuu

SEQ ID NO: 7294 - RNA, 107288 nt, Mus musculus
aagccauuuaaaggagucaaauaugucacaaaggcugggaaguuccaagugaggacaugagaagaggccaaacuugcucaagaucaguuuguuuuuucaagugucauugcaauuuauuacuauuagguaccaagugggugggaauaauauacagcauuugugucaagcuacccugcuaacaaaguugcuuaguaauugauguaggguucuuacggagcuuuaagcuaaggaaaguuuucuaaagacuuagcuuauuuuguaucuuuucacuuaggaaaagguuuagaugauuucuuccaugggggcuaccagcugaaugcugcacauucuaacagucaaagcagaaggcuacagugauauccucucuccuaaagcaagccaacuggucucaucuaccagcaggaacugucucagucugugaugugucaggugcagccaagugucacaccuucugaucuuagccaucucagugucugucccaagagaggagauugccccaccccaagaaguuuacagaaaacugccucuucaaguguuugccuuacucagcuuuucacuugugccauuaagcaagcacuguagcaaaagccacuuccacauggcccuggcagggagcacuacagcuccgugcuccauucucacuguacuugguauuauauuuuuuauaaauaagauuuuuauguaaagcucagauuuugauuuacaaggaccuugcugcaguaaauauuccaucaaucuugugccacuaguucagcuguuaagauagcacagucaaaucauuugcaucaaaagggcaaauacuuuauuaagacaacgaaagggaacacuacuucuguuguuagcgaguuacugcaggcacagcuguuugugcuuuuaaacaaauuaaaguaguaaaagagaaaaucaagcaaaaccuuugccauucucauguuuuauuaaagcuuuauuuaaugccacuaaccuaauuagcuugaaacccuaguuuagcuaaagaaggaaaucaugaguuucacuauguugcucuuuucaaucuuuguguguuuaaauaguugaauuugcuugugugcccuucauuugggggagcgccuuuccauacuacauauaucuccaggccauugugaugacaccuucuccaaacuccuaucaaauucgagugaagcacuuaagugucuuugccguacugcguacguggaagaaccauucacggaaggacagaguccucaguaaccauuuauacuaauuggucuuuacuccugaaaagccagucugugacucaggccauucugcaucuuucacuuggaaauccuuguucaaugacaaaagaaaauggaggaagacaaaagugcuugcccuuccuagcugccuugucauccuuugucccuccuuaccaugcuaggucauguccuaggcucacuccacguuggcgugccaacgaugcagcagcagugccgccguggcccccaucuaauagggaggccaacuguugcaaaacuucaaguagacuuuucuugaguaacgaaucucagauugacaauuauauuuuaaguaaaaacauaaaauauucccuuugacuaagaucuaguucuaguuuuaguaucuuguucuuuuaccucaaaagcaagcacauaaguuuuaguucuucaccauccuuuaucucacgaccauaccuagaccgcacagcuuccuuccugugcaucuucuugucuaaguuucuugucuccagggauuucugcuaaaguagcuaagcagacugaauucuuuuacuguuaaauuguuguauuuauuaauuugacagacccuaauaagcccuuucucuaguucuggcuaucaugucaauaaauauaugagcaaccaaaugauuuuuaaaguuugauuguugauggaauauucucauauucaggcuguauuaaugcaggcugcacuggaucaguuucuucuguaucauaaaauguuacaguugcuugaagaacauugaagaggccucuuccugaauagagcauauuuacaaccauucaucuucugguaacagaccacgugauaaaaaugaucaaagcuaucuuccuuaccacuucaauauagacccaggaaaacccaguaucaaaagauuuuuuaaacagaguucuggguaagccaccauauucuccuuuuuucuguuguucuuaagaaaucauaaucuaagaguaaauaaaacagauacuuauugucugggugagguagccccacccccaccccccaguggaauucggcugguagccucauuuccuaaaggugcuacagaagaacacuggaaagaugcugguaauguuguccuuaaaagcaacugcuuaaaaauacaacuaacugcagagucugcggcacacaguuccggugaacaaggugaacagcaaauagaggcugcagggauuuccaagucuauucagcagccgugaacacaggcugccauccauucuguaagucaaugcaauggaaaguuuacccugugguauuauuuaaccuuuucuuuuucuucuucaguucuagaaaauuaggcaaaaaagcauguuuguuuguuuuuuuauuuuagucaguguuuccucaaacaagaggaggacuauguccucaaagcuaguucugccucacacccauagcuauguacugggguugggaacaaacaaaagugucccucacauuucacaacuucagcuuuuuaagggacacugguggucucuacuaaaauuagggugucucuagccaggaggugaccuacauuuggcugcuuugcccacugguaacuugugauuucuucuccuucuaauguauaagaauacauuagcuagaauuguugccaagauuguucuugaucacgcagacccucuuacguaacuacacuauuauauaacuccuuuauggauugaauaaagcuguugguuuccagaccuugagaauuagcuucaauacaaaauaagucugaccuaaaguuguuaguaaaauaaccucaauuagagcauuauucauauaaauguacuuuauuguuuuaaacagaacaaaagaagaggcagaaacauuuacauauaaguccuagcuuauaaacauaguuuuuagugguggcaucucuaacacgucauucagggacuguuuccuuuugccuccuuguacuguaagcacugacacuagaaagcacaucugguggacaugugucuccagaacugaaggaacuuggagaauaaacaugauucuucuuaguuccucuaagaaaucuuuaguaagacaaaaaaugaucuuuggcauagauucauacuuuaaaggcauugauaugcauuuauaucagguaagcaacuauacagaucugcugagagcuuugaaaagaaucuuuuaucagcaaaaagaaauagggggagccugaguauucagggucaacuuaagauuuacaaguucaguguugggauuggacauacuagaugugggaagaacauccaggaagaaggccucacuccuguauucgucugguuccugauuucugaaagaagcauuuguauacugggaaaugcuuauacagccaggauaaaugcaaaaaaaaaggaaagucacuuuuacacuaacuuugcccaauaggaaacaugccuuucugauaaauagauaccauacucauuauucuugaauacuucguauuuauggaaggaugaaaaaugcuugguuguaguugauuaaaagcaacugggaacuauaauaguuccuacugauuuuucccuagaagcaccagaaguauaaucugcaaaugcuagucucccagacaagauugccuuuccauucaagucucuuaaggagcaagcccuaauucuuaagucucaauuuugaaugaaccuuucaaaguuacaagcaaagucaaguguggugguaggagcuaacaggcugacacagguagaucacuugaauccauaaguucaagacuagccuggacaacauaaagagacccagucucaaaauuuaaaaaaaagaaaaaagugggggauggagggauuacagacaaacacauaccuauguaucuuuaaagucuuguuuaaagaagcauacagaagaagacugccaaagccuaggaugauuugguuaaaaguaaaugcagcacuucagcucagaaauuaaagaaaauaagggcgaagaaugaaugccaaggccucagcacagacaucuacuggcagugacaaagcauagaaaaucugggaguggccccacugggaggaugggcaggauaacaccccagugacucuguuccucuagugacagagcaccaguguguuuacaggaugguuaccuuggcaaccaaacaaggcaggaugugagacaggaaguuuccauaacacauacuaguuaguggcaugguaaaaacagaaauaaugauuuccucacaacagugaaaguugguuucccauugugaggaacuaggguuacacugggagaaagcaggaaaugaauccaggccgcacaagcuagaacucuccagagaccacuuuuuccugcagcaaugaugcacagcccagagaagguaggcagggucagcagcagggggggaaacccaaaauaacuuuggaagcacaguuauuuagacuugccucagcucuaggucuugagagccuauaguggggaaagggaguuggugaaccguaaacacagaaaugacccccggggcagagcagggcuuccggcuaguguucacgcuuauucugagcugcuguaaaauccaugggagagagugcgcauaguaacugaaaguacaggguuuauagagagacacauuucaaagugcccaugacaagaguauaaauguuccuuucuggugugugaagccagggauugauguuuccauuccugacaacucugaauggcuucuggaacucaagaugguucucuucucuuuagcagagguguauguaccagccagauuugacgaggugccuacugguaccagggagucuuucugacccagcgcagaguaaagccagcaucuguucggauuuugauugaagcagcuucagccucucgcacagucuccuucacagacugcaugagguucugggcauuaugaaccagcaucucuguggccugcaauaggagagcccuguuacuauagccccuaacgcagcacucgcugccaggagugggcugcaguuaagcccuauacccgaucccccugcuccaccaguaguuuaacuacauaaacagcaauguuuauacaauuuggcuuguauaucaaugacugcacugugucuuuguauggcugacagcaugcacugguuuugaaaggugguguucuuuuaggacuccugcuauguccucuaccuguaacacuuuucuuccaaguaugccagacucccccuccaguguccaagcauucuuuacuugaagauauuuuucuucauaaaauccaucauaaauuuaugcuauauauuauaccuagauugcuugggggugggaguuuuuuucuuaguuggcauuugcuuuugguguuugggggaggggguaguuuaguuuaauuuaucugucuguauucuuuaagcuccauagggcagagauuuuuguuaguuuuuucacugcucuccacuauuuaguacaggaugcauuucaaaagcaaugaaugaaaauaaucaagcuaaucgacccuuaaaaaugguacauuauuuuucaaaacaccaaacuagaagauggggaucuaguuggcugucuacucacacccagacaacucaaguauuuuuuuaagauguauuuauuauguauacaguguucugccugcauguaugccuacaggcuagaagaggucaucagaucucauuacagaugguugugagccaucaugugguugcugggaauugcacucaggaccuauggaagaacagccagugcucuuacccgcugagccaucucuacagcccaacuacuucauucuuuaagacagcaaacuagcuguaagucauagaucuuuugaggauuuaaggaagaccauagaguuucccuaagcggggaaauguaucccaugagugaaauguaugcauaaaauacagagggcucugggagaaguaccuacagucuaaauuccaaacauugguccgcuuccuucuuaggaaaggucucaggcccggaaaggcuuauauccuugccaggcaaacucauacaacaaagucaggguccagcucaagacuuuucacuuauauccucaguuuguuccagucuacacaggcuuuuuuuuuuaauuucauuaaacacauagucccaacauacaugaugugauuaauuagcuugaugugauuuagcauuaauccuaguccugccuuucauuucccaacuucuccuaucuuuaggaacaagacacccuaccaaggaaagcaauccaggacccaauucugcuuacaauauauggaagguagggauuuugaugaagcucccaugguaaugaagaugagagcuacuggacugaaguaauggcagugucagcagcaggaagcauauccucccuguuucgaggguacccguagccucuguagcgcucagagcggcuggucuaccuaguggggauugacuaucucucucauuuuaacuuuuaaaauaaugauggguccucuguacgcagugcuaccaagaugugcucucuaccauacaaucaggcgugugacucaguaaggcccacccaaggggagguaaggcaagagaggguugcugaauucucaauuuagagguaaguuuguccuaaagcugaaauuaagcagcaaagaagcuugagacagagacuccagagcagcagcacauaccugcucagacuccucaucacugauguugguccggcccagcauaguggccuucacuguggauaggauuuugagcugggugcuuauaguugggauucgcucgcauaccuaaagagaaaguuucauuugacguuuguuggcucucuugcccacaaguucauagccaacuccauuuccaguugauaacaugcagaaaguacucaauaaaagagcagcacaaaugcaguaguucuaaucccuaccaucaguccugaccauaugguugaaauucuacuggguuaagaaauaaaacuuuguauccccacacugcccuuaaugcuguugcuuucccuucuugagugccucuuccuaguaacccacuucccucuacuguuucccucacagucaucauccgagcuucccacguaggugcugucucucuuguucccucccuccccacucguucucucucuccucucaucccaucccccaccaccauggacacacacacacagccuauuucccaaguaccuguaagagauugguucuaauccgcuuaucugugcacugcuuggcaaccuccuuggccaaccucgucaccucaucagaggccuuggcgauauccuuggcacacugaauaagugcccgcuugguaccacugcccccucuuaccagccgagacaucucugccaucagcagagccaugcgcuuggcugcugcaaugaugucauugcccuagagagaagcauagauacagcaugagcucugccuacacaccagccaaguuaaggaaaguagaaaaccgggaggaagccugcugcucuagcagcccucuggaaggacaggaaacggggagaguacuguuugggguacuagaaagcacuggagaagcagaagagagagacagggcucuugccccagcacucaugagagaauauccuggcugaaaacaagacccagauauuagucugaaagggcaacaugggugucccaggcacagcacuggacaagcacuugagcaucuccagguuaauugugucaauaacauagggccagagccaaggagccgcucauacaggcgucuucacuucuauaauaggggagaaagcaggggaggcggccagagagggagaacgcagaggaggcuuuccaggugcugaaagcauccucuucaucuuuccagaugcugaaagcauccucuucaucuuugcucuuguaaaaagcagccaaggacuugugcaacuucacuagaucuuaaaaccccagguaaugauucucagccuaagugagaaacacaagagaacuggaauaguuuuucaucuagacuacuuugcccucuacugccucuugaccugucauacuauuuuaaucaucccacauuuuaaaagguaacaaaucaauuguucugucccaucagcuucaugaagccuccaauuaaggaauguucaccuaggaugcugagggaggaaucaaauaaauaagccugagucaggcuguaaauggaaccuccucuuauuaauggcaguuuaucugaaauuuggcaauugguucacuuaaaacucucguggauuauaaguaaggaaauauuugaguaauuuauauccuuauagcaacuacacuauuuaaaacuaccugaauggccaggccccacucauuuuuccccucaugcuuuucgauuucuauauaaugcagugaggcacacacaaaccaugccacucaggguacucuugcaagagcucgaaaggcaccaugaacuggcucaucauuagugcuuugaaaguauaaaaugucucgggaauuaaacugaggcaagagaacacagguuugggaggaagucauggggagaggcuuguguuagaugaagcccucuggacaaacuuccagcauagaccugauguaauuuaggauuacaugacauugguuagaagacagcacaaugccagaguuaguuauuaacccaccaucuucaggcucuuucuugcaacaugccaucuuuaaagaggaaauaaacaugaucacuucuaugccucagcucuccaaaugaacccaaggcucugucaccuaacuugagcugucccuguggccacuuccaaugccucugagacaccugugggcucccaugagggccagcaucugucacacagccaggugcagggcagcaagcaguccuccugagucugccagauaaagcugcugcuugcucugaucaacucugcugagccaucagugagaggucagugggagccaagcaaagcucaguggucaagcuaggggaacucaagaguguccccaauggcuccugaccuagaagucaccaagagaugcagcuacagcuucccaaggaguuuauagcuccaguauuggccacaaaagggggggggaugaauucuuuggaaagugacccccauauccuuguauuccacaaacauaaaugcaauucaguugggcauuagcaaaccuauuaaacuugugaagccaguccuaacaacaaggugcagacagacaauugcccgcccggcucagacucacaggacccgcacagauaaugagugaugcaaggugucaaggcugcacauggccggaugcauuuggagcagcccccaacuggggguaccgaucaguaccuuacuagaccacuugguagcuucccggugcaaggacugagccgcggccagaaugggcugguugaccggcugauuagauggcauuaacagcagcucagguucguaaucgucuuccaugucagaggggaaagggaacccaacagcaucagccgcauuugccucagcuacaacuccuauacccaccugagcggcugggauacccggcuuugucgauggcgggaagggugagaaacagggauaguguuaguaagaacaacaggacucgggaacgaagcuucagcugguuuaguuaccaaagcuugccugggaugggaaagaaaauggcaugcucuccaggagccaugggaaccaagauucaaagacaggaacucagccuccaaccuaagucuccuugagauaaguggagaaauuugauccagcaaaauguuuccacagagggcaggggcuauauacuugcugcugaaguuaaauuugaccacaaucacauguuuggggagccaaacaacccaguagccauuaccuuuacagagacucuagaggagaaaagugagcacagucauguaagcuguuuggaaggaaaaacugagcauccuccuaaaucacuauuccaucauccaggagcacacagcucugcagcucccagacucuccuuauuuccuucagggaucagaaguucuacguuagaaaugguaugucaaagguagcaaaccaggagacaaaagugaagagguuuaccaaauacccuacaaccacccagcuagcucuaaggggcccaagaagacacucaucuaguuccuagagcagugaaaacccuacaccucggacugucuuccuccuuaaaaaugucuucagagacaacucuuccaaaguaucucacugcagcaacugaaagugccaccguguaaguacagccuaacucucuccuuuguugaaaacagcuucucaccccaaacucagcuuacugguacacagaucagguaacacauggacuuggcaacuaaaugaggcuaagcucagaggagccucauaugaacccaagugguugcuuaugaaagacaggaaccaagaaggaaagaaagugaguuuuguaccaaaaacagggauucuaagaggcuaggaagauaaaacagaugcuaaaaacaagcuggaguggaaagaaaaggaauugcucuaaugaagccgagccauuuauaaaaaagacuggugaaaaaagguuuacaccaagaaucugugaccaggaggaaaugaauguuuauacagaauguuauuuaagguucccaaaaguguuauccuaacaguacuccagaggcagaggcaaaaagaccagguuggagagcaaugagucaugagacugucucaagaaacagaaaaacuuuuaaaguaacaacagaaauucugggggcuagaaagauagcacagugguuaagagcauggacuacuguccucagggaccuggauuuaguucccaccucccccaugaugguucacaaccaucucuaacuccaauuccaggggaucugacaccuucuggcuuccaugggcauugcacacauguggugcacagacauacacgcaggcaaaaucaaacaaacaaacaaacaaauuuuauccuaaacacaaaauccaccucaaaguagcaaucaaauuggaagacacagggccaacaagggguuagguaaccaccaauccuuucaccuaaacugccacaaccaaggcuccuccccauuccuugaaggaaagaccaguugacugcugcuaacauucagaguaacaagcugcccaaagucagagcgacagauacaaacacauauaccuucccaaagcauauauaguucauauaguuccuagcuuuguacaagucaaaagucggggaacucaugaaaucagaccuucuggccaggacuuaugaacacacugagcauaguggggcaacuauaugggccagugcugucugacccuuuauauuccacauacauuuucacaauaugugcaggcucauuauaacuacauuugcauuuucuuugggggaaaucaacccuauugucacccauuguccauucacaguaggauuaugcuacaugauccugggaguguuggagagacaccauuauaaauaauuccacuggucagauccaacaccagacugggcuccaagguaacauuggcagugguggcacuugccuuuaaucucagcacucaggaaaagaggcaggcgggaucucuugaguuccaggccagccugguguacagguugaguucuaggguagccagagcuacacagaaaaaccaugucuugaaaaacaaaacaagaaacaaacaaaauagaacaaaccaaggucaauuucucagccugaagaaaaaauccaacaacaacacaagauuaacuuccucugggaaguauauucuguuaagaugaauauaaaggaauauagugggaaugaagagcuagauuucugauuccuuacagucucgagcuaagaaccauauccucauuggcagaugagcagcaggauuuugcucuaagcaaaaaaaaccaacuacucauuuccagugaugggaaaaggugagcaugcaguagaacuggauugcacccagaucucagccacaggaauaguuagaauuuuaaauaaucagagcugaacauaaccuggagcauuccuaaguagagaaaaagcacaagaugauucugagaaaggauaaacaguuucuaaaaaagaccccagaugucaggaucaguacagcugacacucuacuggacaaaggggccagacucucuucuuuagccacugacaucucagcuuuuaccucugcccaggcaaaggcaagccaucaaacacuagagacuucucacuaaaucgcugguaaaaacccacugccugaaaugaaggaacugagcaagaagcaaagugaucacauggacuucuuccugggguguucuccguccuuucugaaaaggcacgcauccccagcaaggaaagaaagucccggggcuuaccuugcuagaccauuuccgagcuucaucguggagcugccuggcggccaucaucauuggcugguuaaucaccucaccagcuuucugcucagggaacucuucauccuucucuucugguggugggggccuggguggagggacuucacccucaggcagagguggcuuaggaggagccagcucaucaguuagcuacaaaugugaauaaagcagguugucaguaaagcccaggaagcuacuaccaaaaccagccuaggaaaugggcccacguagacaccauguaagaccaccaacacugaaccaugacgacaucugugcaauaucaauaaaaacaccauguaagaccaucaacacugaaccaugaggacaucugugcaauaucaauaaaaacuuuuuucucuauaagaaaccagcagcuauguguugcucauaucccauaggaggcauacauaacauuaccagaucagcgauucccaaagccaauccccauagaagauuuaagaccugguucugguucugguugucaaagggcaaaugagagucaguaacuucccacuggagccucaaguucuacaucugccaugugaucucaaugucccuaauucuaaaugucaugacucaaagaagccacuuaccaggaaucucaucaucaaaagccucauuggaaaguguaaagaaauguugaaaacuggaaccaccaauccuacuuauguauagugacccaauuuagucauuaaccaaccugacuucuuuuacugacauuaaauaagaaaacauaccaaaggaaguaaauauaauucuugucuuaacguguuucuagacuuauuacuuggaguaaauacuuguguacaugaucauuacacaauguuuuuguuucuaggaucuauaacuaaaagauacuccccaaguacaucaugggaaagaugauacaugauaaauguauucaugcuacuugaugggaaagaauuacgaaaagauuugagggccuagagagauggcugagcaguuaagagcacuuguugcuccgccagaaacuauggguucaaauucccagcauccacauggcugcucacaaccaucuacaacugcgguuccagggcauccaauacccucuucuggguucugagggcacuaggcauacgagcagugcgacgcauccauacgcauaaauuuuuuuuuaaguuuuaaaaauuugaaauucgaaucagauuuaaaaacacagaaccauuucuuggucuaaggagacaggagaguacuugccaugccagcaugaagacccuaguugauccugagcacccaaguaaaacacucaucaugggccagcaaugguggcgcaugccuuuaauuccagcacucaggagguagagacagguggaucucugugaacucaaggccagccuggucuacaguuaaguuccaggacaaccaagacgauguagagaaacucugacucaaaaaaaaacaaaaacaaaaaaaaaaacaaaagcagcaacccagcauggcaguaugugcuuauaauugaggaggcagagacaagcaaaucucuugggcucacuggccagcuaaccuacccaaaaaauggcaagcccugcaucccagugagacauccuggcuccaaaacuaauguggauggcuccugagggacaauacccaaguugaccucugucuuccucaagaaaauguacuucugugugugugugugugugugugugugugugugugugugugagagagagagagagagagagagagagugcacacauacacaauuuuuaaauaauuuuuaggaguaaauacuacuuuuguuacuaagagagagaaaggcaagaaccuaacaagguucuaauucugcaauuuucuccuuagcaagucucaccacgcauguacaaacuauuuacuacaagucacaucucaucaauucaucccaacugcacuuaccucuccuccauucucagccugucugucacacaggcuaauuucauggaauuucaugcacaagugcuggcuuaugauuccacucaacuuaggaaugaaaaucaagaccugccucuaguuaaucacauaaaagcuacagaagccaccuggaaauggagacuguaaaagcagaccugccucucacacaugcugccacuugcugcucaauucuccccaucucucugcgcuuacuuacucguagcuguucaaggucugguggaggaggcgggaagucaggcuccugagguuggaaggcuucucugaccuuggccacagcucccaggauccgauauccugaguccaggaagcucuuuugcaggccuaaacacaagacacucauuuucagcuggguaggucagugcccagagcacugccuguccagcagaagaacugguucccacuaacaagguuggauguggagcugccggggggaaucaugggcauggaaaaaggaaggaggacaagucagaggcccugaggaagugucacaggauggcugcucuuacaguggugaggaugccuuuggacuguaaaaguaacgaguucuuggagaacgcugggugugaaugcuuggcuugggcaguacccaucacuucucuuaugaugaggcggucaugagauaggucugaggagugcagagcaugggagauggcaguuucagauuagguuccuaacuccccagaguccaucucaccuuucugucuacaucugugcucuaguuggcguucagcguguuaacccuuaucuugaacugcuaagcuaugagaaacuccaaggaggagacaaaauccauccacagagauggaggacugggaauuugaggaagagucugcugaggccagaagugagucuagcagccuagauucucacugaugagauggaaaauguugcuuuccaaaaagaaaggaauauacaugauuugcaacccaaagaaguggcugcaacuauuaacuccuuuggugguacuaaaacuauggucaaaauguagcugaagaaaauucaaauucucucauguagggccuaagaggccaaaguugcuugaagcucucuagaucugacaaaaacaaaauucucuacagagaaaagagaaagaucauuauaugcaagaaaaguaaaagagacgugguagcaacuucaugaacuaaaugguuggcagauaacuagcauuuauuuuaaaguuuccaaaauuaggacuaucagcagggauagcaagucagacaauaucaggaaaugguagagaaccugauucagaaacugaaaggccugacaagaccguaaaaauauugaacagaagaaaaccuaaaugucugcauucuguaacucauuuuguaacucugcccugacugaccucaaacugacagcuauucuucugcuucagccuccuggguguugagaugacaagagagagagcaccaaaccacgcacuguccauauguucccuccccgauuuuauauacccugguuguggauagcuacucuuuuccuauuuccaccgaguuagccuagcaauuggaaugaaaggcaccaugcacuguuccuuaccagggucagagauguuuccagccacagccuuggcauccaucaccaugggggagauuguuuugcucaguucaucagaggcagcuuucacagccucucggaacuucggguccucagaguucucuaccucccucuuagcaaccagcagaauccgguuggcccgacgagcaauacugguugcuccagcgaccagcaucugaggcugaauauuggccauggcuaccuuacacuuguccaggucuuuuuuaauugcuucuucagaagcauccaacagagacuugguaucaauagccucguccaccagcccugucaggagaacagaaauggagcugaauuugcuuuuagaagaacaaagauuugaaaacacuguugucuguuugcaucucaugagaaaguacaacacucagaauucucuucucaguucaaagcucuuacuacaaaauugagagcuuucaagagaacaaaauaacuuuaaaaaacagaagugcaagcaguacagcccagaaggucauuuggccucaggaguuauacugaccguggucacuggcccucuuaaauccaccacagacaagcagacacgcaaagacaucaggaggaaccggacugagucuaaaaccuucaccgcauccccagcacaguaucugcuaauaacacucucucccuuccgggcucacucuccaccaccuguugauuguuggcagcuugaagugcccaagacgagccacacggaggacuccaguaaccuaacagccuguuucuuacuucuguuaccuagcuuucgacacuuugggagcuccgcuuucaucacugacugcuguagaccccugacagcagguucuacagggacagcgaagagccuacacuccucauuucugccuuucuguccugucccucuacagagaacucagaggcacuucugcagucguacaggcacagaugucuccucuuuuuuuuuuuuuuuagaacuauguaguugauaaguuggaggaaacucugagacaagcuggguuaaaugguagcuauugugguuccuugaaaugugaacccucugaaaaugacagggacacuuacuguauccacaaacaccgccucccagccucugaaaccaaacucuagcugggacugagcaaagacacuauucaaagagaagauaggggcuauaacaaugaacaucacaccggagggcgguucucaaauaaagacgcucacacagccucucauccaacaaaguagcagagcuugaaugagaagccgccacugcucaacagccuaaucagagcccagcacacugucaagcucugacugucccuuuauccaauuacagcugauauaaccgguccugcuugagguccucagaacucaugcaucagcccaaaggcauucugcagaacucuaccugucauuuuuucaacauuaucaauccacugguucuucauggucucaaaauguucauaagcagccugguuaccaggguuccucaguaagauccgagcagcggagaugaccugucaauaacaaagcaauuuucaaauuccagggugccagcacaguccaaauacaaacccagaguaaagcuuuucuccauuucaccuauagauggcaccagaaaaccaaaauuggcaagccucgucaggcuaaaugcauuaagucugaugccaugagcauaccccagagugggcccuucccuaguucuaagaaaaaaauaaggugucaaaguaaaugagcauucauuuaauauuucagaagaacaacaaaacuggcauauacuuaauaguugaugucuugauaucaacucuuucaucuuaaaaaauauaaaugugguuagacaagguacuucaauccuguaauuuccagcuugaggcaggggauuuucaaguucaaaaugcagccuaggcaaaauuuguguuaaaaaacugaaugugggggcuggagagaugacucagcaguuaagagcacugacugcucuuccaaagguccugaguucaauucccagcaaccacaugguagcucacaaccauccauaaugagaucugacacccucuucuggagugucugaagacagcuauaguguacucacauauaauaaauaaauaaaucuuaaaaaaaaaaaaaaaaaaacugaauguggugguauaauccccuaaaugucagcacuuggaagugaaagcaggcugaaggacuccaaacugaaaugguagccuggacaaucuacauaccaaggccagagggaagaaggggaggggagagagaggggagagggaagagggaaaaagagagagagagagagagagauauuaauugguugauugauuaauugauugauugauugcugggggcuguacacaugcuuuuaauccuugcacuggggagacaggcaggcagaacucugaguucacgaccaauccauucuacacagugaaauuccaggccauuggggcuucauaguaaaaccuugucuauaaaauagaauaucagcgugcaacaaaacauuauucaaauugauuaaugaauaauagugauuaaaauacacaauuaaccaauuacucaaaauucuuuuagaauaacauuaacuaaaauaucugcuuucacaaacugcuuucacauucauacauacggaaucuuuacuacaaccccaugagaggugagguagguuaacaucuucucuuccaaacuacaaaaaucaagacacccaagagguucccaggcagucagugucgguguugggggaagaaauccugagugccuggcagugcauagugcauacacguguguguuuauuccucaaacuuugcacugugaaggaguaagcaucacagaaggagaagcuaggagacaucugagcccagaucugucucugaaguccucgaucuuuccaaagcgggaguuuuaggucuaguuuucugcauugguuuuuguuuuuggaagcacaaagacaacuguauuauaguuuaaaacaaaaagcacagcacaggcaagcuguaaaaccagcagcuaccuggaggagucgaacgaaggagaagacagaagccaucuaagcuggcagagaggucaaacacaugggagacaagcagcacaugggaaggagaggugcuuuagaaaaaaagcaaaaccaaaauauuggcaggaaagcccaaaguguuaaagaaaacauguuggaauagagguagaaaaaaguaaaggaaaaguugauuuuucugaauaauucagaaaaggaggagacuuauugugcccaaaugacuguagcccuuaaacuucugucuuucuggggguguuguuguuguuguuguuuguuuuucugguuuuuguuguuguuguuguuguuuuuaaucucacuuuuguucugagagauggcucagcaguuaagagaacugacuguucuuacagagguccagaguucaauucccagcaaccacauggcagcucacaaccaucugcaauggcauccgaugcccucuucugguaugucugaagacagcuacaguguacucauacacauaaaaaaaaaugaagauuuguuuuagagaaaaucucuuuaauaaaaaaaagaaagaacauuugaacaauauaauaaauaaaucagcuuuuacaaccugaacugaugacauucucuucugugcccucagccagagggcgcugcauauggguuugcauguguguuaugcuaauagaugguaaaaacaggaaaaaaaguucguauuuuaugaaauuuucugaaaaggcuagauaaagccagcauaguggcacaugccuccaucccaacacuagaggaaauggugugaguucaagaccagccugggcuucauaacaagauccacucuuaacaacguuuuuguuuuuuauuaaacgagugugacuuuuccacauggacugaggcauguaacuccauggugguggaagguauuuuugccuugaguuccauuccuaaugaugggaaagagaaagggaaggaaaccagagaaacaggcaacaugggcacacacacagaccauuucccuccccuccccagagaaguucaacaaaagcuagaaucagggggcuggagagauggcucagcaguuaagagcaccgacugcucuucuagaguuccugaguucaauucucagcaaccacaugguggcucacaaccaucuguaauggggucugaugcccuuuucugaugugucugaagagagcaaugguguacucauauacacaaaauaaauaaauaaaaucuuuaaaaaaaaaaaaaaaaagcuagaaucacagacuuauacagcccagcagaacucccaguaagauuucucuguauuaauagaugggggaaaagcaagucugcaaaaccucacacugaaugcugagcuaaugugucuaaggaagcuagccaggugugguuuaguacaccuguaguccucgcauuagaucauuuuaguccagugugacuacaaaucagaagccugcuucagaaaagagggguuugagagggaaggggaagcuggcugauuuaucagaacucucauuuccagccuuuuguuucccaacuuccuggcuauaguuugguuccauaaugauggauaccaaacuauaccugaguuagcuaugcaguuaaauagaaacuauaccugaguuagcuaugcaguuagauagaaacuauaccugaguuagcuaugcaguuagauacaaaagaaaaauaagcaauggaaacaccuauuuuuuuuuaaucucuucaaagagaugcugugaaaagauagaaacuaaauaaacuuucucuuaauauuauccaaauauuuucuuauuauacaugugugauagggaagaaggcugcuuuaccucuugucuuuugcuuuugaaagaauacugaccauuacuuaaaaauucaaacacugcaaaaauguauaaaguucaaaguuuuguuaaaaauccuagcggucaccaaguuugacccaaugaauauuauauaaauaugcaugugggguauguguguguaguguguguguguguguguguguguguguguguguguguuuguguguguguguguguguguugugcaauguguguguauauaugauguggaugugcauacaagcauuuauaugugugaguggguacauguguagcacaaauguguauggaggucaaaguauguguauggaggacuuuaguguugguccucaccuugcaacuuguuggagacguuggucucuuuguuguuccugaaucaauaugccagccucgcuggccugagaaucccagggcuucuccugccuccacccaccaucuccucugaggagcaccauaugacagacauauccuaccaugacuggcuuuuacaugaguucuggggauucaggcuccagugcacaaaauuauguggcaaguacuuucucugcugagcuauuucccuagauccacaugcauguuuuuaagauuuauuuuuauuauuuguaauuauguguggguauguguauuguauauggguaugugcacaugagugcaggugcccaugaagaucagaagaauuggagacagaaucacaggcacuugugagccgcaugacauggaggcugggaaccaaagugugguccucuggaagagccuuuacgauaacucagcagucauccuaugucccaucccccaacauacucuuuuuuuuuuaauaugugaucuuaacaaagcaucuauaauugauuucauuuccugaauauuacacuaugaugcugaaaggaaaagugagcaaaagcuaaccuggggagugaguucucgggcugucuucacagaugccugaaugccuuccacugucgauuuauuggcaguaccaacagcagccgccuucucugcuguggcuccaagccuuccugaaugguuuucaaaauuggcugcccuuucaucaaauaccuugagaaaaaaauaaaauaaagacauuaaggaaauguauuuccauauaaugcaucaggaaaccugaagaaaggucuuuuuaaucugauucugcaacugcucaaagaucuuauuacuaaaacaauaaucaaauggcaaaucuugaccuuuauguauuuccucagagguucagucuuaagcaucauacacaaagaggcacauccccaaaucuucguuuaaaccuacuuaccaagagcacacacaggacuauauacuuuacaacaaguucacaaaugcaaagacuaaauaauuucauuccccaaaggccuucuuacuuugaagagaacgauaaaccccuccaggcucuaccauagacaaccgggugcauuacaauccccaaguauccacaaagaguccuuaccugacuccagccuccucuaauguaucccauuaccauuaauguuguaaaaacucugcccuugaccucaaugggaaaaacgauagcuugugcucauaccagacagaacacagaggcaaggauaggugauuuuuauuaguucuaaaugcaaaaugguucucucguuuaaaaaguuaacuuuucuuucccucagggauaucauuagagacucuaauuuuaaaaaaaaaaaaaacuaacuuacaaaugacaaaaaaguuucuauuuguuugagugacauuaggaucaguaucuggaaaacaacgucuaccagacagcacugggucaguuuuaugcuacauauagagccugccaggagccuagcagaauacuuccuuuuuuuuuuaaauguccuacugacgauaauugagagugccacuuccauacuuggugucuaacucugacucaagucagacaaucuguaaagguuuuguaguuugauagcaagcuccacucucguuccaauguucuacauccaccaccugaggucccuugacucauucugaucuuuuguuuugauucagcuuccuagccaagcaguguugguugacacaugccauuaaucccagcucuugggaggcagaagcaggcagaucucggaguucgaggucagccuagucuacaaagugaauucuagaacagccaaggcuguuacacagagaaacccugucuugauaaaaacaaaaacaaaacaaaggaaaggaaaggacaggguauuuguaauaauggugccacugugugaauuagcaaagcuacacaucaaucuuauggguguaaaagaagaggcacuuaaccuauccagaaagcaaagaaaacaauaaagaagggagaggaaccacgcagaaaagaagcuggaagaaauuagggggaggaagcaaggacacagaagggccaaguauacaggcauuauuccagacacguaguuacugcagcagcauggaguaagagccugcagccuagaugaaaccaacauacaaagaacagcaagagccagaccacaggggcuccgggacauagcacauugguagagugcuugccuagcgugcaugaaguccuggaucugauccacaacucccacaagccagcuauuauggcacaaucuaugaggccagcccugaggaugaccaggaggcucaaggcuauccucagacuccaagguuagccugggguacaugauaacaaacaaacauuuaaaaaaaaaaaaaaggcccuaucacaaagcuccaucuuuauccuggugccacugagagaucaggagaucagggcuucaugaacucuccucucucccaauugguggcuuaguaaaugauucaaaggcaacagagcuaagcaaccaguuagggaguggagaacaagaauaggauuuaaacuguggcaauaugauaggauucaaaaugauugugauauaaaauuaauaugccugaguuaccuguugguauuaaaggacuaggaaaagacacuagaaacaaacaaucucaaagaaaaauucaccauaugcuaaggaaccuauaaaucuagauccuaaauagacaagacaagcagauagcugaaauuuaggagucugaaauucagaagccugggaugagaagguagcaaaucacccuaguguaaggagacccggaacugaacaccuucuaaccucagccagaaagagaaaggagagucacuaagaagcaagaacacaacauuuacccaaaauaauacacacuggauggcccuccaaauuuuucuccucugcuacuaaauaaaggcuacaaaagcacacgcuucuuguccuugguccuuucacaugcugugugacagucuagacaucgagauacugugacguucucuccaagaguuccauucggcaccaauccuggcuugacugacacugcuuagagaacugggccucaauuacugacaaagcaaagcccuauccacauggaacuuucaugaugacaugagucaaauagaccaacaaagagacaaugcucugugugugugugugugugugugugugugugugugugugugugugugugugugugugucaaggaugaccuucaacuucuaauccuucuguccccaccuccugagcacuaggauucccccucaccagcuucugcagcgcuggagucuuugugcuaagcaagcacucggcaaagcgagcuauagccccagcccaucaaacauuaguaacuucuaagaagaaaaguaggauaugaauaucacgaacucccagggaugagggguggguccguuuguuuguuuguuuguuuguuuguuuguuuguuuuuauguauagucacacaacagugagauuucaacagaaaggugaaaagagugaauaaauauaauuugugaaaaggaaagcaagugucaagggcuugcguagaacauacacacauucaaggaacacuacagguauuuaagguccaugugaauagaggaauugaagagggugaauagugucaccaugagguugaagagguaguuagggaccagacuucaguaguuaagccacuuguacagcucuacacuaauuuacaggugucaaauacgucccaucucuuuacagcuuugcuuucaacaguuuuacauuaaaacagcuauaguagcuggggauagugguacacaucuacaaucucaauauuugggagauggagaugggaggagucacaaauucaaggccagccuaggauauguaaacaagaucuugucucaaaaauacaauacaacauaugagaguaucuacauaauaaaaauccaagcaacauuuaauuuacaaaucaggccuuuuggauucuauucugaagaauuagcuuaccagcacaucacuggucugcuaucuacuguaacaauucuggcuucacucagggacaaagaggagucaacagaaggguuugcacagaauaauuacaucaaaugaguuuaaaaaauuguccuagcugggcagugguggugcacgccuuugaucccagcacuugggaggcagaggcagacagauuucugaguuccaggcagccgggacuacagagugaguuccaggacagccagggcuacacagagaaaccuugucucaaaaaaaaaaaaaaaaaaauuguccugacuuguguugagucuaaaguguaguucagaaagcuguggccugggaagagcucagagcagaaaacuuauagcucagcuuugauuaaagauggcuuccuuguuuacucaagaaauucaccuuucuaaaagacaugaagaaauaguaucacaaagauuaauguuacuucagaaaaugaaaaacaaauuuggagaugaaaacacagaaagggcaucucuccuccaagccacugagacugcuucuagaagaaaccuccgacucuugcaggacauagaugcugcagaggaggcuuuucagaccaagcuuaucccacacccacagccuucgaugcuuucucuugagacucguuacugggcaucaguagaagaacauauccccaagugggaacuguuucuuuuaggaagagcaccauauccaauuggugcugaaaaucaaaaugaggacuccauaccacgcuguccuugaacaugugaucaaccucuugucucugccucucaagugcuaggaaaacagauuuggaauccuacucauaaaacucuugcuggucacuugaaugcacauucaaaaugcaaagccugggcuuccgacuuccaaaaaugcaaugcuuccugacauuuccucgguugccucuugaaguucaaugugaauagcugcugcuacuucaagagugccugauaaugucuaucacugugcaaggauguaugucucucuggugacaucuaaauguugaucguguaaauucuguggcaacacauaauguauuucaaaggcauugccaaguagcaucaaaaucauuuucccccaaaucuggguuuaaccuaacugucaaaucaaacucaaaggaaaacaaauuacaaaguuuauuuaggaaaaaaaaaaaaaagaaaaaaaaagaaagcuguggccuaaguaacccucaucccucacuucuuccugacugcagugauugaugccuccccaugagaacagccaccaagaaaaccacagaggagccaauuguuuguuuuguuuuguuuuuuaacagacgccaaaaacauuuacuucugucgugcuucuugguaugugaugaaaagcaaccccacuugcuuuaaccuaaugaccacauacgcuacaacauucacuuaaagacagauauagcuaacacacuuggugaacuagaacacuccccucuuuuuuacuuccaucuuuuguccacaagcauccucuguacuucagauaccuaccucuucccuauugggugcaucaggaggagcaguggcggcuacugccaacagcuugauaggaguuguaguaucgcugaaaacaucggauaccucuugagucauagcuuccugcaucugggcuuuaagauccuuaaaaauauaguuuauaagugaaaauguauagcaaugcccugaagccacaucuguuaugcccugacuccacugaccuauuuguucuuucuuucacucauuuaccuucagaacuauuucuugaauaucaaauguguacaaagcucagauaugauuccuuucucgauggacacuaugaaacgacaaaaccucaggucugagcacagagcaggcucuaggaugaaaaagagguccucaccauuuccagauuuagccaggccuggugauagcuauauuaacuacuuagaagacucaguacaaaauuucuaaauaguucauuaucuugaaagaaauuaaaauaaaaaaauuaaaaaugggaauaauguuuauagagaaauucaaugaccucuagcuacauggguauaauugcugcaaucagaaaguccugccaugaagauugccaagagcucaaggccagucugggccacagagugagauacccuaucuaaauaaacacugacuaaauaacaguaaaaugauaucagcauagagcaaaaucaugacagaucucuuaauuaaaugugaguuagaaaaauguuaauuguugccacuuggcuuucuccuaauaaacucugauuuucuauuauucuugucucguuuuaauuuucccuaaacccaaaaaucucaagccucaggccaagauggggcagcucagucaguaaagugcuugccuuaccacaugagaaccuguaugugagcuccaaagcucccauuaacaaugcuggcacuggagaagugcugacaggcagguccccaggggcucacuggccuacccuacucugcaagucccagaacaaugagaugcccugucucaaaaccuaaggguagauggugccugacaucugaguuauccucugaccuccacaugcaugcacacccacugcacagaaaucucuucugucuguuguuucucaacacuaaggcaucagaaaguauaccuuuaaggaguccugaagcugggaugcaagugcucucgccugaggacucucccccuccccucgggcagccaggucagccagcugagcuguuagcuggucuacacggucacauuuggcaagaagaucuuggcgauaaggucccaucaugacauuggccagccgaugccccucagccacaaguccacggauggcagccugaccuaaaccaaaaggaaaacacugagcuuuacacagagccagggagacaacuaugcugccacuccagauuuuuuagauagcauuuaauagggguaugggguucccuaguaaacauaacucuuuggaauacacuaugcacuaacuuuugggggggggguaccucacacauaucuaacacugaccuauaaccaagccuaaccuuuauuccuugacucccauucuucccaaugagcagcuuccauuuacuaaauaucuuuuuuugaaagcauggucuauggauggggagugugacauaauggcagacuacuuuccuagcauuauaaaaguaacaaaaacaaaaauauaaccuaaaaauguuauauauuuuuaaaucauuucuuuauuuuuaguuuauguacauuaguauuuugccugauguacacagauagcugugagcugccauggaggugcugcacauugaaccuggcuccuggaagagcagccagugcucuuaaccacugagccaucucuccaggcacgagguuacauguuauuauauuaaccauaacuaucugacugcuuacuacauauuacugaauauucauaguuuacauacauucugauaguaacuuagaaaugaauuaauagaaaaaaaaaucacuccuaaaaucaaacuacagacgcaguagguaugaagaguuuaacagcacugugcauagaacucgagacucaguguuuauguuauuucaguccuauacccaguuacacaucugcccauucucuagccccucacugacacuaggcaucauuaacuuaaacacucaucuuacccagugaauguaggaaaggugagcguuaucuuucaggcucagcaaacgugccaagcaaucauaaaacaaacuauacacaccuauucuugggucuucuuaaaaucaaacuuuuagguuauaaaauuuucaacuuucaacuaggcauugugguacacgccuuuaaugccuguacucaagagccagaugaaucucugugaguucaaggcuaaucuggccuagguaguaaguuccaggauagccagagcuacacagagaccaugucuaaaaaaauuuaaaaaaauaaaauuaaaaaaaaaccaaaccaacaacaacaaaaauauuuaaauuuuuacaggaugcuuugaggacauuauauaccuuuuauugucauucccccaccccacucccucaccaaaaaaaauauauauauauauauauagauauagauauagauauauauauauauguuuaauuggguacuugguaaggacuauaaaaacagaaauacuacagaaugaaaauauguauaggauugauaguaauuaguucaaaguuucaauuaugaagcucuuucuguuuguccacagcacauuuuuuuacucucuaauacuucucaauuaaaucauagaaaucuuacuggccacauuuggaaauggagccacacugaaaagugacuuccugguagcuagagaacccuuucagcaccuuaucaccaauaaucaaguaaauguggcagugaccugcacaucugcacugagaccugcccuuaccgacuccacggucaucuacugugggguuaucaauccaccgcugcgccuguucaaucuugcccucgagguggacagcugcuuuggcaggucugcuguuggccacggcccuguugguuuuggucugcagguucuguagugccgucgccacuuguuuagccaaggcucgagccucuggcgagucuccuuucccccuaaagaaguacagaugaccgucccgcuauaauuuacauuguagacaugauuuauguugagaucauuuaacuguuaaugaauguuaaugagaauggaaauugcuaaugauuaccaaacugauuugaaaugauuuauuuagcccauaaauaugaaaauaguuuaaauucacauuauuuucuccuagcuugagucagucuucacaguuauaccaggucauauuaacugaguucacucacuuaccucuagauugccugcacucucacucugccauguguaaaaucacaagcacaaugaggaacuaggugugccuagauaaccaugucaguaguagaagcaguaucaguaauaacacaacuagucaugaagcuguauuugaguccuaauuuucccagguaugcuacaagcucuccccuuucaucauuuaauccucacaucaacccuauaaagaacaguauaagccaaaauacaaaaccaaugugcaaggugaauaagaucccaucacuuaauucaauagagucaggguucaaauccagcccuaugaguuuagagggcacacuuuucuauuugguuuugauuuuguauuuuaccugagacaggguuucucugugaagcccuggccaaccuggaacucccucuguaaaccaagcuggcccccaacucacagaauccugccugucucugcuucccaagagcuaagauuaaagguguguacugccacccggcuuagaaugcucaaucuuaagcuaccaccuauauuaccauauuguaguaucauauaacccccauucucugccauaauugauugaacuggguggucucuacucaaaaaaaaaaaaaaaacaaaaaaaacaaaaaaaacaaaaaaaaacccugcagucacaaauuacacuuaacuagauucuaguguuucucaaaguauaguaugaaagauaucugggacuuauagauucagauaguuaaguccacuaucaaaaagagacccugauaaguuaugucuaggaugagauaaagguccacauuuuaaacaaaauuugcagguaauccuugguccauacuuaagaaagauuuuucagucaacuagcagagccucuggagcuagaaaaucauguuagaccuggggccuaagucaaaccuaaggaagcgcccccagcaaaguaaacagaaagagugcacagacacacaggauccauuugucgucuaagacacugaaagagaaugagagcuccuagugacuucuagacuuggccacaguucaggcuggccuucuaguagcuuccuuauauauuuucaauaacccuucacuuaguacuugaucuagcagccagagaacuugaacuagugaauugacacagaaauaaaacaaacaaaaaaaccacauuagucucaagaauaaaaacugucccaaaagaacuaauuccaaaaaugugacucugaccauuaagaaaaggaaaagauggggcugagauggcucagcaguuacgaucacugguugcucuuucagagggcucagguucaauucccagcauccacaugguggcucacaacuauuugcaacuccaguggcagggucuucugaccucuguaagcaccagacaugcaugugauguccagacaaacacccauacaacauaaaguaaguaacaauuugagaaagaaaagaaaacacaaagaauccagucaacuuuauaccuugaaauuauugucacaaaaaaguaccuucaucuggcucaucuauaaauaugaaaauacaaugcagguggugguggcacaugccuuuaaugcuagcuagcacuuuggagcagaggcagcagaucucuaaguuugaggucagccuggucuguagaggguuccaggacagccagggauguuacagagaaguuuuaucucacggggaggaaaaaaaaaaaaaaaucaacccaucugacaaaaugacuuauuuuaaaaauuucuuuauuauuuaaagguucucuaaucuccccucuuaacaccauguuuaccaugguuuucccauggcuaguaccgcugcuggguaguugugugcaugucuguuuauguuacaaugauaagcaugaugacugcauucguggucuacaugaaggucuacuguuaucaccauuaccaguaguuaucucuuagucaccuaaaaucauuccagaugucuaugugauaaacuguguuagguccuaggaauucacagucucugucuuuuugcuuucugagccagcaaugcccucgucagaagauucuaaugaaucucuuacuuugggaggauaaaaauaggcauuuuucucacagacaaacagaaauagaacauauaaguuaaguggaagaaauggaauauucccagauguuugacuuugguuauccuuggaaaauagugcugcaggacugugguagaaaagagccacuucuuucccaucaaucccucuguaacuuugcugagggcagguugagaaguucuggcaaggggagugcagccacuauacuacaccccugaccaacauuggcccuccucuagcucucagaaggcuauccucaugaacaaaggaacuauucuggagagauaaacauggagcagugaaggauggcaagggcaccaaccucagacaccagaugggccagccagaccacccuccucacauccuacuguagccuccucacauccuacuguagccuccucacauccuacuguagccuccucacauccuacuguagccuccucacauccuacuguagccuccucacauccuacuguagccuccucacauccuacuguagccuccucacauccuacuguagccuccucacauccuauuguagccuccucaauuccuacuguagaacguucuaggaaauggugcuuugguuugcuuugguuugcuuuggcuugguuucuucaaacagggucucauaucaaauucaugauggaaccagaggagaacuugaauuucugaucuugucucuacuucccaguuuccgggauuauagauaucuuccuccaugccuuauuuuaggaaaugcuggugaccaaacccagcccuacacaagaacucuaccgauuaagcuguauccccagcccauggugcuguuguugaugugauuuuuaaagagagcaauauauuugucagaacaaaggaauaacucuuuucuauauaaucaaaguaggugcgaugaaagccuuuaagagaggaagcuguggcaaggauguuauuacaggaacaaucauccaggaaauguaauuuaagaauccuuuauguaauugcuacucaagaaauagcacugcugggaaggagaaagugccuucuuaugccuccugacucucucucucucucucucucucucucucucucucucucucucacacacacacacacacacauauacagaggagucuuuucacagcuaacuaaacacucauuuuccuugugucgaggacagccauguaacaaacagaauacagcaaggaacgucguaguauauaaaaauagagcuuaaacaugaguucucagaagaauauaucuagauauauucguuuaaagccauuugaucagcaacaaaucaguaaaguucaauuacaucacuguacauuguaaaucuguacaucagauguuacagagguaacaucugaccuagcccugucacaaaccuauguagccuaugcauuuaacaugcaucaugucugagguaggguccaaagaucugcauuuugaggauuaaauaugcauuuaaccuauggggagucaacucuuucugcuccuagaguaaaauaagagagggagagagagugggccgugaaaugaagagacacuaacuagcgugagacuaagaagucagguacguacugucuucgcaagucuccuaguuuagaggucagagcagcuaucucuccaagggagcggaggaugucaucucucuccuuaggaucaucacauaauucugcaaucuuccgagcuucagccaaagccccucgaaucuguucuucucccucagguccaccauuuggauccgccagccaauucuauauaccaaaacagacaauguaaucuacccaggaaacacauuuaaacuuagccaucagaaaugucucuaauguagucacaccacauacuggcacuuuguuuguuuguugguugguugguugguugguugguugguuuugguuuuucgagacaggguuuaucuguauagcccuggcuguccuggaacucauucuguagacccggcuggccucgaacucagaaauccgccugccucugccuccagagugcugggauuaaaggcgugcaccaccaugcccggcuccuagcacuuguuuuuuagagugcuaauucugaucauuuuaugaagguucuuagcucagguaagaucaaaucacuccaucuuuucuuuucuagauaccaucauguuauaucccccauacauucuuaccacugagcuauacuuccagauguguuaaaauuaaaauaaaguucccaggcugggguuuuagcuuaauaguacaaugcuugacuaacaagcacaaggcaagcaaaggcaagcgaucucugaguucgaggccagccuggucuacagagugaguuccaggacagccagggcuacacagagaaacccugucucguaaaaccaaaaaaauaaaagcacaaugcccugaguuugauauccaaacugaaagaaaaaagguaaauaacgacaaaaaggaauaaaauaucuuuguaaguuuuaucccacucuuuuaauuaaugacuuuuuuuuucaaguuuuucaagcauuuguauuuauuaaaugcuugaaaaauauuuuguacagaaagaaucugaaauuugaauaccacuauggccuaauauagucauugagguuuugucuuuuacugucuauuauaaugcuaagugcagacccccaagaccuggagucuguacacagauacuagugauccuucccccaguuaacuaugagugguaaauaaagaugcugacagccaauagcugggcagaagagauauagguugagguuucaugaacuugaggaaagaggaccacaaagaaaagaagaaaggagaagccagcugccaugaagcagaagaaaaauguacuggagaggagaaaggaagccaccaugggauaagggucaagagagugugaacuuagggcuucccaauuagcguuaagagcagcccagauggaacauaguaaauaauaaguaauaacuugggguuaucaauagaaaaguugagucuaacaguauggaggcuaggcagcuacccagcuaaugugcugcaucaggcuuauuaaaaacauaaugggguugcugggcacacgccuuuaaucccagcacucaggaggcagaggcaggcggauuucugaguucgaggccagucuggucuacaaagugaguuccaagacagccagggcuacacagagaaacccugucucaaaaaaacaaaaaaaauaccauaauggcuguguguguuuuuauccaggaacucaauaaccaaaggugggguugaaacaccaggcuaggauuuuuaauauuucuuacuacauacaguagugaauucuaagccaggaaccuguuucaaaaucuaggauuuugucguacucagaccuuuuaacuacuugaaguaccgaaaaugaagaucuuuaauucaaaauauagacaugagucugcaccuaggaugguaugggagacugcuggaaacugaucaucacuaaggagcauccauuaucuacccacaggagagggugacaaaggacagugcagaagagaugcaggauacauaggagcccuucucuuccucucucuguccuggcccuccugagaaccacccuuaccugggcagcaucaaucuucuuugcaaugcucugcuuugaguucgucauggcuuccagcuuccgagcugcauucuccacuuuggcgguaagcacgucgagccccugagacacuugcugggccuucugcauggccacuggggaagcuccuuguccucuauucagcacgacagauauggucauuacauccucucaaauacuuaacacaaauauucauuuaccuaguauguguaauuuucauuagcaugugugccucugucuauuuccccaauaaguucagacagcacaagaaaacagaaaaaagaaaaacauccaaaccaccuacuuucucuuuuguuuuaaaaaacacgcuuuuguuugauuuuguuuuguuuuguuuuguuuuguuuuguuuuguuuuguuuuguuuuguuuuguuuuguuuuuagagaccaggacuuaucuaacuguagcuggcucugaacgaacaccucaucuuccagcuucuuucucaaguaauagaauuauaaacccgcacugcuauguccaacucauauuagcuucuggggacuauuuaaccacugagaagccaggccagcaaauuuuaaugaugaauuuuuuuuuuuuugaacagagcuuauuuuuuuuaagguuuauuuauuuuuacuuauaugaguacacuguaacugucuucagacacagcagaagaggacaucagaucccauuacagauggcugugagccaccaugugguugcugggaauuguacucagcacuucuggaagagcagucagugcucuuaaucacugggccaucucuccagccccaauaauaauuauucuugauuauauaacaaacauaagcuuccguaggaaguuuugauggagaucuuacuguuacagagggcuuugcuacuauaguacugugugcuuuagaaaugaguagcccauuagcuugucuuauuuauggggaaucauauacuuaaauuauuugagaacauagcauauacaguauaagaaaguauaccacauugaaaucaauuaaaucuauguuucuaacuccugacuuuuggccccguuggaauguuuguucucauguuuaacauuuuggggcuucagaguuuauuugguuuaggggaucuuguuguuuuguuuuggagacaaagccuccuauguggcacuggcuggccuggaacucauuauuagggcuaggcugguuucaaacucucaaauauccaccugucuuugccucccaaguauagaaauuaaaggacugugucaccacagcucacagcuucucuuucucacuuauaaaauuaaagugacauaaagugaaggcugauagcaaggcagcguuugcccuguauuaguuauuuauuaaacagaguggcuaaaagggucaggacaauauacucggaaacacacucuuagcucaguauuagacugcuugccuagacugcauaagaguuggaucaccaacacugggaagggaaagggacugugacgguaauauacagggcugaaguauggcucucaguuguagacagcuugccucaauuugugagguccagaguucaauccccagcccaaagcggguugaggguggggaacagaaaggaaagggaaauaugggaaagaaagaaagagaaaauauacuugaaaauacauugagaauacaaguuuauaaauuacuaaucuaacuaaacuaucaccacugcuaugaugaaccuagggaauccugacauguaucuuccauuaccaugcaaccuacaaacaacacagcagguuaguacugagggaugaaaagagcucacugcuccccaugaagucuuaaagacucaugcauuucccucgcucagaaacguagucugcuucugugaaaaaugauaggacuuaguagagaccugauuccuuaaaauaacguuccaggccagaaaguaagacuugccaucuuuuuacaaacucggauuauuuuuagccaccuagacuaauaaauucaaucacaggugugacaauuucaucauuuuauagaauggcaugauugaaucugagcuucuaaguuuaggauaaacuccaaaacauccuuguuucccuuaagaguaaaacgagucuauuauuaacuauuuaaaauuuuaugcucuugccucucuugcuuucucucuagcccucuugcucccucucuccccuccccuucuccccucucuccacaugaccauggccucccucugcuucuuuacuccucucucucucucucucugcuuuucuacaauaaagcucuaaaaccaugaaaacaacauuuuuaucuugagauagcauuuauccuuauuugaucuguauggguguuuugcccacauguaugucugugcaccaugugcuugcagugccugcagaggacaucaaagcuucuagaacuagagcuaccgauaguuggaagcuaccauauggaugcuaggaaccgaacccagguccucuggaagagcagccagugcucuuaccucacugagccccacguguauuuuuuuuuuuucuguguguauguguucaugugcauguuugcauccauguguagaugccagugugugaguguuguuucucagcugucauccaccuuguuuaaucagacagggucucuugggagucuagaacuugcugauuagacuaaggcuagcuggacaaugaaccccaggaauacggcugucucuaccucacuggacuggaauuauagaccccagagugucaugaggucugacuuuuuaacagauucuagagaccuucgcacuuauuggcaaguacuuuacuggcugaacaauguacccaacccuucugcccucuuuuaaaaauccaccuauaccaacaccauauggaaugagcucuguaaacauacugccaggugucucacacuugaggccuuccuacaaccuaagaaaauggaaggaagacugaggaaacacuguccaugguuucuuucaaugguucugauauaugaaucuaacugugaaagguaaaaauauauaugagccaaacucaaacuaaaaaguuuauuaaggucagcgaggcagugguggugcacaacuuugauccugccacucaggaggcagaagcgaguggaccucugggaguuugaggcuagucugaucuacaaagccaguuccaggacauccaaggcuacacaaagaaacccuaucucaaaagaccaaaccaaaccaaauaaaaccaaaccaaacaaaacaaaacaaauuuguauugagacuuauagaguuaaaaauguauucaugaaacccagaagcuugaaguauuacugugcuucagccaucaaaaugauaaaauagcugcugggcacauuuuaaaaacaaacaaacaaugggaagauagcuuucuaaucuuuuaucaugaaaggauaaugcaggcuccagugugaggcaggaccaguuacucaucccuguucuagccuuuucucuuaacagauuaacggucuuucccagacaacuacuucauucuuuugcuuauauucacagcuguguuuuucagaauuccaagugaaaauugccugccacacugugaaagggaugcagaaccaaagagccaacaaugaaaaauuagaagagccaagaaucuugucaaacugcauuggcauuuuuccaaaugggaacaaaacuuauuuugucccuucugcaaaguucuugccaugcucccgacaaggagggcuguucucacugggaaacgggcucagugagacccaugagacugcacagagcugugcccucucccaaggagacacacacuccaaaagccauggggcgccuauggguacaacacaucuaaaacuccacaaaagacucccuaauacuauauagauaucugcauugcuuuagguaaagaugaaugguuucauaagaauaaaaauuucaugugguccaaaagaaguacuuuuauaagcuauaguuagcuuggauacacuuuggaucacauagcaugcugagguuuguuucugugcccuaaagaaacgguaugcuauggacaacagugaucaaggaauuucaggacauucucaaagcaaaagcaaucucaucuccuuuaggaacuucagcucaauucaauccucucaaugucuauaaauauauucauuaaccccauaggaguauuuuuuaaucuacauucuacugcauuauuucaauagcaaacuaaguguacuuauuuagggguaggugcucugaaaacaaagauuugaggaggauaaagggaagguuaaacaaauuauaaggggcucugugagauggcucugaguacagguguacacacaagaauaguguuaaaauauuaacaauuuuuaaaauaaauguacacaguaauaaacacaaaaugaaaaaaaaaaaccuaguaucucauguuguaguggguguggccuaacgcuacuuguauuauaauguuaauuuugguccccaaaauugguuacaggagugccuuacagaaaacacugaggggcccuguccccaauugguuuugauugguaaauaaagaugccggcagccaaugacuccgcaggacagaggcaggaugugagaauuuccugggcuuggcauggagagagaggaggaaggaagagauccaccaugccaggagaaggugaggaaagacgccaugccugaggagugggggacagggaggcaugggcagccgugaagaggcugggagagugcggcccucuggcuccagggcagccaaggcagaauguagaaucuuguaaguaaugacucgggcuuaucaacaggaggcagauuaacgacauggagguuagaagguagcccaacucucacacuauuuaaggcauaucaaaaugcaaaggcugaguguaugucuuucauuuaggaauguauaaacauugggguggauggcaggauuuauauuuaaaaaaguauuguuacacauguagcucaggcuggccuucaguacagcagauagcugaggaugacacugaaaucggguccuccugccuccaccuccagaguucuagggauucgaggcaccugcuccuugcuggcuaauggguucuaggaacuaagcccagaguuacacacauacuaagcaagcaaucucucaacugggguauaucuccagcccuacuggaauuuucuaucuacccauccauaaaaaaaccuaauaauuauauaaugagcucuaacuuuauuagacuuugaauauuuuaaagcucuguuauuagcaaaggacaguucaauacaaucggcguggaccugugcucugaaucaccuccucaggagugagcuguucagcacggguuaagaaaaggagaggacccuuaccuggcucggaggucagccacuuggucagucaucugcccuagcauuuugcagguuccuaggaucucccugcguuccuugccugcacaaaguucaccaacuuuuccagcuucaucuaagaucugccugauggccugcucuccagcauccccuaaaauagugagauagucaauaucuacaccaugaacacaucaauuauccagagagaucccaucacaagucauuccguucaugaaggaauacaagaccugacagccacacacugccccauagacauaaggcgaggcuuaaccacaggcccugugaaggaagauauguuguaccauaucugcuuggagauaugcaguggccauaaguauguggcugaugaaaaguagucucauaauucaacaggacuuaggaccuccaacuuccauuaggcuuuucacauuugcucaaacaaucugaaguggaauaaauauuaaauuagaaaagccaaaagccuuguugggucuuaucuuuauauauucaacuuuuauauaucuuacauuaagaucacuguacaaucuacuuaacuaaguacuuugcugacauaaauggcaccagcuuccaaacagaacuagcaaaaaaggguguuuauucaaaauaauaaccuuucugcuucaggggaugggcgaagcaguaacuuuucaaagacaccggcuuaacuugguuuauuuauucauggugagaaaugagagauuuuaugccuucauccuuuaaggccagggauguuucaauuucucagaacuauggcaggaugccacaguuaccucaggauggugagauuauggaaggauuccucccauuccuucauuugauuugauuuuaacuguuuauuguucagaaaacagaguuuuuuacugcagaguuaccuggggaggcauuggggucacggagccaaccuuuggccugguucaauuuggagucuauggacgccagcgcucucuucauggcuucaguguccuuuggaagagaaaugccacaguucuuguguguuuuguaacauggucucuuaauuuuuacagagcaguaguuacagcacuaacacacaacagcucagguaguccuacaacagccuuaaauaaucucaccacaccacaagucuugugucugucaaaaugcaacaucuugcaugcaaaucuucaguuaauucuauucugccuccuggugucuucaaugcuaaaauugcaaaaagcuuaaaaaacugcucaagccaaaaaaaugccuaaugucuccagcaggaaggagcccugcugcucauacuucauuaucagcuuuccuaauggucgccauccgguaggaaacuuguggagccucaacaucaaguggaagccuugccagagcccucccugcucuaggcaagccuuauuaguauguggugccacaaagcacaguccuuuuaucucuuauuuuaaaaugcacacgcacaaacaccagaugguauuucacuauauuaaauaaaucaaaaaacuuaaagaguuacucauuggaaaaaauaaauaguauuaauguaaccauuuuguuuuaguucucaaaauaaaccacaaaaaguuuuacaagaaggaagcgcacugcuggccuucccugcuguucuucacuccucguccuuagauuuccccccccccacccuaacaaauggaucucaauguauugcuuauaaccaggacucaggaugauaagcauaaaacuaacacagaaucugcuaggaugucacuagaaaacaaccaaauaagagaaaaaaaaauuuuuuugagacagggucucuuuauguagcucuggcuagacaaaauuugcuaugucaaccaggcuggucuguuaacauaaaauugucugauuaaaaaagguaugugccaugacucccagcuuaauuuauaauacauaaaaaauaacagugaaacaaauauccaugugccaaucuuuagaacugggagauuauacagucucucucucccucucuuccucuuucucuucuuccuccuccucuuccuccuccuccuucuucuucuccccuccccuccccucuccuccccuccucuucucucucucucucucucucucucucucucucucucucucucugucucucucucugucucugucucugucucuacaccucugcccccauucucccaccuccaaggguauaacuguguagcccuaguucccuggaacucaucacacagaccaggcuggcuuuccagugaucugcuucugccucaacuucuaggauuaaagguaugugcuacaucuggcccuagucuggccaucucuacuuaacaucuuaaaaaacauucugucuccuuuuuuugcacuagagaacugacucccagagagucaauccaucaaagcauaauguuaacuucuaaaauucuucgcaugcccuuauuccuaaacuuucuuauuuccaguccuaccaggguuguaccaucaagcuuccacaagggggcacugagcacaucccuacuuccaagucagagucaucacuauaacacaaaaagaacaggcugaaaacucagcagcagcugaacccugaugcuucugaaaugucuacucaaaugauggacgcugcuuuaggaccccccuuuucuuucaucuaaaaagauagagagugugcucucauccuaacuuuauucucagccacagcaacaaaaaaagugcacucccgcugggugguaggguagggugaaaaguuacuaaguuacaugaauuaugacagcuaccaauguuaggcaacaucaggaaaaucuaguccaaaguccacucauaaguacacuuaauaauauugcuuaaaucuguuucuuucuucuacuuuguugcuuuguuguacaauaauuuauacaacaagauuugcucccagagcugaauuucaaaugagaaaggccuaaauggauagacucucagguaacuccuaaccucaaaaaacuggauagcuuucaguauuuaccuaccauaacuuauaagauuuuacaauuugccuacauauauauuuguuuauaauaacauaagcuuuuucuugaaaaaauaugugccuaccuuggaaaaaagaaauugugucaauguaaaauuuaaaauucuguuaauaaacaccucugugauacuuuuaauuuuggugagaaaacuaauagacaccuacauuucaaaaucuaaauuccaaagaauagaacauauuuucagaaagucagacagauuuuagcacuaaucuagcaguaauggcuacuaguuaggaagguaacuucaguccaguuuccuacaggguagaugcuaucuuagccaguuucccuucaguuacuucagugaaucucaaggugcaauguaacuuuaucuuacaacuuaagaaacaacgacuugggaccaucugaccuuaagcuugcugaauccaaccucuuauuuuauaucacaugaaacucaauuucuuuuucuuuucuuccaaagaaaguuggcaaauauggcacaaacuuucggcaccagucagcacaucuucaccucgucaguauggguuccgccuaaugcuucucagaagagaagcuccagagcucagacuuacaaucugcgcuagcagaaauggcugcuuugauucuccaacgugucccaaaacgguuugaaacacaaugcaaaaacaagcuuugcgcuaaucagcauccucaaaaaucauuucuuuuuucucuaguaaacucaacagccccuucaccaugaagagaaacugugauucucaggaagaggguaauuuucuucugagcagcucugacaacaccaggaaauuaaaauuagcagaugcuuguuuccccaacucugaaccaagggcaaauaugaaaugaagcugcaauuuuuuuaaauguuauuuggauguuuuccuugcacguauguuugugcacugugugcaugucuggugcuuauggaggccagaagagggcaucagauccccuggcacuggaguuacaggcggugcugaacugccacgugggugcuaggaacugaacaggggucuucagaaagaguagacaauguucugacccacugagccacuccaguccugaagcugcauuuuuaaaccugggaauugcaguuaguuucaagguugguuuuguuguuguuguuguuguuguuguuguuguuguuaguuucuagguugguuuuuguuguuguuguugcugcugcugcugcuguuauauucuucuauauuauauuuguguaugugagugggugacaauguaucacagcacaccugugaaggucaaaggacaguuuacuggagucaaugcucugugacaaugugaguuccagggaucaaacuuagaucaucagaccagcagacacgugcauucacccucugagucaucuuucuaucacucugauuuuuaaagccugugauuuagacaguuauaaaaauuuauaaguuacuuaauagaccuuaaguucuuuuuuugaccagagcugcuagugaucacaguuuagucauuguuguuaaaaacaaauguguucauagacacauguauagauacuuuuugucuccaaaaaaaucucacguauauuuuuaaagggcaucaugucuugagcaaugaaaauguacuagcagcagauauaauauaaauagauuccauaagcacuaagccuagaagucaguuuggagaaauguguguguguguguguguguguguguguguguguguguguguguguguugcucaggaucaaaacuucaguguccuagcagucacuacuguauacuagggguggaggaaggacauccaaaacaaaaacaaggaacauuuugggaaagaacuaacagacucuuaagcuuuaauacacauucaggcuucaagaacaccugugaaugguacugagauucucccgggaggccaucaagaauaaccacaguuagaaaaguggaguucagaacucuggaggcugaagcaggaggauuucuguaaguucuaagcccaccuguucuauauagaaaguuccaguacagucaggacuacauagagagacccugucucaaauaauaauaaauaaauuuaggaagaaaagcagaguccuacaaugcuaguacuuuuaaguuacgaauucuaaauauggaaacuccugcccagcccucuuuccuuucuucuacuaauacuugucaccccaucccuccucacuucugacuccauuucuacaagcaccaaugcucugaacacagauguuucagggaagaacaaauugaccgaugacaaaguugccuucucuacccuugguuucuccucccugauaaaagcuucacaauucuaaauaccuacaccauuuaugagcagaacugacagguggaccagcuaaagauaaccuagaucagaugggaaacaccaauuccuuuagcauuugcggauucccuccuugagagguaaacaaaacaucacaaaugccugaguuaacuacuuagccaaacuccuauagauaaaugucuuauuuauugagggcuaaaacaaaaccugagaauacucaaaaacauguucuaagcuuacauacaaccugaucuuuuuuaaaguaaucaaaauuaaauucaacccuuaaauccuaauggucugcagugaggaugucacaggacagcaaaaucuaacaguauuuccuucuuguugaaaagagcaauaaucucauguggaaggcauccuagucagucacugcccaucaccagccuagaccccagcaggagacucaccacaagaaccaaucaugagucacaguaucugauggcucagcaugaaaagcuaccucuguaaggcucaaaaaaaccgugagcgauaaaaugcuuuuauuugucucucaucucccaacauguaucaaaauauacguaauauaaauaauuuuuuaaaagacuaaguacagaguucuaaauuugcagaguaaaguaagaguuguauugauucauaacauugucccaggaaaaaaugcuggcuucacuuuaaugaucacucuaaaugacucuugauuuaagggauaguuuuuccuuucaacagaaaugaaguacguaaaauuaauauuaaaugugugaaccugagaguugaauguagguuuaacagguacacuaugcagcuaugcauugccucgucgaaaucugaacuuauucagaagacguauuuuuaucaagaauuuguuccacuuacuuucuucccccacuuuucuagaggaaccuucacuuuccagaagaguacugcaccaauggggaagcaugaaacaaguacgggaagacaaaguuaauuacuuauggguagggacggagguacugaaaacugcauugaacaggaugggaaucugguggcaacagacagaccccagaucugacuacuuuacuguuuacacuucagaaaagaaagauuuggaauucuacgaaaaauaaaauacaguguuuuuaauuuuaaaaaaaaagcacuucccuaguuaacacaguccauuuucaggguaaaauuucuuuuucuaaauauucuuauaaccacuaaagaguuuacacauaggguuaaauggaggugaacugggaaggcagcagggcugggaguggcucgucauguguaucuuuuuauacuauuuugauuuuugagucaaguaaauguacaaaacaaaacaacacaacaaaagcaggcagauuaauaaguuccucucguucacucaaaugcuaucuauguauuugagcuucuuuuggccgagcagacuuaauuuauucucacucuugaagaaguuaauuuugcuuuauccugauuaaccagcuucauccagggcaaaugaauaugggacagauucaaggcagcugguaaggagcaggucuauuucccucgucuauccugcccaagucuaugauccuauuacugaaaccaacuaaacuuaucuggguuuugcuuguuuguucuuuaagaagcauuucuugauggugguugcagaaaauaaacucaguaacguauguuuacuuuaaacugagagaucacuuuuccccccaaaacagagaaacguuacaauuaaaugccuguucuuccuuacuaguuucucauccacuggaagcaaaggaaagagauuugguuaggggaacaugaaaucacugaauuauggcugacucacagcuuaggcaacagaacaugcagaaagucaccaacucaagguaaggggaaaaaaaaaaccacuauucuuuacuuccuguccucuuuugcuuugguaguagaagcaggacagcucucuagccuacccauuuuuguugucagcaaaaccuucaaaaagcaaaaugugaaggcccacagagauggcugauaggagaggcacagagaugcaucacuucaagucuucuuucccaagagcugggucccacauaacuggcccagcuacguaggaaaaugugccuuuccaaugaggccacugggaugaauggguaaaaaauguucuuagaggcccugcucaaagaaacaaaagcaccuaccaaauauagaaagccugauauccauagcagucuuuucuaucuugucccauccaccccaaaacaccaacucaauaagacacaaagucaaucugcccagcacagcccagauuuccacauuaagucagauucuggcacauauccgagcacaguguuacacaccggcacacgaaauaaggcauggcacacggcacgagaaagccucacagacaugcuuuuucucuuuuuaagcaaaaagggaacuaaagggcaagagaaagcuuaccuucuaagcucgagaaaaagaauaaaacaaacaagagaacaacaacaaaaagaagaugcacaaagaagucauugggaaguaaaguuaucacgcaaaagcaaaaucaaauaucaagaacuuaagaugauuuuaucauaaaaacuuaaaauauaguuuuacagcccguuagagaacauacuauuaaugagggaacaccucugugaaugaaucuauacuauacuuaaaaguaaacugauuauauccuguuaaauuagcuuucugaacagcaggaggacuggcgauguuaggccccagauuugaccuuaccuucucugagguccugaaggaagggaaaagcagcccuaaugagcacccaacaaagucaaauuauaaagucauuguuaacaaccagcugggugaccuuggugacagcauuuuggucauacgugggaaagcuagacccuggagucgaggcauuuaccacgacugccuacauccugcacuucucuaaggcaaguauaaagcaaaaugccuuggcuucaccagaccuggaagcuuuacccuugcauaggaauaguagaccagagcggcaaccacuccaaaccacuacccauaggcucuaaaaggaagcacauaaugggcucccuuugcagucugaguaccuagagaaggcaaaggaauugguaaacuaacugacaaauaccaagaccaauauuuuaauuacacuuuccuuaggaaaaaacagugaucaagaacacaucuaaaaauucuagaguuuccucuguccacucucuuaaucaaagguuggcuaaggcuaggccuugcaugaaauacauaauuauaggcauguucgcuggcuuucuuaaguucccuggcaacaaucacccauguaaaaagcaaggagcucacccaaggaaguaugauaccaauucccccaccagcccaaccaaugagaauuaagccugaaggaaggcuacacacuucagcuuucuaccaguauuuauccuacaugccuauucuguccaccuuggaacaaaggaaauguauaauggugacaggcaauugauaaaauaauuauguccauaauaucuguguauuucuacaaaauaauagucaauaaucaaagucucccaggagaugagaauuugacauuucucaugauuucuccuccaguaagacuuaccuugcuggcccaggcaucuucaucccaggaagugaguuguaacacacgaaugaucucguuaauuucagcacucaucuuuucuacaguaaaauuucgauuuuucaaagcuucuucuauuccuugguuuuuugaguuuuugguuguaacaaaaaucuucauagcuauaaaaauaaacaagugaucauaauuugaucuuuuaaaaauugauguggagaucagaggcaggaagguggggguuauuucucuuugaccauuugagugggccuaggcagucucugauacauugaaucuuguugcuuaauacuacucacaggugaucuucuauacuuucaacauauauuuugaucuucugaugucuuuaaaagaauauauaaaacaaucacugcaaaccugaugauaaaguuccaauaucagcagcuuucauuguauagcaaauugaaaauacaaagggagcaccacacaucauuggggaacuaauuuaacacagagagaugaucuacaaucacaaagugcuuaauauccuucucaaucagcagcaucgugaguauagcauggccuccagacccggcaaaccuaaugggacagaauaacaaacaccaauagaacuguuggguaaccugcuccccugacacuaugguaggccccaaagacaucgguaugucuuccaggaguucucaguggacaccagugacuucucuaucuuccuccuuccuuucuuccuuuccuuccauuccauuuuguuuuuaggauuuauuggguuuuuuuauaucagagaauuguggcacacaccuuuaaucucagcacuauuccugugaguuugaggccacccuggucuacauagugaauuccaggacaccuagggcuacauaagaaaccauguaucaaaaaacaauccuucccacuccccaaaaaaagaaaaagguuuuuaauuaaauuuuuuaauaaaaauauuuuucuuauuuauguguauguaugugugauugugcgucaaauauguacaggugucccuagagaccagaagaggguauuggggccuggaacugaaggcacugaagcgugacaauaacauacuucauagaaauuuaaauacggccaucuucuaagaauuaaacuaaguaacccacaaccagacuaauauacacauaaucagggaaguacuggcacauacggacacuccguaagcacaaauuucuuuugucaguuaaagcagaaagagagaaagaacauucaagauggugacuauaggguuaacauuuaacacucaaaucuucacccagucuaaaggacauguaccagggaggcaaaggagaacggccuucugagccagaacucauaacucccccugcccuauaaauaaagcaggaaguaccugaaaugagaacaggaagcagcucuuugacaguguucauugaguucaccaacaucacacgguguuccuggugagucaacuccugcugucucucaucaaucauuuuggccaucuuagucauuccuggggcacaaagaagcaauuaugcagggugagcaaggaaacaaaccagaaucuggccuuuucggccuaaauccauugagaauuacuacaaaacuccuaaccuacuaucuaccuacuuaaagacagacauugcuaacuaacuagcauuuauguaauguuacaguuugcagugaagguaauuuacuaaaaagcaauccuaaauguaaucguuuucauauuguauacauacagacuucauauugcacaagaaucucagggaaagcauucuaagaacaguggguuggacuggguuagauguuuuugguuuuguuuguauguuuguuuguuuggcauucauuuauuuguguauugggagaacacauguguggcaaggugcaucucuggacagaggucagaggauagcuugaaggaacugcuucucuccuuuuaccauguugguucugagaauggagcucgggcagacuuggcaagaaucuuuaccuaaugagccuuuaccuugguaauauguuucugaauuuucaaguugauucaaaauaauauuaaaauuagaaucaaaauagaaauauuauaaaaaguacagcuuuuuaaccaucugguguuuuggaaucaaucuguuaguacuuuguuuacuuuggucauuauucaaaagugcucuguaauuuuugaauugcauucauuuauugacggauauguguuaugugaggacacacacucgugucacaguguacguguagaggucaguggacaacuuaggggucaguucucuucuacuauguggcuccugggauagaccucagguuggcaggcuuggcuccaagugcuuuuauaaucucacuggcuagcuauaugauuuuuguuuucagcuuugguguuucaaaucaccccuaggauuucauaagguuuuacagaccaucaagaccaaggagaggcagaaagauggacugcuucugcuucacccugagcaccuuuaacucuguuagauucgcauaaaggcaccugaggaaagcagaauacaggucuuggcuaggggugucccacucgccuaccaugcacuuagccuguguucaucuccaacacucccaaacauaucccagccauuccccagcacaccucuaagccaugaaaaaaggccauucccaggugauccucaacucagaaaaggaguaaguucaaggaacaacuacacuggaccucagaaagacauuguuaaauaaacaccaacauuucaauuuaaaaauaauucacagggcuauaaacaucaagcuaaaaccuauuaagccucuucauuaaccuuauccauacuuuauggacucucgaggauacguuauaucuauaagaccaaaugcuggcaucuguguauuuugaauauucaauacucagaucccuaaauaaucauuucaaaaugauuagcuacaaccacuccucucuccuuugaggccugaucagaucucugcagccuugagcuauggcauaaguccacaauaguaggcagcuaauuagcaaacuaagaagucauaaagggcgaccggccagcuggcagacagugaaggaaugcuguguacugcagaaugggaggucaggauuaaggguggccuucagcauuacaguaguagaaaaguauuuccuucaucucccucaucagcauucacaaaucugguucaaugauuuugacagggcugagacuugcaggaaguagauaacagacuucagagacagcaacauauccucagcagaaacccaucaucaacuccaccccauuuucugcaaggaaagaguauucuuuccucuugaauuaacacaguaaauucauagaacuuuuaauauaaaauuuggguuuuguggggcuggagagauggcucagcaguuaagagcacugacugcucuucccaagguccugaguucaaauccuagcaaacacacgguggcucacaaccaucuauaaugagaucagaggcccucuucuggugugucugaaaacagcuacaguuuacuuacauauaauaaauaaaugaaucuuuaaaaauauauauaugcaugugcacauacgcacaacuaaaaaaauguaauaaaauaaaauaauuuucaaaaggaauagaggugauaagaugguuaucguugucuauuuaaaaaaaaaaauggguuuugcucaccuggcccaagauucuuuguguaagugaccaagucuuccauaguuuccacuaccucugccacuguaagauauuccaaaauuccuuugcaaacccuaauaauuuuacgaaccugaaaaauauauuuaaggacuuagauuagugaauaacacauagaaaauggcacuagagauauaaagcuuuuuaauauguuagcauucuaaaacaaccauccaguauugguuugcaugaucuuguuuuguuuuguuuuguuuuguuuguuuguuugaggauguuuguuuguuuguuuguuuguuuacccuuucuuuuuaauuuugguuuuuggagacaggguuucacuguguagccuuggcuguccugggaacucacucuguagaccaggcuggccucaaacucacagagacccuccugccuccaccuccugaguacugggauuaaaggugugugccacuaugucuggcuuccauuauuaccguuaaaauugcacuuuagaggcuggagagaugacuccaggucaagaacucaugauguucuuccaaaggacccccguuugguucuuggcacccacaacagguggcucacaacugccuauaacucuggccuuaggaauaugauaccuucuucugauuuccaugggcacccauaaacaagcauauaugagcacauacacacgugugcacauacacacacauacaaauaaaucuaaaacuaggcuucugucuaagggaggucuuuaugagccucauauugccuaccucagccucaucgaagguaagcaguaggucagaugugccagaaaggauuccccuagagccgucaaugagguaaucccgcgcaggaaccgaguaugggucugacugaagcaucugggcugccugaacaagcuuggugcaagcauuuucaacccuagggggaagaauauggguuaacuccuuagugaaagcaaauagaagaccaugauacgaaaacacaaaaaaugaauacaugugaaucuauuuauuuuucuauaugguagauagccaaggccaauuuauaacaggacuuggccuuugaaaucucaaaauuugcugcuaguggcaguucauucacucugugcacuaggcuugugaauaacuuguucuuuguuauuucuuggcucuaaaaaguaagagcacauuugacaccuuuacuuuacauggcuguaucuuuguaacucuuuugcuggaauuuuugcuucuuuacuucucccuaucccacacccgauauuuacauaaaagacugaaaaacaccuguaguacugucagacuucacauaagcccuaaaguauuauguagugauuuuuauucuuuucuuuugagacaagaguccuacuauguggccccagguaguguagaaaucauuauguagaccagauucaccuugaagucaaagcuccaucugucucugccuucaagugcuaggcguuauauaaucagacaaaacaaaggaauagggguaaaaggagaaagaauaaaauaagaugcauauuuuauacucaucuugcucaguggauuugaguuaagcaauucuauaaaacuauguuguuaguuaaaagaucaauggcauuaauaacugaaccaguaacuagcaguuuacuacuaguucaguuuauuauagaccacuaagucagccaugaauuuggugggggagggggaaacucauuugacagaggaacucaaaaugcauaaaucaaguauauuccuugacccuacuuacuaaaauauauucauucauucauucauucauucauucaauuauucauucauaaaaagagugaguggguuaucuccucuaaucucaguucaauagacccauuguuuucauugaguaacuuaaagagaaaagaaacaaauuacuuaaaaacauucucacuuaaauuaaaaaaaaaaaaaaggcccuacucauagcauucuuuuguggaucaaaugaaacaauacaaaaauuuccacaaguauaaagaagcauuacugagggcuggagagauggcucaucacuuaagaacacugacugcucuuccagagguuauaguucaauucccagcaaccacaugguggcucacaaccaucugugaugggaucugacgcccccuucuggugugucugaggagaguguugguguacucgcauacauaaacuaaauaaaucuuuaaaaaaaaaagaaguguuacugcuaacaggaagaacuaaaccaauaugaaaauuucaacauaauaaaaaaaaacuaggcuaugaaagauguaaaaaguauuguuauaauucaaaaaacacacuuuauuaaacugagccauaaacacugguaccacaaagcaguaccuaauaagucuagugagaaacaaagaccuacuaugccugccugcccuaccuuaaucccucuaccccuauccccagcucuucuacucuuacuauguacuucaggcuagccuugaacccauuguguagcccugccugguuuugaacuugugcuccuccagccuccaucuuccaugcaguguuaggauuacaggcacacaccaccaauaaugugauguggcuguugauaagucuuaauaaccucaggccuggaccuggagagguggcucagcaguuaagagaacuuguuacuauugaaaaagauggagauucaguucccagaacccacaucagguaguucacaaccggcuauaauuuuccuccaagaaacuacaaacccucuucugaccuccaagagcaccagaaacacauacaugcaaguaaaacauacacacaucgcuucucggccuuuuggcuaagaucaaguguaguaaaacauacacacacauaaaauuaaaauagaucuaaacaaaauuuuaaagauacauaaagagccacuucauucuuuuauacagcuauauaauaacucaugauuuauuagccuacuacaaugaacugccccgaaagcucauuaugaguguguauccacuagcugcucaaucaaaggagcgagugcuguaauuuuaauaugcagguauacagccauccacaaaagucauaugaacucacauuuccaccacaauggaugagagggcagaaacaauauuuacaucaucaacaacaaacaaacauauguaaagaauaaaauuaaaaauaaauaaauaaaaacuuuagaauuuaaggagaaagaagcaaaaaaaaaaaaaaaaaaaaacuacacuaaggaaauaacaguggaauuacuuaaaaccuguaacacuuuuguuuguuucgaggcaggggaaggagaaaggguuucucuguguagccuuggcuguccucuaacaaauaaugauucuccugccucugucuccugagugcugguauuaaaggcauacgccaccacugggggauuggggagaugauucaguagagugcuugccauuaaagcacacuugaggaccugaguucaguccccuauagccauaaaagggccaggcacaguaguggauaucuuuaaccccagcacuuuggaagcagacauuaggaccccuggaucccacuggccaaccaaccuaacagaaucaguaaacuccaggcugaggaaaagaucauuuccaaaaagaaacaaacaaaaaaaccaaaaaccaacaaaaaccaaaaaacuugcuggauaugguagugcacaccuuuaauccuagcccagucuacuuggcgagucccagaccagccaaagcuauauacuaaggcccugucucaaaauuaaguaauuaauuaacuaguuaguuuaggucaugagcugaugaaaugacuuaauaaggcccuuaauaccaaacuaggacccacuugguggaaggagaaaaccaacucuccaaagcuguccucugaucuccacguucccacccacaaaaaguaaguaagcuguuugaaauaaaguauuuaaaagaaaacucaacuagacuaaaaggaauaauuucaaaagcagcguaggaauagccaauuguucauugaagaccacaagucaaagacuccuuacaugauccuuucugcuaccucaggugcuaucuaucucccaccuuucuuuacuugauuggccuccccuuccagugcucaguuuuaagucuuuuccuuuagggaacuguuacuugucucucaaaucuacaggugucuuguguucccacagaacuucucaacuuucucucauaacuuuguaaauucagcacagcaacauaaacaucucauucaccuuaacaauuaccuuaacaauucaccuuaaaaacucacagacauaacacuguacaaauaaaaacugcucaguaagucuuugaugaauacauuuuuaccaagaaaagaaacuuaaaaucaucugagccaaggaaaucauuauauuuauuuguuuagcauuuuuugagacagaauuuucccauauaguccacacuaguuuuggacuuguagccuaggcuggccuggagcucaugauucacuuauuuccaucuccccugcaaagggauugcaggcauguaucaccaugucuagcagaaaauuguuaaauagucccaaacuugguuuuacuucaaaggaacuugauccuggaugaaaauauagaaaauaaacaugcaucacagaaugcaauuccugagcuagaucuacucacaaaaauccaguuacuguauacaaucuucaaacuugaaaaaagaauuuuaaaugccaggaauaacuuauggagagaaaaccuggcaggaugggaaaauaaaauggaaaaggcuugccaagaaucaaauugauuccacacuaaugguucucuugugugauaaaaugauaggcagaauagacacugugccauuuuuuacuacaauaagauuaucuggucaguacauuaaaauuuaaucgcauucauaaaagacaaacaaaucccacuaugauuaaccagcaaucagaaacaggaggagugaaucaugucgguggcaauguuacuuuuauuuaagcauucugucugccugccugccugccucuuaaagugaucuuccacuuugaaauagaaaccuaaauuguagggaaugacuuggaauaagaucacuuuccuaaacaaucucauaaccugacuaugcccuaauaauauucauuuagagaacuuaaagcaaucaacuagugcaagcugaggcuucucugccuuuaagucuucaaccagugcuuguggguuagaucaaacagaccgaugauaguuuuguggaauucuuaacacacucacucgugacuaaaucccuccuucgcacagaauaccgccccguguaaaauaugauaaaagaagggucuaaguuccuuaguccucagagacuuuaauuaucucuaaucaagcuguuuugagcuucacuuuuuuuuccuaaugcaugcuggguaucagacauucauguuaucuaucacucacgcuaccacucagcacaagucacaaaggccagucuccagugucucuuugagauccuuuucaaguagcucucucuugaacguucuucuuccugagccuccagaggccugggguuacagauguguggcacaggcuugauguccaacuuuauuuuaaaacaacagaaauuaagacucacucuuguguagcaucucaacaacagcuaauaugcauugcauccugggguugccauuuugaaaggucaaggauccucagccauuagucaucuagaaaccugagugaaggccacaggcacaguagcaguuuuuagaaaggaguagggaacacagaguacaaaaagagacauacuaucuaguucaaguagcaagugcacagccccaacccacccuaucuuaugcugcaugauaaugguaaaaacacauuccaacccccuguguuuuuauuguucucauccgugaaauccauaaacucccccuuucccuguaccaauuucccaaguacaacacaauacaaagcagcuuucucacucuaagguuuauuuuaguuacguguguauggggguggggggacggagucaaauccacuggaacuggagcugcaggugguugugaacugccugacaugguacuggaaaccaacuagagcaauacauacuccuaaccucuaacugcacguauacacucaaaaugaaaacucugaccacaauaaagcuaagggauaagguggguuugguuuuguuuuguuuuguuuuaguucauuuaugaguauguaucuacaucuauggaagugaaugccacacauauacacaacuuguggagaccagagcaagugucaaagccuuuagauucagacagccccugacaauggugcugagaacugaauguggguccucuggaagaguaguaagcauauuaaaaauuaucaaaacuguuuuuuaaaagcaauaguaaaugaacccuucucuaaauagaguauguacaaacaaagcuaaaucaccccccuacacacacacacacacacagagagagagagagagagagagagagagagcuguucccuaauuuccuuuauuuccgaugagaucagcuaacccugcagacaguuuuggcuucccccaagagauaacacaagaggaagcaguauucugggaaugggacuauuauaaacaucccagccauccaggcuguguguccaaguguugauaaacagcaaacuugaaauccugugagucauaccuuugaauccuuagcaugucaaguucucucucccacuccaucucucuccuuccuccaccccuuuucaaaucuggcaccagugcacagaaaagggauucuaaacuuugcaagguuccaugaaaaacuccaugacccauaagucauggacucuacuguccuuuucucucucaagucaggguuagcguagagacagaaugaacauacaagcaaauguauuuuauaagcacccagaguuuucaaauguaugcugauacuauguaauguaaaaauuauuuuuaaacauuauuaaacccuuuuuaccuucuuguucuaauauauucuuuuaauugacuaauaguuaaagucucacuguuauuauuacuugaagguccuguggaaaaaaguugauagucacuauucuacaucauaauguaaucaaugauguagaagcuuaaauugccuaaacacaaaguaaaauggggcaaauacagugagggaauacuuucccuuuaaaaaaauaaagcagcuaccauuaacugucauguggacuuuaaaaaaagaacaaagucuggagcuacauggcugacaucauagcauuaacuaaaaaacagguacuaaagagcacaucaccaacagaauuuagaaucuaggagaaccacaaacuuuaaaaccagcuuaacaguaucauuuagaaauauauaaagcuuauaccuaaaacuaaguagaaaauuagcauagaaaauuuuaacauauuucaaucauaaaccaacaguuccuacacacaagcaguaagaacagcuaugaguuggacccugguaccacaaaaagaaaagguaauaguaauaaguaaccaugaguaaucaagacugcugcagccaguggacacagagagcuuuagacauuuugucaaacuuucaacaguaaauaaucuuuaccuuagguaaccauuuuaaagaccaggaaaagaaccuauuuuaugaaaauuaaauaaccuugauauaaacuuguucaagaacagaacaagaaaauuauucaacaagguucuucaugaacaaagaagcaaaaaccuuuuaauauuuuagcuacuuagggacagagauggcucaauugauaggugcuugccaccaaucuuagaacccacuugguggaaagggaagaaaugauucuugcagggucuaucuaacuucugaccuccauaaacauacacacacaaugaaauacauauaacaaaaacauuaaaugucagauaauuaaaucugguaugacggcuuacagcuguaaccccagcacucagacaacuguagcaggaggaaggggagagggaaucugaggucagucaggaccauacggugagauucagucuuaaaaaugggguggggcacaccauccuaacccaacucagcacugcuguuugguugggcaagaagaucuugcuaugcagcccacgcagccuuuguagcucaggauggccucaaacuagcaaucguccagcuuucaacccccuaagugugucccaacucccuguuaaugcuuuuuaaaaucauaaccaaauacaauuuauccaccaaaaaaaaaugcaagcaugguucauuaucagaaaauguacauucauguaguggacuacugguuaccauaauacaauaaaggaaaaaacugugugauugucucaauggauacugaaaaaaaacauuaaacaaauacaagcuauuuguguguguguguguguguguguguguguguguguguguguauaauucagcugaagauaacugucuaaaaccuuaagacccugggucugaucuccagcacaacaaguaagucuuaccaugagcagaaauauaaauaaauauaaauauaaauaaaaucuuaccaugagcagaaauauagacuggaggaaagaaacgacuaucauaauguuuuuaaaguagcugaguuuauuuaagaaaguaauuuuaaaaaaaaagagagagagagucuguggcaggaguggaccaucagcaaaccuccuccccucuagauaguuuuaccucuauuaucauucauggaugccuugaagaaacuagccuacuaucagccagcauucucacaaaggagagggagagugugacuuagcacaggccuugcagucagacagucuuggguuaggaucuucugccaucccugggcucaguuacuuucaacaaguuacugagcuucugagccucugcugccucgugaacaaaaugaaguggauuaaauaacaagcaguccacacauggaauuuaagaaauagagcuguuucauggguuccuuggcucuacucugggaagaacaauaaaaaucugaaacaauuuaaggaaaagcaacauauaaucuuuacacuuuaauaaugcauuuauucauuugagauuugaacuauauuggaaaagucaggguaauaaaggaauaguguuucuaucugccuuucguccuguuuaacuuauucguaugugugugcaugugugugugcgagagugaguaagcgcauguguaaguguauguuuguauggggggaugagagagagagagagagagaguguguguguguguguguguguguguguguguguguguguauucaugugcacauaguaaagucuuaacucauugagugucuuccucaaucaaauucaacuagacuggcuacccaguggguaaaccaccaggacucuccagacuccacccuacccccuggcccccaauguugggguuacagguacauaucacuggguauagugauauacccaaccuuuucugcaggugcuagggauccaaacucacacccucaugcuuacacagcagguacuuucugcagugagucaucuucccaggccuguuuguccaggaaaaaccuguggcagucaacagucucuauauaccuaugggaugagucacuuagucaauaguaugugugaucccugaaucuguaaaagcuuaguacuuucauucuuuacaguuggcacauuuuaagacaaaggagccaaggggauggcuuaguguaguacaggacuugcugugcaagucuggcagccugaguuaauauccuuggaacccacaagagcuagaugaggugcagcuuacaucuaucagaagaaucaccaaagcucacaagaacagcaacaggacagaaacaaaagguaacccagccucaauagcagagaaaaccaaguccuggaaguuauccuccgaccucacagccacauuagggcaagcacaugccugcacccucacauagaccauaaaccacauacauagaaacauaacaaauaaacaagaauuauuaagacagugaaauauaucacagauuacaucuguacuuuucuccuuuuugaaacacuuaggaaaagaauaaacuguuaucuucuaaaaauaguacacaacuuuaaucccucaucucaggagccagagacaggugaauuuaaauuuaaagaagucagcuuggucuacauagugaaacugucucucaaagcaaaacaagucauuacuguccgagagucacacuucuuucuggagaaccugacuauaaaaugaacauaccuucagaaaccaugaaaucugcaauaagaaaguaacagggugaucuugggugaguugguuugucaaggauuggucuuuuuaucuauauaaugaguuuauuacugaugguguacaccugcaaucuugggaucaggauuuuaggccagcuuuggcuauauaugcagcucaaaguuaacuuaggccgcaugagacucugccucaaaugugagagcuuauuuuaaaugagcagaaucuuuacauuggcauucucagaauuacauggugucuuagucaggguuuuauugcugcgacaaaaaccaugaccaguaguaaguuuuggaggaaaggauuuauuuggcucacaaguccacauuguuucucauuacugaaggaaaucaggacaggaacaggcaagaguugaugaagaagacauggaggggugccuccuuuuuggcuugcucucaugacuugcucagccugcuuucuuauagaacccaguaucaccagaccagggagguacuacccacaauagacuagaaccucccccaucaauuacuaacuaagaaaaugccuuacagccagaucuuauggaggcacuuucucaguuaaugucccuccuuuuagguaacuaguuuuugugucaaguugacauaagacuagccagcaaacaugguaauauuauguauauacaugcuaguaauguauaugugaucucccugggcccucugagcucuuuucaaccuugugauuacucuguagacaauggaacacaagugacacaagccuaauguuuuauuugcucauuucuaauugaaggguacauaaaguaaacaagauuuaauccaucaaccuauuuagaccuugucugcaaauuaauaaacugagucugcuuauuacugagaagauucaaguuauuuuuaauuagauauuuucuuuauacacauuucaaaugcuauccugaaaguucccuauacccucccccccgcccugcuccccuacccacccacucacacuucuuggcccuggcaucccccuguacuggggcauauaaaguuugcaauaccaaggagccucucuucccagugauggcugacaaggccaucuucugcuauauaugcagcuagagacacgagcucugaggguacugguuaguucauaugguuguuccaccuauauggcugcagaccccuucagcuccuugggugcuuucucuagcuucuccauugggaacccuguguuccaucuuauagaugacugugagcauccacuucuguauuugccaggcacuugcauagccucauacaagacagcuauaacagggucccuucagcaaaaucuugcuggcauaugcaauagugucuggguuugguggcugauuauuggauagaucccuggguggggucaaguuauuuuuaaggaaguaaauccaaaauggcaguaugcagccauguuugguacagcaaguccaaaggggagcuauuuaaaaucaagagugcuugcucugugucaaaaaugcagucaggcagcauuaucucaugaaauuuggccauucaguugaagagacaaaagucuucuuaaaauagcaauggaaaggaucacaaaaaucucaaguuaaaaaccagacaaaacaacaacaaugaaagaauaaaacaaaccacccuaaaacaucagaagcauacauuagccccaggcaaacaaauggcauugaaugauaugauuuuucaaaaaauucuaaaaaucaaaaauccuaugcacuuuaaccaaccaguggguuuaaaaauacaaaucccaagacaauuguuugcgugcuuaagaucaaaagaaaacaaaagcuauuuauaaguacuaauaauauaaaacaaaacacuauuuaccuuaggccaaaaaagaccuaaauuagaucuaguuauguuuuaauaccuuuaaaauguauuuguuauacauaaauauaaacuguguuaaaauuguacagguaugugccaaaaugaugcugaacuaagaguguucaauaaggaugagggcaaggugcuucccggggaaacacagcgaauggauggcgcaccgagcucucuuucacacagcacucucagaacauuguuuuauucugcaggccuagagagcccaauaugcuucagaaacaauccaagcuggcaaaucaaccagagcuuugacaguucccagcaagcuguugagagcagcagcgaggcagaagguaacacguuccagucccugugcaagagcauuugccagccugcagcagaacgugcgcacucugcuccuuacagggacuucaugcacaggaccgcaagugauugccugagaacacugccgggcacugagcagccuuagauggggccaagaaauaagaaugaggcaggugaaccucugugugaggucuauauaaguaguucaggauagccagggcuacacagugaaacucugucucaaaaaaaaaaaaaaaaucuguuuaaagaauaagauucuacuauauacuacaaagguaauuuuuugccaagaaaaauucaaacaauucaucagaaacaugucucaccugcaaggaaucaauguggaucaaaggaaucaaaguccauacugacagaaaaugaagcuagccaguuggacacacaacuuauucuucauuuuagcacugccaccuacuauccacugugaaucugguuaugaaccuugcuaaaaaaccacguucgugcugucauccuguggcucuaaaacuacaaagcuucuuuccugccagcuggaaauuccccagccaggcuuucaaggacuuucaucccugggcccagccuacugcacgaggcucaguuccugccaccucugccaucaccagcccuuuccucguacaccuccaugacuuacauccacgucuuacugcauccacacuagcuugccuucucuguucucccaagucacacacugaacaugacaccaccuccuucuacuagucacgccuacucugacaguucuauuaaaguccauuguauccugaauuuugaaaguucucagaauaucuccaccuuuuguuucucuuugauacauagaaaaagaaaccuguaauccaucuagcucagggagcucaggcagaaggaucuugaauuugaugccagaugagcuaagugugagacuuuuucuuuuuuucuuugaaaaagaaaaacaaaagacaguucauauauaugacacgccccagcaugcccccaugugugugacuagaacuacgugcaauucccagacauaagagcuguaacuccacucauuccuuuuccaauaagaacaacaacaacaacaaaaaacauaguaaaaagcaaagcagucuacuacacuucagugaaaguguaagaaaacaacagaaagcagagaugagggacgugugauugaauagucuucauuuucuuuucuuuccaacaacaccuacuccgaccucuuggccaguuucaauggacuuauuuuaauuuuuucucuuaaucuuauauauguggguguuuggucggcaugucuguguaguauaugcauacgcugccuggugccugugggagccagaagagguucuaacgcccugcaguggagguauagguggcugugugcuacagcgugaguacugggaaccaaauccaguuccuuuagaagagcagccauccucuaaccugcuaagccaucuugucauccuucaauuucuuuaaaguaucaguaaauauuguaguuuauuacuauuaauaaacuacuuauaauaccuuucacaggggauuuuucacuguauacugcuaugaacugcuauucuauguagcaaugagcaugcuagacaaauagagugcaauaaauaauuagccaaugaguaugucuaggcuauuaaucaaucaauuauauauaaauauuaauuagugcucagcugacugaugaugauugaugaaaauuaaaaauauaaacaugggaugaaagagccgcaaugccugcugacaguuucuaaaggacaaaaccacuucucaggaggcaagucuaacauuucaauagcccaucauggcuacugcucuccuaaaguuuaugaggaucaaaacaguuucuauggcaacuauuaagcaguguggcuaugauucaaaucuuggguaaacuuagugaacugugaacucauuuuccagugcagucagagaccaaauaacuuguuccacccacacaaagaaagccuugcuggguccugcaaauuuuuuucuguauuaaaaugucauuguuuugguuugcucugguuuuguuuguuuguuuuugguuuuguuuauguuuuuucuuuuucaaaacaggagucuuacuauguaacccuggcuguuuaggaacucaauuuguaggccagaccggcccggaacucacaaaaaucugccugucugccugucuuugccuccugaguguugagguuaaagaugucugucacuguacccagccuuuaacaggucuuugagaagaaggaacauccugagcacugcaaguccuuccauggcaauuacaacauaaacucaguuugaauaguccauaucaaaacuaaaaugcuugagaucagaaauaauucugauuuuaaggguuugggggccggggggaucaggguuuguuuguuuguuuguuuuacuagaauguucaaccugugugucacuuuuaauuaauauuaaacccacuuuucaauauucccugaauuguuuacaaguaaaccuauaauuugauuuugagacuaccucaaacccugaaauggcauauccuucccugaaacccuuuuaaauauauacaggaugaucugaauaugaaccuagccaugcccaagagccuucugcuuccuguagucuuagcauccucacagucuagaaaggaaaccuaagaguaaguuccuaaaacuuauuuccuuccuugugcugccuaaagagcagucacuacugagauccauguaacacagacuucagaggcagcaaaggucaguaaugcccuggaaacauccaaacauccaccaaauagccccaaagaauguccuacuccacaauuccagggauggaauuaacugcuuccauuuguuucccucugucccuuucccgcacagccaagacaucuauuuucugcuuccuuacaaccuaaagaaaagcaagaaaagcauaaccauuguguuucaaauguagagaauuuacuugccuccagagcagacaaccacauacaucuuguuugggcuuuaagcuacaguaagauuuugguggagcuaauuaagugauacacuuuuuaaauaaacggcucaguaauuuucaguucauccuaacacacugguuuucccauguucacugaaauauauacaaugaugaccuucuaucauuucuuccauauuuacaguucacauucuccucaucaaauagggcuacaaaguaacucugaaauaaacuuuauacaagaauagcaggagaaaaguuuauuuuuuuuauuuccaguugcuaaaggauugcuacccuaguuaccaccaaggguaaucuacagggggcggggcagggcggugcgggguguuguuuguuauaggauuuauuuuauuuuugaccuccacauacacaugaacacacacacacacacagagggagggagggagggagggagggagggagggagagagagagagagagagagagagagagagagagagagagagagagaggggaaguaacucuugggauuaauuacuuuuucuuucuaucaagaauacuauucuauuuaguaacaaauuguuaguuacucacuuaauaaaggcugguggcauaucucucuucagaaucugauccucaguggucugaacagucucuuuuccaaccuacaagaggaaggcaugagucaaacaucaauucucagacuguuaccuucacuuacgcaugucugaaacacaggcaugguagcacauacccacaaucugaucacucuagaggcugagucaacauuguuaccaguuugaggccagcauuuaguaccuaucaaaagaacaacaaacaaaauaccuccacaaucuaguuucaaaagugagggauuuuucaauuauuaagaucacucaaaccaggcauaguggcacccagcuguaagcaauacuucggagaaggaagcaggaggaugagcagcucagcaccaucuucauuuacauacauuuacauagugaggucauuuacauacauuuacauagugaggucauuuacauacauuuacauagugaggucauuuacauacauuuacauagugaggucaaagccagcagaggcaggagaacuugucucaaaaggaaaaaaaaaaaaaaaaaggaucauucccauaucauguuuucacaaaauaauuagagaacaacaugaagucaaaacagugcuguuaccauucuuuaaagaaacucggaggcaucacugagaaaagugagaaaauagagaaaccuguuaaaaauacacaugcauaugcuacacugaaaaacaucucucaacaacuuaaacaguaaaaugaauauauaaaauaucaugcacacaaauauauguguggggaugagaguaggagaaagaugggaaaaaaucuaaugaaauucugacucugauacuagaaaucaaacauuaaaacaugaaaccuuaguaugauauaugcauauauaugugugaguauauauagauagauagauauagauauagauauagauagauauauauauacacacacacauaugugugugugugaaaauaacauucuuuuccagaucuuagaagcaauaucaccaaaaguaauaguuacaauaucacaaaaguguucacuaccauguuaaucauaacaaccaaaguacuuuuaaaauaauucaccaacagaaacaguuaagcaaauuaaagcacaucuuaauucaagggaaggucaauaugguuauaaagacucaaugcugugggaaacuacuucugaccuuacauuucccguugaagaacgacagcuacaugugguagcucauaccuacaaccucagcagcagggugacaaguguauaaaaccuggguacagagugaacuccaggccaguuuaaaaucacaaaaccggucuggaacaacagcucacuguuacacuggccugguacauacaugucuugggaucaauucccagcuccccuccaaaaauaaauuaaaaauaauuuauaaaauauaaucuuuagauuguuaacacuaagccaugugugcugguucacacauauuauuuuuguuguuguuguuuuuuguuuuguuuuuuuugagacaggguuucucuguguagcccuggcuguccuggagcucacuuuguagaccaggcuaaccucaaacucagaaagcugccugccucugccucccaagugcugggauuaaaggcgagcgccaccaccgcccgcccugccaggcugguucacacauguuguuuuggcaccuaggaggcugagagaaaaucaccauggguuugaaguuacccuggguuauacacugagcucgaggaaagccugagcuacagagugaaacuuuaucuaaaaaacaaaaaauacaugaugcauuaaaaacaaaauuaugacuggggagcuagcuuaguugguacuugccuggaacacacgagaaccagacccuaaguucuagaacucgugugaaaaagccaggugugguagcacaugcuuauaaucguuuugcugggaauagggagacaggcugcuagucuagacuaacuggcaaacuuccaauuccaaugagaccguguaucaaaaaauaagauaagacagcuucuugagaacaccgccugccaugaccucuggccuccacaugcaaaugcucauguaccuguaggcacauguaccuacauauguguaugcauacacacauaucacaacuaguaacuaauaauaagauuugaauuagcaaauaaaacuuaucauccucagcaccacaaaaauugucaaaauauuaagucacugaacaaccaaccaaagagcauucauaagcuggacccaguuacccacccucccccucccuccacacacauacacauagcagaugugcagcuugguauucauguuggucccucaacugggauggcuaggcgggagggggggggugcacauaucccuaacucuguugccuaccuguggauccuguucuccuaacuggguugccuagucuggcuucagugggagauguccccaaugcugcagugauuugaaugugccaggguggauugguacccaaggggacuucccucuucucagaagagggaagcagggaugauguaaggggcugugugagaggggcucugggaggagaggguagcugugaucaagauguaaagugaauaaauaaguaaauggaaaaaauauuaagucauacuaacuagacuguauaaguacuugucuaaguauuauaccacaaauuauaaucuuccuuauucuuuucaaaaaucauuccugugcaaagguuagauguccaauauuauccccuuguauccucacuaucuaaucugccaaggaggugaacuauacaucugacauuaccaaaagcuugagaaaccacuucgagaggcaacacuguaagcagugaaacucacccacucuaucagcaucaaucuccuuagguaugcucagucaugagguuaaacuacuucacagugcagaaauguaaaauuucuuaagcccggguuagggaacaucuuaauccuacuuggccauuuaacuugugauuuaggcuuaaagaaaaaaagugaguaagaaaaucccuaaaugcacaauaaaucagcuaaagaaaaggcuacaauauacuauucuuagagaauacaagccacacauaaauuacugaagacgaguuuuuuuuucuaucaaguuaauagcucagaaagagcaacacacagugcuguguaagagccagcacucccacagacaauagacugacuguagcauaauaaaagccuuucaaaucagcagcugcuuuaagaguuucucagauaaaauaugacagaauauuuccagauguauuguucacuauguuugcaggcugaaaccaaccauucaaaaagcugugggucaugauuucaugaaguaaaggacgaaguucaggcgugaagucaccaguucauacuaagaauggacuuaaaagaacaaucacaguuaagaaacauggagagcccuuuuaaaguauacauagggagcaggagauggagaaacaggaaacagaggaggaagaagaaaggaagugagaaagaaugucagacagggcucuagguaguaaagaugaagcagauaguaaguuuccugccgauauggaaauuacauucuaguaagguugcacagaaagucacaaauaaauagagcugagguugaggcucaguugcuagacugcugccuagcaugcaggaagguagagcgcuggccaagcaugugggaagucccagguuugauccucagcacugcauaacccaggaguggugcaacacucagaaggcagaggcgcgguacacugauguacacacacagggaaacacucacacacauaaagugaaauuuuaaaauaaacauaaaagcagacaaaaccguuuguucuaaagaaauaauacuagagccaagacuucuaagccaaggaggaaacucucauccuaaagaucuggacccagugaccaugcuacucagaagaccagagaaggaagauugcaaguucuaggccacccugaauaacccagugagaugcugggucaaaagcauaaaccuauucuaccuauaaccauugcagguucccaucaguuaacacaguaucuagggaacuagucuccuuguuuguuuuguuguauuuucuuuuuuuuuuuaauucuuuuaaagauuuauuuauuauuauaucuaaguacacuguagcuguuuucagaugcaccagaagagggcgucagaucucauuacggaugguugugagccaccaugugguugcugggauuugaacucaagaccuucgaaagagcagucagugcucuuaaccacugagccaucucuccagccccugaauuuacauuuauaaaacaugaguacuauaaaaacucucuacauggacaugggaaggcuggagaaaacauuacuugucaucucuugcuugguggcuucaaaacccaaaguuuugucuuugguuugucuggacuuuuuaucaguuguuuacaaaccaguagaugauaucauucugguccauuauacccuuagaaacuggcuucucugaaugcccuggaugcuagaaacuuaugcaauaacauggaacuguccagaaguucaacagagaugacagcucuucaacagaccugcaggucaagauagccuaacuguccuuucuaaaccauuuccuuagcugaagccccuccagccugugcuuccgauucagcaaaccauguauucaaacccaucauacuaagcccuuccugugcuaauuuuucuggcugauccuuugcuucaccaccuacaaguuccaggucuagcuauuucuuuugugaagaagucauuugguaaaggcaaaaaaaaaaaaaaaaaaacaaacaaaguugaugaguaacagaagaaugaguuauuagggucaggagacaaguaguuuuagaagauuaauguucaggguuagaaguucaguguuagguuuauuauucccaauaggucaguaaugugucucacaccugugcagcaccacaucacaaaacaccuggccuguuaagccaaaggcugauacaggauagagucugguaccucauuuauuguuccagauuagucaauaaacagcugugaccucagauacuuuuccuuuuaauuacucuuuccaacgcugugaccuaagugccuuaggggaugaggugauagcucagugauuaagagcacugucuccucauccaaaggacccaaguccacauuccaguaucuuugucaacaauuucagagccacuaaugacuccagcuccagaggcuccaauucccucuucuggccucuagcucacacacacaaacacacauaauaauaauaauaauaauaauaauaauaauaauaauaauaauaauaggacuuuuaauuaaagggauaaaauguagcaauaaguugguaaacuuuugauggacucuaauaacuuauuaauaacaaagaaagaauuaaagugaaugaauuauuuuuggacugcaauguaaugaaccaaauauuuuucaauaaauuacagcaauacuacuguaauucuuauaaaugaaagcaaauaaacagaaauuuucuacugaaaaacaaauuugggaucuugaaagauagcacagcaguuaaguauaaguuuguuguucuuucagagauccuaaguucagcucucauuagccgcauccaguugcucacaaccacuuguaucuccagcuccaggucucugacaccucuggucucugugcacaccugcccuugugugcauuuauccacacacagauacauacacaugauuaaaaauaauuuuuaaaauuuaaaagcaaagaaauauuaacaaaugguucuuaauuacaugagguucugagcaaguugucuggucacuguuuuaaaucaguuauaacugcaaaaugucaauucuauugcucuguaguacccagauucauucacugcuagccagugcucuuaagaccugauuuauauucaauccaaaaucaagugcucccugccaacuaugugucgccuaggugguaggaaaagaaaaagaaagaacacauccuuggucacauacacugaaauagugguagugaaugagaaacaggccugggagcagcuucaggggacuuggaaggaagccuuguuucuucugaaggcucuuacuuugcucuguaguuaauuuaaauauccuuuguucaauaugugacuuucaaaucaaaaauucuauauaagaaggcuuuugucuuccacuauuguuauuauuaaucuuuucaucacgaccuacucaaguucuaaaauguagaaugauugcuuucuuccaggggaaaaggagaguggggaggugcuagccagguuccuaccuagacugaaaacuauguuaauagaugucucccuuagcuucacuaaggguaagaaaaugguuaggacaaaacacagcagagaggauuuguaucagcaguuuguguaguauaaguggugacuacagggcuuuacaaaagguggcaggguggcagacauggcgcugcgugcuguuacccucauagucuuaaaugagcaggacugugaaggaagaauccaggccaggcuguaaaguaagaccauguuuaaacauuagguuuucuuucuuuuucuuuucuuccuuccuuccuuucuuuuacauacaagcucucacuauguaguucuggcuggucuagaccucacuaaauagauuugcguagccuugcgaccaccaugaucuugauaucacagagaucccccugcccucuaccuuuggaguggugggauuaagggugugugccaucauacucagcuagacaauaggaucuuacucuaagccuuuacacugccacaguccacaagggcaaucauuuaugagcaaccaaucaagaucagacucgggcaugaaauaguacucuagcucaaaucagucuuuaaugacacuguuagccugagcaacccauuauacagaaaagucauugugacauauaaacguacccaaugccagguucaggccaucugauaauaauguuugugaccugccaucagcacugucuucuauaaugaagauagauuugcauuucacccaaccucuucacugaaaaccuuugacaaucacuccuaacuggacagcccaucggguguuuaaaagucauacauccagaaaaacuaggacaggaauccacucugcuuuccaauuuagucauucauugaaucaagcaugcacuaagcacuuccuauaugguaagcacuguguacaucaccaugggauacaaguuaagugaaucuaccccauaaccuucuuagacaagacaaaugcuuaagcaaaucuugugugcucgaccaggguuacauccacguuuccaugacuuauaaaacacuagagagaaaaaggcguucaggccaacugacgauucuccaggagaaacggaaaagagggcuuucuaaucacuggguaucauacaugagagcauagccaguuuagaaagcacagaucuacagggaagaaacaugggguacugagcagagaagaaaugugaaaagguuaggaaauuacagaaccauaaagaagucacgccaugaaaaguccuguauguaauacuaugggcugaaauagccucuaaacaaugggaaauuuuucauauuaacaaguaauucagaccugcgggcuuccuugaaaauuggggaaaucugauuaucauuaaguccuaguuccacaugacaauaaacuggagauuguaauaacuuguuagggacuacacuguuuuaaauaccccaguccucauaucuccuuagaguccuguagcuguccugauucacucacuaaccacuaggcugcagcaggcagcaguuguguuuccuaaugcuaccaaacaagauuuaauuuugaucaguacagugaauuagacuagcucccuaauagcauggacuuuacucaaaacgccuauuucccuaaugaugaaacggucuauugucccccaauuauuuaucuaaacagaaaaaaaaaagaaaacuggauagagaaagacacaucauggaaaauauaauuucagaugauuuauuuucuuauuaauuauuuuugguaccuuccagauaggaagaagggcagaugaauaugcauugccuucauaauuaggaaauuccaaagugcuggccaagcaugauggcacaugccuauaaucucaguacaaaggagguuaagacaaaaggacuguaggucuaaggccaaccuggaauacaaagcaagcucaagguuacagaguuugaagccaacaugacacacauaguaauacuuugacuuagaagaaaaagaaaggaaaggaaaacccauacuuuaucaacaauauccuuuggcacauaacaauuuauagaauguaagaaacuguuaguacugaaaguuucaacuuguaacaaauuucaauaaacuaauauauaugugcacaaauaagaacacaaucaugugagccaaauggcaggugaaccauguuaauggcaacuuguaacaucaacaagcucauccaacaccauaguuuccuggaacucaaguuaagcugccuuggcagcagcuguuuaugcuacccaacaacugagauugcaugcauucauuaaggcuggauaaauguuagcagagcagcuugguucacuagacccuauuuaagaaggcacugugauuaggcuuccaacgugcaaagacuuccuuccacgugcaaauacuucauccucucucaacucaaaauucuuccauaggcuuuacaaccacuuacagcugucuucuagagagccaccaaguuaacaggaaaacagaccacaauacaugcuuagauauuccucaccacccacuuuccuaccaauucccucaaagaaacucaaacuaggccucuuccacuucaugaauuggguauuguggggugagaaagaauauagcaguuuuauuccagauaucucauuucaagaaugaagcucuaggucuggagauguagcuuggugguggaguaccugccuagcacgugccaggccaugcauucaauucccaggagaaagaaaaagaggggaaaggagaagagggagagagagagagggagagagagagagagagagagagagagaaagggagggaaguggaggagaacaaugagauuugcaaaaguuauuucucuuaagaaacuuaaaggcccaccaaauacuacaaacacauguaccuacuaggugaauucuagaucccccaagucccaagcuuaguccuaccucuaauauuaaaucaagcacuaacuauaggaaaacaaaaaaggauuuuuugguuugcuuugguuucugguauuaaaaagacuacuuagaggagaacucaguagcauuccccaaugauuacaauuaaguaauuauugcauacucauaaauacugaugaggaaggaaagaucuuuggaugaccugaugcuauuuuuaauaaguguuucaagcauagugcaaauuccuuagggaaauugugacuucaggucuaagaaugguuuuucccucacagccaugacacagugacuggcacagaguaagaacucagaaaagaacugcucacugaaacaggaaaaaaauuaaagugaggagccgggccuguugguauuuaauucuacuaacaucuuaucugcccacacuuacucucuaauuccucuacuccuccuaauuuguguacaacuaagaaaaccuuucuuuuauuuucauuucuucuucaauagaucuagaaacucuaacauucuauaacuguauuaagaugaccagcuaggauccccuaugccacuaaaauacaauaugaauaugaaauuagaguagaaaagcuaaauacuggaagaaguucaguugacauuaccaucugucgugucauaagccugaucaaggaaagggaaguaauccgugagaauguaccauucaugccuaaugccuuaaaccggcccccagaaacuccaccaccaaaauccaagcuccgccuuucucacugcugccuucuaaucaaacccacuuuuucuaaagucuuccacaaaaacuuacacgugugggguuuuuuucuguuuuauuagcuagaauuacaaacacauuuuuuccuuaacaguuuuaaguucacaaauaugcagaauuuaaaaaacacuguagccaaacaguguaacuaccaccaaaacauuuucaggggggcggugggggugggugguuguauuuugccuuuauuuuuauuugcuuguauuugggagggggaggauuugagacagggucuugcaauguagcccuggcugaccuagaacuggcuauguuggccaacacauuuguggcuauuuuucugccucaacuucuuuacuccuaggguuacaaggcaugcacaaaaauauaaauaaauaaauuuuuccaggcagugugguacauuccuuuaaucccagcacuugggaggaagaggcagguagaucccugaauucaaggccagcauggucuacaaaucgaguucaagaacagccagaacuacacagagaaacucugucuugaaaaucuugaaaauaaauuaaugaaugaauaaaaauuuaauauagcacaugcuucaugucaggacuuauuauuuuaaaucuuuauaacagcuacagaagguggauacaacauauuuucucauuuuucaaggaguuaauugauuugccuaaaaagucccucagauugugacguucaucuacacagauccaugcucuaauccuaacuaaucccagcagaauagaagcugcuauuagugccucuuuacaugacaaaguggguuucaaugaugucugaugcuuccugaaguuaucuuucaugauccuauaaucuuauaaaaauguauggcauggcaagaacaggaaaacuugagguugacaaugagucaauaggauguaggaccaggaugcagucuaacugauagacaacuguccugguuucuucccauaggcuaggucagucagguucauuugggcuccguguccuuaaucuuaacuguuauucacuuaggaacuaucaacugaguagaggcuaagagccccuggcaucuacauaaaagcugguagcagcagcgugugucuuacagagacagaagguaucccacagguacucuggccaaccaucuagccagucagagagcuccaaauuuagcaaaaagauccuacaccaaaaauuaaggugucaacuacuaaggaaaauauccaacaucagccucuggcuuccaccuacagaucagguguacaacacaggaauacgugugugcgugcgcgcacaaaaguguacacacacagauaaccuggcuucaacuagcuuuuaaaguugaaccaagacuaaccuacaauauaggccuuuuucuuuuuaauuaauaacuggugccaaaaucugaaauaguaacccaguggcaagucuuuaaauguuuuuauuaaugcuaagagucauuccacuugcuaauuggagauuauucagaguccuuuuacaauacaauaauugaauuuggcuccaggccacaauaaacacucugacccauuaaaucagggccaaagcaacauuucacuauuucuuuguuaguggacaagcaguacucaagccucaauuucucauaagcagccagagcucaaaauucuuuucuguaaaauacaggaaucaaaugacaagcugccaauuaaaaugcccccccaaaaaagagacucucaggauuaucuacacuaaauaaaugcccaaaguuguaucuuuaaggcuuuuucuucuucuucuguguuguucuguuuagcuaggggaaggggggucagaagaagcuuacagaauagacuugcuucucuccucccaccuuaauguggguucuggggaucgaacucagaucaucaggcucguacaacaaguacuuuuacccacugagaucucuucuagauaguuuuauuuuuucaacaaaugcaaacacaauccagugugaaacaauauaggcagagcacagacucaguugcaaacaugcugaaaugugaaauaggagaacagugcuguaccucaggaccaaacuagccaagauguacugacagaagaaagccacagccauccccagcggugcugccugaguuugugccuucugcagauguacaucuuauccuugcuccucauguaacauuaacauagcacuggacuagccaagagaaagacuuguaggaauauuaagcuuguuuucuuugcuuacaguacaaaauaucaauaccgcaaucuaaauauugaacauuugucagagauaacugaaccauuaggauacuccaacccuacuaucucaaaugacuauucccagagggcaaagugaggacugaauuagaaagaauugagagaauaaacaguccauuacuuuguuguuuaaaaaaaaaaaaggcuucagagggcuggagagaugacucagccauuaagagcucugguugcucuuucaaaggacucagguucaaauacccagcaccuacagggagacucacaaccaucuauaacuccaugcaauuccagggaugugacaccuccucuagccuccucaggcauauaguucaggaugcauauaauaagcacccaagaagcugaggcagguggacagccuggaguucaagguuagccagaaauguaaauauuauuguuagccccuggacaauaaaaauuuggcagaguuuacaguuagcugaaccuuguucucaauaagaaauaagagcagagccaggcagugguggcgcacgccuuuaaucccagcacuugugaggcagaggcaggcggauuucuaaguucgaggccagccuggucuacagagugaguuccaggaaagccagggagcuacagacaaaaaaaagaaaaaaaaaaaaaaaaaaaagaagaagagaagaaagcgauugcaguaaucucaagagcuagaagagggccugagagauggaugguucaguggucaacaauccauggucucugggcuucaauucucagcaucaacacaguagcucagccuguaacuccaguucuagaugacuggacaccaucuucugacuugucuggguaccagacaugcauaugcuguacauucaucauggaaaacauucauaaacauaaaauuuaagaaacuaaaagaaggccccggcccgagagggcuuugccugagcaucugcgggagacaucuuggaucccagacuccaccgaggcuacucugcacaggugagaguguagacuacagaagcuaacagcuucggggacaggcgggagccacagagcuucugaggcagcccccuuuucgggcuccagacauccgggcaccuucccugccagaggauagguguccgccuggccugggagagcuuuaccugagcaucugcgggagacaucuugguuccuggacuccaccaagacuagucuacacaggugagaguguguacuccagaagcuaacagcuucugggacagguccuguuucgggccuucaucuucugccaggaggcaagccugaaugccagauaucugugaaccuuuccugaaagaggagagccugccugcagagagugcucugaccacugaaacucaggaaagagcuagucucccugaucugcugguagagcauaacagaaucaugagaggaacaagcucuaaccagagacaacuauaacaacugacuccagaguuuaccagauggugaaaggcagaccuaagaaucuuacuaacaaaaaccaagaccacucaccaucaucagaacccaguacucccacaucagccagucgagggcaccccaacacccccgaaaaccuagaccuggauuuaaaggcauaucucaugaugaugguagaagacaucaagaaggucuuuaauaacucacuuaaagaaauacaggaaaacacugcuaaagaguugcaaguccuuauagaaaaacaggaaaacacauccaaacagaugauucgaaugaacaaaaccauacuagaccuaaaaagggaaguugacacaauaaagaaaacccaaagugaggcaacgcuggagauagaaacccuaggaaagaaaucuggaaccauagagcaucagcaacagaauacaagagauggaagagagaaucucaggugcagaagauuccauagagaacauuggcacaacaaucaaagaaaauacaaaaugcagaaagauccuaucucaaaacauccaggaaauccaggacacaaugagaagaccaaaccuacagauaauaggaguagaugagaaugaagauuuucaacucaaagggccagcaaauaucuucaacaaaauuauagaagaaaacuucccaaaccuaaagaaagagaugcccaugaacauacaagaagccugcagaauuucaaauagacucgaccagaaaaaaauuuccucccaacacauaauaaucagaacaacaaauguacuaaauaaagauagacuauuaaaagcaguaagggaaaaaggucaaguaacauauaaaggcaagccuaucagaauuacaccagauuuuucaccagugacuaugaaagccagaagagccuggacagauguuauacagacacuaagagaacaaaaaugccagcccaggcuauuauacccagccaaacuuucaauuaccguagauggagaaaccaaaguauuccacgaccgaaccaaauucacacauuaucuuuccacgaauccagcccuucaaaggauaauaacagaaagaaaagaaaauacaaggacagaaaccacauccuagaaaaagcaagaaaguaauccuucaacuaaccuaaaagaagacagccacaagaacagaaugccaauguuaacaacaaaaauaauagaaagcaauaauuacuuuucuuuaauaucucuuaauaucaauggacucaacuccccauuaaaaagacguagacuaacaaacuggcuacacaaacaggacccaacauuuugcugcuuacaggaaacccaucucagggaaaaagacagacacuaccucagaaugaaaggcuggaaaacaauuuuccaagcaaauggucugaagaaacaagcuggaguagccauucuaauaucuaauaaaauugacuuccaacccaaagucaucaaaaaagacaaggaggggcacuucauacucaucaaagguaaaaucuuccaagaggaacucucaauucugaauaucuaugcuaaaaauauaagggcagccacacucauuaaagaaacuuuaguaaagcucaaagcacacauugcaccucacacaauaauagugggagacuucagcacaccacuuucaccaauggacagaucauggaaacagaaacuaaacagggacacagugaaacagaaguuaugaaacaaauagaucuaacagauaucuacagaacauuuuauccuaaaacaaaaggauauaccuucuucucagcacuucaugguaccuucuccaaaauugaccacauaauuggucacaaaacaagccucaacagauacaaaaauauugaaauugucccaugcauccuaucagaucaccauggauuaaggcugaucuucaauaacaaaauaaauaauagaaagucaacauucacauagaaacugaacaacacucuucucaaugauaccuuggucaaggaaggaauaaagaaagaaauuaaggacuuuuuuuagaguuuaaugaaaaugaagccacaacauacccaaacuuaugggacacaaugaaagcauuucuaagagguaaacucauagcucugagugccuccaaaaagaaacuagagacagcacacacuagcagcuugacaacacaccuaaaagcucuagaacaaaaggaagaaaauucacccacgagaaguagacggcaggaaauaaucaaauucaggggcgaaaucaaccaaguggaaacaagaacuuuucaaagaaucaaacaaaugaggagcugguucuuugagaaaaucaacaagauagauaaacccuuagccagacucacuagagggcacagggaaagcauccuaauuaacaaaaucagaaaugaaaagggagacauaacaacagauccugaagaaauccaaaauaccaucagauccuucuacaaaaggcuauacucaacaaaacuagagaaccuggaugaaauggacaaguuucuagacuugguaccaaaguuaaaucaagaucagguuaaugaucuaaacaguccuauauccccuaaagaaauagaagcagucaucaauagucucccaaccaaaaaaagcccaggaccagauggguuuagugcagaguucuaucagaccuucaaagaagaucuaaucccaguucuucacaaacuauuccacaaaauagaagcagaagguacucuacccaacucauucuaugaagccacaauuacucugauaccuaaaccacagaaaggcccaacaaagauagagaacuucagaccaauuucccuuaugaauaucgaugcaaaaauccucaauaaaguucucgcuaaccgaauccaagaacacaucaaaacaauccugaccaaguagguuucaucccagggaugcagggaugguucaauauauggaaauccaucaacguaauccauuauauaaacaaacucaaagacaaaaaccacaugaucaucucauuagaugcggagaaagcauuugacaaaaugcaacacccauuccugauaaaaaucuuggaaagaucaggaauucaaggcccauaccuaaacaugauaaaagcaaucuacagcaaaccaguagccaacaucaaaguaaauggugagaagcuggaagcaaucccacuaaaaucagggacuagacaaggcugcccacuuucuuccuaccuauucaacauuguacucgaaguccuagccagagcaauuagacaacaaaaggagaucaaggggauacaaauuggaaaggaagaagucaaaauaucacuuuuuacauaugauauauuaguauauauaagugacccuaaaaauuccaccagagaacuccuaaaccugauaaacagcuucaaugaaguagcuggauauaaaauuaacucaaacaagucaauggccuuucucuacauaaaggauaaacaggcugagaaagaaauuagggaaacaacacccuucucaauagucacaaauaauauaaaauaccuuggcaugacacuaacuaaggaagugaaagaucuguaugauaagaacuuaucuguaugauaagucucugaagaaagaaauuaaagaugaucucagaagacggaaagaucucccaugcucauggauuggcaggaucaauauaguaaaaauggcuaucuugccaaaagcaaucuacagaugaaaugcaauucccaucaaaauuccaacucaauucuucaacgaauuagaaagggcaaucugcaaauucaucuggaaucacaaaaaaccuaggauagcaaaaacucuucucaaggauaaaagaaccucugguggaaucaccaugccugaccuaaagcuguacuacagagcaauugugauaaaaacugcaugguacugguauagcaacagacaaguagaccaauggaauagaauugaagaacccacacaccuauggucacuugauauuugacaagggagcaaaacccauccaguggaaaaaagacagcauuuucaacaaauggugcuggcacaacuggcgguuaucauguagaagaaugggaauugauccauuccuaucuccuuguacuaaggucaaaucuaggugaauuaaggaacuucacauaaaaccagagacauugaaacuuauagaggagaaaauagggaaaauccucaaagauauggauauaggggaaaaaaauuccugaauagaacagcaauggcuugugcuguaagauugagaaucgacaaaugggaccucauaaaauugcaaagcuucugcaaggcaaaagacaccgucaauaagacaaaaaggccuaauauccaauauaaauauaaauauauguauauauauauauauauguauauauauauauauauauauauauauauauauaacucaagaagguggacuccagaaaaucaaauaaccccauuaaaaaaugggccucagagcugaacaaagaauucucacccgaggaauaccaaauggcugcgaagcaccugaagcguccuuaaucgucagggaaaugcaaaucaaaacaacacugagauuccaccucacaccagucagaauggcuaagaucaaaaauucaggugacaacagaugcuggugaggauguggagaaaaaggaauacuccuccauuguuggugggauugcaagcuuguacaaccacucuggaaaucagucuugcgguuccucagaaaauuggacauaguacuacuggaggauccugcaauaccuccccuggacauauauccagaagauauuccaaccggaagaaggacacauacuccacuauguucauagcagccuuauuuauaauagccagaagcuggaaagaauccagaugccccucaacagaggaaugaauacagaaaauguaguacauuuacacaaugaaguacuacucagcuauuaaaaagaaugaauuuaugacauuccuaggcaaauggauggaccuggagggcaucauucugagugagguaacccaaucacaaaagaacucacacaauauguacucacugauaaguggauauuagcccagaaacuuaggauacccaagauguaagauacaauuugcuaaacacaugaaacucaagaagaacaaagaccaaaguaugggcacuuugccccuucuuagaauugggaacaaaacacccauggaaggaguuacagagacacaguuuggagcugagacgaaaggauggaccaucuagagacugccauaucuagggauccaucccauaaucagcuuccaaacgcugacaccauugcauacacuggcaagauuuugcugaaaggacccagauauagcugucucuugugagacuaugccggggccuagcaaacacagaaguggaugcucacagucagcuauuggauggaucagagaaaguauccaaggagcuaaagggaucugcaacccuauagguggaacaacaauaugaacuacccaguaccccccagagcucaugucucuagcugcauauguaucagaagauggccuaaucggccaucagugaaaagagaggcccauugguccugcaaacuucaucugccucaguacaggggaacgccagggccaaaaaaugggaguggguguggguggaggagugggugugggaguguggggggggacuuuugggauagcauuggaaauguaaaugaaauaaauaccuaauuaaaaaaaacugugcccguucaacagucauuaucacaauucauaaguaacaacagugaagcuugugaaaagguuauaaugugccuaagaacacgugagacguaauugguuaggggagaaucugcacagaaguagucuguugcuccacaugccauuuugugcuugaguauauguagcugacuugcauucuggaacuguucaguaccuuuuuuucuuucuuuucuuucuuucuuucuuucuuucuuucuuucuuucuuuuuaauucucaggccauauuauuuucaaagugccagagucaugaaaguauacaccuucaauuuucagaaauauucuuuucuauaaaauuaccauugcaguuagcaaacuaacuuuucagauauuuagucuccuuuaugcuaucuauaagggcuuuaacauauacucacaugucaauauuuauucauuuucaaaccccuugauuguguguguggauuaaaaguucuuauagaucaaacuccuaagauagugauacaggaaugccaugaagguuaauggauugcaaauacaagaaaaaaaggaaaaaaaaagaaacuaaaagaaaaauauuuauauuacacuagaagacacuguggaggaagcuuagcagauuucucagcagaaagauguugagaucagaauuacacuuaaaaagauuuacuugagggagaaauaaagaccaaauuaacuuaauacgaacuaguagcuuugaagauagaaaagaaaaaucugaaagaacgauuggucaaauguuauugagaaaaaugcaaacuuuauuucauugcuaaaccuaaguuuaaaggcuccauuuccaggcaagaagugugagaaaagagcuauuucucuuuuuccuuccuggaguagcaugacucaggaaucaaaggaauccgccuguccuagucaggguuucuauuccuguacaaacaucaugaccaagaagcaagcuggggaggaaaggguuuauucggcuuacacuuccauacugcuguucaucaccaaggaagucaggacuggaacucaagcagaucaggaagcaggagcugauucagaggccauggagggauguucuuuacuggcuugcuuccccuggcuugcucagccugcucucuuauagaaccaagacuaccagcccagagauggucccacccacaggggggccuuuccccccugaucacuaauuaagaaaaugccuuacaguuggaucucauggaggcauuuucucaacugaagcuccuuucucugugauaacuccagcugugucaaguugacacaaaacuagccaguacaccgccuuuugauagaagcugaaguuccagaccaggcuggaacuuccauucagucuucuguaugcaucaaguaaaauguaacauuaaaauguugguuuuggagaugcaacagagaugauguucagugacuuauagcuucuucacucaggagacaucucaaauuaggaaauaacauuuagcacauauacaacaacacaucauugcccucggaaguauuaaaucacucugcuaguaugggucagaauuuauuuuuauuuguguacauguacaugugauguauaaguauguguguguauauauguguguauauagguauauauauguauauauacuuauguacacacacaauauauaagaagauauaugggcuggagagauggcucagcaguuaagagcacugacugcucuuccaaaaguccugaguucaaaucccagaaaccacaugauggcucacaaccauccauaaugagaucuaugcccucuuaugguguguuggaagacagcuacaguguacuuaaauauaauaaauaauuuuuaaaaagauauauauguauauauguauacacauguauauguacauauguguguauauauacauauauauauuauauauaucuucuugcucugaugaugagcagggggaaagaacaaaggaaggaaggaaagagagaacaaacaaacuaauucaauagugcugcaaauacaacagcugaauuaaaguaucaacaccccacucacucaaugaggaguacuagacuccuucuagagcucaaagccggaugccagacgucagaaggaaagacagauacacaggaacacaaggaguucuaacuuguaagaugguuuaauaagaaccagagccaagucuugcagacacaccaagcagaugaauaacuucauagagcaguauguaugcugagcucauccuaacaagacaggaaguguaauccaggcagugggaguacuaaaagguggggaaaacacuggacuaucuuuucuuuuucuuuuuuuuuuuuuuuuuuguaagacaaguaucuuuuuauacggccggcccuccuuguccuggaacuugaccuagacuaggcuggccucaaacucauagaguucuaaguacuaauaaguauucuauaaaauaugacgguggaaaaguuggacuaagacaguaugacaaggagacuauauuucugacauguaccuaaacucucuccaagcacuccuaaaacacuguuuccuauggucuugcuuuccuaagaggacagagggaacccaggaugagaagguccuuucgacccuaauccuuucaccuuuuacguuuuaaauuaaaugacuguuugauguauucauaaaucagcuuuucuuuucuuucuuuaugacuaguguauauggcaaaaaaguuccuucccuagcagaccugaucugccuuaguagucucauuguuaacccuucccuacuccuaacuauacauuuacacucuucucuauguucucuugcaauagauuuccccauuuucucaggcuaauucccucauauuucaaaaauagccuccauaaaguuaaacaaacuucccuucuugucuucccaccacauuccccaaaacagccuuuggccuacuuuugauugcauguguacucucuagccucugagaccaguucacagucccagcccgaguccaccagaacuuuauacccaucaggaacagaguccaaauuucuuaaggcacuaaaacuaugaugaaacagcagcauuacuuuuuaauauccauagacauaugcaacccaaaaucuaucaagagaugagcaaugaagcuaaauaugguagcccaaucagauaguuccgugggguaaaggugcaugccaccaagcuugauggccugagaaucacaugguagagagagauuugacauuacaaaaauguccucugaucuccacaugcaugaaggcauacaugcuugugugcacacacacccacacaauguaguuuaaauuauuuaaauauaaguauuauauauuaacaacaaaauauaauucagucuucaaaaugaaaaaauucuaacacuugccaaaaagagcccugaagacaacagucacuaaagcauaaacauuguggggcucaggaugcaguccuguagguagaaugcuugccuaggaugcauauaaagcuuuggauucaaucuacagcacugcaaaaauuaaaaagacgauacugcauaauuccaaagguagcaaaagucaaauucacuaagacaaaaaauaaugguauaugccaauagcuaggaaaaagauaugugguuucucaacaauauaauguauauuauauacauuauaacauacaauauaaauauuauaacauacaauauaaauguaugauauaauauacauuuauauuaauauaauuaauauaauauauauaauguaacauaugauauaaauauuauaacauacaauauaaauguauaauauaauauacauuuauauuaauauaauuaauauaauauauaauguaacauaugauauaaauauuauaacauacaauauaaauguauguuauaccacaaaacuguauauguaaaaauuguaaaauauuuagcacauuuuaccacaacugaauaaaaaaauuaagaaccaaauacagggcugagaugaugacucagaaagcucacucagcaaaggaguugccacagaagcaugaaaaccugaguuaggaucucaggacccacauuuuuuaaaaaaagcuggguauggcagcccacaccuguaaccccagaguuggggaagugcauaccagaggaucucuggaaguugcuggccagccauuuuaacugaauccaaaaguuccauauccaaggaaagaucaugucuccaaaaauaaaguggaggaugguugaagaaaucauaugaaccauuggcuaucauaagaacacacacacagagagagggggggagggagggagagagagggagagagagaaagagagagagagagagagagagagagagagagagagagagagagagagagagagagaggcaggccguggagagaaccaaagacuucuacacucucaagauaaaauauaauucugacauugcagauuuuacaaauauaguaguaaacccuagaggucuccguacuucgaaaugcuucugauuaaaacaauguuaucaguauugguauuuaaaguaugauuaaggaauaagagucaaaaaugaagcauuuaauuacucuugcaaagguccuagguuuggcucccagaacucacauggcagcucaccauggggauuccacacccucuucaggccuucacaggcaccagacacacaggugguacaccaucauauggcaaaacacucauauacauaaaauaauauaaauauuuuuaaaagacuuugaaguuacugcuaugacuuuuaagucuagaaaaaccauaaaagagacuagaaauaauguauauaacuuccaaacaggcaguugcugucuccugagucacauuugaagucuguuacucuuucaauugauagggccuuugaagaagauugucccuuuuuaaauaagaacuaugaagcuacuucagucuguagguaaucacaguauccaccauacuaaacugauguguucuacuguucauagaugcaauaccucagcucugcccacagcgcugaccccagguuacuucacuggguggccuggcuacccuucaguuguuucuuaaucagauuguauuuuuuauucuuacuuauguaugucuguguauauguaugcauuguguucggguaccacugaggcaugaaggggcaguagguauccuggagcuggagucaacgguacuucauuguaagccaccugaagaaggugcuagggacugaacuuaggggcucuggaaaagcaagaagugcucuuacaugcuaaacuacuucuccagacaguuuguuugcuucuuuguuaaugaaauaaggcaauaacgcagaauaugguggcacccaccuauaaucauaguacuugagacacaggggcaagaggaucaggugugcaaagccauccuaggcuacauaaguucaaaaucagcuugaaccacaaauaaauaagaaagggacuaggaagauggcuuagagguuaaaaguuuauauuauucuggcagaggacccaaguuugauuccuagcccuaucuaguagcacacaaccagauccagggcaccagcagcaccuaacucacacagagagagagaggggagggggagggagagggagagggagagagagagagagagagagagagagagagagagagagagagagggagagggagagggagagggagagagagaaacauaauugagggaaaagugggacagaagaaagguaagacaagaauacuuuagcuaacugaucaaauccuaaaccucaacucuugcuuucaaucaggaguagacuggaacacuuuuuccuugcugucauuccaaucagaagacagcaauuaaaaauucaaaccagagccaggcgcaggccuuugaucccaggugaguuugagaccagccuggucuacaaaagcaaguccaggauugcuagggcucuguuacaccgagaaacccugucucaaaaagccaaauauauaaacaaagaaauauuuaaaccagggcuggguggugauggcacacaccuuuaaucccagcacuugggaggcaaaaacaggcagaucccugaguccagccuggucuacagagugaguuccaggacagccagggcuacacagagaaauccagucuugaacccacccccaucucccaacucacuggaaaaaaaaaaaaaaaaaaaaaaaaacuaagccagguccauucuugaaaucuugcuacuugggaagcuaaaaagauuauuugaauuuaggaauuuuagaccagcuugggcaacauagcaaaacccuaucuuaaaaacagaaggaaagaagaacgaagggaggggggaaauaagugguuagaauaaacgaguguaguucagugguauagcuuuugccuagcagauauaaagcccuggguuuaaucaauuuaaucccccacuccaaccuccaaaaaaaaaaggaaaauaugagacugccuuuaaucaugggaaucuggaaaucaaagguucaacuaccuaagcuguaauauuuuucccacaguugguaaaacuguauauuccacaacauauggaauucuacugaaagcuuucauuggcauuuugccuuguugaauaaaaguuaagagcuaugcuuaggcauuuuuuaaaaaaaucaacagucuuuucaccagauuaacauuugaaauguuacuuaaaaucacagggaagaauauuagugauaaaaucuaauacagacuaagcucuuaacuaugugucaauaauagcucuaaauaguuuuguaaacucauuuuaauacaaacaacacuaaagaggcacaccuuauuuuuaccucuguuuuacagaggaggaauuaggaacuaaauaauuucuccaaugguaccuaucaccaaauagccaauggucaggaggauuaaggcuuaguuuacuuuucauuguggggggagguacacaacagugcaggugccuacagcguccaggagacagugacaggauugucuccauaugcacacugggauugugccuagaauuuauucaacaugaacuggaugguuguauuugcaugccaugauuucuauaucuuaaauauccuagcauugaucgcaauacccaauaaugcacacaguuaccguuuaguauauaacaucaauauuuggaaagcauuauagaauggguauauaauucacuugcccacuuauccaacuuauuuuauucauuuuauugagaugggguauuaauacauagcacuggcuggccuggaacucccuacauagacuaggcuauccucaaccuuagagauaauucugucucugccuccagagaacuggaaugaaagauguacacugccaugcccaacuucucccaaccccuuaccuuaacuauaugaauaaaaauguacuuuccaccugguaaacagugaguauuccagggugggaagucaaagaagacuaaaaacguugggaagguagauaauacaagaccaucaacuuucaacucuaagaacaggcaugccauuuuucuuucuuuacagaaagcuuacuuguggaaauaauuuaagcuacauucaaaagaaggaaugacuuuaaccuggaugguggccaacugugcuaagaacugcagcaaacacaaccacuuuccucuuaaaagucacucaacuggagauuuucucagugggaaguucucuaagggccaaugacucuauuaucugcaccccaaugagucucaaaauacuguuaguucuaauuuucagcucucccuccuuaugcacauacauaugcagcccacgcucacaccaacccaaggaaagccugacuucucauagaagagagaacaaauuuuuuggaaucaaauguccaauauccguauccaguauaauaugcuauccuuuacuaauccuucucucuuuguguuuguacaggcauuuaaacuagagugacacuuggggacaggacaagagaaccaccaagccuuccaaaagaaagcuauccuccucaucaugaaauagccuaacaugacaccagaaacaccaaauaucaaagaacaacacacuuaaggagggaacuacagagcccugguccugaagagacacacccaggagaaguagggaagcaggagacgaacuucagucaaaucauccaggccugauggcccagcauaggaaguacaaacuugacagucuuacuaagggaaagaagccaaugcacccuccauuuccuaugucuaauugugaaaguccccuuucacucaguacccuaucaucaacauaucaucucugcauguaauacacacauuuaaacaaauuuaaucaaugagacuuugacagcaugucuugaaaaacaugucaguauacaaggucucagaggaucuagcugcuuacucugaaguuuuuccuuucugcacuugcuggaagugcagccagguaacuacagccuagcuuccuagacagcguauggaagagaaagucucaaagggguacaaagugauugggucuccucccuuuuuuaucuuuuuuuuuuuuuaauaaacacauauucucacuacauagcucuggcugacuuggaaucuucuguguuaucaggccugccuuugccucccauaugcuagaauuaaaggucuauauccuagagccagcuuucauugcaaauuuauaaacagaauagugcauuaggggugguucuugguuuuguuugcacuuuucauuaauaguaaaaaaaaaagagagagaaagauaaaaaugguguguguguguguauguguguguguauauacacauauauacauauauacaugaaacacugagaaauauaaaaaucugcuaacuuuucaauaaugaaaauacaauuuauaccaggcaugauagugcauuccuguaauuccagcauguaagguggcagagucaggaguauuuugaguccagacacccugggcuacauaguaaaacccugucuccaaauauauauacauauacacauacacacacacacacacacauauaaucugcaacaagaaaaguuuuagcuaaguguuuuagcagaacuaaggaggugguaacuggauucaguucaaggucaucaaguuugaaacuaggccaagcuauaggagucugaggcaggagaaaagaucuugaguucaaggccagccugggcuacacagccaguccaagaaagccuaaaccacagcaaaacaauguuuugaagaacaguguugggaaggauagaggucaaggagaaacccguuuucuucuucuaguccuauauauaacaccuauaggaaggccuaaagugcgaaaaagguuagaguuagcugagaggaacaguuaucugacagaauacucuucucaucaggaguccucaacacagagcuuuauuccaaagacaccuauaaaaucagcuucucucugauacuuccuaaagacugcuacucuuuuugguagcaccaagugcugguucuaauuucuaaaacacaagagaaauugguguauuagaggaaggacuucucuuuaaaagcuuucauuuaucuuucuacuuccucugucuggcaggcuuguugaaaucuugaaguauaaaauauggagcuguaugagauaaagugugugugugugugugugugugguguguguguguguguguguguguguguguagaaagagaaagacagacagacagacagacacacacacacacagauucacuuucaugacgaccugaauaaaagagguuggauuugaaucagccagaaagcaaaacagcagaucaacuugaaaucuuugucuccugccauaugguucaaagaaauacagcucuuuaauguggaauccaugacucauaguaugaggcugcacuguaaccagcagggcuccaaauaauagaggaacaccuggucuaaaucguuaaauuuuuuaaaggcacucccaaaaagagaaugcaaaaucccaugccucuuccagauaggaggcagagucuugagcuaugaauuuaguaaguggccugcauagcugaaaugacuccuaaacagagaaaccacaacucaaaauagccugaacacuuuuguuaucucaaacaacaggcaaucagccauccacuccucccuuaguacauauuugaccuguauuagccaaagaacauuauaaauuuggugaagcuuuaaacguggcuauacaggauguuugaaagcuagagacuagaaguacuaacuauacauugauuccuaauguuguauacauuaaaaugaauacuaugcagauucauuuaaauuuaaaaauuuguacuuuaagucuaugacaagagcagacauagcccuaaaaguuaccagaaaagagaaacgccuuaacuaaggugaguauuucaccagagcauauacaugaccuguuagacugcaguauauagauagugugcgaauucccauuuacccuucccaaaagguguacauuacuaagaaccugucggaaggcuuuuauuuuguuuaacauauguacuuuccuuuuuuauuuuucauacaguuggggggggguaguacaugugucaggcagaaaacagcuuguaagagucaguucucuccuuccauaauguauguuccagggaccaaacuugucagguuuggcaacaagcaccuuuacuugcuaagcaaucuugcuggcccucagcuuuuaaaugauugcccucucaguauacagguacaguauacaguguacgcacgcauacauauacacauauacacacauacacacacacacacacacacacacacacacacacacauaucguauacauggauaaaugagcagugguuaaauaaauacauaaaaaacaggcugcucuauguuuacuuguauuauaugaguguuuuacuuauaugacuacauguauguauguguaccaaagugugccugguacucauggaggucagaagaaggugucagaucccuggaacuggaauuaugaaugaccaccacgugggugcuggaaaccaaacccaaguccuuuaugagcgcaacaagugcacguagccacugagccauuucuccagcuccuagccugcuuuaucuuuaagcaaacagacaagaaguauuguauuaauacccaagugaguccuagcuccauaaagguauuuucccuaaugccaucuuucuucauaacaauaauggggguggggaggggucaaaccaaaguuacuacuguugacucuugcugugccuauuuagaauuagcucaaugcuauuuauauaacagcuaacuuccuacuuuguagauauaaacaaacauuuaaguuaggcuccauuaaaauuacaaauauaguuacagaaauauacacaauuuccagaaaccuucuguaaucucagauacaggagugcuaauuaucagaauaagguucacaucagucccauuaaauacccuuugaucugggacaaaguuuuuuaaaggaaauuucaugaucucccaaagaauacauauaauuuuauuucaaauauuacuuaguuuuaauaggguucaagcuaagcaauuacauauacauauacauauaugacuuuccuaaagccuuaaucuguuuuaaauacuuuaauaaaguaucuuuauaaauacuuuauauacuuacuuaauaaaguauuuagaggcugaucugcaccuacucuuuaauuccugagauagaaaagggagggaagaaggaacggggaguaugcugaggcugggggugaagcuccaauccacaucacaucaccccccaugauggucaugccaaagccagacucugcagacacugcugccaggcccaggacaaauggaaaugugugacuaacaccauucuugcugcuucuaguuccagguggaacuuuuccacugauacuuaacaaccaugaucuaagcagaugaggaacaauggagguauaagaccagagcaucuggagucagagagcaagaaucuaaguccaagcuaacuaucuauagggaaacaguguuucucuaaaacacaguuaaucuauaaaauaaggaccucacaacaucuacccacaggauuguugcaggcucaccaacaugaaaguauuucauaggcacuuuguguuuucugagcaagcaucagcucuccacuauucauguacaaagcuguccucggaacuguccaucaguagcccuagggugaagacagaucuccagggcucacugacaagccagucuagcugaaccuguaagcucuggcucaaugagaaacucugucaaaaauuaaaguggaaaagcagcugagaagggcaugccagccucaaccucuggccuccaaaauaaaauacacacaggccaagaacacacacacaugugcaaaugcaggcuuauacaaaugcacacacacacaaacacacacauauaccacgcacauacagaaaaaaaaaauuuuaugagguauaaauggcuauacaaauguccuuauuuacuuuauuaaugguucuguuuguuuuuuaaauuaaaaaauacaaaaacauuuuuuaaaagauauuacccacagaccuaucacucagacguuguuacugccugaacugagugagauaaaccuaacacaaaccaaaggaaacuacagcaaaacuaaguucagauguuaauacaguaacuacaagugacaaaauuaauuacuggucucuuuuaaagagcaaagcagacuuucccaucuauccaccuaaugagaagacaaugcuauugucccaagaacuuaugauaugugagugaggcacauaaaagucaaggccacagaaauaaauaaauauuucaugaguccaaguaauaguuucaacacaugaccucagaugcgaggggagaugaagcaucugaaugaagccccaucaauaaaacugacauggcuguacuggucacaucaaagacucacuauaggucacuucaaugagaaaagaaaaagaaaaauuugcauauggugcuaugagauggccuaggccucugacuuuucuacacugauugcuaagccccacccuucugagaacuugugucccuccucuuuauuccuguuucccauccaucccuuuucuaccuccuccuuugcuuuacuaaugcacugaauuugcuuuuuguguuugaaaugauuuccauacaaugaacuauuauuuagcagcaacagagagagagagagagaaagaaagagugagagaauaaaguucugagacauacuacacuacuacacuauggauaaacccugaaaaauaauaugcaaagugaagagaagccggggagagaagccacacacugucugauuccauuuauaugaaauguccagaagaggcaaauccaggagcuaggaaaggaaaagaaaggaaaggaaaagaaaggaaaggaaaggaaaggaaaggaaaggaaaggaaaggaaaggaaaggaaaggaaaggaaaggggucaugcagguaaaaggauacaggaaacaauacaagaggaauguaaaugggcaucugaguucuuucugaguagucaaaacugcucuaaaagaggauaaaugugugguggacaagaaaagauuauaacagagguuauaaaucauguacacauagaaauuauaaagcccauuauuauguaaaauacaugcuaauagaaaucuuaaauaaacuguucuaaaauuugguuguaguaauaguacaacaauaauauuacaaaaaagcaacuaacaguauacauuaaaugaaugaacuguaucaugugggaauuauaucaauaaaacuguucaaaaacauggucuuauucaggauccuggucagaaaacaagacauaaccaggcaugguaguguauaccaguaagcacuugggaggcaaaggcaggaaaaucacaaguucaagucuaacaagagauacagagaaacuucuaaaucaucuagagagccacaaugaaucucugacucaaaaaaaaucaagcaaaaaaaaaauuguuuuaaguggaccaugggagauaacuucacaguuaaaccuguacaagugagaggcucaguaauucagacccacugaacccacauaaaugcuagauggguguggcagccugccuguaauuccagcauuagaaagcaggagacaggugguccuccaagaagcaaucuggauugcuuugauugagagacccuaacucaauaaaugaacaagguggaagaacaauugaggaugauucucaacgucaaucuuggacuaccgcaugaaaagucauauauacccacacaguaugaauacacacacacacacacacacacacacacacacacgaaauggggaaagagaaaacaucuuuuuaaauuuuccagcugaucucaaguguggaacaaaaaugacaauucagggacugaagagauggcucagcaguuaagagcacuuacugucuacuuuccuagagaggacccagguucaagucccagcacccauacagcaggucaaaacuguaauucugaugccagaagaucugacacccucauacauacauguaaauaaaccauugagagagagagaaacagaccuaugaacagguaguaaagcuacacuuuagccagguggugguggcacacaccuuuaaucccagaacacaggaggcaguagcaaguggaucuuuuaaguuuaaguccagucuggucuacagagugaguaccagaaaagccagagcuacaaacaaacccugucucaaaaaacaaaaaccagaugcuagauacagugaccaaacuacuauguuucggauuacuauggcuggacauaguggcauacaccuuuaauuccaguuugcauugaggagagagagguaggaagagcucugugaguuccaagucagguagaucuacauacacaguaagaccuuguccaaaaaaaagauaccagaacuccaaauccaaaugaguccugcucccccaaaagcaguucaaauugaaacuuguuuuuugaaugcuuaaaaauucugcacuuuugccuaaguaguuucuuccauuuguaaggcauuuauucucacaacuuuagauguuccuauccucugucuuaaacgaccagcucacauguuauaucuuccaugaagccuccaauucucccaucaagucaucucuccuuccucugaacuugcagugauuugccaccucuaacuuucaaucuaauagaacaaccacucuauucaggaucauucuuacugucuuaacauucaaggaggauuucaauaaauuucuguuuuauaaaugaauaaccauguucaacaagucagaguuucaucuuccuccaauaaauuuaacuucggaaauaugcagaugucauuuagacaccagcuucuuaaaugguaggucaugaucucauagggucacaaccuggaaugugggaaggauaaauuaugugacacuaguaaaaggcuccuaaacuauggccauaaaucaaaauuguuucuggccaccuucgcacaugcugcauggaacaacuucaucauaacuaugaaccugaacauauaacaugcauuugcacuaugcauggccuuaucagaaacaccuccacucagauucacaacuaccaucagugauaaacugcaguguuuuugcugugcacacacaguuuuuuacacuucuagaaguauaaauguuuaauuacagaaaagcaaagacgucuaauauuuucuuaccaucauucccaagcauguaaguaucaaguuagaaugaccuuagauuguauuauauucagaugauugauuuuuuuuaaagaugcugucuaaguugcugacaaguugcauaaaaaaagaaaaucauuacauggaauucuggcuugggagaaggacaagauuuccaacaauuucugaaauggcccuuauaugcaguuugugccacauauuuaugugaagcuaagcccucaaaauugcagauuauaaaaucaaaauacucaucaacgcugaaaaacacuaaagaugcucuguaucacugaagugccaaauauucagccaagaguuaauucuugacacgcaaacaaacuagcacaacuaccccauuauacuaggcaaauuuacuugcaucuuuuauuaaugguaaaguucuguccauaccaaagaaauguuuuaaaauaaacuuauaauuuauugauaacuguuuguuuuauaugccuauuuuauguaucuauauagcuaaggaugaguaaaaauuucucaagccaaaaggaaucacaaguagaaauagcuuaagaagccgugucuuagaccacagaugcuaugccaaguagaugggcuuaauuucacucaaaauauacauuuucuggaccaaaguaagacuaauuuggcauacauauauaaaucaucugagagaaauuccagaagagaagcacuggagcaaggauauagccuccuaaaguaaccugcaagaaacauucugauuagauggauuccaauauuugcucaaaacuuaguuccauuauuuuauagacacgacaugaguuuugcaacccuagaguuuuauuauccaguuacuauuauuucucuacuguguuuauaguuaauuccuuuucuagucuucgugcagccuuaugagccuccuagccuaacuucacaugguuccucuuccuuuaacccucuauuuauuauuaaccaaucugugugucaacgcugaagacuggaacuagggaagaggaaaaaaaguuccacuuacauuguguuuuccugacaggaguuaggaacuugagauguguagaggauccauacauuuaugaaaacaguugauggguccucaggccucccuagagcccauguucuuccucacacaccauucuucccucccacucccaaccaacuugugcaucuuauuaaauaagaccuucugcuaaacuacccauauaccauucacuggcuucgagucugauuucuuuaaccugcaaucaagacaaucuacuuagugaaaccugguagcaccuuuguuuaugacuauuuaucagcccaauccccuccacggauucaacuuuaaauaccuuuuauaguuaggaaguaugcaacuacauguauuuuuuuuccaucuuauaucugcccuuguuucuuuuguaugucuccuaacuaugaccaucauaaccaccuauggagcuacuuuaaaaaacagaaaaccuuuacuccuggagauccuucaguaagucugggaugggaacuggaaacaguccuaucuacaaagccccauuggugauucucaugcacacccugagggccacuaauucauuccaaugcucuuuauacagcacacauucagugcuuacuaauucauggccugggagcucauaaaugacuucucucuaaauagccuaaccagauaucaaccaagcccuugacuacaccagcuguguuccaagugcaacauguggguuuaagauuuccuauccucaagugcuacauggagggacaccauuaccuugucucuuuacauuguuucccauuuguugaaaaaccagaggccuggaaugcagccaugucagacaacacuacauaagaauguacucuggggucuaagauuaaaauuagcuacaaagagaacaagaacaagauagacagucugaaugaguacacugcuccuacucaauaguuucuuacuuaaucaguacagaagaacagaaauuucagucccuaguuccgcccucccuucucucccucccuccucuccccucccccucccccuccuacuugcugccacaggucuccuaaaaugccugagacagucccaggccccugaagacccaggaagucauuucaugcguuaaaguccuauaauccgauaaauaacacaagccccacccgacagacaguuaccuaucaacuacccugacacaccauuuacacagcuugguucggaaagcaguaugaacuuuuuccugaguuguucuucacagggaacagcagucugagucacacccagccuggagcaagugugacauuagccaggguacaguuacgagacuagucucucuaucucuuuucccauuucagaagugggcuacaaagaucgauaaauagcuaggggcaggcagaaaaguguggacuggcaaagaacgcccuagccuuccccucaggcaggggcugcagaucccagauuccacaggccucucacagcagcuccaucuugcuuccugccagaaggaggggcagaggaggaggccccccaaaucuggaaaggccccagugaaagaaagccauuugacagcaguaaagauggauagacagcuucauggaaggaauaaaaugacggccauggggucaggcagagggcaagcagggcuccugguuaugaauuacugucuaaaggugcuaagaguccccggaggugugagcaaaaugccccgaaggaaaggaggcggcgacagagagaggaagaagccaagcaguuggguagaagcgacagacaccaggaucccaggggaggguugggcaggugggucucaggggacagaaguauuagaaaggcgagcagcccggugcaaauaagaauccuuggaaguuagggcagggagaccauaagagaaaccacccacagguuggagaggagaggccuaaaaaggagcuaagagcaagguacucaacgcaagugacgcgagccugcccaggggagggaccgugagacaaccuaacgaccauuucuugggcgccuacuacgggcacacacacccuaggcacuucacaacuaaaagcucgcugacucuucacagcacagccccaaggcaggauuucucacacaagugucccauuuuauagaugaggaaacugagguccccgacaggcucaguggcuugcucaaggucacagcccagagaaaucggcauucgaaaccacggcaccugcccuggaguccacccgacgcuccaagcgccugcgaaugcaagcagcgaggcggaccgggacccuggggacuucucccgcccgcgcucccgucccaggcccggcgcgcucacccggacgagguugcugacggccgccugcacggcggcuacgggcgcggugaggucaggaauggcuuugccguccaccucgcccuccucgugcauaaucaccaggugcgagaucugcugcgccaccggcuccaggaugcucucgaucguacgcgugugaaacaccggcaucgcggcggcuagcggggcggcguaccgcgggcaacagaaaacugggauccguagggccgggagccggcggcgagugacugacucggagcggcgacuagaguccgggcuucccucggcguaacuagccccacaggcgccccgcccuc

SEQ ID NO: 7295 - RNA, 1337 nt, Mus musculus
uggauacuuggggauuguaaugcacccgguugucuaugguagagccuggagggguuuaucguucucuucaaaguaagaaggccuuuggggaaugaaauuauuuagucuuugcauuugugaacuuguuguaaaguauauaguccugugugugcucuugguaaguagguuuaaacgaagauuuggggaugugccucuuuguguaugaugcuuaagacugaaccucugaggaaauacauaaaggucaagauuugccauuugauuauuguuuuaguaauaagaucuuugagcaguugcagaaucagauuaaaaagaccuuucuucagguuuccugaugcauuauauggaaauacauuuccuuaaugucuuuauuuuauuuuuuucucaagguauuugaugaaagggcagccaauuuugaaaaccauucaggaaggcuuggagccacagcagagaaggcggcugcuguugguacugccaauaaaucgacaguggaaggcauucaggcaucugugaagacagcccgagaacucacuccccagguuagcuuuugcucacuuuuccuuucagcaucauaguguaauauucaggaaaugaaaucaauuauagaugcuuuguuaagaucacauauuaaaaaaaaaagaguauguugggggaugggacauaggaugacugcugaguuaucguaaaggcucuuccagaggaccacacuuugguucccagccuccaugucaugcggcucacaagugccugugauucugucuccaauucuucugaucuucaugggcaccugcacucaugugcacauacccauauacaauacacauacccacacauaauuacaaauaauaaaaauaaaucuuaaaaacaugcauguggaucuagggaaauagcucagcagagaaaguacuugccacauaauuuugugcacuggagccugaauccccagaacucauguaaaagccagucaugguaggauaugucugucauauggugcuccucagaggagaugguggguggaggcaggagaagcccugggauucucaggccagcgaggcuggcauauugauucaggaacaacaaagagaccaacgucuccaacaaguugcaaggugaggaccaacacuaaaguccuccauacacauacuuugaccuccauacacauuugugcuacacauguacccacucacacauauaaaugcuuguaugcacauccacaucauauauacacacacauugcacaacacacacacacacacacacaaacacacacacacacacacacacacacacacacacacacuacacacacauaccccacaugcauauuuauauaauauuca

SEQ ID NO: 7296 - RNA, 1337 nt, Mus musculus
ugaauauuauauaaauaugcaugugggguauguguguguaguguguguguguguguguguguguguguguguguguguuuguguguguguguguguguguugugcaauguguguguauauaugauguggaugugcauacaagcauuuauaugugugaguggguacauguguagcacaaauguguauggaggucaaaguauguguauggaggacuuuaguguugguccucaccuugcaacuuguuggagacguuggucucuuuguuguuccugaaucaauaugccagccucgcuggccugagaaucccagggcuucuccugccuccacccaccaucuccucugaggagcaccauaugacagacauauccuaccaugacuggcuuuuacaugaguucuggggauucaggcuccagugcacaaaauuauguggcaaguacuuucucugcugagcuauuucccuagauccacaugcauguuuuuaagauuuauuuuuauuauuuguaauuauguguggguauguguauuguauauggguaugugcacaugagugcaggugcccaugaagaucagaagaauuggagacagaaucacaggcacuugugagccgcaugacauggaggcugggaaccaaagugugguccucuggaagagccuuuacgauaacucagcagucauccuaugucccaucccccaacauacucuuuuuuuuuuaauaugugaucuuaacaaagcaucuauaauugauuucauuuccugaauauuacacuaugaugcugaaaggaaaagugagcaaaagcuaaccuggggagugaguucucgggcugucuucacagaugccugaaugccuuccacugucgauuuauuggcaguaccaacagcagccgccuucucugcuguggcuccaagccuuccugaaugguuuucaaaauuggcugcccuuucaucaaauaccuugagaaaaaaauaaaauaaagacauuaaggaaauguauuuccauauaaugcaucaggaaaccugaagaaaggucuuuuuaaucugauucugcaacugcucaaagaucuuauuacuaaaacaauaaucaaauggcaaaucuugaccuuuauguauuuccucagagguucagucuuaagcaucauacacaaagaggcacauccccaaaucuucguuuaaaccuacuuaccaagagcacacacaggacuauauacuuuacaacaaguucacaaaugcaaagacuaaauaauuucauuccccaaaggccuucuuacuuugaagagaacgauaaaccccuccaggcucuaccauagacaaccgggugcauuacaauccccaaguaucca

SEQ ID NO: 7297 - RNA, 21565 nt, Mus musculus
ucuaguccauaaccauuggcucuacgcgcuucccuacaggaccucgauuacuacgguaagggaccccaaacggaguuaggcugcgggugagcgccugcgcucagggagugccaaccuccccguuccuucagccccugaguaauguggaagagucagaucuucaaccucuguagacaccgagccucucacugaacgccguuccgcucguugugucuaucuaguccagccgaccuccuuggugccucugcggcugcuagucaggcaaucugcugggcacuccgagcgcgggguccucgcggcauucucugcugcuucagcugcggugcagagaggacccggcaccgaaucacugagucgcccaggugucggggugagugugagggcggggagucuccgggcuggagaccucuccaaagccggggaguagaccgcauagcuccggcucgggacucuagccugggcuccaggagcguccccgcugcugugcaccggggccgcgccugcccggcacguccgggcuuucuagccagcugggccggaagggagcggugcaccugccacguaggguucucggacccuggaccccaggcacgggaaaugucaucuauagugaggugcaguaccgacgacuugaauuuguaggaccccagguuuggccuuggagggcaaguccccugaagaagcuaagaacgcucucuuuauaggguggcgccugcgugagcuggccugggauggggaaacagugaguaggguguugcagcuucucaggagacaggugacagggcuguaaacuaagaagguggccuggagaauggaaacauaaugaggggugggcugauuggaugcaguggauuuguuugauauugaagcuuuaacuuccuaguugagaaguugagucacuguaaaaauccggcguucucgcggggaaagaauuuuuuuuuuuuuuuuuugguggcauuugggauuuugacuugaaaacacauuacacagaagaaaaggaauuuucugcaggcaaauauauaaauccuuccucuguauugaaagaagaaaacgugccccccuuuugagagagucccacugcuauuaucgucuguuucucagugucuuccugguuuuuaaacauuuuuuuuuuacauuuauuuguuuguuguauguguguugcaugccacaauauacauguagaauucagagaccaacuucugggccacaauucucuccuuccaccaugagggucuuagugcucaaacucagguccuuaggcuugcuagcagacaccuuuuuugaugagccaucucagucuccuuaucuuuguuuuaccuacuugcugcuuuuagcuaagaaccacacugcuaugccguugccaacauccuacugaguuaucacuaaaauuacuuuaaccaacaucacccaucacaucaaauaugacaaucauauauucucgguauagauuuaaaaaaaaaagucuuggagcuggagagauggcuugucaguuaagagcacuagaugcacuuuugaugaaccagguucaauuccuggcccucacacaguggcugacaacugucuguaacuccagucccacggggauccuacucccccuacuggccuucuugggcacugcacacucaguguacagauacauaugcagacagagcacccauacaaauacaauaaaaacuuaaagaaaaaaaacaaaacuacuugcgaaucagaaaaguuaacccccuuuuaaugcauaagacauagauauauuuuaaguaggcauguguuuugggguuuuuuuuuuuuuucuaauuugugugggagaugcugcagagaacccaaguucaggucuuaacaaccaauaacuccagggaaucugauguacuuuucuggccucugcaaguaccugcacucacaugacauauacaaacagaaauacauacaaaauuaaaguuuaaaaaacuuggguugugagcugccugagaugggugcuaggaacugaacucugguccucggccgaagcaguagaugguuuuaaucccacccccuguaucuccagcuuuaagggauccacuguccgcuccugguccucauggaccugcauuuacaugcacaaacccacacucaaauacacauaauacacaucuaaauuauugaaaaaaaaagucuuaucaaacagucuguagggaacaguaugauuugcugaggguaaaagacuggaaauguuagaucauugguggccagcagucauggcauaugccuuuaaucccagcacuugggugguagaggcaagcagacucuuguguuagaggccagccuggucuacagagugaauuccaggacagccgagguuacacagagaaacccuaucuugagaauaaaaaggaaaauuuuaaaaaggaaaauuguaaaacauuuuuugauauuuauuuuuauuacuuguuuauuauuugggguuuauuuuuauuauuugcauuauuguauguguuuguauguggguaugugcacaugagugccaugcccauagaaacaaaaggcaauagauccccuggagcuggaguuaugaucugccugacauaggugcuaagauugaaucugagugcuuuguuuguugaguuagggguucaguuuuguuuuguuguuguuguuguuggggguauguuuuguuugguauuuuguuguuguuguuguugguuuuucaagacaagauuucuguguguaaccacccuggcuguccuggaauucccuuuguagaccaggcugggcuggaacucacagaugucccccugccucuucccuugaagagcaagguauuuggcaccaagcccagcauaaucugggucuuccguaggagcauguacaugcucuuaaucacugagucaucuccaaucugagaaaaccacuucuacucauccuuuuaaaucuucacagcuucacuucuguguggcauuccccuagaaaugcauaaauaugcuucagauacuaaaauucuccaauacacuucagauacuaaaacccuuccccauuuuuaaaauucugcuucagcuccaucuuaggcuuuuuuuuuuuuuuuuccuuuuuuaguuccgcuuccuugcuauucaaauacuggcuuuuucuuucauauauguuccuugcuauguucauaauuuauuuggauauaacuccuuauaauacccauuaacaacauaucagucucuuugaaggacuagacucaaucaaauacagugauugaauguacucaguugagucaaauauauuaggaauugggucaaauuauguaugaccaggacuaacuauuucagcugucuucuuauuucuguacaacauacccagacuuaaauacauuuuuucuuaaagcuuguccaaaucucauuguauauuuuacuccauucucuuguuaaccuucuaguacaggcuccuacuagggcagugccugagaaggccagaagagggcacuggacccccuuggacuagaguuaaagacaguuguaagggugucaagccuuguccucuaaccugccaagcauccaucucuccagcucugauccaucacucaucucuuaacuggugucacauaauuuggugacuucuuauccaauuuccauaguauaauuaguauaaucucuccagaaauguaaaucagauuugcauauuuucucucaaaauaaaaaauuaaauaaaaugugggaaauuaguucacugagaacaauaaacaaggcaagccuugccccaugaccaguggcuguuuucauauucuuaccuuuuuuccagcauuucuucaaccuuaagaguugcacauuuuguuuuggauuucuuucauguauucucuuuguacguguaacccuugaagauuccaauaguucacucuauuuauccuaucauaugaguugcuucuuacuauauuuguauuugcaacugacgaaaaguauagaaauuuucaguuuagcauauccccaaaugccuaauauauaaauauagaacaguuuguugaauaggggaaaaugguuaagauucugguugagaaucagaggaacuaaauucuucucguuucauauuuguguauguguacaugcauauguggggggggggcggugcaugcaacuucagggauccccauguguguguggaucagagguuuaaguugggugacuuugugguucuccaccuuguuuccugaggcagucucacugaaccugggccucacugacuggcuagaauagcuagccugaaagccugucuccacucuacaguccccaaccccuuauuccacuguuagaguuacagaaaggaaccacccaccaccuccuguuuugauauggcaguggggauccaaauucagguucucgugcuuaaauggcaggcucuuuacugaccuaaacaucuuuccaucccccauucucucacuguguauaaaggccauucugugccuccauuaagcucugaaagaaaccuugggugugguggaugacuguaguuccuguugcuuaagaugcuguggcaagggauagcuuaaggccaugaguuuggcaacauacgacuaucuaaaaagcaaaagacacacuuaccuuccaagaauauuuugacuguaauugucaggaagaaugcacacauaaagaggauucaugaaguaguuacacuacaaucaaaucucugauggguguguuugcaguucaaaagucacauccacauacaguuuguggugguggucaaucaaguaaggaacaacauaacugcagcuacuaaaagcauaaguggcuaaagaaauaggcuaauuuuuuucuguuucaugagguguugcuucuuauauacauuaggcaauugaucauaauauggauagaaaaauuaagaucuuuucuuauuauaggagguuaaaauagguuuuaaagccaagugcuguugagugcuggaaguguuaagcucucagcacaaaggauaacaacaguaaauccaguggcuggguugacaaccaguguucugaaaccugaacugcuaccgauaaaaacaacucugguggaaacuuuccuggaaagaauuuuucaccagauuaagaaagugaguggaaaucuaacccuaaaauaaccagucaaaacaagcaccugucuuagagaguguugugauaauggagugccacuguguuccagggggcuagugcuuugacauaaccugugucaccucuuuuguuucuacucuaaucaguuaaacuuucucagcauaaaaucaagagcauguuuugguuucuauauggaacauauccuucaacucuuccuuuuaaaugaagccagaagagcacauugacuauagcaucugucuauaaugauaucaccaacagaugucaguaugauaaauaccgugaccaaaagcaauuuguggaagaaauuuauuuggcuuauacauccugaucacagaugcucguugaaggaagucaggucaggaaaugaagaaagugcagaggcaggaaacauggaggaacgcugcuuaguggcuugcuuagcuucucacaucacccaggagccuaggcauuacaccacccauggugggcuggguccuacauuaaugaccaacagauaugcccaaagaacagucuaauggaggcaauuccucaauuagacuuucucuuccagauuuaccuagguugugucaaguuaacagaacuaacaauauauuguauauugcacuaauuaacuauccuguguuaaauaaacuugcauucuuggaauaaaucauauuuuuuaugauuuaauuuguugcugaauuuuguuuucuagaauuaagaacuuuuccaucuguguucuuaagugaucuuaaucugcuauuauuuccauugccuuugucugguuuuuaugucaaggcaauaugacaaggaauuuuuuuuuuuuuaaaccagcucagcagacuccaaacucugcaucuccacugauuuauuuauuuauuauauguaaguagcugucuucagacacaccaggagagagcaucagauuuuguuacggaugguuaugagccaccaugugguugcugggauuugaacucaggaccuuuggaagagcagucggcacucuuaacugcugagccaucucaccagccccaaggaauuuuuuuuaauacaauauauuuugauuauauucuuucuccuuccccuaccuagguccuucccuuccccauaccuacccagcuuuguguucucucuuuccaaaaagaaaaggaagaaaaaucagacaaauagaaaacacagacaaaaaaauaacaaaacaaacauccacacacgcgagcgugcagagucauccucguguugucaaccacuguggauggugccugcccugcccagugauacaccaguggagaaaaacaauuuucccucuccuaacauguaucaguugcaagcaguuuggucagggguaggacuuagugucugcgucccuuucuuuacccugggauuuugucuggugugaaucuguggaggucuuuguguggugucagagucucuacaaguucauaugcauaucaucucuguugugccuggaagaugcuguuucuuuccuuggaguuguccacuacugguucuuggacucuuuucugucucuucuacauaguucccugagucuugagaggagggauaugauaaagaccuccuguuuagggcugagugcuccaaagucuuuuacucgcuguacaucguccagaugugagucucugcauuaguuacaaucuacugcaacugugcauuuucaguguacaguaagcauaaccccuuuuuuuuuccuccacagaaaaugauccacagucuauuucucauaaacugcucuggcgacauuuuucuagaaaaacacuggaagagcguuguaagccagucagugugugacuauuucuuugaagcucaggagaaagcugcugauguugaaaaugucccaccugucauuucaacaccucaccacuaccucauuaguaucuaccgggauaagcucuucuuugugucugugauacagaccgaagugccaccucucuuuguaauugaauuucugcaucgaguugcugacacuuuucagguuuguauccgucaaacuguuguuacuaaaucacccaagauaguucaaggacacauacacacacacacacacacauacacacgugcgcaugcuuucauuuguuacuuaaauuucugauguguacuggcugacuucucuuuguaacuaaacaaucucauaaacacuugcagagaguauacaguagcgcacguugcuguucugcucauugcuuuuuauguguggcaaauuauaucaugaggaaacaggaguacccuccacuaagcacucucuggaucaucacaaggucuuuauugucaugagcgccuuuauauuucuguuuucuauuuucuauuugaugaauaaaccaaauagcuuaaagcuuuguauguguuugaguguggguuagugagggcaaaugaaguuuauagcucacauugcagauugaugucucaguacuuucugucaugauauauaauaggaaucagcucaguauaaauacaauaagaaaauauugaagagaaauguuaggauuuccauagagaacuuuuucaagucuauauauuucuagcaucuuaaaccaugaguuaagcuacuauuaguuuacucuucagaacgaaggguauuauauaaaagcaagccuuccuuccugcuuucucuuguucaauaucaugaauauuuuguuaggacuacuuuggugaguguucagaggcugcaauuaaggauaauguggucauaguauaugagcucuuggaagaaauguuagacaauggauucccacuggcuacugaaucuaacauuuugaaagaacugauuaaaccaccaacaauucuacguucugucgucaauucuauuacagguaugaaaaaugaaaacacugcuaggaacugauccauugaaauuguauaaacagcucauuuugcucauaugacagacuauuaggguagucuacuuuggccaaaauuaaguuaccaauaaugcuuaaaugaauguauauuuccguucuuuuucuuugucccucucuuucucucucuuggugugugggugcacaugaacgcaugccugcacacaugccauagcaugugugugcaggucagaagacagugguucucccugucugccguguggaauccagagauugaaucaggcccucaggcauggcagccaaugccuuuacccaacaacucaucugaccgggccccuuuucuuuuuggggauggagaacaauaacaaaaacagauccuaugaggucagguguaguucacauguguacucauaucacuuguuaggaagcuaaccagggaauuguuaauuaaguucaaggccaacuugguauauagaaugagaaauauguuuuguuucauuuauugaaagaggcucagucuugaaggacaaaggacuuuuaggguuaggguauagcucauuuuccuauuacuggguucaauaaacaguacuucgaauaaagaaaaacuaauaaaauagguagaaaauuauuaguagacuucaugcauauugggcuuuaugcuuuuuuaaaaaaauaagcuuaauuggguuuaauuguaggccauaccauauucagaucaucuuuugauuaaaagucuuccacaaaaagugggcuuccuggcacaagccuuuaaucccagcauucaggagaauuugaggccaaccuggccuaaagagugagcuccaggccagaugggaugauauccaaaaggaaaaaacaucuucuaaaggaagauucuuauggaaugcuauguaccacuccagccacaucuguacuuguccuuuuaacaucaaggaguuacacucuaggaaaaguaguuuaaauaucuaaacauuuuaaagaguacuuugauauuucauggacauuguugugaggcacugcaaaucucucacaauacuguguuuggugggggaaagcacaaacuguuagauauagauauauauauaaauauuugcaaagagaaacaugcuaaaauguuuacauugacuaucuuuuuagcuaagaagccauccuaauuuuugccuuauacaucuuaaaauauguguaugaaugugugugcguguacauggagaugucaugcucuaugcgcucaccaaguccuuuuugagacaaggucucugacccuggaucuaggucgguggccagcaagcccuagccauccugucucgacccccacagugcuaggaucacagguguguacaaagucacacccaucuuuuuaugugggugcugggaucuagcagguccucauguuugcauaagcaagcacuuuuauccacugagccaucucuccaacccauuucauacuuuuuaacuuuuaagaaaaaaauguauuugauaggaaaaacguacuaauuugucauguaaaacuauaacaugaguugaugacauaaagagaauggguucagacugaauguggugcugucaccuguaaucccagcuacaguugugaggucacagguacagaggagccuugcuuauuaaacuaaggcccugauucuguuuccuaguaccacaccuauaugcacauaccaaagagugguucaauaguugaaguagucuuucuugaacuaccaggcccuagcacaggacccaucagaaucgguagauuguggaauaagauagagaaauaagagcauuaaugagaaaauaacgcauacaaugggagauugagcuguauuagccccucuagcagaaguagagcuguugauaacugagcacugaggggcacacggaacagcugaagcugggcugaugggauggccaagccuccaguccacgacagggagcugagaugggagaacacuucugccagggcugagcaaaacauuuagcuuuuaucagaaugcaggcgggggagcacugaaggcugcugaacagggaaauaauaugauuaaagcaguguuuuucuaaaacucuuacaaaggaacaggcuggagauaggaacaccagcaauaaauagacuauaaaauuaauguuagcuuuguuagcuacacucagugacacacaucuguaauccuagcauuugggaggcuaauaugggaggauccccaguucuaagccauccuggacugcauauauuccuugucauuaaaaauuaaucuagauuggaauauauugugugacuguguagucaagaaugacugaauuugcaauccuccugccuccauuuccucacaguugauagguuuaaaguguacacucaaccguugaaugcuggacauugaacaaaaagcuucaugcacacuaggcaagcacucugccuguuacauccccagcccugaaaccaguuucuguuuggggugcuuuugugugugucuuguuuuguuuauggagacaguccucauaagagcucaggcuggcuuuaaacuagcaaccuuccugcuuuagccuccugagugcugguauuauaggcuugugcuaccugucuugcauccuguuuuaguuucuuauuuauugcuuuaugaagacagggucuuacuauguagcccugacuggccugcaucucacucugaccaggcuggccucagacaugcucuuguccucuguacccugucucucaaaugcugggauuacaaauucgagcccuacaccuggcuuugcaaguguaaagaaagcagaauuaccaaaauagaaacauugguaaaugcuacuuauggggaaguauuuaaagaaacuugcauaaauguuagugguaguugauguuaguaauaguaaacagaccuguuguuguuguuguuguuuuauaagcugccuuuuacugcuguucagcauguguuauuuuuccauuaaaauguaaacugaacaaaauguuuaauaaaucacaguggaagggguucuguuuggguaaccauacauacauacauaguuugccaggaagcuagucagauauugaacguuaaugauauuucagcaaaaaaaaaaaaugguauacugaccuuaagaaggguauuggguuuuguuugucuguuuugcuuuauuuuguuuuugcuaugcugggaauugaauaaggccuugcauguuagaacuacauucucaauagucuacggaacuucacagauuggggcagucccucacauagaauuccccugcauacccaaaagccagguucugaagucuucucaguagagacuucuugccaacaggggucuuccuuucauuacuaccaauaaacaggaagcaaaagauaaaugagugcauuuaucuuggucuaacagguagacagaaaggcccauggccuaucucuggucucuuguguggaauauaucuccauuaauuccagagcccaucacaacagcuaugaaggaaaauccaaacauuaaaguagaagcuaaagcauuauuuuuuccuuuucauaauaacuuuucuaauaaccauugcacgcacccacuuugccuucuucuuuucuaauuucuaggcaguaguaauguuggggauacacuccccacugggcagcuauccaacaucccauggcgucgagcaggagugaaguacacaaacaaugaagccuauuuugauguaguugaagagauagaugcaauuauagauaaaucagguaauuauguacacguggucucaugggggaaagaacuucaauuaauacaaguugaauugaaaacugaaaucccuuggcaggaaguuuucagcagagaaacauucauuuucuaaugauguauaaaucuuuuuguucuccccaaaagcuacauauaauuaucacagccacuaguugagauauugccagauguuuuaagucccucuugcagucacucaucugacagguguuacauacccaugguacccaugcuucuccacucuguacuccuucugcuaaaggccucuucuagugguuucaaccagagaagacauuggugguaaauacuagaauaauaaauuuuuauuuuuaaaaaaucucauuguaucuucacaauuuauacauaaagcagccgagacucagaaccguguaaccugcucagcaucauauaacuaguugguauaggggaauggaugacacgaugaauuacagguauaauuuugucuucuuuccaauauaaccuaagccuauagcuuaguccauauuaugugaaaccugcuucaucuuuaaauucuaaacuucuguccaaauaauccuuacaagauugauucacuaaagguuucaucuuucuuauacucuagcuaguuagguguggccagugagaaacacuguugaaacuaguauaauagauccaaauagauccucuguccucucaccugucagugaggugcaaagccugugguucucacaaccaguguuucuacuacucaggauauagugauagcucuagagaagacccaaagccaugcagguaaucagcuuuuucuuucuuucuuuaggaucuacagucuuugcagaaauucaaggggucauugaugcuugcauuaagcugucuggaaugccugaucucucccucucuuucaugguaaguuuugaucuguucuauaguuccuuguaugcaugaaacauuugaaaugcuaaaugauauaauugcugaaauaaaauuuuacucauguuguauuugugugugugugacuuggcagaggacagcuuccaggauguggauccuagaucaaacucagauccucaggcuugguagcaaacacacucuaccuacuaagucaucucgccagcccuggagugugucuauuagguuacaaacgacuaucucagaauaucccaaccagcuuaacagacaguaacugacauguugaacauggccuugaugaaaaggucaaagagaggucuuuaccuagagugugcuagaaguagcucaagaucugcugucuggcuuuugucucuccauggucguuuuuaccgacuguaugcuuauguaaaggggcacugaucauuuuacauucagcaugauacacugcuacagacagcaaagagaaauguguucugcuucugucucuguucccagugucucucgccucucuugaagcucagucuucaucucuaggauacagagugccgcuuacuuucccauuguuuauaaccgcaaguaaagugauauauaugaaagguuugcaaacuguaaaaggcuacagagcuauaaggugauucugauguuguuauaaucaauucuuacacggcuuuuacaguggcuuagggaguauauuaauucauaauauucauaacauguaauucauuaauguaaauauuuaugucauacgacuuauacucugugcauacggcuuaucuuuuccugacagaacccaaggcuacuagaugacgucagcuuccacccaugcauccgauucaaacgcugggagucugaaagaguuuugucauucauuccuccagauggaaauuuccgacucauaucguaucgugucagcucacaaaaguaaauugacgcaucagccagaauuugcaaacaccgacaaucugaaucgaacucccaguuguuguuucaucuuuacaguuuaauucuugaguuuaccaauguuuccuuuagcuguggcucaccuggagaccuaaugagaauuuuguacccaaaacaauuaguguuucugaacauggaaguguagagaaguaguaagagagaguaaguuaaaaaucuaugauuaagaccaagccuuuggacugugcgugaccugggcaaaccaugaacucagugccuuagucugcuaugucuguaaacaaacaagacaggauacccuaaaacauccccuaaacuaccugcuucaagucacuguucucuacauugaguuugggagguugaagugguucuuguuuuuaaaacagugucuuauuuguuaccucaaacuguggauccuccugccucagcuuucugggugcuaggaucauugauaugugccaccauauucaucuugcauugagcuuuaaacaguuuacuguugucagcuggggcugacgugucccuuaaaauuccagaaagcauuugggugauuagacaaaacugaaacauuuuucugagaaaauauuucuuagugcuuuaaauucuuuuaaugggcucuucucuuucuuucuuucuuucuuccuuuuuuuuuuuuuuuuuuuuuuuagcuguaucccuuuauccgaguuguuuaugugauauuuggaggagauuucuguuugggcuuauguauuuguuacuaacccauacauuucuagcacauugguaccagaacauugcuguccucaacccuagugcauaggccuaaucugcuagggcauaugguccuguggcacaguuacagaccucguaggacauacacuacaucuggaguugucccauaccuuucauaauguacuuuuguaccuuuuugugucuuuuuuuuagucuaguggcaauaccaguguaugugaaacacaguaucagcuuuaaggaaaacagcucuuguggccgguuugauauaacaauuggaccgaaacagaauaugggaaaaacaauugaaggaaucacagugacuguucacaugcccaaaguugugcugaauaugaaccugacaccaacgcaaggcagcuauacauuugaucccgugaccaagguacaggcacuucgaaacaagaaugagcaaguguucugcaaucuauuuugugguuguggguggaggucacaguacuuaggaagcaggguccuugccuugcuuaaacaagacucuagccaaggguuuucagaguccuagaaaagaugauuuucucuucgcucccuugcuuccuuauguaggaaauguaaguuuucagcagaauagaguacuugauaaaugagaagguguuuugguuugguuuggauuguguuugaaauggaggagccgggcgugguggcgcacgccuuuaaucccagcacuugggaggcagaggcagguggauuucugaguucgaggccacccuggucuacagagugaguuccaggacagccagggcuacacagagaaacccugucuuaaacgaaaaaacaaaaacaaaaaaacaaacaaaaaaaaagccuuucugggacccuuuaagugugaggugugagcaggcgaguccacauccucaccuuccagcugagcuggagucauccuucugucugucuguuacucagccccacacacaugauucugcuguggauucuguaacugaacauuuagugauuagaacauaagccaguuguguaguccuggcuucuguuuucuaagacacugcuucauuuuguguaguguauagcaucuguugaccucugagcaugucuuuaacacagcucagguauuuucucuuguguuuuuaagguacuagcaugggaugugggcaaaauuacuccacaaaagcucccaagucuuaaaggacuaguaaauuuacagucaggagcacccaagccagaagagaacccaaaccucaacauacaguucaagauccagcagcuugcuauuucagguaacacguguuugcugggcauugaggggagauuggggcuaggagucuggaagaguacuaacagcucuacccuagaaggaacagcagcuccagacagcagccauuugagaacacaacuuaaccucaugcucuucugucacacauaccucaccucaccuucauuuaagagccagagaagcccucauuuguguucaaagaaaguggaacuagcuaguuuugugagcagaggcaucuuaaccaaggccaugcuccuuagaguacagcaugugggggauagaaaagggauguuguuuccacaugaugaauggagcacugugcagugucacaucuaaggcacaguguucauuguuacacaaguacugcauuauuacucugguaguaaugauucguuucauucuuuuugacacaggcuuaaaagugaaccgcuuggacauguauggugagaaguauaagccauuuaaaggagucaaauaugucacaaaggcugggaaguuccaagugaggacaugagaagaggccaaacuugcucaagaucaguuuguuuuuucaagugucauugcaauuuauuacuauuagguaccaagugggugggaauaauauacagcauuugugucaagcuacccugcuaacaaaguugcuuaguaauugauguaggguucuuacggagcuuuaagcuaaggaaaguuuucuaaagacuuagcuuauuuuguaucuuuucacuuaggaaaagguuuagaugauuucuuccaugggggcuaccagcugaaugcugcacauucuaacagucaaagcagaaggcuacagugauauccucucuccuaaagcaagccaacuggucucaucuaccagcaggaacugucucagucugugaugugucaggugcagccaagugucacaccuucugaucuuagccaucucagugucugucccaagagaggagauugccccaccccaagaaguuuacagaaaacugccucuucaaguguuugccuuacucagcuuuucacuugugccauuaagcaagcacuguagcaaaagccacuuccacauggcccuggcagggagcacuacagcuccgugcuccauucucacuguacuugguauuauauuuuuuauaaauaagauuuuuauguaaagcucagauuuugauuuacaaggaccuugcugcaguaaauauuccaucaaucuugugccacuaguucagcuguuaagauagcacagucaaaucauuugcaucaaaagggcaaauacuuuauuaagacaacgaaagggaacacuacuucuguuguuagcgaguuacugcaggcacagcuguuugugcuuuuaaacaaauuaaaguaguaaaagagaaaaucaagcaaaaccuuugccauucucauguuuuauuaaagcuuuauuuaaugccacuaaccuaauuagcuugaaacccuaguuuagcuaaagaaggaaaucaugaguuucacuauguugcucuuuucaaucuuuguguguuuaaauaguugaauuugcuugugugcccuucauuugggggagcgccuuuccauacuacauauaucuccaggccauugugaugacaccuucuccaaacuccuaucaaauucgagugaagcacuuaagugucuuugccguacugcguacguggaagaaccauucacggaaggacagaguccucaguaaccauuuauacuaauuggucuuuacuccugaaaagccagucugugacucaggccauucugcaucuuucacuuggaaauccuuguucaaugacaaaagaaaauggaggaagacaaaagugcuugcccuuccuagcugccuugucauccuuugucccuccuuaccaugcuaggucauguccuaggcucacuccacguuggcgugccaacgaugcagcagcagugccgccguggcccccaucuaauagggaggccaacuguugcaaaacuucaaguagacuuuucuugaguaacgaaucucagauugacaauuauauuuuaaguaaaaacauaaaauauucccuuugacuaagaucuaguucuaguuuuaguaucuuguucuuuuaccucaaaagcaagcacauaaguuuuaguucuucaccauccuuuaucucacgaccauaccuagaccgcacagcuuccuuccugugcaucuucuugucuaaguuucuugucuccagggauuucugcuaaaguagcuaagcagacugaauucuuuuacuguuaaauuguuguauuuauuaauuugacagacccuaauaagcccuuucucuaguucuggcuaucaugucaauaaauauaugagcaaccaaaugauuuuuaaaguuugauuguugauggaauauucucauauucaggcuguauuaaugcaggcugcacuggaucaguuucuucuguaucauaaaauguuacaguugcuugaagaacauugaagaggccucuuccugaauagagcauauuuacaaccauucaucuucugguaacagaccacgugauaaaaaugaucaaagcuaucuuccuuaccacuucaauauagacccaggaaaacccaguaucaaaagauuuuuuaaacagaguucuggguaagccaccauauucuccuuuuuucuguuguucuuaagaaaucauaaucuaagaguaaauaaaacagauacuuauugucugggugagguagccccacccccaccccccaguggaauucggcugguagccucauuuccuaaaggugcuacagaagaacacuggaaagaugcugguaauguuguccuuaaaagcaacugcuuaaaaauacaacuaacugcagagucugcggcacacaguuccggugaacaaggugaacagcaaauagaggcugcagggauuuccaagucuauucagcagccgugaacacaggcugccauccauucuguaagucaaugcaauggaaaguuuacccugugguauuauuuaaccuuuucuuuuucuucuucaguucuagaaaauuaggcaaaaaagcauguuuguuuguuuuuuuauuuuagucaguguuuccucaaacaagaggaggacuauguccucaaagcuaguucugccucacacccauagcuauguacugggguugggaacaaacaaaagugucccucacauuucacaacuucagcuuuuuaagggacacugguggucucuacuaaaauuagggugucucuagccaggaggugaccuacauuuggcugcuuugcccacugguaacuugugauuucuucuccuucuaauguauaagaauacauuagcuagaauuguugccaagauuguucuugaucacgcagacccucuuacguaacuacacuauuauauaacuccuuuauggauugaauaaagcuguugguuuccagaccuugagaauuagcuucaauacaaaauaagucugaccuaaaguuguuaguaaaauaaccucaauuagagcauuauucauauaaauguacuuuauuguuuuaaacagaacaaaagaagaggcagaaacauuuacauauaaguccuagcuuauaaacauaguuuuuagugguggcaucucuaacacgucauucagggacuguuuccuuuugccuccuuguacuguaagcacugacacuagaaagcacaucugguggacaugugucuccagaacugaaggaacuuggagaauaaacaugauucuucuuaguuccucuaagaaaucuuuaguaagacaaaaaaugaucuuuggcauagauucauacuuuaaaggcauugauaugcauuuauaucagguaagcaacuauacagaucugcugagagcuuugaaaagaaucuuuuaucagcaaaaagaaauagggggagccugaguauucagggucaacuuaagauuuacaaguucaguguugggauuggacauacuagaugugggaagaacauccaggaagaaggccucacuccuguauucgucugguuccugauuucugaaagaagcauuuguauacugggaaaugcuuauacagccaggauaaaugcaaaaaaaaaggaaagucacuuuuacacuaacuuugcccaauaggaaacaugccuuucugauaaauagauaccauacucauuauucuugaauacuucguauuuauggaaggaugaaaaaugcuugguuguaguugauuaaaagcaacugggaacuauaauaguuccuacugauuuuucccuagaagcaccagaaguauaaucugcaaaugcuagucucccagacaagauugccuuuccauucaagucucuuaaggagcaagcccuaauucuuaagucucaauuuugaaugaaccuuucaaaguuacaagcaaagucaaguguggugguaggagcuaacaggcugacacagguagaucacuugaauccauaaguucaagacuagccuggacaacauaaagagacccagucucaaaauuuaaaaaaaagaaaaaagugggggauggagggauuacagacaaacacauaccuauguaucuuuaaagucuuguuuaaagaagcauacagaagaagacugccaaagccuaggaugauuugguuaaaaguaaaugcagcacuucagcucagaaauuaaagaaaauaagggcgaagaaugaaugccaaggccucagcacagacaucuacuggcagugacaaagcauagaaaaucugggaguggccccacugggaggaugggcaggauaacaccccagugacucuguuccucuagugacagagcaccaguguguuuacaggaugguuaccuuggcaaccaaacaaggcaggaugugagacaggaaguuuccauaacacauacuaguuaguggcaugguaaaaacagaaauaaugauuuccucacaacagugaaaguugguuucccauugugaggaacuaggguuacacugggagaaagcaggaaaugaauccaggccgcacaagcuagaacucuccagagaccacuuuuuccugcagcaaugaugcacagcccagagaagguaggcagggucagcagcagggggggaaacccaaaauaacuuuggaagcacaguuauuuagacuugccucagcucuaggucuugagagccuauaguggggaaagggaguuggugaaccguaaacacagaaaugacccccggggcagagcagggcuuccggcuaguguucacgcuuauucugagcugcuguaaaauccaugggagagagugcgcauaguaacugaaaguacaggguuuauagagagacacauuucaaagugcccaugacaagaguauaaauguuccuuucuggugugugaagccagggauugauguuuccauuccugacaacucugaauggcuucuggaacucaagaugguucucuucucuuuagcagagguguauguaccagccagauuugacgaggugccuacugguaccagggagucuuucugacccagcgcagaguaaagccagcaucuguucggauuuugauugaagcagcuucagccucucgcacagucuccuucacagacugcaugagguucugggcauuaugaaccagcaucucuguggccugcaauaggagagcccuguuacuauagccccuaacgcagcacucgcugccaggagugggcugcaguuaagcccuauacccgaucccccugcuccaccaguaguuuaacuacauaaacagcaauguuuauacaauuuggcuuguauaucaaugacugcacugugucuuuguauggcugacagcaugcacugguuuugaaaggugguguucuuuuaggacuccugcuauguccucuaccuguaacacuuuucuuccaaguaugccagacucccccuccaguguccaagcauucuuuacuugaagauauuuuucuucauaaaauccaucauaaauuuaugcuauauauuauaccuagauugcuugggggugggaguuuuuuucuuaguuggcauuugcuuuugguguuugggggaggggguaguuuaguuuaauuuaucugucuguauucuuuaagcuccauagggcagagauuuuuguuaguuuuuucacugcucuccacuauuuaguacaggaugcauuucaaaagcaaugaaugaaaauaaucaagcuaaucgacccuuaaaaaugguacauuauuuuucaaaacaccaaacuagaagauggggaucuaguuggcugucuacucacacccagacaacucaa

SEQ ID NO: 7298 - RNA, 191047 nt, Mus musculus
caguucacuuccggccgccugcggauccagaugugacucucagcucuuucuccagcaccaugucugccugcaugccgacgugcuucccacuaugaggaucauggacuaagccucugaaacuguaagcuagccccaauuaaauguuuccuuuuuaagaguuggcauggucauggugucucuucaccgcaaaagaaacccaaacugagacagaaauugauagcagggacugagguauugcuaggccugaccaugcuuuuguugggaagaauguggacuuugggacugucuuaagcauacuccauaacgccccgcuuuuuuuuaaaacccagguaaacaagaauagaguccagccauggguacuuaaugaguuacagggcagugugagaccauuuucaaaaaacaaacaaacaaaaucaacaaaaauaaaaggggcuggagauacaauacagcgcauagcucagugagagaacccuugccugcuugcuuaugcucaaggcucuaggcucaagcaccaguacugaaaauugaacaaucaccuaugccaaugugaccuggugugaccaaaucauaaaacaugugcuuagcauguuuagcgaccugggucuaucccaacucuaaauuaacagagcacaguggggcagugccgauacacuuuaaucucggcccuugggaguaaaugguggauuuucguugacuugcaaaggcuguauuuuucucugaccauuuuccccaccauauuuuccccauagaaaugcccagugcaccgggcagugaugguacacaccuuuaaucccagcacuugggaguucgaggccagccugguccacagagugaguuuaaggauagcuagggcuacacagagaaacccugugugggggcaagugggggaaagagcugcccagugcucaggugagguggcugcagggccuguaucagagaagcugcuguacuuucucaguucugaagaaggaaacuuguuauucgaaaguuuucccuagggagccuuagccccaggggcagcccgggccaccuccuaaguccccucccuaaagugagccaggcuuucagcgaagcuucuauaagcuguuucuccugugcugugaauacuuccaacgaacucucaguaggcaaaccuuccuucccuucucugccuccucuuucuguuaugaugaugaugaugaugauuggugacacauaugccagagugcacauguggaggucagaggacaguuuuauggaguuggcucucuucuuccaccuuuaaguauguuuggggaauugagcaugggucaccagucuuuugaggcaagcaccuuuucuguucuaaguaauuaauguuaugggggcugagacaagagcuuagucugcaagguacuugcuuugugagcauaacggccuggguuuggugccuagaacucaaccugacuuagugacuuaagcuuguaacaagagcgugcccaggacauaggaggacccagcagaaucuauugggugcacucuaaugaggggcccugucucaaacaaaauccagguggauggcaccugaggaaggacacuggagguugaccucuggauuccacaagcgcacccacacacauaaacauguacacccccacacuccaccauuaacacuguaaggcuauagggauguaacgaagcuaguaaaauucuugcccuagcauguaggaagccauggcuucaaucucuaaaccacacuggaauggugggacauacuuguaaucucaagcacuugaaagaagaguuuaaggcuauccucagcugcauauuguaugaaccuaggcuaagcuucuugagaccuugucucaaaacacacacagaaauacagacacacauauuuuugaauuagaaauuauauauccuuaagcaauaccaguuguaaauaaaagcaguaaauaauguuauguauugugggggucugguggcgcacacauuuauucccagcacuugggaggcagaggcaggcagauuucugaguucgaggccagcuuggucuacagagugaguuccaggacagccagggcuauacagagaaacccugucuugaaaaaccaaaaagaauguuacauauuaaaacucacccaugccaugugaaguggcgcacaccauucauccagcacuuggagaucucucagaucuggucuacacagugagucccagccagucagaauaauguaaugagacccuuucuugaaacaaacaaaaaugaaaaugguaaauuuuaagaaacauguauuuuuuuccuaauuaacaucaacaaaacugcugggcacauuaaaaucccauauuuaaaucccaguacucaggaggcagaggcagauagaucucugaauuggaggcuagccuggucuacagggugaguucuaggucaggguacacaaacccugucuguuauacccaaaucaaccccauucaaaccaaccccaaaaccagcaacaaauguaaguuauuaaaaggagacagaaccaaagcaagugagggcaacuggaguguaggggcccugggagggagcagaaggaggggugcuccugaggucacagaaacaaaacuuagcuaacacccuaaacuuuaacucaggcaacacugggcagauccaaaggaaccgggccacuaaaauuguuacaaaaguggaggcacugaucugcaccggagagacaguuaaaugaaacaucagaucuagguuuggcuccuggucuaagaaagaaaaagcuauaaaagccuuuauugggacacuuagugauauuugaauaugaauuccagguuugauaacagcaauuuaacaaagccacauuuucugaauuugauaauuaugugaucauuuaaaaggguguccuugauguuagugaaagcuggaccuauuuaagggguaaaagucuuaagucuacucucaaucacagagcauugcagagauaauaguauacacaguaggggguuauaaagagaaugggcaaaccucuguccacggagucugguugagcgcauaggaguuuguuuaagugauuuugcagcugcucuuugaccaucauaucacaugaguucuucugaugcaagauugaaaaggucuuuuguuuuaugauguuuuugagucagggucucaugcagucaaaaacucaugauauggcugaagaugaucuugauggagugagugaugguuagagugggugccucaggcucuggggagagggucagucaugcaaggaaagcaacuacaguccuccuugccauguaucguguccccuugcucuuggaaguccugagugacauugauguucuuagcuuauagaaugugucucuugcauuauggcaccgauggcuaagagccaaaaugaaaucagucugagguaacaaaguucacuuuguacuucugcccauggacaaugagccacacacacacacacacacacacacacacgcgcgcgcacccgggacagcaugugcgggaggguggggauaggcacuguacagcugggugggguuggguaaggucggauagcauaggagguggggcaacaguauucagggcagagggcaugggagcgggcaaccuggggguagcauaggugcugggugucaguucugggagagagcacaggugccaagagggcccgcuccaguguugguucuucuccaccuucucauuacuugguucuuccagguauagacagggucucuucaaggguccuuggauuagaguuaaucacuuucauaacccagucuaggccacccuuggucuuggaagacuacaggcuucuggagcugcucuggcccaggggaugcugggagucagugaguguggaacucugcagggacccuggcuggggcuggcauggggacuuaugggcagaggcugggaugaaccugucuguauuuaucuguucuagacuguggaggcugcugucugagcugggguaauguuuuagaaaucucauuuugucacaauugaagaaggcugguagagcuccagcuagcuuucuccuuuuagacuccuuagaaggagucaccugucuacuugccacuuaagcagagucacagcccugaaagguaucugucucuuggcugcccacgugggcuucagauggugaacuggacagccauggcccuggccuuccagaagcccaggaaaauaugaauuaguggauuucaacagugcagugucucauagcaacagaaaaagcaauugcagagcaccuaggcagauuguaggguuuuuuuuguuuuuuguuuuuuuguuuuuuuuuuuuuuugaggcaagacauuguguugcccaggcugguuucaaacuugcuagcuaaccuuaaucugaccuugaauuuauuuauuuauuugguuuuuucgagacaggguuucucuguauagcccuggcuguccuggagcucacuuuguagaccaugcuagccucgaacucagaaauccgccugccucugccucccaagugcugggauuaaaggcgugugccgccgccgcccggcauauuuuuauuuuaaaauuaauuacguguguguguguguguguguguguguguguguguguguguguguaggugcacagguguagguagcuccugaggaggucagugguuucagauagccuggagcuggaguuccaggugguucugagcccccugcgaugggugcugggaacuguacuguugguccucugcgggagcaagcaauacugaucuuuacuaagccaucugucugguuccuugaccuugucaucuugacuuuccugcuuccuaaaugcaguuauagacaugagccacuauaccugaccuaacauuuuuuuuuuauuaaaaaaacucuaauggcugccaggaacccaguauggggguucaaagaaaaggaaauacaaaugccuuuuaaacgcaugaaaaggaacacccaaguucuagucaaagaaaugcaaauugaauuuugaugggauaucuccuguugggugguacagaaccuuuggcugauagcuggugcuguucucaaaacucccucugaggcaagucuagacccaccugcugacuuuuacuuuaaaauucaaaacuguaagcugagugggugcuacagauuucugguaucagccuucagcggguugaggcagaugggucgagaguucaaguacauaugggcuuuuauagcuggccccuacauuuuuaaaaacgugucauuuauuuuuauuucauugguguuuugcugcacgugugcaugugagggugucagaagcccuggaagugagucacagaaaggugugaacugccgugugggugcuggggauuguacucggggcaucucaacugcggaaucaucacuuuagccaucaaaauacauuauuuauuauauuuguguguuuauauauauauauauauauauauauauauauauauauauauauauauauacuguugcuguuuucagacaccccagaagagggcaucagaucucauuacagaugguugugaggcacuguaugguugcugggauuugaacucaggaccucuggcaaagcagucagugcucuuaacugcuggaccaucucuccagccccaaaauacauuuuaaaaagacauucugauaguaggguguuuguaauucaaugaaugauacucaucgcugaagauaaauguauuucuaaaaaaagcauugacaauauuuuuaauguuuauuaaucuagaaaggaagaagucucaugaccaccguggacuuagugccuagucauuccaaacacucuguauguguauuggcuaguacuacuuuugugaguugcucauguugaauuguguguucagcugcauuuaaauauuuauuuugagaggggcagggccucacuauguuauauguuacccaggcugggcuugaacuugugacucaagugaucuuccuccuuggccuuccagcugcugggacuaugagggugaaagaguaguaaacucagugcuccaagguaugcucaucauaaaccagauuccuuccuccacccacccgcuuccuggguucaaagaguguucauucaaagaaagucacccugacccacccugaccauugcuggaacccacuaugcaaaggugcuauugcuaggggcucuuagauuguuaggggcucuuagaaacugucuugagagauaaccugacacuuguaacuuuguacuuccuugugacucuuaacugguauuuuugguauuuuccaacaacgcccuucccaccuccuugaguugugguuccuuccuuuaaauacccccuuacucagcuacucggcaugccacaguccucuaccccugcgugguguaugaccgugggccagagagcgcucuugaauaaaaauccucuugcaauuugcagcaagacuguuucuuguuggugauuuugggaugucgccucuccugagucagaaugugggggaguccucacguugugggucuuucaagggcucaaccauaccugaacuacauaugaaaaaucaaaaacuaaaauacuguuaaaauguaacauaugccuagccagacggcucagggaguaagggugcuuaccacucccccaagccugaugaucccuguuggguccuugggaccuacaugguaggcaaaaaucaaacccugaauuguccccugaccuacacuugccacuguggcauccauggccaaguaugcaucaaagagggcugaaagggaugcuuagacaaaagcagcacuucugcaauuucugcacgagcaccgauggucuagggucaccauucuuggagugaugcuucagcuacacgggccauucuuaagccaguauggcaauaaugcuggccugccagcuaggauccuugucagaagcaagucuauuaguuuguagaaacuuuggccuugucugccucuuccugcaggccuuugcucuggggucugccugcauacagacaaauaucaaauaagacacaaauguauauuuuaaaguggcauaugccuauaaucugauugaggcaggagaaucaguaguucaggguuaacauaagcaacauaccaaguucaaggcuuaccugggcuauaugaaacccugucucacaaacaaacaaacaaaaagucaguucuucuguuuaucguuugucucacaaagauacagauugcugugaaccaaggcgucggugggugcagcacugaagggugcugggcucccagggccucagcgucaucuggcacucugcaguagagagcucugggggcacugugcacugcaucaaagagggcugaaagggaugcuuagacaaaagcagcacuucugcaauuucugcacgagcaccgauggucuagggucaccauucuuggagugaugcuucagcuacacgggccauucuuaagccaguauggcaauaaugcuggccugccagcuaggauccuugucagaagcaagucuauuaguuuguagaaacuuuggccuugucugccucuuccugcaggccuuugcucuggggucugccuggccaggaggcaggcuugucgagggauccugggaagggaggcugauuacugccugggagggugagcaagaggcuggagcaaaagccugcuucacuuggguuuugugugccugacagccacccuuuagcaaggugaauucuuucaguaaggcucucauucacauucugccaagacauccgccaccuauucuugaguucacacaaaaaaauuaaaagcaaaacaagaguccugcuaauuuagcaacuugggagaugcagcugcugcucccugggcaccagaaaggcuggccucagccuucaggccucagccugagggaggucucccaggaguuauauuguauccugcagcucaaggccucauugugacagcugagugacuuagcuggcacugugggcuggagaaugauaaagguacaaagaacaggcagcuugguaguuggggauggcacuggauggugggggcggguacauggcugguuuugccuaggccuccuaugagccccuacuuaggcagcugcugcugcccaaggcacagcaguucuggccguucacuccacccucuuuguaaaacaauccucgcaucaauuaaguguaaggcuuuugucguccaaagaaagugguaauucccauauccuuucaguugguugugugccugucugccugucuguccaugucuccagaccuauccauaccugaccuaugacuguugucuuggugacuaccaguaacaccuucuuuuuuaugcauuguguuucaggacuccuuccuucuaucccuaguaucaguucacccucccugggcucugauaucugauuuccuggugccaguuuccucucccacugauggccuauaguguaguaagaucaugggcuccucagaucugcaucugucaauaaucugcugcucucaaaagugcaguccuaagcugggcgugguuguacaugccuuuaaucccagcacucgggaggcagaggcaggcagauuucugaguucaaggccagccuggucuacgaagugaguuccaggacagccagggcuacacauagaaacccugucucaaaaaaccaaaaaaagaaaaaaaaaagugcaguccugaacuccugaauaccuagagaaggccacucuucuggaggaauggcuucagccagccagguucuguaguucagccucccggaggggcaagcagaauguaaugguaaaaagccuggcuaggaauacugaccucccaccaaguacucugcaccucagggucacaguuuccuugucuguagaacaggggauaauagcaguauuuaaacuagauuguugugaggaccaaaugagccaauucagggaaaucacuuagcuuuguaaguacuccaugaguguuagcuauuauuaacaacauuguuacaccagacacuuuuaaagccauguucagcaaaugugcuccuggaguccacuucagcagcccaaguucucacacuguuuauccuccaagguuuugaguggagccacagaauugcacaacaccaugucagcgucauuccccaacuccuuuaauugaugagaauaaaucgugcuucucuuagcugucguguaaagcagcuccuaggucauuagccaugucuuagagcucuaagacuagaccuagacgcugccaagagaguuuugaacagauucaaggcagaauuuauuucucucucccuugagaugcaggccuauccccaagcaacauccguaucuccaaaagcuccauucacagcaaugagaaaacaguuacuuugaagucaggaagccaguuucugugauaguucauuuugcagugcuguggcagauaucugggacuaagcugagugguauaccuaagaggcagaggcuguuuugagacuagccugggacacauguucuacgugucaaaacaaaaauagaaacugugaucuguaaggaccaaacauuuuagguacugaagggcacaaagguuucuuuaaaaaugguuuggaaaccucaaguugguggcacacaccuuuaauuucagcauuugggagggagaggcaggcaaaucucuaguuugaggccagccugguuuauagagccaguuccaggacauccagggcuauacagagaaaucuugucucaaaaacuaccaaaaacaaacaagcaaaaaaguauguguauugcuucucaguguuuugguuaaggucagggcuagagauguacuugugagggguugcauucaggaguuugugugaacaacaccaccugcuugcuguauuagauaaacuucauuuucugugcagcuuaacacagcgaaguuuguucuccuuguaacaaguuagaaccguggaaggaaucaccuguauuaaguuacucgggagucuaaucuaaacagaguuaggccaaccuguugcucauccuguggagcccaugucuucugagauguuacugacgauaaggaagagaagagauggagaaugggucacucuaauucuuucucuucugugugagccucugugaucgaucaaucaauguggaguauaugugugugcaguguguacccucggaggccaggggaggacacugaaugucuugcucuaucacuacuuucaaccuuaauccuuggaaacaaggucucucacuggacugggagcuaggcugguggccagcaagucccagguaucccccuguguccccccaagcagugcuguggcucgggugccuaaugccaugucaugcugcuuuauuuucacaggggugaaaagguggauucucuuucuuguacaggacgcacucuuauccacugagccaucuccccaguuccacauuuucuuacuauguaaccagccuggccuccaauuuacaacccuccuguuucagccuuuaagugcugggauuauagauauguguuaccgugcccuuguuuuuaaacucuugaccagggcuggagagauggcccagugauuaagagcacugauugcucuuccagagguccugaguucaauucccugcaaccacaugguggcucacaaccaucuguaaugggaucuaaugcccucuucuggugugucugaagacagcuacaguguacuuauauguaauaaaacaaacauacaaacaagacuccaaaaauaagaugcauugcuucucauuuucauccccagugaggauugaacccauggccugcccuaauggaaaggaaagcauugauccaugagggaacauggagaagaacuggggaacaguagucuaguugucacaaggauggauacuguggacuccagguaaucuagguuugauguuguuaguucaggaagcaagcucuagggcuuauuauggacucuuuacuagggcaaucacuggauauagcacaagaaugggaaggaacaagagcucagucccaguuacuagucccaguuacuagucccaguuacuagucccaguuacucguucaccaaguccuaucaaccaccaaggccaggcacgugaagcagacuaauaggcagcaaacuccaaaaggggcagcuggaauaacuguaguggacaggagcuacucaagacguaucccuuguaucuuucaaagggaaaagcugagauggcugcuguauauacucacucauaccauagaagaaaaauagcaauaaucauauauacacuguauauaauguuuagauauuagugcccuuuugguuaugugugugugugugccuguguguaauuuuuuuuuuuuuuuuuuuuacuugagacaaggucuugcugaguagcucuggcuggccaggaauucaauauguacagcagacuagucucacauuuacagagaucuguagccuaccaagugcugagaugacaggcaugagucucagcuaacacugcugggacaaggcuguaaucccagucacauggggcacugaagcagaagaaccacaauucuaaggccaaccuagaccuugucucaaaaaggacacugauaaugaaaacaaagcgcuuggagcagugccacauuugcuagcauagaugagggcauacuuucaauuuucaguaccaguaaaaaugaaaauuaaaaccccuauggguuggagaaauggcucagggguuaaguguguguuguguauugcucuuauggaggagcagaauucccagcaucaaagugaguggcucacagcaccucacauccagcuccagaggaucagaugccuucuggccuccaagcgccuguacucuuaugcaguacucaauaccacagacaacguaaagggaaaacacauguuuaaaaaacaauggcaauaacugagggcuagaaagaggaaccgugguuaaaugcacuugcagcuuuucgcagaggucugaguuuaguuccuggcacccauauggaggcucacaacuaucuguagcuccaguuucagggaguucagugcccucuucuggcuuuucagacaccaggcaugaauucaguacaugacauaaauuuagacaaaacacucauacauauaaaauaaaaauaaaucuuagaaauaagacaaucaacccuuguuuucugugaggcaguaagucuuaugugggcagcaacauacucucagauuggcacagguccuagcauaugauagaugcuugauaaguauuugcuaaauaaaugaaugcauuuaaccaagagagguuuuuuguuuguuuguuuauauuuugggaggggggggguucgagacaggguuucucuguauagcccuggcuguccuggaacucacuuuguagaccaggcuggccucgaacugagaaauccaccugccucugccucccgagugcugggauuaaagguguacaccaccaugccuggcaagaguuuuuaaaauugguauugguaguucauguuuauaauucucaaauuuaaggcaagaagagugccuuguguuggagaucagucugggcuauaguauaaacaccaaucuaaaaaaccaagaaacaacacaaaguugacuuuuauaaguucuuuucacauauaaucuagauacuaauauucuguugucuauacaacuguugcauuagaggccaaucuucucagacagugcucauguauccuaagcacucuauaucuggaaaugucccauuuucucaacagaguugaugacacaggcucuaaguuuuccuucucagccauaugauacucguguagccaagcaucacauaauuuaaacugacaacuucuacaccgaacuucauguugcaaguucaucuuuucagucccaucccaaggaaggccaauggaugagacuguugagccauccugcuaacucagaaacucucuugugaaagacauacuuaagcuuucauauaacaagcucagauacagaauuccacagggaguggagguauggcucagccgauagaguauucaccuagcauacaacagguccuagcuucuagcuucaauccccaacaccacaccaaaaaauaaggguaaaagaauuacaaaugccuucaaggcucuucuuuagugcagcgggccuggauucaccuagacugccuacaacuguccucaguuuugccugauagaaucccagacuugugagugcuggaauuauaggagagccacuacaacuggucagcuugguugguuaaauauagaucuauuaaucuaaaugcuaucucuuaaauacauauuagacagcaaacuucauaagccugaagauuuccuauacagagucuuauguaaguauguaaguuugcacaggguguuuugaaaagaugcugaugaggacuggggacuuaguauaauaugguagaguacuuaccuagcaagucugaaacccggguuucuuccuccagcacuaaguaaauaaacuugggcuggggaugcaccugucuucugcacuuaggaggugagagcagaaggcucacaaauuagacugaagggcagcaaguuuuaggccagccuggguuauguaaggcucagucuuauuuacacaaaaauuaaaguuucuagugugaauguauguauauguaaguauaucacaugcccacagguacccacaaaggccagaagagagagcuggauugucugggacuggaguuaaagguggcugugcccaauguggaugcuaggaacugaaccuggguucugcaagaacaaauucuuuuaacuucugagccaucuuuccagcuccaguucucccuuauuaaaaacaagagagcuugcuccucucuugcucuugcucuucccuucuugcucccgcccucuccccauuccuuucucccagcccccuuccauguacucauggcuggucucuacuucucucucuuuucucucucucuuucucucucuccgccuuucucugccucuuaacucucuuccccaugcccugaauaaacuccauucuauacuaaaaaacaaaacaaaacaagagaaaaugaaaaaccccaaacaaauaauagcagacccuaccuccaaauauucuaauuuaauuagucucaugugagaccuagggcaaagaaagguuaggcuaacacagaugauucuaaauauggcuaaagcaagagucacauaugaauugcuucauagauaaagggcaguuauuccaaugagcaggcugguggucuguacaauagaaagauuaauuaggaaagccugugaucauaggauuggauaaaugcuuuuauuuauuugguccuucaacaaacucuaaacuuuauacagaccagggcuacaguagggaccagaaugcugugggccccugcacaggccaggaaaacuugacaggaagcagcagcagagccuagaaguccaagagcccuucaaggucucugucagauacaguagggagggagggcacugcacagagagaacgagggagcuggccacaagucggagagaaagaauaguguuggguguaguccugcauuggcucacugguuucagauuugauccagaaugcauuuaaaggauuugaaguuauagaggugaagcuuacagcucagcuucuggaggcugaggcaggaagcuuucagaauuggaggucagccagagagagaugcaaugaguuccaugcuagcccgcuucaacaaaacagaagcaagcaaccaaucaaucacaaagcaggaaggcacauaugagguguggggugauaccaucugagguuaacuugggguguuccuuuacagagcuugagguuauuaaaucauuuaacgauugaccgauaaccuugucuguucaugacuauugaaaucagauguuagaacucuguggcuacccauuccuaauuagccuuggcaguuugaagguuugcauaggcuaauacuuuuuuuuuuuaaaugauuguuuuucuugugcauuggucauuugcaugcucuuaugcucaugugaggguguuggcuccccuggaacuguuguuagauaguuguaagcugcuaugugugugcuagggacugaacuuggguccucuaaagagcagauaguacucucuguaguccugagcuaaugcuuucuaagggccuaauaacuaaagguacauagaauuccucacagccucgguccuggauaagaaaguucaaggucuuuaugucugcugcuuccuuacccacuuucccccaaaucagugugaguguaccuggaacuuuuuuuuuguuuuuugagacaggguuucucuguguagcccuggcugucauggaacucacuuuguagaccaggcuggccucuucuuaucugacuugucuuagagcaaguaaacaagccccaaagaucaaaacuccuguaguucccuuuggcuccuuccccaccuacucugcccuuuuuuuguuuuguuguuguuaaagcucaaggacacaugggucacaccucggaaucauuccaguccuaauucuggcuaagaaaaucauggaauuauuucuguugagggggaagaauucagccuaggcuaacaguucucaaauucaaaaaacugagaauuucaauacaagucuugagcuaacaguuguagaucuggcaacccauuccagagcuacugaaucagaagguggguugggccaaggaugcuaucugggaagcaucccagaucauuccgauuccagugaucuguggacugcacuaaacagcacaaauagcugucaauaguucuggcagaggcuagcuguuuuccggugguggugaacaggugagauaagaugcugguuuaugauggugcagaaugugugcuaugcuugguuuucaauucucgcuauuccuagguuaacuuaauugagcuauuucacucagcagagacuugagauaccacagauaagaaagagguuuaagagggagcagugaguaucuaucuggcugcgucucuguuauccucucaguccuacuuaucugaagaggcagauuuaucaaaggacaaguaacccuccaggggaauagcagugggaaaacuguuccccuuucuugccacacccguuggauaauuuuguuaggaaaagacauuacacuauauuucugcuuuccgaguuuucuacaucaacaaagauuuagacaaaugucaaucuauuuuuuugcugucucccuugcucucaggguggcuggggcuugaaccaugagcauuaagcaaguucuuuaaagagucugauuacugugaugcucuggaaauucuugugcacagugagcccaagggccuggguuucauccuuagcacugugacagcucuaagugucaggccuuccuuuuaguggcaaaagggaugagugaaggcuggccaucguagacuugacuuacugguuuuaguugcaucuuuaacauacuugguucgaauauagagaucuagaguuuuaaaccuuguuuuuaagacaugguuuauuuuauugcuccagauaaaaugcagucugaggguugggcguggugguuuacuaucugaaauucuaucaauugggagacuggguaggaggacugcugugaguuugaggccaaauggucuacagagcaagaccuugucucaagaaaauaaaugucaccccaagggaccaaaauguaacuuaaaaaauaaagugcaucugggcagacuaucagaaaugcaacaaagcaaaacagaagggcuaaugagucagccaguauccuuaaauuuacuuuguaacuucuuggagaaaauuccuaccuagcauguguauuauggggggaaaagcacaccuuauaaaugcccuucuuggaaacaaucuaaaugaacaggacugaguuauggacuaauggcuugugaaaacucuccuugagcaaguuauugaagauccuaacugaaacagacaggaagagacuuagaaaacccaacgagggugggguugggggcggcauuugcuucaucaguaauguaauucaaaaguugccaagccgaucaguggcugaguuuaccuuguuucguuuccuugggcugagucugagaguguccggauuuaaccuaaagagguuuguguuuuaaaaacuaacaaccaaguaauaaaacaccuauaaaagagguuuauaauggaacuggugacaguucugaguguaguguuacaagucuucugcucuccccucuuuuuuuuuuuuuaaucugcucuccccucuuuuuuuuuuaaucuuucauucaccucugccuuuuguccuggcuucuuccucaccuugcugccaagcucagaagcagaggaagcucgcacaccagaguagccuuugugcauuucugucugcaugugacagggcugcugcugcugcuaagauaagaacugagauuauugggucuaacaaaguaccuacauaguugaacaguaguuucuaacggggaguugaacucugcugcaggaguggcaguggcaugaaaaugagucauucagggcagggagacugaaauuccugcucuuugacauccuacaucuccucaucaggggccccaagaacguccugauucaaggacagaacuucaggcaacaggugguuuuucaccccggccaccacacggggaaacuuggcuuucccagggacauagguuuguuucccuucuucccaaaggucugggaagagaaacuguucaaacucuguuaggaggagccuuuucucaagucuaccuuucucauacucucaaguaucucuuaccagcaucccacccaacucugggaagagcaggacguuuucuccagaguccggagggcgcugcaaggcaugugggcaccuuuagaguagccuugccugggcggccagaggaucccccagccucccucguaugggccucaggaacuccgggggcccaggggaagccuggaaaaccgaacuucgccaucagcuuuccuuacagcgcugguuggagacgagggaagggccccccagcggucgccccccgcccaaccccaauguuauccagcugcacaguccaggaagcacccagaacgcagcuccgagcucgccagccucucccgcaggccgggagagggcauccugaggggcagcuucccucuccagccugcgucugacauccccacucccacccgaggaugccuguccgcagucgcugaaugucacugcucccucuuccuccugaucaggguagagacagcuccugaggcaucccccaccccaaaacugccgcggucgcccgaggguacaagacccgggagaaggacgaaguuuggggcccacggcggcgggagggggggcgcguuuaagaagaccgcaccucagucccagaccuggcggacacacuccccaccccaaaacagcccaggcguccccauccuuucggacaccggcauccccgcccuccccugagggcggugagcggagccccccggggcggaggcagguacccccggggcggagacuggggcgggcgggguccgggcugcgcccccggccgggccaggcgggcuagcgggcggcgcggggggagcggggcugggcggcgcugccucgggcucugugcgcugcagcccggagccgaggaggaggaggcggaggaggagaaggaggcggcggcggugggucccgggcggggggagcgcggcgcugcggacccgggcggcuggcaaaggacgaggcggaggcugaggaaggcagcggggagacccggucugcagcaacaaagggcagcaagcgauuggccgggcuggaggcgagguuagccggggaccgggguggccggaggcagcggcgaauagugcacgugcuugcagacacgggcgagugcggagccgggggugcacacccgguggguagggggcuugcucccccuccguaugggauggcgaagaggcugcagugagaucguuccgccugcacccggccugaggcuggcaggguaggggguaugugaaggggguagggugcaagccagggggcgggcgaguagucgcccgggacaggacaggagagaggguggaggagggggcuggauggaacgcuccgggcggcgcgcccguccgcgcgcuccucggcgggagcaggcgacugagaaccucgaauuuuaacuucgcgugcccgcccgcgcgcgcccgccugcgcccaccccuaaauccugcggccgccgccagcgaucagcucucacacaaacuuuagcugcgggcuaggggcuuugggguugagugggggaggggagaggaaaaaaggcuucugauuggcgucguguacagccaauaaggccaagcgccucuccugcgccuagauccaauccauuucuagagguagagggggcggguagguggaaguagagguggcgcggugucugugagagagaaaaagggcuggaccaauaggugcccggaaaaggcgggccccgcggucuguugauugguacuggcagucgacccucccucgggguggugccggagguggggggggggaaaugaugggucgagaggugugucuauguggaggcgagaugaccggcaggaacuugccccaauggggggcagaguguuuagcgagcgggugacggacagacccguaggccaacgguuggcccuaaguguucgugcucucguccaauggaacggcgccggggcggggccgcgucuuggguuuaaugagacuccauugggcuguaaucagugucaugucggauucaugucaacgacaacaacagggggacacaaaauggcggcggcuuagcuccuaccccuggcggcggcggcagcgguggcgggcgcuacggcaccuccuccaggcggcagccguagcuucuuucucaggcagauucagcgcccccggcaggcgcgguggugguggcgcgcggccaggucugucacccaccccgcgcguucccagggggaggagacuaggcgggcgggggaccgacggggggguggccugggacccucgacgccccucccacaggccccugcgcgagggucaccgcggggccgcucggggucaggcugccccugagcgugacgguagggggcgggggagaggagggaggaggaauaagcuccgccccuggccgagccuacggggcaaggggcggggcucaggaauggaagggcggggcaaagucgggaggggcggggcagagggauucuaaggcuugggcugggaggggauuucugugcaagagugaacugguaggauggauggaggggucggacgagggcgugggcaagauuaaaagaacgggagaugagaugggaaacgggagguguagaaacagguguagaaggggguguagggaggggcgaaauuuugguggaagugggaaggguaccuaggacugugugagggcuggugaagugcugcagacuggcgagauugccguuaacuggggacacacuaaggaugaauuugggugugguaaaugagagaguauugcugaguugguguugguucgucuuggggauggguucaugaggcggguacaguuucuuugguggaagaaucaggcugaauccucauguuggcauaggauagugguuugcuggcccaugguaaaugaaacauuaagaaaacagaaggaaggauggauuaguuaaguuugggagauuuucuaagguagcagaagagacuuuaaugagcagggaauggagagaggcugcuuguaauuugcagcaguauauuagaacaucucaucaggacaggugauucaaaguuaggggaaggcuguggcugugaacgagggcagcacugagcaauaggucugggugcuauaauuugauggacugugcccccagucuucauugagccaagaaagguuauggagacuuuaauuuugauggcugggguuguuuggaguaaacuucaagccuagucuugaagguguggcaggaacagggagagcauagagugucccuaggaagagacauggaugcuugcuaccuugggcaagaacauuugguauuuuugaguuugguaggacuuugguuugggcacagugcagggaguaaugggaccuggcaggguaaaggcagaagaagggcaaauuagugaccugcaccauggaggaguuugaacaauugcaguugggagaaagaauguucaugugagaguaguggaaguuaugaaggagcagugauaaggaauuacaguugucagcaauagcuagagacccagugaacuugggguggagauaccaggaaauucaagggaaagaguaugcacagauuuguaugggcaagagguagaaguagcgcaugggacuuuaguuguguuaguucuuuguacuccaguagugugugcuugugcacacacauacaugcagauguaugcaaacacauuuugugcauuugaugcauacaagugugcacauccagaggccagggcacgacauagaaugucuuccucuaucucucccugccauauugccuugacauaaagucucuuacgaagugguaguuggccauuuuugcuaggcuggccggucugcugucgagcuccuggaggcugccugucuucaccugcucuugcugggacuccaggcagucuaaaccacgcucagcguucaccugggugcuggagauccaaacgcaggaccuccugcuuuccaugcugugcccgccaagcccucuaucucuccagccccagcgaaguggguguuuguagaaaguacauucuuccucauacuaguauacccuucauuuccugaugcaacucuaaaauacacuugacugcuugcuuauuagaaauuuauuauacauguagcagagugaaugugagcuguuguuuuuaaggaguaauggguaaggagccuguaauccuuggucaucuuuggcuuuugaggucagccuagguaguaguuaaaacccuguguuuaaguaagcgaagaaaaacugaggaaggaaaguuuuaacuuaaaggaagaauuuaggugacagggucagcugaacuuugaccuuucggcuguaccugggccucuggguggaugcugaugauuguguuguguuaaggacuaaugaacuacuuguggaaacagguggacgcuaucagagguaagaccugugaauagaaaguaaacaggaugggugaagcagauaugacacuuauuuaucuauuuauuuauagacagggcuucuuucucaguagcuuuacaguccugaacagucugaccaacucacagagauugauugccucuuccuccucaaugcugggauuaaaggugugugccaccaccgcugggcucuaacaaaugauuauaacauuacuuuuuucuuuuuuaacaguuauugagugugugugcgugcauaugcucguguguguauauguucaugugugugcuuguaugaaugcccacacacaugugcacuggugcaacuuuggaguucugauuucuucaccacguggguuccaagguaucaaacucagauuuaucacuaagugcauuuacuuaugugagcccugucacugcaccuuucuuagacauuucauuucccuguuagaaaaguuuuaaccaagugucuggcuuguaguuucuaagcuaguuuugugaguaauuggccuuugauuuccacauacagagcaauagcuacauuuguaucuagaaaagucaguugguuuggggagacguaggaagguggguuguaguaagaauaguaaacuuucgauagaagauuuagggcagagggacauaauuuucauggucucuucuguuguugcugaguauuuuaguuguuuuugguuugcuugaagcaucucaacauacauaucgugaugcacauguguacacauuucuugaacguagaguugcauuguugguuuauaggcagggccgccucaugcucugcucuauaucuguugucucagcauaaucaaccuuuuuggcuuugaaugaagagcugugugguuacccuugcuagagcacuagaguguguauuugucguacugcucacugguuaaacuuucccaagaacacucgcuccuauugcuucucuuuccuuuccaacucucagacuuguuaacuuaaaauuuuagccugucuaaauuuugaguaguaagcagguugagaagcucuucauguauuugucauucagcuuuucucgaugguaaaguucccccucugucccaucuuuucauuuggaacugagucuuuuauuacuacuuagaaguuuguuuguuuguuuguuuucgagacaggguuucucuguguagcccuggcuguccuggaacuuauuuuguagaucaggcuggccucgaacucagaaauccaacugccucugcuucccaagcgcugggauuaaaggcgugcgccaccacguccggcuagaaguucuuuuuuuaaaaaugcuguucuuuaaccauuuguuuacaccguguguguguguguguguguguguguguguguaugcaugugugugggcucaugcaccaagacuugggugaaagucagaggacaacuuuucccuccacaguauaggucccugggauggaacucaaguuuagcagguuugauggcaaguaccuuuaaugcuuugccaccauguugaccuggaagcuacugugacuacaagcucucuguccuguguguauguuacaaauacauuuucuacccuccggcuuuccuuuucauucucuuuaugaugucuuucagugaacugaaguucuuaauuuuaauggagucugauuuauuggucuuuucuuuaugggcagugccuuuuguguguuuuauuuuaaagacuauuucccuacccuguggucaaaaaguugaguauggaguauuaucuccugaaagcuuuccugacuuuguaaguuguguaacugaguaccccacacucuuccugcccccucccccaccuccccccccagcccccagccuugccacugcaaaccuucagguuuuuuucuguucucugucuugaauuuauacuugucuaaagcuacagcuaaggccaggugcugcuucccuagucucugaggagaaguggucauguagacggaagcucagccagauuagacuuuacaggccuccagcugacucuauuacccucucacuuuuacgagcuagcauuuuauugugcgccugccacuguccuugcuuccuucaucucucucucuuaucucagucauuccucuuaauaguucuguaaaacaagcuuguauucucauuuuuacacacgagaacuugagacuuaaauugauuuacuaauaugcccagugucccacaguuuagguagguagcaaaguggaaaccggacccaacuuccuauaaacuuucuuuuuaaaaaaacuuuuuuguuuuguuuugagacaggguuucucuguguagcccuggcuguccuggagcucacucuguagaccaggcugguuuugaguucacagauccaccugcuucugcucccacgugcugagaguuaaagacacuaugcccaacuuguugaauaagauuucugaagccuauuuuaaaaacuuuauaaccagagagacuuccuucuuuaccuuuuuauguacuuuuaauuuuguuuuuggugguggugagugucucagggccuuucuuuuacaugccagguaaauauuugauuacagaguuacacccucauuccuaaccagcuuacaggagugaccaucaugccuguccccuaacuucuguauucuuauuguaaccugucuagcuaagguacauagagcuguauauugugagcguggauagagugcaucuuuaugucaguagaccagcaggcuucauguggcuuaaggaugaguuagaggcuggcacacugauuccagcuucauguggcuuaaggaugaguuagaggcuggcacacugauuccagcuugagagccugaggcaggagggccaggcaugguucaguuguuucuguaccaccgugacauguguuccuuuucaaaaggagacuuguuuguuuguuuuuuaaagauuuacuuauugauuaugugugaguacacuguagcugucuucagacacaccagaagagggcgucagaucuuguuguggaugguugugagccaccaugugguugcugggauuugaacucaggaccuuuggaagagcagucgggugcucuuaccugcugagccaucucuccagcccuguuuguuuguuuucgagacaggguuucauuguaguccuggcuguccugaaaaucacucuguagaucaggcuggccaugaauuucagagauccaccugccucugccucccaaguacaucaccacugccuggcugauaagaagaaccucuuucucuuggagagugugugcaugugugugugugcacauguguuuaucauugcgggaggcuugguguugacggugugguggucuccugcaucacucucuaccuuauauauugagguagggucucuuaacugaacaaagagagcucacuugauaaggcuaugggccgcuaugcccacaugcuuuuuguguggacucuggggcaugggacaagugcucuaucugaucucagccuucagaaucaucuuuaaaauucagauggcuuaauuuuuagagacaggcugucauguaacuuggccuugaagugaugcuugugccuuccacuucucaaaugcugggauuacaggcuugcaaaacgcccagcaaauuauuucuuaauacaucguucucugucauuaaaaaccaaauaaggcugggcggugguggugcacgccuuuaaucucaacacgugggaggcagagacaggccgauuucugaguucgaggccagccuggucuacagagugaguuccaggacagccagggcuauacggagaaacccugucuugaaaaaaaacaaaaacaaaaaccccccaaaaaccccaaaacaaaagccaaauaaagcuaacuugcaauuagagagaaacuuagguuugaauagaaaaauguuaaugcuagaaacacucuaaauguaguugauuauuuuuuaaguggaaaugcuuagugguuguaauuacuaaucagugcuggcuucaaaggcccaccgacccgagcugacuucuucauguuucgucacauccucccuauuacaagggaucagauuuccugugauguuucuaacagugugauuaaacuuuagagacggaaacuauugagcacucagaugcaggaaugacugugcaaaccuaauucauggcuucaaccaggaggcuugggaccugucccuacuaauuuaugaugaugauguugaaacuaaucuuugcuagggauuauggaagccguaauaguuuauugaugguucaguuauuguuuguugaagcagauuuacacaauuauaguuuaaugacauaacaaggguauugucaacuaggagagcaugacaugaaaacuuaaacuuacaauucauauaauauguauuaguugaaaugaucauuuucauggugauuuagccucuuagaaacccuuagaaaacauuauuagcuuaugaauugaaaacucuauguuaaugaguagugggaaagaauuuaguauuccucuaaaaagacuggaaauuagacauucaguccagcuagcaugcaucgacugcguuacccucauaaauuuaaucuaaacuagauugauguuuggaaggaugaaauacugcuugcucugguuccuuuguugcuccuccauuguagugacuagauguugccaaaaugcuucaaauauuuaacaugauugugugugagugugugagugcacgccagcacuguauauguguacuuugcuuuuggugucauguguucuugacuuacuuauuugauaugucacauuuacaugccacucccauaguuagucacagcuuuuccucuucucaucuucuuucucuuuuucucacucucauccccccuccacccuuugauuuguguugucuuugcuguguaacucaacaggacucaaccugagaucuuccugucucugccucccaguuccuuguguagucuaggcuugaguugaaguugagaugcuccucuugucuuagcccacugaaugcuuauaggugucagccacuacaccaugaguucaagaccagccuauauagugaguuccucuacacucuagacuuuagugucggauacuguaaaaaacaaacaaacaaacaaacaaaaaacaaaaaaaaaaaccccaacccaaaccaaauaaagaaacccccaaacaggcauuguuucccucuuuugauccaguuguagccccagaaaguggagcacauagaaaugaaucaaaugugagaucugguccugugguuguaagaauggcccccauaggcuccuguguuugaaugagcgguaugguugguggaaccaguugggaaggacuaggaggcauggucuuguuggaggaggugugucacugggggcagucuuucaguuucugaaacccaccucauuaccaggcauuucucucugccuccugcuugcugguaaggauguaagcgcucagcuacugcuccagugccauacuccuuaacacgaugaaccacgagccccacauuaaaugcuuucuuucuuucuuuuuuuuuuuuuuuuuguuccuauuuucuuucuuuccuuuuuuuacggggugggguuauaggaguggguuuugagacaggguuucucuguguagcacugguuguccugguacuuauucuguagaccaggcuagccucauaauuagaaauuugccugccucugccucuugaguguugggauuaaaggcguacuuuucugccacccagcuuuuuuucauucauucauuccgagauagguucucaguguguauuucuggcuauccuguaacuauuuguugaggcuggccucaaacuuacagagaucugucugcucugucucccaugugcagugauuaaaggugugugccacaauacccaacauaaaugccuucuuuuauaaauugcuuaggucaugguguuuuagucacaacaauuaaaaaguaauuaagacaguuccuaagaauuauauaauuggucaguuccaaaugagcaaaauauaaaaaggacaugaauuucaaaaugguuggaaagcaguaagaaagcuagacauguccagcuaagcagagguguguagcauuugucagauggguggguguuggcugcacugacccauggaaaauuugacuuggcagcuaucuagguuucuacuuacuuauuuuucuuucaagacagacucuugcuauguagcccauacuggcuuggaacuuucaaucuuucuggcugccugggaucuaggugugauuauaggggaugucagaagaucaacacuguuuucccagguucaaaugaaguacccugcacaauggguguccuacccuggguuucagcaaggcucaguugcugcagacuggucucuaaucagaggaacauauugcuugaagaagccuuuguggggacuccaggguugcuggagucuucacgccacugaaauuauuaaggcaugugccaucaugccugguuuguuugaucugaggcaagaucucauguaaccgagguugacuuuaaacuuccuguguauccaaggaugaccuugaacuuuuggcucuucugucucuugagugcuaggauuacagguuuguguuagcaagcuuggcuuuaugcaguguuuggggauuuaacuuggggcuuugugcaugccaagcaaaugcucuaccaacgaugcuacauucucuagucccuaguucuuuuuaguuucuuuggcugugguguugugcuuuguuguauuuagugacagggucccauuauauagcucuagcugcccuggaacucaguguguagaccacguuggccucaaacuuggaguacugaaauuaaaggugugugucacuaugccuggcuuuguuuuaguuucuaaaaauauuguuuaauaauuuacggauuuaaaauccauguaauucauauuguuuuugagguaagaucuguguagcucaggcuacccugaaaugcacuguauaguccaggcuggucuugaacucuugaccaaauguuaggcuuuugggugugaaccacuacccugcugaugaauuauuuuaaagugguuaacucaguugcauuucaguacauucacauuguuguuugaccucaccucuuucucaccucucauuguuuucaaauaaagucucauacuuauaaaacaguuucucuccacacugagguccuagcaaugcaugcuuuguuuauaaguuauauauggauguuuuauagaaaugcaguuauaggauaucugaccuuugugucuaguuucuuuuacaguauaauauguuucaguguucauccauacuguaauaguauauauuaguccuuuauucucauccucucucucucucucucucucucccucucucucucucucucucucucugugugugugugugugugugugugucugaucuauuuuaucacuuuuuuuguuuuuuguuuucucgagacaggguuucucuguguaucccuggcuguccuggaagucacucuguagaccaggcuggccucgaacucagaaaucccccugccucugccucccaagugcugggauuacaggcgugcgccaccacgcccagcuguuuuaccacauuuuaucuguucuacuguaaguggauauuugggcuguuuguaccuuugaguauugugaacacugcuguugugaccauguuuugucuguaucuguuggagaagcuaugcucaguguuuucaaguguauggugugaaauaggccugugggaucaugguaaucucaccaagcaguccuuugucacuucuuaguugauuccugcguguccuggcucuggcucuggcucugcuuugccuuucccaugccaugugccauaagaccguguguagggcagggacuuagugccacugaguauucauuuucuuugacuaguauucagaaccucaacucccaguuuacacauauugggugcaagcauguuuuucagggaaguagauggauuuagggcuuguaugguaccaagcaucaccaaguaagugauauuugaugucagacaguagaugguugugaaccaaggaugcuauuuuaagccauugugccauuuggguguggugggcaguaauggaggaaagaagucaugguuucuuccagugugugcuguauuguggaagauauugucaguguaugcuguauuguggaagaucuuguuagcauuuguugaugcccacucaguuuauacaaccaucuuugaaaacaaaaguccuggagcuuauaaaaguaagagagcugaaaauagcaagccaaaccuaggaugguaagauaauauacucuauuauuaaccuuuuguuuuucuaccaguguuuuuggcacaucuguaaucucauggcuccaauguugugacacuaauuuugagaugacacaggcuuuccugcaagcguaaggaggccucuucugagugggauauuucgauucuccuuaugcugcccugaauauuucuggaguguugauauuuauguaaugccagugaggcuuaaagcucagcguuggaccaagcguuuuccuggauguguagaauagcuuguaacgagugcugcaaaugggguucuaaggcugcaagguacaacaauguaauuugcccauguuuuuuuagccaaaguuaaaacguuucacaaccauaggcaauagaaagggaucauuugaugcagcaugaaucuucugaauuaauuuggguugacuuacuccuuuugguagccuuuaacuguuaagguuuuuuguuuuuuuuguuuuuuuuuugguuuuucugagacaggguuucucugaauaccccuggcuguccuggaacucacucuguagaccaggcuggccucaaacucagaaauccgccugccucugccucccaagugcugggauuaaaggagugugccaccacacccggcuagcuguuaaguuuuuaaaagggaaaaaaaggcaagagaauaaugauuugaguuuuagucgugacuaguggcccuguccacaaacacagcaaguggacucugcaaaagagaagugguggggggcagguaauuuugagucagggggaaaaucauuuuuaugugacuuucgaaugaauuaugcauuuuucccccuguagaucugucugucuagauacugcuuggacugaaaugaaacugcuuuucaguguauucucuuagcuuguaccaauuuaaggugggaccguggggugucagacaaaucagccccagauuaaaaacaaaauugcaguggauaauguacaaaguagauacugugcauguauuuauccgaggauuggcuuacagguaagagacuucugauuucccuccuuuccuaacuguauauguuuuuuaaacauucgauucagcuuguagcagagagcugcugaaauuacaucggcuucugccuaauuaacucuuguuggaugguuuguuggaugggaucucauuuugagauuaaauugaggagaggggcuugugcugggggcugguggcggguggagaagaaggauuuaagauacggguauuuaugacuucuuucuuuuuuuuuuuuuuuuuuuuuuuuggucuuugaagugaaaaugaucaccgugcccuaaauugaggcuuguguugauauugugccuuucucuuccuuaccaguaugucaaucaaugcuagacggauuugggaacaaauagugauugcugccugggaaaguuaguguucaggacuagucaguuggugguguuuucaugagaggaauucuuuuuuuuuuuuuuuuuuccgagacaggguuucucuguguagcccuggcuguccuggaacucacuuuguagaccaggcuggccucgaacucagaaauccgccugccucugccuccugagugcugggauuaaaggugugcgccaccacacccugugaggggauucuuuuuaagaggcugucacaaaccuaguuuuaaauuuagagauugugcucaauugcauagcucauaucuaccagagcuagagagacuuggagaugaguguggccucugggccgucuuuaugcaaucacagacuuacacaguuuucuuccugaugcucuuuugcuuauguaucuaagaugccuaaaagcaacuugguauuuauuaugggcacuuuguugugacaucuucucaccugcuucccucagguaugcuuuguacagucagaucaagguaguuguggguccuccugaauaaaugaugaaggaugagauaauacuuggcuccaaugaaauagcuccuaaugaaauuuugcuguaagugauuucacuuugaaaagauacguuugcuguugugcacgcucugacagggggagaugcuucagcaguuuuaucccaagcacggugcuccagcucuaaggucugucagugauuuaugucauggcacaagauggagaacuuaauagaucugcagaugacagucaagauucagacagucuuuggcagguuagaagauaguccaaaucagcuuugaauaccacgauuuaaaaagccaaggguggugguacuugccugugaacucagcauuugggaagcugagccagaagguuugcccugaguucaagguuagcaugagcuauguaaugaguaccaggcuagcaagaccuuguguuaaaaaacaaacagcaaaaggaaauaagccacaagaauaacaacaaaaauccagcauuuuaauuuuuuaaggaagggcuggaaagguuuaguuggacaacauuuuuggagaaagaucugggcaugugcucagcauggucagcauggcuaugugugugugugugugugugugugugugugucugucugugugugugggguuccugugacuuugaguuacacuuugaccugaguaacuccugggggugugugguuaaaguggauguuagcaguaaugugcagcagacagauggcugugguuagagaucuaggauguaaaagguugaaggagcuaggauagcaguguuuauuuagggagggguagaggugggggagauugauagugguuuuuaaaagauaauuauuuucaaguauuugagggccugucauauugaagaaaucuugggauuauuccuggggaacucaacuugugugucagaaucauaggaagguggaggcuugcuucugugagcaaauuaauuaugucuccagcuuccuuucaguggugcauugagcugccuccaaagauuuggugggcuguuagggagauuggccaaagaucuuguacugggcagcugagaaguggacuggaugacugcuaagucucaucagcuucccauuucugaaucucagggaaacguggcgagcugacuggugaugugcugagaaggcccuuucaggccgugcucaggagcugcgugggccacucuugcaggagcuccgggcucugaguacuaauguuguucuuuagugucuaucuaaagaauuugaaauuucuuuucuuuuuuguuuguuuuuuuuguuuguuuguuuuuuacaggguuuuucuauguagcccuggcuguccuggaacucacucuguagaccagacuggccucgaacucagaaauccgccugccucugccuccugagugcugggaguaaaggugugcgccaccacgccuggcagaauuugaaauuucuaucuuuggguaaaucccuaaauuagcaaccauaagacuuugguuuuguguuuugugagacccccuucaagaucuguagacacugaacuuaguagacaucuaugauaauaguuggaacuguguuuuaaauaguaagugccauucuuaacuaugcuuuuaguuaccaucagcugaccccacaaaacuugggaagugaacaauauuuuuuucuuuguaauuuuuaaauuaccuuuauuaugguauauuguuagcauuuuuuauuuuauuguuguucauuucuguuguaccugauuuguaaauuaaaguaucguuauuguguguguacaagaaaaaacuaaagcaagguaguacaauauguaucagguacaguaucucugaucuaggccucugcugguggucuuggaacuuuccccauugguaaguaggaauacugucuguaugcugccuguagggaaagcgacucaagcuuaggucuuguacuucuccacgagguaguaauagggcuggggaccagagccuuaucagugucucugcagaggcagaacuagcugaagcaggcggcuaaggcacaggugagaacuggauugggcucagauuccaaaaugaugucccuugagcuguucauugcuacauccucucaagccacuuacauuuauaguuaugcuggcgauuacaugauguuuuuggguggugguuguuuauuuggauaaaaagacaguuuuauguagcugagacuggccucaaacucucagucuuccugcaaccucuuaaaugcuaagaucccaugcuuaugcuauuauauuacaccuagcaaaauggugcuauguaugaacacgcugucaucuggauagagugggcugagauggagacauuacuggagagcaguaggucuggcccaguuccugggccgguauuguaucaguaccagauuggagagcagaagucugagcgcacugcugcccuggccagcuggagucagguuuguagggauugucuuucuguugagcugugggaugagcuggaacagguguuaagauaaguagaauacugcguuauuaaaaggugaagggguauuuacuuguauucauuucaguuugccagccugugccauacacagaugcuacgcagagcagagcaccagagugcccugaucccauacagauggcgagguuggaaauuucccucugugaccuagcucagcucagcuuuacugugucuugucuuaaguucuuuuuguuuggauacaguuucacuguguagcucuccacuggcuuuagacucccuuguagaccacggucuucuucaaacaaagauguuccugucucagccuucugggugcuggaauuaaaggcgugcacuauuguuccuuuuuuauauuuauuuuauaucucugguagacauguaccuuagacugcuuucacaugauuauaauuuugauaacaggacucagauuuuccauguuuuaacuuguuuuguacuuugagagguuuggggcagcauaucccacagugugugcauagagggcagacgaguuuggggggagaggucuuuccuuucacuguguggguucuagggguugaacucagguggagcaggugccuuuaccacugagucaucucaagccuguuugacagauguggucucuuaaguuauuauguguaaauaaaauccuaaaaacaaagucgugcacagagugcaccuagugccugguugcacagaguuguccuguggcuggauugcacaguaccugccuuucaguguguuaguuuuguaccugauaaagaauaaugcugagaaaucuuuauuuuuacaaguuucauuauuaagagucuuuucucucucucucucuuuuuauccuuuaaggucuugguuuccuaaagaugucuuucacuugaagagugcaguccuucccauuggugaacuaagacaacucuccacguugccuggcagucaguccucucuuuaaggaugguugucccuaugcuguugcuucacaugggcugggauccucugcccuuguguugaauugugacuuuggaaugugcagguuguguuaaguacaaggcgaaucucuauggguaacgucuguguuggagaagccauuugucaaccaugguaaaacuugcaaacccacuuuacacagaguggauucuugaagcagugcagaaaaucaagaagcagaagcagcggcccucagaagagaggaucugccaugcggucagcacgucccauggguuggacaagaaaacagucucggaacagcuggaacuuaguguucaggauggcuccguucucaaagucaccaacaaaggccuugcuucauauaaggacccagacaauccugggcguuuuucaucgguuaaaccgggcacuuuccccaagccaaccaagggguccaaaggaccgccguguaaugaucuacgcaauguggauuggaauaaacuuuuaaagagagcaaucgaaggccuugaggagccaaacggcuccuccuugaagaacauugagaaguaucugagaagccagagugaucuuacaggcaccaccaaccauccagccuuucagcagagguugcggcuaggggccaagcgugcugugaacaaugggagguuacugaaggaaggaccacaguacagggucaauagugggagcucagauggcaaaggggcgccccaguaccccagugcuuuuccguccucacucccgcccgucagccuucuaccccaugagaaagaccaggugagugagcccggcgguaucgacgcccuggagauauuacuguuuuaccuuucgcuuccacuuaggcgugcucagccugugggucccaacccuuucggcaaacaucuaucuccccaaauaguuacauuacaauucauaacaguagcaaaauuauaguauauaaagaauaauuuuauaguuggcuguauuaaacggucccagcauuaggaggcugagaacuaccgauguggacggaagaucugaauggaguuugaaaagaucaguuguuugugccuugaagcugguuuuuauaauuuauauuaggauguuucauagcaugauuguuuaaacaucauuuuaugacacauugaggguuucuucaguggcuaauaguuaacauaauacucaccugacuugcuuuauguuguaacuaccagguaaacuugaaucuaccuucuucaagcccaagaaaggaaagugugggaguuuuucuucccuuaauuguagagagaaaaaccuccauacuuauuuuaauacugagaaucuuugcauaaugugugaccuaaaucccuucuguuuaaagccauuuauugucaguggucaguguguguuugguguauuugucuauuuuuguguuugugugcacacauaccugcgagcccuagugcacaugaggaggucuggggacaguugcagguguucuuuccuuccacucgguagguccuggagaucaaacucagguugauaggcagcaacuuuaccacugagcuguguugauugauggcccaaggcuuuauguuaguuuuauagcauuguaagugugugacagaguuuuguuucugcugagauuuuuaagucuucaguugggugugauuuucuuuguuuuauuuuaaacuuacugaauuaauuucccaaagucaugcugaaguagaacagcagauugcaagucagguccuccagguuuuguauuccuuucccaacuuuuggucaagugcacucaucgauaggaugacauugagcaucgugaauaggaagcgacugugccuguaagcugcuugcugagaaguauugaaagccaggugucaggcucugugggaagggugucugccuguucccaugacgaggccuucauuuugucucagcuccuaugagacccaaguauuagcaaaacugguuugcuucuguucuucugguacaaagaacucaugaaaugggccguuucccuuuuuugcuuaccuaguaggggccuaccucugaacuaaggaagacccuucacacagguaucugaagucuagaauggauuucuuagcuguguucauaccuucuuggucucccacaacauuuauuuauucauugauuguggauguaucaaaaaugaaguaaacuaugaaauuuucuucauaacuguccuuuaaaaaacgacaggcucuuagcucuugccucucucuuacucuugccccccccccuugcuccccauuccccucccccucucuccuucucucugccuuucucugccucugcuacccucuuaacucccguccccaugcccuagauaaacuauucuauacuuuuaaaaaauuacagaaaaugacuuauuugaauuccugaacacagccauuuagauaccuguuucuccuugaaucuuuuuuuuaaaauuaaaaacaguuuaaaucuuuacugaauucuuuagagauaccuggcuguucuggagcucugaauuuagcccaggcuggccucaaacacagacucuccugcuuuugcuucugagugcugagguggaauucuuuaagggaauccagagccauuccuucauaagcuugauuaucuuuauuuuuuauccucggccauggcaaaguugcauaauuaucagggacauggucuccauucaggcacuguggccaguuuugugucuuuaugaauaauuguagacucuggagggaggcauuuucugggucuggagcgggcaggacagguucuccaaagcuccccuccuucucugcaaccuugcucaucauuucuugcuagccuuaucuuuucucuucaggcagcaucuguacagaacuauuuuuagucuaaaggcaaaauucauguuugaaagagucuaggagagagaacugagacauuuauugcuuagcaugcaauugcaguugcuuuuucuaggauguagaucuuuuagcuguccaguuagcaucguuauuuaacaaggaaaauugagaaaacaugcuccagaauauuuaguugauaaaauuuggggauuaauuguaucaaguaaucauaauaagauuuugaugguauuuuauuagugagcaaucuagccucaaccuaauauuaauaugcaugcacacauacauacaaacauguuauuuuuuagauaaaaucucauuauguguguagcgcagacugucuuggaacucuguaguuagcagagagcccccucccccuuuuugagacaggaucucacucuacaguagugauggcuggcccugaaugcuuuaugcagaucaugcuggccucaacuuacagaaaucuuccugcuucugccuccugagugcuggcauuaaaggugugcaccaccaucccuggcuuucuuuuuaaauguuggaugucuuccucuauugcucuccacuguaauuuuugagauaggauuugucacuggcuauaugggcugccaaguaauauacccaccuucucagagauaggauuccagacgggcacccacuguagccagccuuguuuucuugagugcuggggaucugaacucagauucucgugcuugugaggugaguacuauacccacugcaccaucgcuccauccccgauuucauuuaaaaaaaaaaaaauauugggacaagguuucacuuaguuucccaggcuggcuuugaauuuugguccuuuuaccuuagccucaauagagcuggaauuucagguaugucugcgugcuuggcagaauuuaggaugugaauggagacuguuccaggauggugcagucuuaacuauaguuugauaaaauagucuuuuaaagaagcuguuauugugauuaccuuugagaaguugaaugucauuguaaaagagaaaauaaaaauagcagcuaauguauuguaagcguaaaugcuggugucuuccaaguaguucgcacuuagcuccugacucauaguuacuggaagagagguagaucggugcccuacuuuuugcagauggaaaaacugcagagcaaagcggacgcuuuuuguucaaggucaguagaacuggugaacagucaggcugagaguccacccagauaguccugaguccagggcucauuuguucugggcgguaucuuagucagccccggggcuauucaugaaugguggaggucucucuugcaguucuucaguaggucagaaacaguuuuccuccagcaaauagacugccagcauuugaaaucugguaguugggaugggcuucuuacuuuuuuuuuuuuuccccaagcaagugcgguuuauaauaucaucaaacuggaaaugcagcagggaagucugugccucauuagauuuaacagcauccucacuccugugcaggaggggcacaguggaagcuaacauaggaggccucggcuuccuggcauguacgucagcucuucugagacucuggaauucuaaucagggaucacuauucucccuucuuagcaugaaagucuugauauuuauuuaagaaaccuuucucugcugagaugauaggaaaaugaauuaaaccacugaagauaaaacuuuaucuuugacugggcacgggaacuccuaaaggauaguauuaauguuucucauuaaaagugguaaagcucaauuaggucagauuaugaggacuuuggaaagucaaauauucugagagacuucaguuaucacacuuuguagcaguaagauuccauuugcacaucugggcuuuagcauuuuuauaaagucaguuuaguucaauuuuaagcagauuccuuaguauuucacuuuguugagaguaucauccuaaaauuuauugaaggucaaaucuuuguguauuuccagugcacuguaaaguaggggaacuccagauauauuauguagcccaggcuggccuaauucuucugccucagccucccaagugcuaagaucaugugacacugucaugccccccccccccccccccccgaaauguguuugggcacugugggcagggcggugugaccuugugaaggauuccugugcagagagacagucccaccgggcaugguggccacgccuuuaaucccagcacugggaaggcagaggcagguggauuucugaauuugaggccagccuggucuacagagugaguuccaggacagccagggcuacacagagaaaacuugucucaaaaaaagaaagaaagaaagaaagaaagaaagaaagaaagaaagaaagaaagaaagaaagagaaaagaaaagagacacagucccauccuaugucagauucagucaccagaccacagauuuuacauuuuacauuguuuuugcugcuuucuuuucucuaaccccuuaucccucaucuugccucugggaauuuuuuaguugguacuuugugaagggucucaauuagagucccagucagugucuuuuuauguugacuucaguucaugugcuuuguaucaaagacucguuguucucaaagaauauuuagcuauauguauccaacuggaaguugaauauacagccuuaaauauuaugaaauaugcuuuucaaaauucucugaauuuuggcauugacauggauaaaaagucgguuuuagaauggugaaaccuauuacaguguaaaagaucagguggaucaaugcucacaguuccaaggucagggaagcaagcuuguggauccuguuguuccuguaauuaagcucgagaaguucuuuagaagggugcagugcgccagggcagccuuugccguugggcaguaccgguccagucaccgcggagcucuuggacuucuccagcuaggcagccaggucaagcggaagaugaagugagugacugggucuuucuauugcacuugaagcauggcagcuuguucuacuuuugaacuguuaucaagauagaacuugucuaggcuucuugaaguagcuucuggagagcaacagcgucgugucggaagguuugauuguagagggcgugguggacauuccuguaacucuuuagaucuuaggugugcuugauguuuuugaugccuuucccacaacacuaauccuguccugaggagcaccaacuuugaggaauugauacuuguacucucuguaccuacaugacuuuauaacugcgcgcguguguguugcugggaauagaauagaagaccuuaugcucauuaggcaaaaacuccuacggagccuuguuccuacgcugugauacuuuuaguaccaagaaagucaguauuuuuagcuuugagguuauuuuaacaguuauguguuguuugcugauuuauucugauuuuaucuugaauggcaaagauuuuauuuuuauuuuuuuccuccagacuucagcagaugauacacuuuaaauguucucaaaauggaagucugaguuguuguguuuuuuuuuuaaaucuauuuuaucuuuguauguuaucacuaacacaugggagauauaauuguuuuuaucauugagaugacaauuuugcuuguaaaaauccaugauuuuguuguguuucuaugcuucauuuuuuaagucuugaacauuaaacuagaguagauuugguaaaauuguuuuccagucacaccaagauuuaaaauaggaaucugaaaucuucucgggccuuucaucucuccuauccauuaauauuucacauaaacagcaauuagcuuaccagauaagaguuagcaaaugagccagccauguaaucugcugauggcacucugucugcaagaccgggaggaaagugcgugcguguuugcaugugggugcucuugcugcuuccaggcaguggcaggaaguugguccaugugccucagaggaagggguggccuugccgugcacugaugcuucugcguggguaggaaacacuuugcugcgaaguugccaggacugggaaacugccuauuguuguugaucuuuauaaaaguaaacaucguaauuaguaggcugugauguagugcacagcguacauuguauuuuguuuaugaaagguuauguuuuugagaguguggaaugagacagaaagaaguauuagaugaaacaacguuggauuaaaccgaagcuggucucuacagaggucagggcaaacccugaucagugcuccgaggggauccaggagggaacuguguuaauuugacaaguggguuuaaaauucuugagcugcuauucuucagaaaccaucuuuguucaaacaucccuuuccuaauuugcuccacuuuugaucuuugauaaaccagcugcaguauuguuucauuaacagacuugacugguuaacagauguuugcuuuggcuugauuguguccucccuauuaagaacagcauaggcacucauagaaaccaugcugggccuuuuccugucuagcuagacuggcaguucaaaagagcaaccuaauuucauuuacaaguucaguuuuuauuccuuggugcuauucuggaaggcaugugacauuuagcugguguucucccuccucggggaggccugcuguuaguccuccuugcugcugcuccucugcucugcagcccuucacuugggguuaagcauucuuagcauucaggaaaggagggauugcggaagggcugauugagacaucauggauucuuccacaauucaagggaaggagugggaacagucuggagaauguagagaaucucucccaccuucuuugaugucagacagcugccauauggagugcagggagaaggaggagagccuggguccaggcugccugugaucuucccaguacuagggcugggagccaaaggcggugugguuucuguaguagcuccugaugccaccaguccuguuuuuuguccaguuuccugccgugcuugugacucucucuccaggcauaaauagaaaggaugaagcucaaaauaagaauguaaagauuauauggaacaagagaaauggcagaagagaagaaggcacaaacuaaucccuguaauaaggucgucaaagaugacucuguccucaugguugaccuguuuuucuggaauuuuagucauguguuucucucuuauaacaaaaucagauuuuagcuauugagcuugaauugugaguaaacccgcagcaaauaguaugugcuuguggaaguguggaggccagcugaagaacaccagcuguucauugcacccugggcaguauguaagggaccugggaagaaagguggguaguggagggauccagggcacgccuucuuccuuaccuuuguaauuuaaaaaguuguacugucugaaugauacaugccacauucuuucaacaacuguuaguacuauaccuuuucuuucucuucuagaaagaaagagaaaaugaauaaaugaauguguauauguauaauuuuugagcuuaguuugguagcucaaacccuuaauuucugguacuugggaggcagaggaggguggaucugccuucaaggccagccugauuuacagacaugaguucaggacugcagaguuuuauagagaaagacucuguuuuaagacaaaacaauaacaaagaagucaaacagaagauaaguuuggaugaauuauuggaauauaaauggcagacaucauuauguuacauucuuaaauauuuagcgaggaaugaaaacgaccuccugggcuggagagauggcucagugguuaagagcaccgacugcucuuccagagguccugaguucaaaucccagcaaccacaugguggcucacaaccaucuguaacaagaucugacucccucuucuggagugucugaagacagcuacaguguacuuauauauauuaaauaaauaaaucuuuaaaaaaaaaagaaaaagaaaacgaccuccuguauagaucagcaccaucacucacguaaacacuucaaaagugaagccagaggguuuaccaagaguuguauuuucucaaacgagucuuaauguuauuuauaacuugauuuaggacucagcaaaguucacaaguggcauuuggucauaaugacucuuagcagagaacaaccuuuuugcuauuucuggagacauugccaguuuugaagaguuguccuguaggauaucuggagcugauacuuucccuggagauuuggacacagggcuuccugaaugcuauacaagccuuacaccacagagguacauuuucagcuuccagaucuuccuuuguagacgaagcccuucuccccuuugugacuaguaagugcucagugcaggcuugaggccaugugacuaaccuuugguucaguguguuugaauuuuccauugcugcuuuguucacauccacuuagcauuuaaagccuugcagucauucuuugguucugugguuaggaagucuaacacaguucuuaccacgguagaggaugacagcagcaugacuuucuagcugagccucguuuccucgcuucuguucccagcuccuaggcuguuugcuugguuugcccuugguuccuguccugucuuuaauaccagcaaugcggcaucucugaucauuccucuauaggugccuggcuucaaaggaugcauagauuacuuuugguguagauggucaauauuaguuaacuuuucaaaccagccuccuuaccugggaguggcggggcauaacuauaaucccagcugucaggaggccaaagccugauuuauucaaauucagggccagcuugggcucuauacuugagacccugucucaaaaagcaaagcaaaacaaugaagagauaaaaccuacuccuuuaaaaauuaaaaaccaaaacaaaguacguaaguccuuuuuccuauuugccagguuacuacauggacaaagaugaaacaggcccugggccuuaaguaaggaugcuggggggguuggggggggaguggccaucguguguugccuuggugcacagugcuuuacccaacucagauuuuauaauaagucaguguaugcuuaugggagaaugggucauucuguggaugugaugcuggccacagguuagagucugcuugucugaguucuaggaccugauuauuucuaaggguggggagcagggccugccuuuugucucugcuugacggugucccuuuacuaacaaaugaauuuaccaggauaguuuagaaaguuuguggggcuggaguaggguuugagacagugucuuacucugcaaauuuaggcuggccaggaaccuguagcagccuaggcuggccucgaacucacacucuuuccuaucuuagcuuuuggcauccggagaguacacuugugcuagauccugcuucuggguuuuuaccucugguucuggaaacucagguccucauguuuagauuuuuuuuuuuuuuuuuuuuuugagauagguuguauucauguuaaaggcaugacuuagauugugauuuacaauauuuucugagggcuggagaaauggcucagcggguuaagagcacugacugcucuuucagagauccugaguucaauucccagcaagcacaugguggcucacaaccaccuguaauggaaucuaaaggcuucuucuggugugucugaagacagcuacaguguacccauauacauaaaauaaaucuuuaaaaaauauuuuuugagaaacacguuuaaaguuguagagaaagauuuuuuuuaagcuaaaugcccacagaguacauuaaaaaaaaaaacagaucacaguccagugacgugucucaguaugugaaggcacuugccuccgagccucaugacuggaguucaaucccgggagcucacaggguaggaaggggcugauugcugccugcuguccucucaccuccacacacgccccagugugacccucacauuccacaguaaacacuuacauauaaaaaaugaauuuuagaaacaaaagauuuuaauuauugugcacguguaaguguggcaugcacauaaaucgaagaauagcuugguucucugcauggugaaauccagggaucaaacucagguuuucacaugagcagucucagagucccagagcuucauuuuugagguagugucucacuguuggcucugacuggccuggaacucccuguguagaccagguauguucaucaggcuggccuggaacucccagagauccaccugccacugucuucagagugcugggaucaaaggugugugugucaccgguccuguucggugcuucagagacucagcaaucuuggaagcauuuuaugucugcuucaaccucaagccucaguuaaggacccuggacaguuggaagagaaaucacacaggugucuuuugaugauguuguuguuuugagaaaaauucagagaagcaagcagcaaucacaggcuggccuuggggagggggcuauagauuccuuccccuucacagugaggcugcaucuccccggguguugcccuuaacugaagugcuuuggaaauaccgaauguugccaguuggugaagaauaacaacuauuuaguuauuagccuaucaucagugugcuuuccagagcugauaaaagcugcgaucuuuccaucugaugagcucugaccuucugaaaccuuccaguuuaucucauuuuccacagcuacugaguauaacacgauaccaacaauuacaucccccccaaagcguuugugccaacuuauaaaaucaccucuguauuggaaaauuguguaguaucuugauuucaauuuagcaugguauguugguuagcaauaaaucuugcuaauguaugaacacaagccugcaggcagcuuggagaacacugaucaggugcaaauuguauguauuuugcaagcauuucagaaauucagagcaaaaugaaauaaauaguuaugacugagagcaccacuuuuuuuuuuuuuuuaaaguacucuuguguauauccugugagaaaauucucaguccucccgaaguucauaguuuguuuuggggaccauuuuuaauuuuccuaucaagucuguggcauucaaugaaagcaaacaggcaugauugaaaacaaauguguuugugccuauaacauguauaugcuugguaguuuacguuguguuugaagaucauagaaaacuauauacgaggauacucauuuaaacacauuguaauguucuuaugauugaaaguagagcuggcugugguagugcaugcuaguaccugggacagccagggcuacacagaaaauacccugucaugaaaaacaaacaaacaaggaaggaaggaagcaagcuagcuagcuuacaaaauaauuuuacaugaauccugagugucugugagagcugcuaagcagguaaaucuuacaggaaaacacaugggccaaagaagagggggaccuccaugggcggugcuggagcgggcacaggacucuugggauucaggcugccuggggugcguuugcccacauucugccccaaucucuucauuugggucaaaucaacacaagucuguucucauaaugugcaaaaccugugccgggcccugugggaauuucaaagagaagccauguuggaaugguaauuuaaacagcuaguagaaaccugucaagaucacagcugggaccccuucauuuucagagugauugaaauuuuuuuauuuucaauuuuuaucuauuaguguuaugugugaagaugacguaugugcugguacaugcaugcuacagugcauacauagaggucagaguauaacuuuuagggguuagugcucuccuguagguucuggggcucaaacucaggucauuaggcuugcauggcaaauacuucuuaucugcugggcaaucucauuagccuuacuuuuuuuuacauuuauuuuauuuuuauuuuaaguuuauuaauguuuugcuugcauauguaaguguaccgccugcgugcccauagaggcugaaagagagcaucagauccauggaacucgaauuacagauguuuguaaucugccuugugcuaggaacugauuccaggaccucuacaagggcagcguguguucuuaacgcuugagcugucccccuauuggagcucuugagcuggagcuacaagcaguugugaaccuccugauagcaggcugcugggaguugaauuuggguuuucugaaagagcagcaagcugggucuucucucuaguccauguuuaggcuguuauuaauuaggguuagguguuguuuaaaaucaauauaggcguccugcaacagggcaucuguggauuggugggcacacuguaaacaacagugaagagagcugaggcccaggaugauggaggcuaaaugccacucucacuguauuuuaaggaggugauggauaagacugucugucugcugguucuaaauuuuuguggcuuuaauaccauguagagggagguagaggcaggaugauaagggugauaaggccaguaucucuuauacaguagguuuauacuagcaugggcuaaaugaaaccuuguuaaaauaaaaauaaaagacccaauaaacugggccuuauuugcuucaaaauccuguuuuaaaaaucugaguuacaagcugggcuuaguggcacaugccuuuaaucccagcacucaggaggcagaggcaggcggauuucugaguucgaggccagccuaguuuacaaagugaguuccaggacagccaggguuauacagagaaacccugucucgaaaaaaccaaaaccaaaaaaacagacaaacaaacaaacaaacaaacaaaaaaaucugaguuacaguauugcucuuguagauaaccuggguuuggcuccuagcaccuauuuggcuacagauggcugacagacaucaguaauuccaguucccggggauccgacacucucuucugacuucugccggcaccaggcaagugcauggggugugguguauguauguauguauauguguguauguguguauauguauauauauacauauacacacauauacauaugcaggcaaaauauucauacauaaaaaugaauuuguaaacaaaaaucugaguuauaguugugcuauguguuauaggccugaagucuuagcuacuuaagggggcugaggcaggggauaucaaauucaaguccagccugggaaacuuauugagaacccuuucuccaaaauauuuauuuuaauuauuuguguguguguguguguguguguguguagcuacccacaggagcuagaggaguuggauccuuauggagguauauaauggaggugauuaugagccagugccugggaagccugagaauugaacuuugaaagagcaggaagugcuuuuagacaguaaaccauuucucuagccugagauuuuugucaagauuugggguuucucuuucucucccucucacccucucucacccucucucacccuuacccacccacccacaccucaaucauggugugcuauugccccccacacccuagacaaaggaaaggaauaugaguuuagaaaguuaauaauuacuugcucauaauucaaaaaaaauguuacaauuggaaaguuuagcaaaguuuaauacuuucauuaguuuuuuucuuucuauuguuauuuuuaguaguuuuucaguuauuuugagaaagggucuaauguugcccaggcugacuucauauagcugaggcugaccuugaauucccgguccugucuaccuccuaaguucugggauaacagguguaaaacaccauacccagcucuuuuuuucauucuuuaaaauaaauugaugcuuccaguuuuucuucugaggcaccugaguauaaauagcuuagagagccuccuuaucaugucaccuuaggauuuauuccuucccugcauggcauauaccuucccaucacugggugcauuuuaagaaccaucaauggaagccagaugguggugucucuaaucccagcacucaggaagcugaggcaggcaaaaucucugaguuugaggccagccuggucuaaagaacacauugcaggacaagcaggguuacacagagagagucugguggaaacaaaaccuccacuaacuguuagugacugauggauagauggauacugagaagcaagcaccuuagccucauagacagccugucaucauuuuccaaagauacuccauacaccuguggcuuuuuucuuuaaaaaaauaaaagauagcuuuucaugugugcguaauggagcaugugcuauuagaggccagacuagaucauaaagcaauguauguucuuuuuagucagugauagacucuggagaucugaagccuccuucuguccuuuugugaauauugaugaauccuucacauacccugaugucaguagccagguuagagggcguacacaguuuaacuguagucuuguuuaucggcugaaaagcaaucccaucucuuuuauggccucugagguucauuuugugcauaggccuguucuuccgcaagaugacgagaaaaacaaaauccauguguuuucuuccaauguuuuucuguuuucacuuuuuauuauugagcuuuugauccaucuggaguuuauuuuacucuaaggaaugagguaggaauccaauuuuacuuuauuaucuuuucagauggcagcccagcugucccguuaccauucguugaguaaucucuuuauucuucuguauaugaaauuccaucuuucuccuaaacuaaaccuguguguuugaguuucuuuugaggcucugugguuuagcgcccugaacugucagugcaugcaccuucaccacaggguuuuagcuacuguagcuucagaauguguuuuauuaccugcuaaguaggccaggcuccuuuauuagguuuuucagucuucaugaauaauuauacuuguuuauuuuccccauuguuccaaaagaucuuagauaagucagaucuucuauuuccuuuccaccccacucucauuuuccuaggggcuuuaaaauguuuauuuuauuuuaauuauuuaaguuuuuagauaaggucuuacuauguagcccuggaagaccuggaacucuuaauguagaccagacuggccuugcucacagagagccuccugccugccuuccaaaugcugggauuaaaggcacguguagcgugcauggcuaaauuuauuugguuuuaauuaaguguaugugaguguguauagugugcgcauauuuugaguaacagugccugcaaagaacagaagcacaggaucucauagagcuaggguuccaggcauuguuacuugggcacugguggcugagcugggguaccuuacacauguacccuuaaccacugagccauguauauacaacguauaaacaacguuuaggugauaaauguguguaugggagguugggccagagguuaauggcaucaauggugugugcucuucagugugguaaugauguuugucaugugagucuuuaucccugugaguuaggagaguccuccuaaaggguuucaugcugacgugccagggugucugagcgcacugucgggugguucagcaaacaucacaacacgaauaagugaugggugugagcauaagauagaaaagaggcagaaaugugaaaaaccagugaucauagugagggguauaauaguguuuccuauguauacuacagcuaaguucuguaggguugacaguuuuccugcacacugggaagcagauguaacuagaauacguggcugcagguaaaaaggcacuuguuaccaagcuuggagaggaguuuaguaccugguugguguagagaugucauguugcagccuaaauugauacuagucucuggcuuugaaguugcucuugugauuaggucuucgauuaucuuucuaacauacacacacauauacuuacauacagacacacacucacaaacagucacacauacaaacuuauauguacacacugaaugccuguuguaacuuggaagguucuugaacaaagacaagauccagaucaugucugccuugagcuuuguuauccucauacaagauguaauugaauaaaacauauuacccaucuggcuggugaaccuuaguggccuuagaauaacaacuuuuuggaucgugauggcuuaagguuuuccguccguucucucucucucucucucucucccucucccccucuuucuuuuucccccucuuucucucuuaaguucaguuucuuuuuagcuguugcuaagagaaguuucacugacacaagagacacaaggaccugucugcaugcugccaguuguuuuauaggcauuuggcucugccgccuugcagaugguaagacucugggugguggggaacugugugcugauuaucuuauugaauuaagguaaccuuuuguuguccacugaaaucugcagaccaguuggccagugagcagcugcucgggguggcuugguuuggggauuugaggaacacaaagacaucucaaagggugaucauucuaauccagguaucuaagaaagcagcgccgagaguuuucuucuucugacacuguuuauguucccauagaagggagugaacaacauuuuuuuuaaacuuuugcucaauuauacagaaugauuaaaacugauuuauuauuuugacaacucguagaaaacuacuuuuuaccuaacauaggaagcugaaaacaauaugcuuucauaauauuugaugccagaagcauccugauuuuauggcagucugugucugaagaucaugguggaauaacaggauuguuuuuauuuugaguuuauuaucaaccauucuagaaacucaaagcuugccuuacuguugccaucugucugcagauccuagcuguauaacucugggcuuggcuuguuuugguuuuagucugucacuucuaucuggagucugcucagucugaaaccacugcaggagccugcuauugcugccgcugccguuccuccucuuccuuuuugaaacaaggucuugcuguugcugaaacuguauggcuuuuuccccuucuaggagaauguuuuugggauggauccuuuugguucuuuauagcacaguauaggugaccacacagagaaugggauggccugcuuguugucagagaggaaucauucuguggugguggaagacgaacauccaucuauuacaguguggccauuucuugugccuuaggaucguccuuugacuuguaaguguacuuuuuccuucagauguaugugcuacuaaugauccugucugcacauaguuacuaagcauacacucuucugggccguggacuuggccucauuugcauaugagguaggucuuauuagcucuguguuaaagacaagaaaacaucucccuagggugguucagaagcugccggguaucacaugcuaauuagggcugggcauauggaguuccgggcucucagagugcaaggcuuauaugucgcacugcccugcugcuguguuagcaucagccccguuaccagaccauacucuuggaaucaaacuaagcucuccuucagggcuucagaaucuguguccaugcuaaucuuauugaugauggugaaaacaauauagcauauacguaugcacaugaaugugugugcaugcaugcauggugggcauacggaggucagaggcggucucagguguuggucuauaccuucugauuuguuggagacacucucuuguguuaauugcuuuguaugccaggaucccuagcugacaagcccuggguagucuugaaucucuuccuuccaucucacuucauuguaggagccuggaggugcuagccacaugcuaaguaagcauuaccaugcccgcuuuccguggguuuugggggauccaaaugcaaaucuucuugcuuguaccacaaaucuuuuaucuacugagccaucuccaaagcccugaugaauuuuuuuauagcgcaaauauuuuuauuguuaccuauccuuuuacauauuuuucuacacacauguucuuugcauaacuacuuauagucaaagaauacaugagcuaaugagcauuauguguuuugugcagaaauuaccauggugaacuggagagauggcuuagagguuaagagcacuuacuccucuuccagagguccugaguucaauuccagcaaccacaugguggcucacagcuaucuguaaugggaucugaugcccucuuccagugugucugaagacagcuacaguauacucauguaaauaaaauaaauaaguuacuauggcacuuuauaauuauuuucuauuuuaauuauuuuuugggcuggagaaaugacuccgugguuaagaguacuggaugcuuuuccaggggaccugaguccaauuccaagcacccaugcggaggcucauaagcaccuauaauuauaguuccagggucucugaugcccucuuguagcccccacuggcaccaaacauacauguggugcacagauauacaugcuggcaaaccaucuauucacauacaauaaaaaaauuuuuaaagucuuuuucuugucuuuggauguagguucucguguagcccauucugaccuugaauuuuugaaacucuuaguucuuuuagccgcaucugagaauaaggaggagcucuccaaaaggcaucagguucuguuaauaaggcuagcaacauacuauauauagucugcccuuacauaccaugucucugauuauuuugccacucaaaccccuucccccaugaagaaaagaacuugcaugaaugcaaguuguuguguuaguugcugguuuauuuagaaacagcuugacacauauuuuucaaacuugaaugguuuuuggagguuguauuuagggugaucaggagacaugugucauguuuucugauaugcugucagaguuaaugcacauagauuuuaagcacaggccugaaauugaaauucccaagggcagaauuugguuugcguguuagaauuggugauguuucaauuugucuucuccacgucuuaauuagggugaguggcagagucuuuggaugcucagugcugucuccccaucugauaacagccacuuguaaauugauccauuugauaguuuuguugaagaucaauuguuuguugaaagagaucauuucagcugcuauuucuuuucuuucuuuuuuuuuuuuuuuccccuugguuuuuuucaagacaggguuucucuguguagcccuggaugucuuggaacucacuuuguagauuaggcuggcuucaaacucagaaauccgccucccagugcugggauuaaaggugugcgccaccaccaccagguuuauuuguccuuuucuuauggagaucauuuugaucgucucccacuccugcuccuguuugcuuguucagacuugcucugugcgcaguccucucguuguuccuucucagggccccaccguucucuucucccauagagccucuuuauucuucccucgcguguacuaacccauguaaugcuccauacagcaaaguguuugcaaguaacuccauguucuggaaccugugcugcaaguaagcaagccaugcugcaguugccaauaaauggucugcaccaagcacacuguuguagagaagcugacacuaaaguuagcgagggcugcaguccucaggccaugcagcacaugaccuucauguccuagcaaaacuuuggauguuauuuuuggaagucuccaagccucccagaauuccagcuucucugagcaucguguucuuuauuggucuauacuugcucauuaguccaguuuagugggccuuggcuuucuaggcaugguuuuuccauggcacuagaaaaacuguuauccgaauugccuaccaauauguucuguggguacaugaaacauauuuaauucaauuuuuaaaaaaaaguuucauuuuaucuucuguaugaguguuuugcccacauacauauaugcauauacauauaaauauauacacacauauacacacaccacauaugugccuggugcccaaggaugucagaagaagguauccaagcaucugaugucuugaagcugcuguuauaggcaguccuuaaccuuuaagauaggugcugguaacccgaacgcuggccuucuugaauaaagagcaguaagugcucuuaacugcugagucaucucuccagcuugcuuucuuucuuucuuccuuccuuccuuccuuccuuccuuccuuucuuucuuucuuucuuucuuucuuucuuucuuucuuuuuucuuuuuugagacaggguuucucuguguagcccuggcuguccuggaacgcauucggguuuuuaaaaguaacuugcaggguugaaaagaaaggcccccaaggucaugugaugucuaucugugcuuugugaggaauucccacaacuggccauguagccuguguccaagagccaggguggagcuccugugcccccaaagcagcacaugcuguguuuagagaugacugggguguugguuugaguccacacuagcugauggagaauggcgaggggcaccaucugcacuugucacgugguugguguuacagaggacuauuuccuaaugcuuaucugagcaccugcuuuaccuccuccuuacagccacaucgauucaagaauuuguuguccuuucuugcuaaaagaacugccacccacugacuguuaagacauccuguccucucaaaugagccaagguacuggguggguuggcauuauccccacugagcuaaggggaaauugaguccuggaggcagucaaggccauacacacauacaggucagagucaaauugugucugacaccagaucuagccuuucuguuuaacucuaggcuuucucuuugggguucccagcauucugaaguucuuuauuacagcaugcuaagaaaugcucuuauuaaucuuggcaucucccauagcacuuacuugagagugagugugagacuugaugugugcccauacuguccuguccuguggaaaagggagaucaccgacuacaucugccaguguggaaucucuagaacgaaguccuucaguggcccuccccacucccugccccuucauuuuauccuuccucauuuaggcaugaugagcuucuacucugaaccaugugauuucacagaauucacauucaggauaugauaggugguagcaugaaggaaaucaaugguggcaagaaugaggcuuuguuguaugugcuggaaagucccacccaggggaacccuucuggaggaagacuugagagguuugcagggucgagguggaaagggccugguuagcguuugagcugauguggccaugccagaguggaccagagcaguacaguggcaaguugauuaagaucaggcacaagaugaguggcuuuguauuuuuaaaaucacagagaggcauggcagcuaaauagaauuggugauggggucggguaggcuguguauaaacaguaguacagguugaguuucccuaaucugaagacucaaaauuggaaaugcuucaaaaucuaaaaguaaacugguaggauuuauacaaauauuccaacccuuuccccaaacaagaaaacaaacaacagcuaguaaguuugaaaacuccugggaccaugcauuuccucugcagcaaguauucacucuguagugggggaaauugugaauuuuuggaagauucauaauguauuccauuuauggaauggauauuugaugccccaagcuugaugacccauuuuuuuaaaaacuuauuugguuuuuuguuuguuuguuuguuuugucuuuuuuuuguuuuuuugagauuauauuuuaauuacaacauuuauccuuuuccuuccucugaaccuucccacacccuuuucccucucuuuuuuaaauucauggccucuuuucauugguugauauugcauggauauauguauuuguguauacauauauucccaaauauaaccuguuaaauccauauaauguuacuuguauguauauuuccaggguuauuuagcacuggacaacuaagugguaucugaucuuauuuuuaagagguguuaauuaagacaagaguauuugcaacuugccgggcgugguagugcuugccuuuaaucccagcacucggauggcagaggcaggcggauuucugaggccagccuggucuacaaagugaguuccaggacagccagagcuauacagagaaacccugucucaaaaaaaaaacaaaaaaaacaaaacaaaacaaaaaaaacaggaaaaaaaaaagaguaucugcaacuuaaucucaaauggaagguagggcaggaugggagagagguagaggggacaagccaggagcauagauaauuaucacaguagacuugcaacuuuuuacguuucaacuuuuuccuaaauaaagcuuuuugcuauuuuugagguagggcuugacugcaaacuuaggguccucuguuuuggucuuucuuagcuuccauaaucaugaauuacagccauguacuaccaaaccuuguuugugggauacuagguaucaaacaaacccaagacaucaugugugcuaaguaagcacucucccaagugaguuacguccucuuuaaguugccuucuaaaauuggaaagccacauacagguuuaucauagaagaaaucucuguugucauauccugcagcccuaaggaaguaaaugacaagauagcuggggugggugacugcuguugacuguguugucuuucagugauuuuucucaauuacucugugucgguuuuguaaucagcaaauagcgaauggagaggucacuucucugugcaaaauauauauuguuugugcauuauuuuacaucagucuuguuuagaauaguauucaggcucauuagaauuuauuagaaaggacagauuuuucccacacauaccuccuaccugucgaguguacugccuccccuauuacagcacuuguaccagagugauugguuuguuacuggggagccaaacuggagacaucaguaacaccugaaguucagaguugcccuuagucuucaguuuggugcuguauguucuguagauaggaguuaaaauuguuucaguuacuuaaaauuuuguauguuaaauuguaaaugccaguauguauuucacagagauaaauguuggauaagcaaauauaacacaagcuggauauggugacacacaucuguaaucugaucucucaaggggcugagguaguaagacugagagguugaggucaucgaggccuacacaaugugaccuuguauacaauacagcaccaccaaggagaccucugcuuugugaacaucccuuaugcacagcaagaguuugguggugccgaggcaaggcaccagucagccccaggcuguggauucccagucauacagaaguagauagcacagcuggcugcucgucagcuuuguuuggcuaguccugggaggacuuaucaaaauagccugggccagugagaccaccucuuaaguaauuuaccauggcauugcaaagugacucuaaaauaaaucuccuuggacauuugacuugcuguuucuuggccuuuccuuuugagguggggucauggcaacucguacuguacuguacuguacuguacuguacuguacugcugcaucuucaugcagaugcuucccggaaaggccacacuuagacuuaacaaaugaaaccuuuucauucccaagaggaacuugucauaccaaagcaaccacguucagaucucuaauuccuauuccuuccuaguguguaccguuuuauucauguagaauaaacacacagccucaaacuucuuacaaggcaaauagacuccuuuuuaauuaacggcucuauauacagaauuuuaucaucaugaaauuuauaagccaaaaauggaacaaauauuuacccugguaguuucaugucagcauuacccacuauuagaaacgcugagaaacugucaaugaacccaccucccuccuuaaaucugguaggaguuaaucaggcuccaaccuccuaguccuugggucaucucucuugugagauucccauagggaaugggaagggacaugcagcuucuuucucuguggguggauacacuugucacauagacuuguuuccaaacuacuaaguuuccuuuucuuauuaauuaaaauuuguuuuuuaaauguguguguguauggguguauugucugugcacccugugcaugguuggugccuguagaggccagaagauggugcuggauucccugaaacuggaacuauagaucaccaugugggugcugggaaccaacccugggaccucuggaagaguguauguguguacacaugcgaguauguaugugcguguguguguguauguccccucacccccacaccaaguccuuucuuauacucuucccauucccauugauucccucucucuccacuccuaaacauucuucuacuuugauguauguauauaugauguauguauguauuuuuugugaaccagugguuuugauuagaguuaguaguuacaggaacguacuaguuguuauacuucugaaaaaauauuucucuucuccuagcaaccauuaguuagguugggaucugaacaauaacaguauauggucuuaaucacugaucucucucucuuuuuuuuuuuuuuuuuugguuuuucgagacaggguuucucuguauagaccuggcugucuucgaacucacuuuguagaccaggcuguccucgaacucagaaauccaccugccucugcuucccgagugcugggauuaaaggugugugccaccaugcccggcucacugaucuguuucuuaagcucuagaacauguuuguuuuuagggguuagcugcuauaguaguuaucauaaagaauaauuuuuuuguucugacagaucuuuuguuccaaggcaaaauuaagucaagcacuuaauuuugauuaagugaugaaauuuuugugucugugaggacaaugugacaaaagaugacuuuaaagacaaaaugugugagcuugggagcuaugaaguggcucaguggguaagaacacuuggaaugugugugagcauuugucuuuggauucuagccccuuuguaacaagcugcccugggccuguaagugugccuauaaccucagagguggggaucuugcugacugccagccuggcaggaaaaaugugaucugggagagacccugccucaaagaaaugaggcagagugaaagaagaggucaucucacauccuucucuggcuucugugugugugaagaggugcacacacccacgugaacacacacccucguggacagaguguguaugaaaauguauguacaccuacagguauacaguguguguguguguguguauguguguauguguauguguauguguauguaugaagacguguguacacccauauggacacagcacucauacuguauucauauacaugagacacauaaaaggauuucugugaguuuaaggccaaccuggucuacauagccaguuccaggccaccugugaauauucaaaacuaaacccuguccuaguaaaacaaaacacaaaucuggguguggugguacauggcugucaucgugagacuuagaagauuggagucaagaggaucaggcguugacagccucauuucaucuauguaaagagcuugaggcugccugacuugugugaagcgucguuuuaauacccuuccuuacuuaccaagggggaaaaauggugaacgaaaagucccaacugguuccagaaaaaguuugcuuaaauauauugggauaacugaagcggggguggggggcggggguguggugagggugggggggagagggaagcugugugauugugcagcuuccuguacuugcuggggcugcgggaggcacuuuuguuuguuuucauucauuuaccgugaauggugauugugcccuguaugcagcuccacaaggacuuuaaggcuggguugcuuggguuauuaaaauauguuuaauaagcuaagcuuuuucaaaaccucaaaaauaauuaagaugcaagaacagauaagcccaaugucuagaaugaauaauuaauuuguaaacauucuagaugcugaggaggaaggaagaugguggcuuauacaauuccuguuguuaggucaggacgcagagaaggugaagcagagaaaauuguuuccuuuuucuuuuucucucugaauauagggucuauuuuggauucugauccuguauaggcaacacugagugguagcguugcagccuuuuuuuucucccaugcugcuuucugcuuccaauuaaagggacacaccaaucauauauaauaauuauauauaaauauauaauaaaauauggugcuacugaaaaaggaaaacuguaaacaagguagggaagcauguauugaaaucaagucuugaaugcuaauauauauaauauaacccccgaguagaugccucucaugcuucaucccuuucaaaccacagcucaguagaaacauuucugucaggagcuguagugcuacugagcuuagcgagcacugggcgccucagauugucuguaguagguauauacggcaggcaucccuguuuaagaaccucagagaguaaugggguuauccgauucacucuguaccccuucaagaagcgaauguguauucaguugggauuaggauaaagauguagcucagaggagagguggaauauuugucucacgugugaggcuagggcuugaucacauguaacgauuuacugauacacugucguacacaguggucagccaggaagacucagcuuacacucagccaguguacacaacugauguuggugcuguacagaacaccuuggagugcaaaggaacgaggcgaauuuguugucuauggaaagcuuuacagagaaagguaacuuauggauaagguucuagguagaggaaauaggaagaugaaagacugggaguccugccguggauauagguuugggcgaugguaagcaguacuugaccagcgcgugugugauucugugugcuagggaaugaagcugugagccauauugagugguuacccagggaugguacauggucucaguccucaggagccugaggcaggggaauggagaacuugagauuagucuguguuguacugaacuguguguuucaaaaguaaaaaguguaaagaguuugugcaggcuugaggcaggaaagcgaaggucugagugugaguuucaucacugggguguugaccuugggggagagagagaggcagucugcugauugagggaagaguacaguggauaaauugaugauauacuaaaguauaagcacuaaguuguguggguugaaggaugauggcugcaaaggagaggagauucuuagcaaauaacuuaaaaauauuuuuauauacaaauguauauacuaccuugcuaucucgaacuuaaaaagaaaucuuugguuuuuuguugguuuguuuguuugguuuggcuuaauuuucuucacauguauuuauuuaucaucauguacauauguguguacauucugaguaccacaguacagguguggagucaaacagcaacucugaucaucaggcuuggcaguagggaccuuuaccccggugcugagacugcaugugugucaucaugccuggcuuguguuucucuaugucauauccgugcccuugcucuuaccuaguucuggagagggacaauuguguuaaacugcuuguggcuucuucacaucccugagguagaggcagagugugcccgugggcuuggccgugguuuggauucuggugcuuuguuuccaacucuguguaucugguucuuccacaucaucccugugccucaguuuccucagaccuguugugcaaacucuaauguucaugggaacguugaggaaaaacuuuuuguuguuuuaaaauacaauaucucucagaaagguauguggcauuuuaaugaggccuuugaauuuuuucauuuauuaaaaaaaaaaaaaaaaaaaagccugaaccaagcugaaccugcuaugguuaaaaguaugagacuaauguaccauuccagcuguuuuccgugacgacuuuuaagccugagugacugcuggcucuuucuuaggaagcaucucagaugcuuuaguuaggcauguguucaacucagcuuuuuaagugggauauuagacaaguagggcuucuuugucccuuggaggcagcaguuguaggcaguggcccacugcuguuagagccagcugcccacaguggcuuuaugccuucgagacccagcaucucugcagcuuccugcuucacugucuuuugcagagaaguuucccucauaccacacuucgcccaggguagcuucuucaugcacaggcucugccuuucugucccauaggagaaaggggaaagguccaagggcaacagcaugagcuguguucuccagaacugaugcuguccccagaggcugccucgucuguguuucguuggcuagagcugcaucauguggcaucccuggcaugagguggggcuuggccaguaucucugugucagggaucuggcuucucagucucugguuaaaaacuaaagggcacaggugcuggggaugguuugugucauucaaaaugcaccuuaguugaaacuacagcauuaugauguaguuacaaguucauagucguauccaggggcacccuguuugccuagggccacgguauuucuguagcugaacaguuaguuaguuguaaggaaaccagcaugguuugguguuuggucugucccuugauccuccauguccuuaaaauauggaagggaguuaucuuuuaaggcaggaacaaccaagagagacugaagaguagguaaaucauuugcugugagaaguaaguggaaagggagaaagcccgaggcaggacucugugggaauugcuuagugcuuaggagauacucauaagagaucugagggcuaucuuguccccaaauucagggacucuuucuggcagcagccugaguuucaugcuugcucacaggagccuuucuaaugggaucaaacuugcuuuccuagucuuuugccaacaaagaaguaauguccucuggacauucuuugccucccccucaccccccccccccaugcugucuacacucuuguggauuuguaccauauguuuuuauuguuguuacugagguauaauucacaucaugaauuuaugccuuuaguguucaacucagugguuucguauacccacagagucauguaaccaucaccguuuucuaauuccagaacacuuugauuaccccagagugaaaccucacacucauuagcagucacugcccauucccugcuucccucagccccuggcaaccacuaaucuacuuugugucucuauggauuugcuuauuauagacauuuaacauaaagagucauguagugacuggccuuuuguggcuggcaucuuucacuaagcauaccguuuucaaguucaucuggaucauagcacagaucaguacuucauuccucuuuacuguacaucaaucccacauuuuguuuauccauucgcugcuugaaagguuuuagcuauuuaugaacagugcugcuguaaucauugugcacaacuagggacucacuguagcccagugagucucaaaacuugugacccuuccagcuuagaugccugaacguuaggauugcagaugugucccacuguuccucaucuucugcaagcuucucugugagcgcacacuuuucuuuccccugcaugugaaccacgagugaaauagcuggaucuucggucacaucacacugugccucccuuuucuagguuggggagucuagggauaucccuaaccuggagggguagcuuugauagucccuauuagcuuuaaaguuugaaucucacuugagugaaucauuucuccaagaugugaggcuuauaaacaucagagcugucucuaguugauccucugcugcugggauucugugggacccaacugagaugauuauguagugaguugaugcuauggccucaagccucuugcuuuugccugcugucaacaccccaugccuccucugcaccaccauuuaauccucacccugucaaaauacaaggaucuaaucucuuacucacagauacuuucuccuuuguuuggacuuuuuaaaggugguuucgcuacguaguccacuggcuucagaccagaucuuccugucuuugcuucugagugcuagagccaccgcuaugggcucauuucacucaaguuuucauuacacugaaaacaguuguguauuguaacaugacacguuaaacucuguugcaaggcaacacacgugcgucuguggcauuucagacuccagggcuuuucuuucacauccggcugacuucugauugggcuugagaacagccauacaccaagucucuggugggugacacaggauggagagauagggucucagaggaaaugucucccuccuagucuuuaccugaagcugaggccuauaggggcugugucugcccaggcugcagggauuccaucuuuuuaaccccuuugcccuucuucaggaugaccccugccucccacccuuucugcccagagucccccuuuuuaaauuucuuuuuucucuuuuuagucugucccaccgccucuuccuuaacaccauccuaagugucugauacguauuugccuuuuuggcuaauguuugacauuaauuucauucuucucuuauccgauaacucuggaacucaggucugugcuucucaauucucaccucuuguaauuaaguuuugugaaaaagaagugugacauucagauauauucucuuauuagcaaagguauuacucgguauucgacuagaacugugcaucuguaaugaguuguuacucucugaauacuaaugcaacuuagaagaagccuuucuuuguuaaagacuuuuccuccacaggccgcauauuuccaggccuauuucauaguuagucauuugugguuuuugagguaugucaguggagaugcuccagccagcacacccagauccuguuaaauaaauaaacaugugagauugcuuacuuuuaaaaaaauuaucuuuguuuaaaaguuaauuuugucccuaaugccagaguaaaaaaauucuuuaguauuuaagagaccugaaaauacuaacuaaaacauuuuguuuugccuucuaggcaucuuuucuaagggcuugcuugguucacauaauuuuucuaaauuuuaagaaauucagaucagauuuaguaaugugccuauaguacacucuuggugaccauauggguuuucuuuauuaagaccagcuaaagaauauguacaugaaugauagcacacaugugagauagugcuuuuuuuuuuuuuuuuccucuugagcuccugagaguuuacagagaaauugcagugggauaaggaugcaugugcgagaugaaggcagugggauaaggaugcaugugugagaugaagcuagugcuugcugcuccuccauuuguucuccucagaccaaggucaacaccugaacucccuggaacggcuugugccauguccucaggguuuaggaccccaggacccugagguugaggggcaaaguagccagcccuaagcccccuuauauuauuuuuugcuuugucauagagcauagauccucccaaaggaaaaaguaguuuguuuuuaggauguucaaagacaaauagugucaaguacaaaggauuaucagccuuaggacugagagauuugaaggagggggaaagggcaaaaugaugccaagucuuggcugcccaagaucucccugcccuccuggcaguauuuuagggauguauuuccuuugaccgcuucuuaacgcaagucagcagucuaagaaucuugcagaaggacagacgggguaggcccucgugaauccuucagauagagcauaccccauuaagaagcugggcaugaucucagauuucaacucuguuauggugugaugcuguggccagcccagugggaccaucacaaacaccucagagaacuguagaaugagacuguauuuuauaucuugagacuauucaauuauuuauuguuucuucuacuacucauaugccugucauccaaugcuguuuuguuaaaaauugucugcauguugaggauugguucuaauguuuuaucuuauuucgauuccaaaaaagccaaguuuccagaccugaggucccuggccccagcuggauuugacugauaauaaagaauugccauacagccaauggcugggcagaaggacagagauaagacuuucagauuucaagggcgaggggccagaaaagaggaagaauuuccuugacagggaaggagaaagaugcugcuuccccuguugggucugggguagcagagaugaaauacagauuuuaaaagauguuaccacaggaauuucagagguggggguuguuugcuagccacagggaaauuuagaagugcccagccaaugagcuacucaaggcauaucaaaauuagcuggugugugugugugugugugugugugugugugugugagugugguaucuuucauucgagaaucuagagagcucuugggcgcaugcguagcaugcauaagaccugccaggagccaaaggcuuaacuaauucauugcuacaguuguccacuguuuacuguuucucucauugcgucacuguaaauaggaaaguucuuacauugagguguugaggugucaccguccggaacuuuuuugcccuuguugaaugagucaugguguuucuacauguccauacaaagaguacaugguuucucuuguguguuuguuugguuugaagggggaaaggcaaagugauaaguaaaguggacaucucugagaucccagguuuuuauugacucuacuccuggcuggccuggaaugaaaacacacacacacacacacacacacacacacacacagagucugggguggccuccaucugccugcugagugcuggaauuaaaggcguauacuaucacacccggccgaucuuuuuucuuuuaacaaaaauuuugaauccauuuguuuauuuuguguguauguguguggauagacacaggcuggagaaucacucaaggagcaguucuucccuucuaccauguuaguucaggugugggacucagaugguaucaggcuuggcaggcaccuuuaccugcugagccgccuugccagcacuacucucuucaguucuuacuuauguauuuuauauguuaaagaauguuguuaguggauagaagagacagagacaacauccuacagagauuuuggguuugcucuguucuauuuuacauucuuucucuuuuuaaaaguuacuauauuuuuauuuuaucugugaguguuuugccuaaauauaugucuguguaccauauguaugccuggugucauauccuuaagaugaagucagaagaaggcaccagaacccguacaguuagaguuaacagauaguugugaaccgcuguuuaggcacugggaaucaaaugcgggccguuuggaagagcagcaugcacuccuaaccaccgagccauccgucuuucccgccccugcauucuuacauaacauuuucuuggcuacuuuuugcuuagcaucaaauucucuaaucuuugaagagcugcauauuuuggcuuuuaugcacacuaaaacccagaaauagacuuuuuucccuaggaguuugcauauuaugcuuaauccaagacauuaagaauuaaauaaagauuaguuuucuaaaugaccauuagcuagacauuuuaucugucaggagagaggauucaugcaacuccaagaaugcauugcccucugcauacuauauuaauuuuggcagcucagagauaaaugaacuugagcugugcuccaauuuuucauugcgaggagacauacauuauuauaaaagcucuucucaucugcaagaguguuucuuucuguuguuuuaauuaaacgaacgguuuaaaaauuaauuaugacauuuugaugaucugauacuggcugggaguaaggauauuuucucaggauuuaugaugcauccagaacggugcuauucaaaggaauucugacaaagcaauuguucucucugaguuuuugcaucccucaauuuaguagccaccaaguguaacgacuugugaaaccaagagacuaauguuuuaguuuuuguuaaaauaucuauuagucucauggucaacagacagaacaaauaaagaauaaugacauccugaggcucucagguuuuguuuuuuguuuuguuuuugagggggcguguugaaaguuugggcugguuaagaguaaacaaugaacaguauugugagauacaaaaacuuuuuaaaaagaugaugcagguugagcuggggagauaguucuguugguaaagugcuugccuggcaagcaugaggacuugaguuugaucuccaaaacccauuuaaaaagcucagucugguguacacacguguaaccccaacacuggagaggcugauccccgggccgucugaugccagcacagccaauguuccacaguuaggaguuccauaauguuaaguugaaauacaguuaagagacuauuucaacaaaacauggcaucugagacugauagcuagccccucccucccgcacaugaucaugagcacgcgcacccccccucccccaguccgguaugcaguucugaagggcacacaucacaucugaaugugagggaauagaggcagaguuagcaggcuuccaacagagaauggggugaugcugguucgggaauuuagccaugguugguaaagucccaucuuuuagucuuuggucugaacuagugucaggcugacuagguuggcacauuuaaguaaguugcuucugcccaagauauuuagaagggaacugaaccuggcuacacccuccugaaaugacacacaagccuggcuggcacagugcuguccaguacuuguucuuuugagagaugggaucaggauaguuggcacaaagcauugccuggccagaaaucacaaguuuguaaagaauaggcuuuauauuagaagaauaauccuaccucuguggaagcaaucucggcauagauaagaauugaguacaucugcuugaagguuugaagugucugucaccaaggacauccccagauaaagaccaacaauaaccuagaagagcaguugguuauguauaggagacaggguaaauaugaaagauguaaagaaccuuuugcaaauaggaguaacuauuuaaauugguaaaaccgauaaaaaugcauuuuguagaaaaaaauaagagcagccaguaauuaccaagagauguuuaucauuauuaguaaucacuuauuagugauggggaucauacauuaaagcaaucagauguuuuuuugccaugagguugacaaacguuaaaaggaauauuaauucuuuauuggcaacagugauugagaaaugaauacacuuguauagugugagcauguaaauuguucagaccuuuuagacagugcuggagcagcuguaucaauaacgucacauaccucgaucugguaauuuugcucauuuuagcauaaaugaaugguuaaguccuggaauggucaccauacaaugguacagccaucacauggaaccuuacguagcuccuaaaaacuguaguguagaucuuugugagagaacuuuuuguggaaacucauaaauuuuuaguggggcaaaauucuaaaagggucacauuuaugcaaaguaaauuucuuaaaacuagaucuaguuauaaauguaucauggauggcauuguaaauguauauauaagauaaauucauucagauucuguuauguuaggaaagaauuuucucaaugcugcacagagacgugcaugaagggaaaggaccccgggcacagcaauauucugcagagggagcaggaggagccugcugagcaagcgcagugggccacaagugccgaugcagguggagacugugccucaccucauuggcaggagcucuccagucaugugacagacgucucaggaaugucugguagggaaguagggagaguuggguaaacagcagaugcgagaguuucacaaggaggaagagauuuauggaauugcugccuuagccauugcugaaaaaagagaucguuucucacgaucagauuucauggauucuaauacaggcuuuuuagaaugagugaaaucccagcacaucccugacaauugcuggcauguagugaguggagcauaaugcacaugagaaaugaagagcuuggcuugaugaaagguuauauggaaauacacugauaacuggcgaaggaagggacaggaugaggcugaggagguguccacagaggcuuggcgucauuugcauuuuaucuauauuuaaauucuucuuacagugcaaauauauucaauaauuacauaaugaaaaaugugagaguauaugucuguuagaagauaacucuugccuggaugccugugucuuccgagccaguugugugcugugacaguuagaccugauacuuagcuacccuggagaacuuuucaugccuagaugcugcucuuagccaagagaauuuucagcuccauuaaguuaaguaacugaagauucaggugguaagagaacugaacacugacuuccaagacuccggaggaguagacucuagagccagggccgcugacugcaugcaggcguaacuagucaugugggcuuccauuguugggauagggaauuguauggugaggcaggagacagguggaaucaaggauccuuaguuauccagugccauuuucuagcuagagcacagcccuaaugggagagagccaucugacuuaguggcguuguaacucccagaggucuugagucagagaugacuacuuagaaaggcucuggugagacacccagggcuugggaggcggaggaaggacuuugucugccagggggauccggggaaaccugacaagagguuauuugugccgucacugguggaaggcagagacugauuuccaaggaaggacucagaggagcaaggacucagugcugcucauaggcacgaaggaggcgauggggagcggugaggagacuggcugauguagagaagaaguguacaagcaaggaagcagggcuggcagcugacagggagguuagaccggccgggccagauggccaagagcugaggauggaggugcuggcucauuuguucccucuaaucucuaggcuaauauagauuuugguaccaccaguuaaaaaugucacucuagcucaccuuauaagagcuuuagaauauguggcuaagcccaguguuaaaaguacgaggcgugcuuguuuuguacuuccauguauaaaugguuggauuucaaaauuaugugugugacacaaacuuuguuuucagucucucugucuaacagucccugcaaacagccaccucacuuucagaggccaucuuuguuauuccauucacuaaaaaagcacagaacugaacauuguuuguuuguuuguuugugugugguuuguuuuuuuuuuuuguuuuguuuuuuguuuuuucgagacaggguuucucuguguacuuuggcuguccuggaacucacucuguagaccaggcuggucucgaacucagaaauccgccucccucugccucccgagugcugggauuaaaggcgugcgccaccacccggcagaacugaacguuuuaugaggaggugaaauugaauguugacacgaacauaggcgagcucugagccaugagccacacacacacacacauacaccccauguagugcaguuuggaacaggaucgaugcuguucuugugcaguggggcuggauuguauggugacuugaacauuuaauagcauucccugguccucuugucccugguucuugcuggucuuacuguuuagugcuaccgugguaagaagccucuagcuccuuccugcauuuggguuugggcucugcaggugccgugcuaagcugagcugaccuuaggcaucugaaccuuggggagucagacagaaauguggcaaucuugugcuuguuuugccauuacuguaaguucuuagaucuugguuuguuguuuuuccacccuaaguaguacaagggguuacucauuuaugucugcgauguuuuaaaaauaacacuuucauaagugucacagcauguauuugucauuuuaguaaauggauauuuuaauaggcagcaauuugcaaauucaaacauagacaacaugauuugacauuaaaaaauuagagaauuuccugccaucuuugccaucagccuugcauggaagauuccagccucuggggcuuuaauuucugcugacugugacugaaaguccacacuguuauuggcauauaaugugaacugacagaaacagccuuguuuaucaucaccaguggcauuugggugugugugugugugugugugugugugugugcacgugcguguguacgugcgugugcgugcaugcaugugcauugaguucuuuaagagggaaccuaaggacugccuauggauaguuuaccuaagugcucacuggugagcuguggcagcauuugcuguucuggccuccugagugcuggugagggcuagccuggagcuugaaccuggacagucucaggacagugucaauagguuacugacauacucaagguuucuuuucugauagcacacacaagugugaccgcagguacaggcgguuuucauuuaugaguuugagaauacugauagccugagcuaccaugcgugcuucuaaugagaacucugagcgccaucccacccugugcagcaaugcuggauugcacggggacuugaacauuuaauggcauugcguuucuuucagacugagccucuguggagucuucgacuugcuggagguuccuuuggugucuguaguccacuaucucagcuugggcuuuagcaggcuacugucuaauuauuuuauuugucugccuugucacuaaauguuuuuuauauguggcaggauguuaaagugcauuuucccacugucucaaauuuaggacccagguucuaaagcugcagauaguaggagguaaauagccacaccaucugaaaagacauccuaaagcacuuguuugcaguaccacauucaagcuauaccuccaucacccauaacccagcccuuguaagagaacccuagagguggagucugugcauuuaacucuaggaguaggguguuauuauuauucuuuggaacuuuccacucucucugcccucccuccauucagagggccuuuagaguuuagacacuaggguagauaaguuuuaccagcuguaggguuaaguaucagguaguugaugcucugagcuuagaauggaauuuccagaguguuuuuaggagagggagguuggccuggggaugugaauaccaaggcuggugucuuccucccaucugaaaguggcagugugacugggaccaaguguaaagagggcagcgguaaugccugacagaccagguggucugcccagagggcaguuggcugucugccagagguaggacucccccucuccccaaggaagaagauuauggguauagaaguagaauggaggcugagagcugagcuagaagaauauaguugccuguaccagacagccuggagguccagccaacgugcucccacuagauagaagagcuagcauuagcauguagguuuauuuagcaagaucuuuagggggcugggccauaaggcaguggaccgauguccuuuuccucacugcuaguuugagagaaggaacucuacauuggauaacaucaaaauuaguuucauuauagacuagauuggacuuuuuaauacccgaaguuuggcuuuauuuacagagaagacuauuuucuuuuuaaaaggaugacuagaaguugguagaucugcuacguuacugaacccugaaaugaaggcagucagucucagcgcugcacaugggagcuggcuuucguaauuuacugcacucccaccugcuuuguacccugcaguuucaagcuucuagcuuacuagcaauuucuguguuaguaaaauuuugaauuucauaauaacccgagcacuguaaguauacuaacuuaguagacaacuaauaauaaacuuugugaccucauguaggcauuaggggaccccuuagggauuagcugaaaacucacugucuuuaauuguauuucuuuugacauuguuaguuuuggguuuauugguuuguuuaucaugauagaauuguaaaauaaaaucuacuguguuggaaacauaaccuacugguagaaugcuugugagaguccuggguuuuagucucuagcacuauagcuacauuucauaguccuacacguuucagucuaccaguacugcacaggcuuugcaauuucugugcacaguuguccccuuguacuacuuucugauuuuauauauauauauauauuuuuuuuuuuuuuuuucuuuucacacaccacacacacacacacacauguagagauaggacuuuaguccaggcuggccuugaacucuuagcccucuugccuuggcuucucuagcacuuggauuccagggguguaucgcugugcccaguuguauucauucuuauuuuaugugugugaguguuuugccuguauguaaguacacuacacacauucagugccuguggaggccguuagagggcauaggaaccauguaguugguugugagcugccacaugggugcugggaacucaguccaagucuucucuagaacagccucuaucucccuguuugcuuuuuacaucuaaauuggauuguuuugacauuacauuguaguucuguauccuggauaguaauuuucucuucuucccugcccacccucuguguguguguguguguguguguguguguguguguguguguguguguguguguguguguguguugcucguguguguguguguguguguugcucacgcacagguucugucuguagcuuggauggcucagguucacucuuuucuuacuucuuccuccccaccaccaggauugcagguuagugucacauguagcucuguagguuaccuuuucgcuguaauuauauuuuuguaguugaaauauuaauucaguuuugaaugcugaguucuacaggcuguagcuguccucccagcaucugcagaacgcagaaaacuugcaacagugcagucauucuucuaagccucuuuccuuuccuuccauagacuugaacucaccaaccugcuagcuuugauguccuccaauaucauuucccucgugguccuuccucccucuccuguggaaggcuuugcuuugugaaaguguaccugcugagccaguugucccuuucaugaggcugugcuugaaagauggaaugcuauccuuucccucuugccuuuuuauuuuuuuaaaauacuucucuuccuccagagacagcucagacaugaagauuuuccagucgaccagccagcugcuuucuucugcagugucguauguacagccuggccagaacccuugucuggaaguauugcaaggcguuuuauaacccucccucaccacaccccagcacugugagcuccuggaauccccagcucagugucuccucuuucuuuucccagcucaccgccaugcccuaagauccagcccauguuacccgccugucacuuccagugacugugggcagagacagagcggugccauuuuggaagagguaacagggcugugguuuuuuuuuuucccccaguuguguuucuaaaauugcaucucaucuaaucuuaucuggcaagaccuuggcagcuaacuguagauuuuccagacuuacauugggcugucuuugucuuguguuacaaaagcaauaauuagaggaaaugaucuuuugagaggcuguuuaaugaaugccacuucugaccgugccgcguccacucuuacuucaaguaaacugugcugcugcacacugucucacuguggcucaguauugaaccagagcaucacgaugauuaaucuccucuguuuccccuuucagucuuugcuuuggugcgugugggucaacaucuaaaagggauuuauugacuuuacauuuagcaugguuuacucuacuugauuauaucauucaacugugcguuugugugugcgguagaggacugcuauguuggaauucuguuuucuguuaaaaacacugcuguuuuauuaacuauugguguuuagauguaaugcuuaaaaauuuuguagugucucauuuuuaaguguacuuaaaagcgauucuuauaaucuugagccuaaaccagcuuccccaaauuguuuucugcccagacaagcguaggcagaacccagggaagugcuguucacugacugcggaagacucacccauguaucuaggacagugguccagggccuagacccucccccauuccuuccucugccuccuagaaacacucauguggcuguguucuacaaaccacagaaacucaagucagcgucugagcucagagguccacuugccccaccucccgggcgcugggauuaaaggugugcgccuggaccacggcccggcuucuaaguuguaucuuaaguaaucaguggacuucauccaaccuggacuugauuucaguuucuaguuaguaaaaguguagccagccaucagaacauagguccugggaaccuguacauacagaccuguugauuuuugcucuaacaauucaaaguauagagacaguuuuguuucugagaacaugaaaauucauuuaauuaauuucccaccuagaaauuaacagaaauucauuuuuacuuguuucuuacauguuaauuuagagauuuaaaaaaaaaacauagcagagauagcagacaacaaaacucuauaggcugugccuuuucuuugugggcacugagucuauguuuaguaaauaaagaauaacaaaguaccuauagauugggggaguugcugggguuagagguuuaugccagccauggucuuguucuucacuuuuaaaaaacaguguguauguguaugugugcguguguguggagguuguguaugugugugugcguguaugugugugugcgcaugugucuguguguggagguuguguaugugugugugcguguguggaguuuggagaauaguaaguauucaggaguggguucucuccaccagcauguggguaucggagaguccucuugccuucaggccugguaacaagugccacuauaagaagugccacuauccccugagccaucuugccaccucgguggcuagcaugcucuuugacuaugcuguucuucuucccuuccuuccccucucccuguaaguguuggcauuacagacaucaaacuacugcccagcuuuuuaugugugugugggaccggaggacagacacuuugcuagcuaaguuaucuucccaaccccugaaauuuugucuuauuaacagaucagaaaugucuggucugccucucugggcugauuuuguacacguuagaucuaaccucuuggagcacuuauguuucuguguaugggucugugcaugcgugagugcaggugccaacagaguucugaaggaggcucuuagguccuccggagccagaaaugcagguggcuaugccucgccugacaagggugcuugggcauaaacucagauccuccaaaagagaagugaagcucuuaucugcugagccaucucuccaggcuucccaaccucuauuaauuucuggagauaaguucuuacuauguagccuuggcuggccuggaauuaccuuuguaaaccagacuaguauggaacucagagauuugccaggguuaaagucaugagucaccacgccuggguuuuuuuuuuuuuuuuuuuuuuguaaacauggccucucucccuuuaacaucaccucagugagccuuacagcccucuucugugguggagugguaugcaguguuccagugggcaaccgagaaagcaggcgcuuugucucucuugucgucacagggucagauagcguaagaacgccagccuggcucuccuggauccauguccccacagcaaugucguugagugcuguguugaggcaggaagagaaaaagaaaucauaaagcaguugguucucugcuccuagucagauuuucaaguauaguugcuucucaaaguuugaaacaaguugaaccuuugguuuuucaccucccaaguccaauauguaguugguaaaucugaagaaagaauuguucuuucuauaacaaaugagucuuggauguuuuuuccuuagucugugagagcuuaaguugaagugugaagauuuaccacuuuugguuuggggacaguaaucacccuuuuuuuuuuggguguuugaccuacaauucuaaauaagugaccaucucgugaccaucucguaguugagagcacgcacuguucuugcagagaaccccaguucaguucucaguccucguggccgacugcuuagaacugccugugacuccagcuucaggacaugcugcauacagcugugcacacacacagauaagauaaaggaaaacaucuagucaugacggccacagaguucuuuaaaccuagcacuugagaggcaaaucuuugugaguuugaagccagccuggucaacauggaaguucaaggcuagccacaacuacauagugaacgccuuaaaaaaauuaauaaaaaagcaguauuacagggaagcaaguaucaguaaguaaaagucucagugagugagucucagugagugagugagugagucucagugagugagugagucucagugagugagugagucucagugaguaucaguacuagcauugcugucuucaguugcaugucagagcuaggauuugucaucuuagucaauauugaaguaauuaaaauguuuuacccuuccguagcuuguuuuuccuuaauauguagcaaacagauuaugagauucaggcauaugaaacaguaagaaaacaguguggauguaaaucucugaguugcgguguguagcauucaaguuuugaagaacuuaggaaaagagagagacugguaguauucuuugguuuuccuuuccuuuccuuuccuuuccuuuccuuuccuuuccuuuccuuuccuuuccuuuccuuuccuuuccuuuccuuuccuuuccuuuccuuuccuuucugguuuuucgagacaagguuucucuguauagccuuggcuguccucagcucacucuguagaccaggcuggccucgaacucagaaauccgccugucucugccucccaagugcugggauuaaaggccugcgccaccaugccuggcuugguuuuucaagacaggguuucuccaugcagccuggcuguucuggaacucacucuguagaccaggcuggccucgaacauagagauccaccugccucugccucccuaagugcuaggauuaaaggcgugccccaccauggcacaggagccaauagaauucucuagagaaaaaugugaauaauguucuacuuugauagaguaaguguucuuuuaauugcuuuauugcuaauauuuaaacauagacaauuugcacaccaccuaauggcagauaucuaaagacagauaacauuccuaccacuguggagguguuagccgcgcuggcugcggcucugccucccucucgugcuuugcuuccucugcacagcacagcagcaucguuugcauuuuaguuuugcccuugagaaugggaagaugacugccauuuguccuuccaagggagcaccaggccuggaggaaaacagcuugcucaggcagguccugccucuggcacuguccaccaucagcagaggcagggggacugugguuugaaggaugcguucacccaggugacuagggugcaaaggcuugacagcugucaacaacccuuggguuccccagcugaaagugggcuccauguaccagaagcgggaagggauaggagacaugcagaggagccccgacuggcuguuauccuagucaugggcacaccaucaccccugcaguggaagggcugguagugaguguugaacaugaaaugggaggagucuuggaauguuuguuaggcaagguucugauaggccgucuagacggcaccggauccugaccuguuuuccccuagucuaauugcaggauauauguucaguguuguaaguacuuucaaaugguuugaaauguuuauauggaccucuuguauuuuauauuuauacuuuucuccuuguuuggcuuuuuucuuuuuuaaagacagagcuucacuuuguagcucuaggacucacucggcguggaguaggcuggucuugaacucacaagaguucugccugucugcccccugggugccagauuaaaggcauguauucccuacccuccaucaugccuaauuugcucuuuuccaaauugaagaaugagauuucugaaugcaacaacccuccauuuuauaaaguaauuacuguugaaucaaaauguuuacucaaugcgagcuaucaaguuaccuaccgaugccaacugacugggugauuagaagguucagaucaaaagcaacuggcuuaucuucauggccguuuuuucauccuuuaauuuaaaaugugucugucuaacugauuaucucacauuuuguaaagaaauauugauguccaauaaaguauucagugaccucacucuggcugugugggcagucucacggcaggccucugaaguguugauauuccuguaaccuuugagcaagaugugugugugugguguauuaaugagcuggcugaagugauguacaguaauuucauccuuggguaaaaacagaugugaaagauucuguuuuaauauuuaaucaggcucaaagccucuguuggcuuguuuaaguugaccugacagcauuauaccuggaaacacuuugaauuaaacucugagggcuugaccuuguucaaacaguuguaauuuaauaaggcugcugucuugguggagauaguguagcuaaugggcaaauccuuucugccugggauuguucuaugugggcgcugggguggggaagcgcacagcuuuagcugggcacuaggguuuguagaaguugugugugugugugugugacuauauauaguaagaaauuguauuuuagaagaucuuuuaaaaacuuguuuuuauuuuguuggaaguuuaauguuuaaucuuuaaaugaaaccucaguugggcucauuuugguugaaaagaguagaaaauuacugguuuuuaaaaggagaauggaauguucuuggauaucaaaauaccaaaggaagagguggagggucaauugcuuugguuaccauguccuucugucuguccuuccaccugccugcccaccuccuucccucuggucucugcuuuugccaccucugugaacagcuugcccugccaucucucccacacgccuuuauuaguuugaauucugguaucuuccagcuguagucacugcuauuagcaaguuugccucuuuguucagauucuucgaaaggggcucucccucucccucucucccucccccccuucucucuucccucuccucuccucuccucucccccauuccuucucccucucccucucucccucccccuccccuccccucccccucccccuguccuucccccuccccccuccucuccuccucuuccucuuucccuccuccuaucauauccaaacccucugugcuuuaaaacaauuuguguuuucuagaguaugaaaccuaacaggaaguuugaacuuaaaaggaaaauugguugggucagguaucgugaguugcccaaauuuauuugguaaaaaugauauacugguuguuguuguuguuuguuuguuuuguuguuguugucaucaguuugacacaggugaagaccugucugggaagagggacucuuaguugaaaaaaagccucugugcgauaagccuuaggcuagcuagucuguaggguacugucuugauuaauguugauuggggcggggggagggggggggcaagcuauuuugcauaguaccuucccagggcugucauucuuggguugaauaaagacagcaggcugagcaagccagaaagcacugcuccuccauggccuccgcuucaguuccugccuccagguuccugcccugacuucccucagaaguuuccuagugguguaagaugaaauaaacccuuccuuccccucccccucucucucucucuuucuuucuuucuuucuuucuuucuuucuuucuuucuuucuuucuuucuuucuuucuuucuuucuuucuuucuuucuuucuuucuucucuguaauuuuauauuuucuuugcuuacccacucacccaaacaggguuucucuguguagcccuggcuguccuggaacucauucuguagaccaggcuggccucaaacucagaaauucaccugcuucugccucccaaaugcuaggauuaaaggugugugccaccaugcccggcuaguuaaaauuuuaaauguaauuuuacuggcuuugaagaaacucaguuuuuggaacugugaggaaugcauugauaagguucaaguucaguugaaggaaaaggagcuaagagacuaccucacuugcugcaaaccucacuugcugcaaagcagcuacagcgaugugcauguggcgugugaaggcuuccggaguucuccagucaugccaguguugaauuucccgugguucaguguacuuggcagaauuccgacugaguccuaaagcucuucuguuuguguaauaucucuuucuugagugugggugagcuacagacgugucaccaccccgugauuauauuaucccauuuggcaaaugggagauuuuucuagggguacauuguagucccuccccaggcccccaguccauuuugcuuuuaugacauggucuggagcccagacuggcuuugaacuggaagcaguagaacugcacacauacagugcagcucaguaaaggguuagugucugaagauggagcagauggagcuuccaaaaacugcacauggccuccaacugacagccagugaagaagugaagcccccaguccugcaacugcuaggaacugaaaccgcuagcaacuuaaugaacccaaaagcgugcauucuucucaggagcuuccagacauucacugugguggcugacacaucaggcagagacccaaggagcugccuagauuuuugauauguggaacugcaagcugaugaauggaguuuuuauuuuuguaacuucuuaauuuuauguguacuaguguguugcuugcaugcauguaugcguaucauaugcuucauacaugcagugcuuacaggggacugaagagagcauccgaaucccugguacuggaguuacaggugguugagucaccaugugggggcuagggauugaaccuggguccuccugacgagcccuaggauucuuaacagcugaaccaucucuucagccccaaguaaauuuuuuguuguuguuuuauuguuuguguguuuguuuguuuuccuuacugacagugucaguagaaaagcaacacagaauaaggacuggcgcugggugugguggcgcacgccuuuaaucccaggcagaggcagguggauuucugaguucaaggccagccugaucuacaaagugaguuccaggauagccaggguuccacagagaaaacccugucucgaaaaaccaaaaaaaaaaaaaaaaaaaaaaaaccaaaaaccccaaaaaaagaaagagccaggcagugguggagcacgccuuuaaucccagcacuugggaggcagaggcagguggauuucugaguucaaggccagccuggucuacgaagugagugccaggacagccuagucuacacagagaaacccugucuugaaaaaaaccaaaaaaaaaaaaaaaaaaaaaaaaaaaaaaaaaaaaaaaaaaagaauaaggacuggcuaauuuguagcuuuguccaaucucagucuaauauugucuggaugugaagggcagaguucuugcuaagccacaggcucaugcuagcugagcuagagaaccuggcguuugggucaggaguuaagugcauuuugguuuaauaccggggacaucuuuguucucggcacugggauacucaguuagcauguacccagacacggcagaacuguguggaagucaggccuauuagugauccuggcauccaaaaggagugagaagaacagcuuuuaaucuugcaccgugucuuagaguuuccauugcugugaagagacaccaucaccaagacaguuguaauugggucuggcuuacaguuacagagguuuaguccauuaucgucauggugggaaguagggcagcgugcaggcagacaugauacuacaggagccaagaguccuauaucuugauccacuggcagcagauggggacugucuuccugcaggcagccagaagagacucauuuccacacuggagcuuaaggacaaggagcacucagagccugccuauacaguggcauacuuccuccaacaaagccacaccuauuccaacauggccacauuuccuaauaauuccacuucugaugggccaagcauauucaguacgcugcaguacuagagagugaaagugccccgcuaccagcucaucuagaguucacaguguuagcuuucaguuggugcauaggaaauaaccacgaugcaaaaugugguuauuuaugugagucuaagcacugguuuacuguguuccuuuuguaagucagaauauaagcuagcacugcagucucauuggaaguucaagguccaagcucauugacaauuggcacaauucucuggcguauuacuaaagaacugugggucuuugcuccuagggggccucuuaugaggucauuucgccuccucaagaacuguaacuuucaagaacuuauaaccuuuaugaguuguaauaaaggcaucaguuucuaaccaccuuccccuuaaaauauuuuuugaaauuacauuucauuauuuuguaugugacaauucauaguucagggaacagcuugucaacauucuuucacccucucuuuaaagacagagucuuccgauguagcuaaggcuggccuaguacucacggagauccaccugcccuugucgccuuccaccacaccugcccagguucucucuccgucuuccguguggauuccugaggucucaggucaucagguuuguuggcaggauaccuuuacugccccagccacagccuucugacuucaaaagccugacccugcucuugcuggaggggacagggguugaccaaggucucccugccacggacaagacuccuggcuuccgggcuuccucugggaaucccuugcuuacugccugccuaccucgcugucugauucuugcguuucgccaguguaucugccaggauguccaguuuuggaaagcucaggccuagacaaguuucacauguggaagggaacagagcugugcaccucugcaccuguccuccuccuccauggcauguuugcuucagaugguaacucugcgaaguuaauuuuauugugcuaaucucuucucuuuucagagguaggcagagacuuuauucuaguccccaagugccucauagccaagcuuucuguugagacuuuuguagucugagaauuguauauuauuagaggaauucaguccucaccagaguuugaagguucugacuuaaaauucuacuuccuacauggagacacuggggagaggaaauaagauuuacacaguuguaaaauauuagcaaaugaaggaauguauucuuucucagcuacauucugcauuuucucaguaugguggcuuccaguaaaaagcauagcuagccuaaaauuaaagcaauuaagaaaaauaaauguuccaucgugggaauuuugacgguacaugaagacaaagauguccuugcccauuaaaaugaacacccaggacuccaaacuguuuucccgagcugcguuuucacaguuccugucuacggugagagaugaucgccucaggccacagugacugucugugugacagaguuaaccugccugcgcucuagggaaacugucaagaaauaggccuuaaauuaguaauguaaaagaauguucucagagcuguagucagucaggugcugauugacugauggagaagggaagaaaguaggcuaauggaagaugacaucccagcucagcaucccagggccucuccugccuucugcuuacuuuccuugagaggguguuacuugcgggguaaacauacagacuugggaaucagguacccagaauagacccccauuuccucguucaacuuaaucuccccaagcuucugcuuuugguuguagugaggguuaaaaguguuuaauauggcagcuaagcauuaguggugggccacggacccuaucucauguuccagccgucagccucaguagcaggagucauaauuguuuagaacugcagguguaggguaauaagaaaaagcagacacuucauugucacuauuuuaaaauccucuccggccgguccuugcuguaucacaucgcgccaucacaucgcauugcuggcacccuggguggaucauuccuccccacucauugaaaugccacagucccacaccucagcucuuuuuacacacacccuccuguugcccugcgcacauaggagccaaggggguuuucuuuauagagagaacaaagccacauugauguuuucuaacaguguugagggagaggaccauggugaaagcugaguuuuaauaaaacuaacgagacauuuuuuuuaauguggguuauaauccauuaccuugucuaagaaguaaaaaagaagaagugacaauauauguauauguuuuugagggggucuggguaugguauuucagacauguucacaaugccuucccauuuagucuaagccaaaugguaguucugguugguaccgccucaguggagagcggagaagacaggcagcaagguaggaagaaggaagagaggagaaauugagagucaggaaagugagcgcccugccuuccugccaccccucgauuaucauucagucuccuuccaccuuccucuaucccuuaacucuccugugaacaaucccagaugagccaagcucaguggccauggugcuuccgucuucagagcccccuauuccucacucacugcugcccuaaacugccuacccauggucacccgugcagccugucaguggugcaguaagugcuuccauccugcagcacaugggacugaacaguugcuugcagagcucccgauuccugcuugcagauguuuguuggcuuuggcuauggccaaggcacaucuggguucuacagagggugggcuggagauauuucuuugccauccagaauuugucuggcccuguccucuuucagaacagaccccauucacaucuacccugucuuuucuauugugacagacaaaaccaacccaccucaccaguacgugcuuugauucaguggacaagagcuuauagaacauucuggaaagggaccgucuuuggaggggcgaggcauuugcacaucucugccucccacugugacugcccugcuuggcacagggcauccuugccuugauucugaaccuuguuucuucuggcgcuuuccagugcagccgcagagucaucugcuucaggacggcuuuccaaauauaaaauaugcucccuuagucacucauuugcacuuuguaaacuuauugauauuugacuauuuuugaccauaaaaauggcagcuucaugcagacagaccucauauaucuuuccugauccucuccuuuucuagccuaaauacucuugugguuuaucugagguuuuuuuuauccuauacauaaguauauaaguacugugaaucauccccaacuccaaagcaagacaggguuucucuguguagacaggguuucucuguguagcccuggcugugauggaagucauuauguagaucaggcuggcccagaacucaaagauccaccugccucugccuacccagugcugggauuaaaggugugcaccacaauugccaggcucuaaaaguugcuuaaucacaacauauaugucuuuaugugaagagucugaaaggagaguaauggagacaggauaucugagaaacagaggcaggagguggcacccuggccuuauuagcagcuuucaucucaaagggaagaagagauagauuuuucuggaacaauuuugagugacauagccugggaacaggaguuagguaccccagauucuauauuucaacauggaagcaguuucacggaguuccauaguucuacagaacaaagaaggcauaaaucaaaacaaguuuagaauaaacugguggguacaucagagaagcaguuauacaggauggggggcuaagaggcuaucugauggcauucuuaguuuauguguugguggaaucuugucguuuguuaaguuaauagauucuaaaaggccuuuauauauuaaucacaagauguuaguucagacgcaggggugaacaagguauggcugccuguuuuuuaauuuuuuuuuuaaagcugauuuucuuuucuuucuuuuuuuuuuuaaagauuuauuuauuauuauauguaaguacauuguagcugucuucagacacagcagaagagggcaucagaucccauuacagaugguugugagccaccauguuguugcugggauuugaacuugugaccuucagaagagcagucagugcucuuaaccacugagccaucucuccagcccuggcugccuguucugaagaccuagccuaagauaaaguaauagucucugaaccacuccacaguccugcaguucuuaucagucagucuuuguagacacgaguucucguccacacuccucagucacacagaacugcucccgacccagcuucucacgcacagugagaggacagugggaggacucagauuuggguagcucugugggaacuuggauagucuuccugguuggugcucccuaccuaucuccucugccccaaucugugcagggcuuucccuucacuccuccuucugucuggguauuggccuucuggauuagaauccggugacauggugacuaaugcuuucuacagcaagccuuccuuuccugcccuaggcaucuugugaauaaauagcacacucugauuuugaaccuuugucucagaggacauuucguagaguuguaguguuucuagggccuucagugcccagcuucugagcucuccuuuuuuagcuccuagagcucucgaagggcucucuccaagcauuugcagucucuuccauugcauugaggccaagcaugcacuggauaggauguggcacaggaaggaucuugcugucauugcuguuacuagucugcucugauaggccgcacccagcuaucuuuaaacuaaguuauuuguuucuguaauuauagcaugaaaagagguaggcaaucagucaaucagucagucaauuaacccugucuguccaucaucugucagaccaucugucugucccugccaucggucaucauugguguuuugacacagguucucccuguguaggccuggcugaccuuuaaccuguggucauguuaagugccugcugaaugcugagauaucaaguguauggcacgacaugaggacuuuguuaccucugcccccuccagccuguccaugcagaugauuuuaucagaagaaaugagcuuaauuugggggggcuuaguaacagcauucugguuuuugaaguucucuuaccaccucuguguacucaaguaauaggagcuauuuaaaguucugcugaaacaagcauaguauuuuuuuaauauuaauuuuuaagauuuuuuuuugcuuuacuuuuuuuuuucuuccuuuuuuuaacccacugagccaucuugcuaguucuuugccuccuuuuguuuuaauagagggucuuaccuauauucccucccuggccucucuucccuucucacuggccucccuugagucugcucgggauugggaggaggucuaggcuugcaaacuugagcagccacagaacuaggaccacugccccugugacgucguggggcgcacacgcaggagcugugugcucucaugcucccuccuugaucccgagcuggacauguuugucucaucuagggcacuggugccauuucaagaucccucucauugacucaugaggaugucacaugggauuuuccuccuaaaaucuguguguguguguguguuuauggcuccuaugcuggggaaucaaaccccagguuucauauguguaagguagccaugccaccacugagcugacaccucuaacaaacauuauugcuuguuguguauuaagacagggucuuacucuguagcccaaguagaccuagaacuuuggcccauccuaucucagccaccugaguacugcgcauauaggcaugcaccaccaugcccaacuuuuaaauuaaccaacuuacuaauuuaucauuucuugugacuguggacaucaaacccagggcuuuggugggcuucaucuaucauugaaucauaucgccaacacaguucuaagucuacaagggcuccugcucuuaucacaauguuguuuuuccagcuccuugcuagcaggcaugaugcuggaaaguucuccuacaccuucacugccucuccucucaucauaauuuugaauuauuacuugaaaauguuguaagguuucaauucaugucuccauuucugcuuacuucuuuuaaaguaauguuuugaaauauuuuucuagaaugacugggcauugcucauaguucagaucagagagagugcagugacuguggcugaauuauaaagcagagucuaugguuuagugcuauuucuuuaguuugugucgaaagaguucuuuauuaugugaguauuuuguuucuuguuuccccuuuuccguuaacaucacuuggaacaguggagaaugcagucaguaauagaggcaccacaucuguuuugagaugguacguggacugguguucuuuacugacacuuuccuccauuucuuuuucuuuuuuaauuuugguuuuucgagacaggguuucucuguauagcccuggcuguccuggaacucacucuguagaccaggcuggccucgaacucagaaauccaccugccucugccucccgagugcugggauuaaaggcgugcgccaccaugcccggcuguccauuucuuauucuguggaacuauuucauuacaagcucagcuaauggcccauguagauuuugucuuauauucacugccccugugauggagcgaacugauggcacuggccugguaagcauucucugacccaguucgcccagcagcagccccagggaagccaggagcuuagaaaauuuguugauaucugaaaguagaguguccuugcugcuauagauuagauugugcagucacuuguggauaaaaagugaaucuaacauuaagugagagcuaugaaaauccuauagacaaauaagugucaaguauugaauuugggaauuaaaaagugggagagguuuaauauauagccagauauucaauauagcuaauguguaguuagguaguuguauaugucuuuccuuagagauauuuggaguuacaaauuuuccugguaaacuuuggaaugaguuaaaaaucuauucuguguuaauuguuuuuuuauaagcauggaguuaagcuuggcucuugugguagaagcaccuugauuugacucuccagcaacaaguguugcugcuuucugugaagagagugcacacgacuuggagaaagcuuguaaguuugaggcccaugucugaggguguuuuguguugaguaaugaaaugcuauuacauagaagcuuguaaagaaaaguuagcuagcucacagcuuggaucacacagugauuuguuuagucucugguaagagccucucucuaauaguggaugauaucacaaccggagcuugugcaagagggagcugccacacgugaggaggagcgccagagagaaacuaggguaugguagaccaacacaagucuauuccaaagccagcaccuccaggaugaccuaccuccuaaagccugugacuuuguaacaucgcuaagcugggggugggggugggcaaucuuauaacacaggagcuugagggacauucuuuaaaaccacauccaaauuacacugggccucuagaaauaggaagcaagcugacguacaagaaacuagugcuagauagcucucugcagagugucgcaucaacuguguagcccauuuguaacacagcacuguacuugucugugcuuaagccuagaaccaugguuauuuguccacacagcgugauaguguuuuauugcuguuucaaaaugaaguuaguuaauccugaaauuaaaaguccuaugacauaagcagaugcuauucuaauggaaugaaaaauaaagauuaaccuuauuuauuauauaaaugaauuguuuuuaaauugaaaaauuauguggguaguuuucaacauaauuuuucaauaugagaugcuuagaacuaauuuaaguuuaguuagcucaguauuuaucacguuagauuauuuauuguagggguuaaaagcaauuuauuucucuuggaaaauuuuagggacuuauggauuggagacuuaagccaaaauuggugacuuucugaagcaguugaagaauuuaggggcuuuuguauuaaugagcaucuucacuuccucuuaauucacaguuuugaaacuguguaguugggaugugguucuagaauaccugcuauacagaugggguuuuguuuuggcacacucugcuuuguuucucuguguagcccuggcuguccuggaacuugcucuguagaccaggcuggcccugaacuccuagagauccaccugccucugccucugccuccugagcacugggauuaaagguaacgugccaucaccacucggcucaaagaugacuuuuaugcuuucuuaaaacaaacaaacaaacaaacaaauccccaacuuuuuaagaacuccgguucuuauuaccacaugcucuuuggugaacauguaaguuuauuuccacagucauccuaaugacaaaguaucaauguauguagcucaagagaaguagugguuccacgcauccaugggccuguauuuccccaccaugcuggccucugaggagugcuuggaggcauugugcuuccuccuguacugcacagucuggcgcugaguucuuuacugccuugaauguguucuugaagguguggcauugugaagauuacucccccagccacagccagcaaagccacucuuccauuugugugaguguaacucagaucagcuucagugucugucugucugucugucugucugucugucuuuguaauccccagcaagacaggaauaucuguagauuaaagccuauguccuuccuucaaaauuaguauuuagauaaguaauuuucugcuuugucuuaaauugaaacauuuucgaaagguuaccuacacugguggaucuauuuggauuauugaucuaauauugcugcucacugucacuguccugaaagugcuauaaaagucacccugccugugaaguaauuagagccuauauuuuuucaugaauguuaccacugaugugacccugagauacuguggugccuuauuuacugauaacaugcacacaaccuuggugcuuucgaguauaucauaguccaaauguuugaagugaugucuugugaugauucaccuuuuguuugguguguguguguguguguguguguguguguguguguguguguauuuugccuguaaguacguauauguuucauguguauaccuaacgccagcagaggccagccgagggcuuugaauccccuugccuggauuacagauaguugggaucugacuugagagcgcugggcauggcacccagauccugugcaagagcagcaaaugcucguagcuguugaaccaucuuucuugccacaguguuucuaguugaugcugacuccccucguuuguuuuucuuggucugugguauucugcaggacuuuauagagugugguuucacugaguccgugauacccagagaacacuuccagugcuggcagacgucagcucauuuuauugacuguacccgcuacagaacuguuugcaggcuuaguccauuugcuuucuauuucucacaguucguuacuuggcuuuuucuuaauuauacuugacauguguguacaugaauuuagcccuggucaaaucucaaaguauagauguggcggugauucacuaaaccucuucugagccgacuugucauguuacuuggaaacuuaguauugaaaauggacauuuguugugaugucuguaaggauuuaacuuaagccuucaaauaaaucuuguaaaagaaagcauuuugaaauaauuuuaaauuauuggaaaguugcaaaaauagcauugugauuuuuguucuuuugguuuuuggcacaggcagaccugaacugucuguaucuaaggauggguuugagccuccugaucaccugccuccacauugagcguuguguuuaugauguccuuuuagagcuuuccucugaaguuaacucuuacauauaaacugcaguagaaauuccaaaacauuacugggaaaguuuuugaugcgauacuauuaacuaaacuacaacucuuggguuguuuguuuguuuuguuauuuagcgauuuuuguuuauauaugaacacacacacacacacacacacacacacacacacacacacgugguauucagaguguaccuugugggaguuaguucucuucuccccauguggguuucagagagugaucuagacaucagacagcaaaccccuuuacugcugaacaaugucucaaggcccuccuauuugucuuugcaucugucacuucaagguccaauccaggauccuuaccaucucuuuaguucgauuucuuuucugucuccuccuauuugguauaguuccucuuuauuuauuuauuuuucccaaucuuagcaaacaauuuuggaucggguaauaguguugagagcuuucagaagagauagcauggggugaucugggccuuaaagagcagggaaggacugcuguggggaacugggaaaaaugagaagggcuuuaaaauuuuuaaaaaaagauuuauuuauuuuuauaugcauuaauguuuugccugccuguggaucugugcaagagugucggauuuccuggaacuggaguuaacaggcaguucugagcugggaaucgaacccagguccccagaagagcagggagugcucuuaaccaccgagccccucuccgccuggaagagagggcauuaggguagaagugacugcauguuaugagcaugaagacuggugcauuuguaaacugcaguguuugcuggcagcagagcagagcguauaggagucuuccagagauacaaagauacaagcuacccucuuuacccccauuaguauaacaauaaaugugucuucauuccuguggaguauauuuugggaaaguuuucauaucccaguuagcuguacauauaagcauuuauuuguaaucacugccucuaguuuuaggauguacauuuagaucuuuauuguccucuuggagaaacaauggggacaaagggaacugccuguuuucuaaauacuuuaaaccucccagcacccuucccuuuuuuggggggaaaauuuucuacaauaugcccuuaauauagguuuuaguuuauucugcuagggaucugggggagggggacugauuuguuucuucagcuauuuuuuccuuuauuacucuuugcuuaacuuuuuuugggggagggguaucuaguuaaaaaguuaguagagagcuagguaugguggcgcaugucuuuaacccaguccuugggaggcagaggcaggccucccaaguucccuuucagccuagucuacacagaaaggccaggcuggucuacaaggcaguggaggauagccagggcuuuacaaagauacccugucucaaauaaauaaauaaauaaaauuugguaugccuuguagcagcucuucuccaaacaguccuucagauaaguucucaguuguacuuuauuaauccucucugcagcuuuguuaucuuccauucaacucaguaagggguuccugacuuaaucuguuguguauuugaucagaaugugggauuuucagcuuugucagcuugcugcugcuuuguuuccuuugguguugcuuggcaucacacccaaggacuugagcaugcucgucaauaacugagcugcauccucagcacagagcacguggucacacucaguuuuaucuuuuugaauguaguguuauuucuguuugccugcugcaguaccuguuuucuguuaacucucuagugagugugauggauuguauaugcuucggcuagggaguggacacuauuagaagguagagaaggacacuauuguuggaguagguaugucacuaggcguggcuuuaagacccuaguucuagcugccuggaagugaguauucugcuagcagccuucagaugaagauguagaacucucagauccuucgguacugugccugccuagacacugccaugcuccaugcuccugccuugaugauaaugaacugaaccuguaagccagccccaaugaaacguuguccuuuauaagacuuacauuagucauagugucugcuuuuuguuuguuuguuuuucaagacaggguuucucuguguagcccuggcuguccuggaacucacucuguagaccaggcuggccucaaacucagaaauccgccugccucugccucccaaaugugggauuauaugccuggcuauagugucuguuaacagcaguagaacccuaaguaagacagaaguugguaccagggaccaacuguauugcuguaauagggcuugaccaugguuuugccuggaagaauguguauuuugggacuuuggauuuugaaggcaguggaaugcuuuaaguggggcuuacugguccaucauaguaggaauauggaagacuuuguugcugagugugcuuugaauugccucaaacucagaaaucugccugccucuaccucccaagugcugggauuaaaggcgugugccaccacugcccagccgaaauguuuuuuuuuuuaauuuuuaauucauuuuuuuacacaccauauuccauucuccaacccccauccaccaucugacugcuccacgucccacaccucuuccuuaccccaccccgucucuuuauggaugcccgcacccccaacccccaccucuaaacucccugaagccuccagucucuugaggguuaggugcaucaucucugaaugaacacagacccagaacuccucuaucuacugugucuguuggggggcuucauaccagcugguccagugauaugcugucuguuugguggucuaguguuugauaaaucuuggggguccagaguaauugagacugcuguuccuacaggaucgcccuucuccucaacucaacaacaggggucagcugcuucuguccauugguugggugcaaauaucugcaucugacucuuucaguugcuuguugggucuuuuggaaggcagucaugcuaggucccuuuuugugagcaccccauagccucagcaauagucucaggcaaugggaccuccccuugagcuggaucccacuuugggccugucacuggaccuucuuuuucucaggcucaucuccacuuccaucccuguaauucuuucagacaggaacaauuaugggguuagagguaugacuguggcaugguaaccccaccccucacuugauguccugucuuccugcuggaggugugcucuguaaguucccucucccuacuguugggcuuuucacuuaaggucccucacuuugaguccugagagucucucacuuccccgaucucuggugcauucuggggggggggagggggcucagaccuccuauuugcugagagaaagauugauauaaaaaauuuguggcuuaauuucccuuagauuuuuaauucccuucauuaugccuugguaccaaauggauuucuaauauacauagauugcuggaauaaauauuuuuggaguauaggguuucuagccuuacgauuucuaagaaaaauugucccuuccuccuuuuuugcacuuuggaggcaagucuaauccuggaguaacaaugcugucacucaaguggcuggcugugccccccuaacauuucuuuuuccuucagugaauaugcauugaaucccugaugugcuagaggugggugugucuccuacauucucaucuguucaacugagcucugcuuuguucgaguggacaagccagcaaccuguccagcuaguuccucagaacucuugcacacuauuggugcuuuggcaauuuucuaggagugcuuugaacaguugguuguccaacugaccggauuuguuucacuuauaaacaaaaugcuuaagccaguguugauuuuuguggcagcucuguuccuuagagugaggugcuaaugaggugugggucauaggucggaccucugcuuaagcuuuccucuggcccauggccacagagccugauuuccccugccagcuguccugcacgugugcuguggcucauuauggggucugagcaggcaagcaaagauaagaacaacaaagacuacuccuacuguaggucaguaaccucuucauuggaagaacagaacauaaguguauauagcuguguuggacugagucuuccuugacucaugauugcauggguugucugagggaaguuuagaauacagcucacgucuuaaagcauguuucaauguaaagauggcuuuuaguuuguaacuaaaacauuguuucauaucaguccauauuuuuauauuaauuuguuucuuauuuuauguauguauguauguauguauguauguauguauguaugugcaugccggacauggaucuggacugacaguucugugcuuccccauaugugugcugggaagcaaacucaugucaucugaaggagaaguaccuuagccacuccagagccaucuccuagcucuuagaaguuaaaauugagaaagccuaaguggagggugggacuccugcagagugcauacuaugaagaagccugccaaguuuaggaaaucccuuccagccccucuuuuccaaccaguccaagcgaaccuccuuuuaagaaggguguguacgugauuuucuaggcaguuauuuaugaaagcauuauuuguaauaauuuacaaacaauucaacagauuugaauuauuucccauuucaguguugaucaaaugaucucuuaugaugacuuucaagcuaguaaauauucugguucuauugucacuugcagggauuuuagggggacauggcggggggggggggagaggguaugagucuuagucuuuacccagacauucuagguaggacucauagcaguccugcuucucaaauguugagaguacagguaugagcucucaucugaugugacuugcauuguuaauuuacauggcuaaaaaagagggggugggagggaggaagggagcgagagcgagcacucuuaaagacauguccuuguguccucuggggaaucuuucuagaccaauagugaagcccaggaugcuguaugugcuggggguggacccguucuuuacauaguucugcuuucacuucaugugugcuagaagagaaauauuacugucuuaagcuuuugauuucaacuauaauagguuuuguuuuuuggguuuuuuuuuuuuuuuuacuauuuacuauuuuaaaaagacuuacuucauuuuauauguaugaguauuuugucugugugcguuuuugugcacuacaugugugaagugcccauggaggccagaaaagccugucauucccucggaacaggaguuaaggaugguucuugugaguuaccuaccagguggguuguaggaaucgaacccaguccucaggaagaagugcugagccauccuccaguugaagcauggucuuuuuggggggcugcgggggggggggguuggagacagggucucugucuucaaugucaggcagucucagacacugggggauugaucaaagagcagaacacacaaaucugugcccucaugaaauucauuuacauucaaaugagacgagacagauaauaacaaguaauuauaucauauaucagcuggcaauaacugcggugggaaaaaagcaguggaagagagguauggaguggcaagggcaggaaugcagcauuucuauuuuaaguaguuugauuaaaugacaauuacuccaacuuguaaaggacaugagugugucauucuggaugcuaggaauagcacaugcaaggcccugacgucaugugcgcugagucuggacguaggacguaggaggcugggcaucuggcuuggagugagaacagggaggaagauaggaucgcagagacccuggcacaagcauugugguuuccagccaucauaaggccccugcugacucugggugggaaccuucugagcagagucugguugagucuuacacccccuaccccuguucuggggauugagugccucauucaucuuagggagaaacacuuagacauuuuaauaacauguuucagcugccaugcuacaagcuacaagguggcagcuaggaagcagccagggagguauugcugcaaaucagacaggcgauacaaagacauaagguuuuggaaguugagaugagcaguaauuauacagacuuggugaaaguguuaggaagccuaaagcuuucaggguuguuggcuuugauaacuaggagagugcaguuauuuauugaaauggacaaaaauuaguaugugaguaaagaggguggaacacgugauaggaaagauacugcuuccuaaaacugcaaccuuguuaguaagaauaaauuccacucaggcuccauguacccaagaccugguaccugaauuuacuuugaauuuuuacuguagauauguuuuuaaauaaaauggucauaauauagcucauuugguucagguuuuuuuguuugucuauuuugcuuuguuuuuaacuucuuucaugaaccauuggcuucgagauagcaguagaggcuggcugccaguuugacuaguuggguuauaaguuuauaguuggguuauaagcaaagcaaacuuauaaacacccgugcgagugguauacccagauaagagcuguauuaggcaaagauucaaagaaugagauagcuaaaagccaugauauuacaagacacguggcuacuaaagagccugaccugggaggaggggacauugccacccucgcaaagaacuguuuugguugagugcuucuuucauauucacuguuggguuuaaaguauaaacuuugucaccaaagcauguuguuguuuugucauccucaggcuauuguguaggcguggauaugcugcuaggugaguguuucaccacugagcuaccaguuuaacuuuuuacuuucaaacagggacuacuaaacuucccagacuggccuuauucugcagucuggcuucagccucauaaauguuugaauuuuaggccuuuaucauuaggcacagcucaaaacauuauucauuugaaaaaaaaauaguuuaucucuuuucauagugaacuacuuaacaaguauuuuuauucuuugagaauuauuuuauuguuucuguugugcuuauauauggggggagagugugggagcauuugcaaguggagguuguagacacuaaugaaaguuaguucucuccuguagggggcgcucuggagauuaaacgcagcuugucaggcuuggggccaagcgccuuuaccugaugaaccagcuuucucacccuguguaugguguuuuggacagagucuuagguagcccuggcuggccuuggggaugcuguauauucaacaaugaccuuuaacuucugagucucuccgacguuuugacggaugggcagugcaguguugggggugccuugugcaugcuaggcaagcccucugccaaaugagauggaucucagcuccuaaaacagcauuucuuaagcuuuuaagacuugaaaguuuguggcuugcuuccugauuguugacugggcauucuucuguucaacaaaaggaaagcuugguuuugugacuucuagccaagaaaagcccuuuuaucuccccaugggccaguuaaaggcugccuggggcucugugaugagcucagaugguggaaccagccaguuugcucuauuggauuuuuuucuuuuuuccaacuucauucuaauugcccuuuagagaauaaacuauuucuuaacaucugaaagcucaaaggucuaauauuggaauuuauggaaugguugaagagauuucauggccaaacuaaaaugaaggcuuuuuuacuguaggagcagcuuucuccucccucugcuguaccccccaaucucugcccagcuugauucaagaagucuggucuucuaaccuuucuuuauaguaacauuuccauccagagucacuaaaggacacgugguggacagaccuggaaauggagucacuucuguuuggguuuuccucacagauagagguucuguuuggagggguguuuauuuuaaaagcaagcuaguaagagauagaaacugucuacuacaggcugauguguuagaagauauguggacaagauuauuuccuuuuccuguauuuucuaagcuuuuuaaagaaaucagacucuuucugagguccgaauguuaacuuuaggcgucauucugcugggcacagcgccguggaaggauuaaucagaggcucuguaucuggcagguagagggggcaggagccagagcagcaggcaaacagguuccgucuguguggcuguacucagagcuaguggaggguaagggaaccaggaagcaaauauaagcaaauaaucacauucacacuguagacaagugggggcauucugagugcauccuggguagacacaaauaaggaucuacacuguuuguauuaauguguauguuagaauagucaaugaauaauuguugaauugagcuuugaaaccagguaggcauuagguuuagacuaguaaaaaccaacuauuguacuuacauugccuacagcagaaaaugcaagaugcuuauuuuaauuauccuauccugucaguguagggagcagaccugcagccuuacacgugccaggaaagcaaucuuuccucuaccucucaagugccggaauuacuggcauguguaaacacgccuguuggacugacuggcucuuaaagauuuauuucuuuucauuuuauguguaucacuguucuuucugcauaugugugugugugugcauauaugugcaugcaguguccauggaguccagaagagcugcucagacucccuggaacuaggguuucagauuguuauuauccaccauguugguaaugggaacugaacccaaguccucuccaagagcaacaaaugcuuuuaacugcugagcuaucucuccagcccauggcugauuuuaauaacuuaccuaaacucuuucuuaguucuguuucacuauucauaugcuuucugaguaauguguguccaccuuuuaagacccgcccagugugccauuguauuauuacuauucucaguggggcacagaacaggcuacauacauagagcuuguggaaugggacacucuuucuucacggaaugaaucauuguuuagcuucuugcucaguagacaccaggggcauuccuaggagccagugacuuuuagucaaguuaguucuguguccaguuucuuuauuuugcaauacuuaucucaggaucagcuaagguaagacugaaguauauucauucagugcaaggcagcagugucgugacaggcagcucuaugcuacuguugugaauaccuucccccaaauggaaguucucugguaauuaacuuguugacccaagaacaggugcuugacaaacuuacucucccacuccauaguaaaggcugccaauaaauuaggacucuuagcugucaacugguggaggaccagcucaagcagaucccuguggaguaaacuggccuuucuguguggcuguaggaaaccucucccgggaagagcaauucagacaacccagcuagggaaugccacaacucagcuggaggccucucuauaaaacccaccccucacagaccgggaaaaucagaaauuucuaaggaaaagagaggaguuggggagaaggaggaguggggggugguggagaagauaggagaaaaccucaaauaauuuauaaaaucuuuucugacuaugucucagcaaguagcaaaccagcagugggugagcuguugaugggggcagggagagaagccucaggcuguuggccaagcacuuuaccuuuguauaguuucuuucuuauguugauuugguguguguguguguguguguguguguguguguguguguguguguguguguguuugccggcccugaguguaaagucuagaauagaacuugggguaguguguuuuuuccuucuaccauaugggucccaggaaucaaccugcagucaccagguguggcagucaagugcaucuugcugcccaggguuauuuuagaugguaauggaaggcuuuggucgguugaucuccaaauauguguucuucccuguaguuuaggcuguccuaaaacauaacauggagcccagggcaaccuugcuguagccucccaaauauuggaauuacagguaugguguggugggucacaccuggcucugauuguuuguuuauuuguuguuguugucccuaaaaauuauuuuuacagcuguuuuguuuuguuuuguuuuguuguuuuuagagauaguaucucuauguaucccuggcugucccuggagcucacuagaucacuagcuguagaccaggcuggucuggaacucacauauauccuacugucucugucuuccaacuugcagaauuaaagguaugugcuaccugcccaguucugcaccuuaaaauucuuugcucacuuaaaucauuugcuguaugucuguaacuuuuugagaaaagggauuuuguuuuacacggcugguaaaacauuaaaaguuuuauaacuguuuccugcaaaauuaagauaucaagccaguaaauauuuaugacaugugcauucuucagccuuuagacaauaguaaaauaaccccggauuaaugucugugggaugacuuugauaaguacaagauggugagugagcuuguagccaggaacuuuuguuuuccugaguugaguauuucucacugcuguaagagguagaacuuagagcugagucucucuugucuggaguuguuuaguggaucauuagucacauaaagauuugcagagcuuucugggcucuagccuaggaaauguugcagauacucagagggaguggcuugggccucagcacuuauaucuuucaugccaguaugccucgauuuaccagagauuauuuuccuauucagaguaagaaaguagucauuuaucuugaaugaaauuaguuucuucuacuuaugcuggggcuuuaguuuucuaaccaaaauaucugaucuacuuuauguaucugcaaagaacauauuuauauaucuggucugccuguguucuggcguguguguguguguguguguguguguguguguguguguguguguaugugcguauguguguaugguuuauauaucuggucugccuguuaucuggcuaauguuuccaggcacacacuguuuugaaaacauucuguuuccacauuagcuugcauaugcuuuucuauacagugaaauguuaugauaaacauuuucaguuaauauaaaguacuuacaaauacaugaguggcaguauuauugacugaaugcugccgggguauauaugaucauguguaggauacauucuaacaugguccugaugcugccaggguauguaucauaauguauaggauacacucuuaacagggucucaguuggugccacugucugauuaccugugauguggucaugucaaaacaaaaccaggggacucucaguggaggaaauuguuugcaauugugauuaauaaccugcggugcagacugacaugguccaugcuuucaucccugccuuagguaggcaggugaaucugagccagcuuggucccaacauggauuaugcccaauuuuguaggagguucugagacugacagaguagaacuugggaccucgugcaugcuaggcaagcacucuagcaguugaccagagccugcguaacuugccaacuuuucacaaaauauuguguuaaaaaaugcaagaaauaugauauggggauuauauugucuuaaguucuuuauaugugucugaucucucuguaucauuugugaauucugcaaagcaugggucacauguucuuacucuuugacucuuuuguaccauagcagauagaaaagccacucuuuuucuuauuaugcauguuuuugaguaguuaccaaaagcuaugcauaucuuaaauuaaguauauguauaguguguaggguuguauuaagcgcaugguuugugggggggacacacauacacacacuuuucucauuccggugauuguuaacucacauuuuauagauauagaagcaaaaaguuaaaguacucagaugcuugaaucccgccagugagucugguuccagauuuugugccuuuucauuccuucaccaggcugugugugggucagugaucuucuagagucuuucaauaaguucucauacaaagaagaaauaugaacuuuccuuuaaccaaacacaaguguauuuucaacagagucuuucgauagaguggcuggggagccuccggccggcaggccuugcuggagagagagaaagaagaacacagggacaucuucucgcacgugccuccugagggagggggugcauguuuugagcccucacaucucauugcugggugacaucagggaacucuuuuuuaaggauggcuguccaucuguucuccucuaggaaccguuggauccacgccacugccacuuggcugcuggcuucauggccugagucagugaguugcucacaccauggagaacaaggaggcucuucucaaagugucuguaaucaccaucaaaugaccauuacuagaaccacagccuucuuauacagucugcagcucuccuggacagauuucuguuuacccaccauuuuuuuuucuugaggaagugggaaugcuuaguggacccagucauuugaguguggaauagagguuggaaagccauguuauccucgcacaccacguuugcuguaaucccuuaguuuauagcauuacaggauaaggcuauauucagccacacaggauagaccauuuggaaggacccuagugcuagcuuaugguccuuucuagaaagagauagcaugacauaaauaacuccuguggagagacuuccaguuaguuucaguuuuagcccuugagagcgaucggacuuguuguuacaggugauaacauuguuucauugguuucaguguguucagagauguaggucacugcuggguuuugccugaugguuuugaguuugagcaguuguugauuaauucaugaaccccaacugcaagguagauguucaguauugauuagacacaugcccuggcuguaugcaguuaaaaggacucuguugugaaaggcuccuaaagcuaaaucaauaaacggcuaaagucggacuuaucuauaaaucuugguauuuuauuccuuuuucuacaugagaaaagcuguuaggaauauuaugaucugcacuguuaagaaaacuagcuaugucuuuaggacaauucauguguuaaccauucuagauaacuaucaauuauuuacauguacauccuaauagaagaaaacuggcuuaguggagauaauaacaggauuucuuuggaaaauuaucaucuuuauucugaugacauggguagagaacuuugcuuagagccuaucuaaauacuaauaaaaauuucaagacauagauccccacaguguuaaaaugucuacagucucuguggugaucaugagcagcaauuacugagcaauucucugcacugagugagaagcaagcaagcuuccuaccaggguacuuuuucugaacacuguagaguaccucuccaagugagcaggcugacuuccucuggauaauaucacucucuaggauuccuagaaguucccaagcucuguagcuucagggagcaggccucccugcuuugccugcugcuugccuucuuuaagcuccuagaaugccugcaugaacucuaagccuuacgcccuuucuugcucucccaggagcuucaccuugugugagguugucagcagccaccccuggcuccucucaucuccaacaccugugcaggcuccaccuuuucucuguagcuagauucugagccuccccaacaacacaacaucauuuucuuaagcccugucuacugcauugacgacguccuccacaccuuuaguuucuuccccugauaagcaucuuuccacuucaggaugauuguuguuggucaccuagaugcuacacauccccuagaccuuaccucuucuggcuccuccaugcccgagggcccuccugugcucaggcucucuucagaaagacuaaggcuauaggaacaucuaucacuguuguaguuuuaaaauaauuuaaccucuaaugccacaggauggacaugcaauaaacauuagauauuauuuuuauuauugagaaagagagcaaagcaagccccccccacauuauucuuaauauacauguauauaaguuacauauaaaugcauacacaaccuucugugguuaucauccagaauuauaaaauauaccucuuuuuagaaaaugaaaaaaaaaaccuauaucaaauaugaaacacgaaauaaauuugaacacuuagcaucaagacuaguguuugcccaaaaguagugaggcacuuguuuuugcccacuauuccagucuaguauccguggucugaucuuuugaaaagcacaagaaugcuguaugcaagugcacaggcacuugcaugcuuuuggguggugguggugguaauauauuuuccuuggggaaauuucaaaagcagccauucauacagccaguuucaaguaaguugaagaaaaaucuauuauuaaaaggacauccuaaaaaugacuguggaaugggccugcaaacaagaugugaguuuauacauaugccuguggaaucccauagcuucaguuauuaguuggaauggcuuauugcauguuuucuuauuuuuaugacauauaaguauucuauugcuuguucuugcugaugacaaucuaagccaacuaguucauuguuaaaauaguauaacaggcuaguguuguuacuuguauuuaaaaauauuaaauguggauauucaugaauuaauuucaaauaaauuaauucucauuuaccagggauauaucagcuaagcauuuuuuaaauuaagauuuauuuuuguuuauuuauguauauaaaugugugugagaauacaugcccacauaugcuucccaguacccacagugcccagaagagggcagcagauccuuccuggagcugaagugguuguaagccaagaaaccggagugcugggaaccaagugcaggucuguuguaaggggaaugugugcucuuagcugucaagucaguuuuuggccucaauaaguuuuagaguuuuagauuaggaggacagaaucuuuuaaaaacaguacuaauaaccuggggaugaaggugcauacccuaauucuaucuagcccuuguaggguggagaugggaggagauggagacaggaggaucuagacuucaaaacaguucuggcuguguagcaaguuugagaccagccugagcuauaugaaaaaucucccaaguuaaaaagauacuuuaaaaaauaggacuaugguguagcacaccagugccuagagauggggggggggggcggcacuugagcgcgagcgccuauguccugugguuaaguaaggcuugguuuuucugcuuccuugugucauuggucaugucuucgaggcugccacccuucuuggggcauacacauuugaauuuaccucauuuucccuuggcucaugugauuuuacagcucaugucauucugucucacuaauguugauuuuuaaaaauuaaaauuauuaguaacaucauacaggaggguggcaugaaagaggagggcagaguuuugcugucucauguuuguaacuuucaucucucaucaaguguagauuuauuccuagugaugcaaauggcuguuuucuuuggcaggcaccagaagcaagucugugugaaauuauguaaugucugaaaaguuauauucaugaguaauuggccuagccuaggcuguguguggaaaaaggcaaucaugcuuuuuauuugaccguggguuaaaguaucccugcucagaucggauuaccuaccgggccuuuugacugagaaauguauguuuagcuuggucucugaaaaagcagaaaauguugcuuccaagccaagugugcuggaauucauauuguaaccaaggucagacuuagcauaacuucaaaagcaaucaguuccacucugucacaccuuaguuaacaaauaaagccaagaggcuagaagcauccugacgaucauccuaauagcuucagagacuauguccuuucuaggucuugcaaggguggauugucagaacugucauguccuagucccgaccuugaccuuaacugaacggcuacacugcucuauuuguuugcuuuacuggacuuuccaacagccauccaagaaagccuuuaaagaugucuccuagggugucaaccucaaaaaccagggcauucaacagugcaguugggucuuuguguccauaccucuagucaaccaccuacauugguucugaacugagugugcagagaacccacgcccccuucauuauuccuaaucucguggcaucucuacuguuagguuucugagauaacauacugugcuuccuaguacaaacuaucuccgcccacuguguauuggccauuuccuccccuuuaucaaccaaucuaguaaggcaauucugguauguuaaaccuuuauccuguuaaguuagcaguucuacauuaugcagauuaaauaaucuguaaaaauaaaaaugcauuuuuguaugacuguaaaaauacuaguauaaaaaugcacaugccuguugcgcgcucaacuggccaggaagaacgacgcugcuacaggauccuucugcacacguuuauucaguccuguuucuucuuucucuauauuucccuuguuuauaucucccuuguuuauaucucucccuuguuuauaucucccuuguuuuuauaucucccuuguuuuuauaucuccccugaacccugggccucucacucuuuuauacucucaguucccauccacacacagcaggccacgccacuucaccaggcacgcagcuucagcuaaucagggcagcaggggcauaucuccaucaaaauggauucaccaguauccugguacaccugcgcagcucucaagauguuuguggcuuauaugaggaagucaggugcaagucauaugacuuagcugcagucccuggcgccuuugggacugccgccacacccgcuccccacaauucccccuuuuuucuuuuuuggcagagagaaugucuguagauagccccccguagucaugccccuuacccguucuugggugacaaacagcauugguuugaucccugucuuagguuggugacaugcccagggagucuuaucacugacuaccucucaaucaugccaagccacuccuggggagauuguguuuugcuuguggcaggugcaucaaaaggccaggauguugauuaaucuauggccagaucuuaauugcugcaagcaagccucaugggugaagguagaggucugauccccagugugcaagcauaggggcccuacacaaaaccaucccuuaggcucaucacccagagaggucuuggccagcucccgugucguuuuuccugggggaagggaacuaggacacugaaccuucaugcaaucagacgugccuuccacaggaugccaacagcaagcuauccucugugcagugcuuagccuugcaccccauggcauaacgcagcauaauuucuuuuagagcggcaaaccgaaucugaggagauugucccgccuccacugcagcaaaagccuacgcuaccauggcgaaagugcgggccgcacacucugcaccuaacacaugugccaaacacaaaacacacacacacuauaacaagcauacaucccagggcucucauccccgcucaucuucccugaagcaagggauagauagccagaggggcuaucucuuuaaggggaauucagggaucaaaaaggcauggaaaaauuugaaugucaugucgagcugguaucggcuucuggaacaccgaaaggaucucucaucucggcuccaucguuugugcuugugggaucauccaccacauccacaggggcaacuggaucaggagccucauucuugcagcgucucaccaaucucuccaguacccaaagagguucugucugguccuguggaaacacacaaacagacccucucgcccacaucaacaccugaucuggucgauccccaggggagauggacacaauaccucgugguaaugagaccauaaccucaaucaccuguguguccaucuggggagucaauacgccaaaucucuggacagaagguccaccuauagguggcugcugaggaggcauagggagaggacgcagaagcuaauucgccuuccuccuccgccucagcucuuuuauuuuguccuuucuguccaccugauaacacugcgucuccuuucuuuuuccuuuuucuuuuuaagcccuucucuuccaacauacuuucuuguugcucuauaaggauuuucugaccugucuugacugccucuacacacaguuucaaacaguaacagaguccauauaucagaacaaacaagaccaaaacuaucagaccuacccacaaagggucaacgggagaaaaaagcauaacuacucagcgaggaucuauugaucacuacacugagguuaucauaguuccuuaacuuguccccaaacagggaaccuuaacuugucccaaagccgggaaccuuaacuugucccaaagccgggaaccuuucguuaccuugugccugcuuccuggcaacuuuaugcuugccucuauuuuauccgagguccuucccaaacuccuggguuacuuugugccuacuuccuggcaacuuuaugcucaccucuauuuuaucgagguccuucccaaacuccuggggucacaaguuucacucaccgugaacuuacccugccggcaaccacugacugcugaaaguucugaacucggugggggagucgguuccccguacgggccaccaauugucgcgccugcucucgaccagcaagaacgacgcgaccaccaguccuucuaacagcaguuuauuccguccucaucuuucuucuuucucuucaucaguaccguuccccagcugaagaguucugaauccacgccggauccuucucaacagucuguuuuacgggaacacuuuauuaaccgcuccuucccagugaugcaguucugaauccucccuguagcagggggucuucgcucuugccugaagauguuucuuuucccggguuucggcaccaacuguugcacgcgcucaacuggccaggaagaacgacgcugcuacaggauccuucugcacacguuuauucaguccuguuucuucuuucucuauauuucccuuguuuauaucucccuuguuuauaucucucccuuguuuauaucucccuuguuuuuauaucucccuuguuuuuauaucuccccugaacccugggccucucacucuuuuauacucucaguucccauccacacacagcaggccacgccacuucaccaggcacgcagcuucagcuaaucagggcagcaggggcauaucuccaucaaaauggauucaccaguauccugguacaccugcgcagcucucaagauguuuguggcuuauaugaggaagucaggugcaagucauaugacuuagcugcagucccuggcgccuuugggacugccgccacacccgcuccccacacaugccuguaaucccagcacucaggagaccgaggcagggggauuauggcuuguaggccagucucaacuacguaaugucaccuugucugcugauaauaaaaaauaaucucagaaagauggcaaggcugugguagcacacaccuuucccuagcauuuaggaggcagaggcggguggaacucugucaguuugaggccagcguggucuacaaagugaguuccacgacagccaggguuacacagagaaacccugucucaaaaaaaaauaacaaaauggaaaaggagggggaagaggaauuuuaacaguuuuguuuuaacuguuaacuagaaagaaaugccaaucuacuuuagagagacuaagucaccucugugagacugacaacacagccuuuauauuaaggaagauuccaguagccuuuaccaauaaagacuacucagagguggaauaauuguggaugcuaauaacaauagucuaugagaaucucaaucucaaaagcauagaagugggaaggaacccuauacacagcaauucucaggcuccauuauauaaaauguaccaaauuaacagaugauaauagagaugaaaguagaggcugauagugaggaggggcacgaacgugggugagaagcaggaagccugaggggagaugggugaugaaccuucauugaagcaaaacuuuguucuacauguuauugucauauauaaaaugcaccuuugugugugcagcaguaugaacaucccaaguuccagugacauaugaacuuagaaguaauuaugugcccuggugggcaguguaguccugcuguaauccugggggaggcggaguguaguaaguauuggucuuacuacagaauaucagaaauuuuacuuauuucuucuuccuauuguuuugguggccuuguauaugcuccaggaaguugagcuuggaaaaucccugaccuggcagggaagcuuguccugugugacccaucuauuccucagccagucuagucuaacuggugagcgccaaaccaaugaaagucuguuucaagggaaguggacacauuucugaggaugaccgcuagcuaugcuguagcuucguagagaagggugaugggcuuguguggcucuucugacuccuggcagugaugcuuuggucccagaacaauguguggcccaaagcauuaguggaucuggaacuuugacaccacaacaaugaucuaggggugaagcugcugcacacacaaacaaggucugagcucugacauuuggguaguaauuauccaagcaacucuagucucccugcuuaugaugaauacuggaauugaaagggcagaggaaacaaggaaaacaaaagcaaaauaggcagagacuuagaaacgcagacugcuggaugguuugugugcgcagaggguggcugagauauaaguguggugauagaauuaugcuacucuuaguucuucugggagggcaaacccuuagagcgucaguuaguuccacugugccaggugacuguggauccgcaguaaaccgcacugugucucccugccuccgggucuccgaaugugaagaacuguugagggugguguugcuauaggagaauguucgguaugucaccucuggauucuguuuccagcuuuggguauuauuuauuggguauaaauaauauugccugugccaaccucuagcaguugguucacguuuuucuuugcagcagaguacaucuaugcaagguugagggccauacuuauaucgaagugggaauugcagaagccauccuuuucucuggcagauaggcaacuccaucgacaacaugguagccaucgcauacuuuucugaugugcaguauggcugucuuuucauuucuccacugcuacugugcacuggccuugcuuaggaaaaguuuucaaaaguuaguacuuuuuuaucuccccugccccaguagcaguguuuuuacuuuuuuguguccccuguguggguaugggugugugugugcgcgcgcacacgcguguguucucgcacacgcauauguacuagaggauaaccucaggugucauccucagaaaugucguccacuuccuuugagacagucuuugacuguuuggugcuuacaaauuaggcuagacuggcugaccagcacacuccaacaacugucuccaccucccuagcccuaagauuacaagcugaggccaccagaacccacuucauuuuuaugaggggcugcaaaucaaacguguucuugcacagugcuuugcugacgccccuaguuccucuuuaggacaggauuucuucuucuuuguugccuguuuugguuugccuugagauugacccucacucuuuagcccagucuagacucagacuuuuggcagugcucuuaaaguggggguggcaggcaggagucaccaggccccaccuccugucaguuuucuuauuuuuaaagaaacaaugguuucaaagucuagauuuugcuuuugccaaucucuuuaaccacugagacuggcagucacuugggagacguguuuaauuaauuaauuaauuuuuuuuuuuuagcaaaaacuaaggacuugugauacuucauuguaaguuuauuugaacuuucuguuuuucuaaaucucaaauuauagugcuaauauaauauaaauguggaguuuauaguucuaauguugugaugugccugccaacgagaacaguuuguaaaucuucaacagucuuccuguaaccguauguugaauuuccagcuguguugaaucagacuuugaucccucuuaggaagauaaaugcaauaucugcaguuucuaauggcagggguggaagagagcuguucagaugcaaucuuaaaagccaaggcccuguccagauaagaaauugaaggccccggggaaacuaauuauuucguugucauuuuuucaaaaugugucggcuucaucuuacagugagagguuuuuguuaagcucagugugcaggauuagauuuguuuucuuccaguagaaucacucuccuuaaucagcaugcuuauaaaugguacaccugccuaauuagaacaaguucuagacuccaggauacagugugagcauuucaauuagcugcacacaguuggugagcgggcugauguucuuagacugccccucacuucucgcuccuuuguggcugagcuccuauugugucuugcuucugaagcucccuugauccaaggcaucccccguaguauguggucauugauacgaguuugcuucuaaaugaagggggaaagggauaauauuuuaugcauauaugcagaaauacuucaaaugcuuguuuuacuaggcuuaggguuuguuguuguugcugcugcuuuuaaauacugagaaugcucaucacugugacaaggagcuaaaauacaaccaucacauucaagaucucuguacauuaccaaccauaaauccuugugcucagagugaugaagaaggccaauccacagagcuggggggaugauacacugcucucucacagaaccaauuacccaccgagaagcauaaugagcaggagaggugagacaguggaaauccauagagcgagaguaaaauuaagaugaaacuguuucccguggaacaucuuguagugagugugucuccaauuaccucccgggaaaaauuacuuagcaucuauucagguucaaauucaugaaucucgaggaaagacuuccacuuuaacaaaggguauaugaacagggagaaaauacaacaugcauguuaugaacaguucuguucugcccagaaggguuugaaguagccccugcugcuuuaaugggugcuggccuccaaaccugcuugcugacccauggcugcacugaccacagcugcugacccauggcagugugagcagcucagaagaaagaagacgcuucaggucaucacaagaagucuuucagaguuuguguguucccaaagacuguguuaggcauauuacuucagagggaagucccaagugugcagggcugagcucaaucuauuacaacagacaucaguugaguaaguggcuaagugauaagaaaugaagcuuaguucuuuauuagauaaaugucacacccaguacugaaguggcagaaaaauguuaaguugacaagaggagcauugucaaccuguguugucacugcacugacagguauaaaguuuugacaguaacacauuaucagucacaaagcaccgauguauguauuuaaaccgauguggguuuaaaauauguauauaaaguacuuuuaaaauagauugagccagugaguacaucuuuaauccaaguacuugggagguagaggcagaccuaucucugaguaaccuggucuacacagugagacccugucucgcuaaauaaauaaauugauugauuugauugauugauugauugaugauugauaugauucuagcaguuagaggcaggaggaucaggagaugaaggccagccuaagauauaccauguggccacaaaaacaagaaaagauggagggauuguacucuagggucugccugcugcugacacugcugcuuccaucucucucagcggcucagcuuuucuccuuccuggcccucauguuggagagggaugcuucaccacuguagacuggccaucagaccuggcuccauagcgugugugcacuauauauguacuuauuuuguauguuuuucauugcaugaaugcaauguauguugaucauauuuaacccauucucucugggucuccccaguacucccccauguccaaauuggcauaauauaaaaacagcacaggguuuuaauugggugauuccuaaaaguuaauauucaugaugauaggaggguaaauuuucuucggguggcuuuaaaacuuuaaaccuugucuugucagauuaugccuagggaaguauaugcccagguaaacauaaguaucauuuauuauaugugugaugguaaauaaacaccuucaauaaaugaugaacacaccucaccacugcugcuugccuuacucaaagugcuuguagucauuaaagauauuugaaagcaggcacugguggucaggaaccugagaaggaggaacaguucccagucgcagcugugcucgcucagugguucaccaaacaccccguggccgcgcugucaucaagugggccuuccgcgugaagaagcuuaagcuuuagcuuuagggauagaagcagaaccagucaggcacugccuagagaugcgugcucaacagugcagcaaagcaaggugaggaagguucuacgccaggccagugaauagcuuuagagacagugggcagucagugcaggucgucugguaccgugacaccuaaauccaacuccauaugccacacaggacugaccaugucagggagggcucggagcugucugaccagaauucuuggaugauaguuuucguggcauugacuuuccccgggaaacagacugagcaugguugaggccagaggcgcacaugcgcagaacuuuaugguaagcaguaaagcaggacccaacuccagagaucagcgcggcuggagcagggccagagaaagcauuguggagggaucuuggaugaacggggagauuuagagaaccgguugaaucaccuggcuuaaguacagacacucuccaauuacaaacuguucuccaguuaguggccgggaaaaggugcuugggcuaaguguuuuucauuuaagauuuuuuaaguugguucauauauuccguauauuuguucccuucugcuaguauuuuuuuuucuucugaguuuuccuuuauuaaauagcuuuuaaaaacuugcguuuuugguugaggugcuuccuaccuuguucauaugaucacugguuaaggcgauucuuuuaaaagaaguccuguaaaauuaauacucaucacagggacugagagaaucaaauucuuuucuagaauaauuuaaaauaauuauuaaaauuucauagcaauugauuugugcuaauauugauaaaaggcuugaagcuguuaagucuuuauaaccagagugaauuggguaauaaauaaggcaauauuuaagucagccuuauaguacuuuccauacucaaucgccguuuaccucugagccauccuagaacuggacaaccugcacacauuguaugcuuuuacaaacucagagcuucaaggaacauacugaaaucucuuuccagucuuuccagucaugcaagucugaguaaauacacacagaguaugggaccuuucaucuguaagauucggaucaccgagaguguuuucuaguaguuuaaaggacaucagagaaggcucagauccacacggcuuacagaaagagagcccuugacauauauccugauuguguacauaggcuauagaaauagcuuaucucucucucacacacacacccuaauuugacauugucaggaagaggaugugagcacggguaccucugauucugcucuaguguacagucuuggauuucuuuuuguacaguaucuuaaacuaacaagaguaaugacacuucuuacaucaugguccuggguuuuaagagcguuuccuaggaagagagcuauuuuauuuuuuuagcucagaggucccaaagaugcucaaaugccuugaguaugauaguuucaaaaaaaaaaaaaaauugcaguggagaaaggccuccguggucauccauagggcccgacugaaggggacgggaacuccacaggacgaccagcagagucaguuagcuuggacacuuguggcuggcagcucggucuucaugugggucccccaacaacuggaacaggggcugucccuaaaacuguugccugucugugaaaucuguuccucuaccugggcugccuugucugacauuagugggaaaggaugugccuaguccuauagggacuugaugugcuagggaggggagacuccuggggaguggaggaggggguugggaggguggcagagauaaggauauaaagugaauguaggaaaauuggguaaagcauuaauaaaguuagaaauaaagacaaauacaguagugaaaagaaaaagaggaauauaacagaguuugauauguguagaauaucaguuugauagauagaaaauacuauacaaauagauguagugauguuucuacaaaauuaugacuguugccaaugaaggcaccuuaaaauugguuaaacugauaaaauuuauguuaugcauaugguuguguauguauuuaucuuuguguguauauaugcaugugcaugcagugagcacaugccacaggcugcaugugguagucagaggacagccuuggauguuagucauucauuaucauucuguggugugugugugucuguguguuugugugugcgugcaguugugugccaugaugggugugugaaagucagagaccaacuuguaacagucaguuuucucuguccaccauguggcuuucugggacugcauucagguuagcaagcuuggcaaugagugcuuugacacgcugggcuaguucacuagcccuagguucucucugauguaugaacugugaguggccugcaagcuuuuaaggauucucuucauuccgccucccaucuuagcaaggacugucagcaucucgguuuuacauggcuucuagggauuuaaacugggguguucaaaagugcauagcaagcagcuuacccacugagccaucucccuaaaccuuagguuacuuuuuuugcaccauaaucucaagaaguguguuaacgacagggagagcaauugugagucuuuuugcuagagagcacagcuguaacauuuuucuauucugcuuuggggucugugcuuugugcccaggagccacugagucuaaccuucuaccugcaagaaaauacccagcuugccaccucccaaaguuagaguauacaccucaguuccuucccuggcuguccugaaacuucuuauguugaacaggcuggccuggaacucacagagauccaacugucuaugcuuccuuagggccaggauuaaaucaggccccaccauacccagcuaacuuuuaaaaacaauauuuacaguuaaagucaugaucaagagcaaggcauaaggucaaagggugguacauauuuagcacucuggaggucaaggcaggaggauaguuaguuuggugccaaccugagcuauauacagaguuuaaggacagucugacauauggagcuuacacauuacaguugccugguuuuucuuucagucuucuaaguuccaagucuugcucaccugcuuccucugcccccuguuaauuuaauuuugaagaaaguggaucauuuauccacugugauuuugguacuaucuucucucucuuuaaaugaguacgguugucuguccucaacacuuccugugaaucagugacuggauuguuauaguacucuauucucugaugcuuauaacccaugugguuaauacuuugcaauggacuucuuuugagaguggaauacuccccacccccauacgugaagauguugaugauucuagacuugaaaauguuggaaauggcaggaaauggacagagugauguggaaugugugugugugccuuucauguugauggccagccgggcacuuugcugcauagccagacaccuuacuggauuuagguguagugguguuuucagagucauuugagaguuacggacauaccaugacacuuuuuaaguauuugcucauaucucuaaaacggugcuuguuggccauggcucaacaugaucauaauauguucacuuaaguugacaucuggcuuauguauuacucuguauuuagugcacguuaccuaauuaucccagaaaaauccuuuauugugacucaagaauuagggugcuagauaaaugccucacaguuaagaguacuugcugagggcucaggucugguacucagcaguaaugugcugccucacggcuuccuguagcuguaguugcagggcacccagcacccucuuccagccuuaaaacaccaaacacacacguuacacauacauacaugcagacaaacccucauacacauaaauaaaucaaucucuuuuuaaaaccacuaauccaaccaaggaucauggguuauauuuagucuccauguauaucuuuugaagagaccagggacauuguuuaauaaagaauucuucaauuuaaaguugcguuaauuguucucuuacuaguagauucaccaagaauggcauggcuguccuaagcgcuuuauggaaccacuuggaggcacauggucuuagucccauauugguuacagaaguaaucccauugugacuaguaacaauauagcauuauagauuuccuuuuaaguacuuucagaacauccuauuggugguggaagaaaguggauugaagaggugcuaaacacaucaauaaauguguugcuccugauagaaagauaaauuucaguccucuguuuuucugagagagucauggagggaaaugugagguugagcacuuggcccuagggacacagacuuggagugauucagaacugcacugggacccgugcaaguuuacagaauuucccuaaccacucacacccucagguuccuagguaaaguagggauaauguggcauacccgcuuggugaguaacugagguggugggaggaggggcuucccugcugccuaagugccacugcuuggccgaggcaggaaaggggcuuacagaacagagccagcucauuacuuaccaucaccacucccugaauguuguuuuaggcuuaacaugaguucagcagaaccaaacaucauagaaaauuugaccaacaaguuagaugccauuaugagauuccuuuugcuuuuuucuuucaaauauuuauuacucuauuguuuaugcacccuagaggucagaaaauaauacucgagucacuuucccuuucugucuauuugugugggcucccaggacggaacuagaguuguucugcuuguguagccacuuuacccaccaagauggcuauguugcugccagcaacccuccaccccgccccagagagcaaagaaaggaauuaaagccgggagugguggcgcacgccuuuaaucccagcacucaggaggcagaggcaggcggauuucugaguucgaggccagccuggucuacagagugagucccaggacagccaagacuacacagagaaacccugucucgaaaaagaauuuccaaaaaaaguuaggugguuuggauuugguuuugguuuucuuuuaagggaacuauugcgugugcuuuacuguguagcacaggcuagccuugaaacuaaagcuaacuuugaagucauuucagucuuucuaccucugauucuuuuuguuuguuuguuuuguuuuguuuuuugagacagguauagcccuggcuguccugaaacucacuuuguagaccaggcuagccucgaacucagaaauccgccugccucugccucccgagugcugggauuaaaggcgugcgccaccacgcccagcucucugccuguaauucuuaaauuguaggauuacaggugugugccgccaugaucaccuugggcuucuguuuucaaaguucuuaaauaucacuugucguuaauagauuugugcggaaucaaauugcuauuuaaccagaccucauucugacuagaauccauuuuacuuuaagggauuauuuuuuaaaagccaagacagacaaacaaacaaacaaaaccaguuuauaugucaucugaagauagugaaucaaaauaauucugugacccauuuacaugcauuacuguacaaguuucauuucauacaagugacaauuuuuuaaaguuaauuagacucggcuacacugagguuagcaaaaagugcuuugaauuaucaauaauucagcagggcagacguuucuguauaaugcagugguuuuauagaguauugugagauaguuauccuuaaaauaaaugguugugagcauacaucagcauggugggguucacuugaaugugauagcaucucugcuucuauuauugggcagugugcgggacaucagucuuucuggccaugaacuacuagcaaccuuuguccuuuguguuaccuuuaguuacaaauggaaaaugagcgugaaugcuggcugauggccauggcucucuuucagcuaaaaauccaucuggaaagaaacauggagcuacagauuuggauuuauuucguuucgugaaugauaugugacauuuuguaaauuauuuaucacuguuagggugguggcaguggcuugaacauuguucuaucaaaugaaagcaaggaucccauuaguacaaagacugugcuuuagccagaaucuaucaggggaacguugucacuuuaaaaccagauuguucuuuuaauugcuauuuaaaggaacaaaaguguucccaagguacugcagccgagcaguugcaaguaauaacuauggauccauaauuacgcagugcugauuaucuggccuuucagaaacuguggcuggagucacugaccaauuuguuguagcuuguccucuugguuucucuggugcagaauauuccacacugagccuuuuuaacagagcuacaacaauccauuuguaaagcucccucagaaagugaagccugugcauauauuaauagaacaaauucggcugaaaauaagggcaggauaaugaacacucauauuguaagaugaaagucacagucauauuaauuguuguuugugaaugcuaggucauaagaugaauucuugacuuucauggcauguuguuagagggaaccaagacauuuguggaaucauuauaaccauccaaaauauuaucuuaaagaaguggcugauuuuucuuuuuaacuggcaguugcuucuuuauuuauucaaccaguaaacauauuuugagagccuacugugaaccaggcuacguauuaggcauuugggauugaaugguugcccaaacgagguuuauucugugcugcugucgacuuagagaauuagaucuaacacaaucuuguuugugauuuacauauaaaaacauuugugauuauguugaguuuucuugcccugaauuuuugauucaugacauuccauauaaaggcuucagagaagaacuagcagacaacaugugagaaggcuuggaaugugcaauaaaauuuuaguuuuuauacaguuuuggcuguucaagauaauguagcucuguaggcacagugaacugcauucauaugguuggaaaugucugcccugcuggcaguaauaaucaaccgaggagacgcagaauguauguagauuuacacauuguuaaaagcaauugccauagagaguuaaagggugccaggggguagacaaauguuuuguuguuucuuuuauaaagugugaaugucagagauggaggguuuaucucuucugugugcccugguuucccuuugaagcccuuggugccagagaggucuuguuaauagucuuuugaucuucucaaguccgacagaauuuuagcuccugcucguucucuguucaugggcucucugaagcacgcauuucauguccgguauuuaauaggugaauaaucacaacacuugauaaagcugaguuaaauaaucucacuaauuaacuagaugagguccauagucuuuguugcugaguagaugaacaguuuauuguacauacagauuaugggaacacuugggaacacagaugaauccuuaauguuccugcugaaggcucugugauaguugaaggucuuaggauucacugaauucauaaaaguuacuucuggaucuaaugacuacauuuaaauguauucagauacggcuuugcuaccacauaacuuaugaugauuuuuauuagaaaauguugauuuucuuuuugauuguuuaauuuaucaggguuuccuuaagaaauauguaagacgcuuugaauuuaauaauuuguuuuaaauuuugaaaggaaggcuaacacuauguuuugguuuuuguuuuuguuucucuuucucauagccccgugccgaucccauuccaauauguagcuucuguuuggggacuaaagagucaaaucgugaaaagaaaccagaagaacuccugucuugugcagauuguggcaguaguggugaguuugguuugugugcguucuacaugguguccacugucagagcuucaugcucucgaucuguagcgaaaccucccagaacauguucaaagacaucguuuggugauagaauagguuugaaauauaagaacauuauacaggucaagggugaaauaugaauguaccaauaccagccuauguuacauguuuauaugauucuguucaguaguauuuguaaccaagcuccaguuucagaucuauguggcuaauucaguguuagacugcagugcaugcaguaaguaaagucacaguagagauuuuguuuguuugacuguuucuugaacugucucuccauguagcccaggcuggcaucaaacuccuuuuacuugucccugagccuuuugagaugcucaguauauugccuggaccaaacucuuaaauccugaccucagucagucagucuccugccucaccuucccaaauccaaucauugccacgccuagcucauagcaaaggauuuaagcuaaacacaguauaccccuucuguucuccccagucucagagagacuccagugaagucuguauuguuucagguuacgacaccuacuggugaaauguaguaauucaauccagcuccauguuaacugaagaaaagggacagaccaugagauucgaggagugugucuucucugcucuuaccauuugauuuuaagauuaugccuccaauuuuauucagagauauaaaugcaaauuguguuuauguuuuuaaagguuuucuuuuacuggcuguucuuuuugauucggcacauaaaagccacucagguuacaugcacauacacauaguuuccugcauaugaaaugguaauacugggccccccuaugaguacuucuguuguuguuguuguuuuguuauuuucccauugaguaccaaccugaaggccuuacccaugcuaagcaaacccugcugcugaguugcagccccagcuguaaggcuuuuaaauguuaaucuuucuguguuggucuucucuuuuucucucagauacugagauauuuuuucccucaauguuaguuuaaaacuccuggcuaacagcuggaguuuuauuucugugguaaagcacuugucuaagacccuagguucaaucccagcaagcagaaggaaggaagcaaaacagcucugcagaaccuauagcaugcucucauacaccacugccuuuccuuccagccagacaccuaaucauuccacaaggugcuguccucauuaguaaugcuggugcuuaccucuacacuuagagggacuaaacagcccaguccagagucugcgugggcucuccugagaacuggaaguggcacccauucuuaugguuuuccacacucucgugcugucccacuugauugcugugaguaacuuaaaauuugucaccacguaggacagcugcuuaaugguuggauagaggaaauaugucauacugaggaaugauuauguuguggaaugguucuuaguugguuauucagaaguucaacuugauaggccauuuguggucagcagccuccaggaccugacuagcuggaaagagccuucacgauaugacaugucaagcacugccuaaaagaugucuucugcugucucggugaugggcuuuauggaugcauuagcauucucucacuuggccaugguauccuggguuagugacagaagagcacagaaacauugucuguguguucagguuaauuuauuucaaccuaugaguccccugcuccccugggcaggcagugccucacucaucagucugccucuacuuaccuuguaggucuuuucacaaggcucauuucaaaugaauuauuuuuuugugucacugccugaugaguucugugguguccagacaucugguguuuaucugugaauuuuaagcuguauguuaaaaugcccucuaucaucuuguuuuaauaucuauucauggggcacgcagacagauuucgcaagugggaagaaagauucucuucauauauuccucauugcugaugacacacccggcccugcugaguuguugcgaaucugggauuuuaucauaacuucaaggccuuccuuauaggguaucaagguguaauucuacccagguugaucuuagacuuuauaauaccaucaagcuccccuagucuucccagauugaagacccagcagagggaggucuggcccccucugcacaaaaguggcugaaaugucuuuucucugaagcuucccacuucuccauccuugcuucccaggcuuguccuuucugcccucaaaaguacccuucuuuucuagcaaguagagaagggucagguucucugucccuggaucacauacaucuaccuguuacuggcagaaaugcaaaccuuggggcauaguguauucuguagagcacagaggaugccugaaggugccucucugggcucuaaaguagagcagugcucuggcaguuccuuaaccaucugugaguguaucagcuuggauuugacuacuucaggggcugggagaagaucccaauuauggaauacuguguagacauguacgcccucuggucaauuaggaaaaaaacuauauuccuuuuuccuccuaaaauuaagcaucgcugggcgugguggcgcacaccuuuaaucccagcacuccggaggcagaggcaggcggauuucugaguucgaggccagccuggucuacagagugaguuccaggacagccaagacuacacagagaaacccugucucgaaaaacuuaagaaaaaagaagcaucaggggcugaagagauggcucagggguuaagggcauuggcuacucuuccagaggaccuggguucaauuccuaggacccacauggcaguuuguaagugucuguaacuccaguuucaggauaucugauacagucacuucaggcaaaacaccaaugcacacaaaauaaaaauaaaucuuuuuuuuuuuuuuuuuuuuuuaaugaagcaucaaaguaaaaugugguuaaucuuaggaggcguuggaguacaugugguuucuaacaccaugguuuucaugaggaagaccaugaugggccacaugcuucugcagugccuugucaggaugggagccaugcuggcacaguccaguccugcagcuccaggggaacuaaagguugguccuccagguggccuuguagagccugcugccuucccauccacagaaggacccaccgacugcaggauggaaucgggacuguuuguaaggaucaaaggaauucugaacauaagauauuuuuguuaaaaaagaaaaauguccaugaguaauagacaaccagaagaaggaaguccagaugcagccaucaggaggaugaugauuauucaaugugcuucccauaugugcucgacgcucuuagucaccucucucugaagccccauugcugugaugacgauuguacugcgcugagcuuccacagacaugaguguaacuguuuccuucugcuuccacaugaagugagaucacuggacuuccucugcuuuaaagaugacuguauaacaaaugaucagaacuccauuuuuuccuugcuaaaagucccauuuuaaaaaaaaaacugcucaagucaagggcaguaaacaugugaagugagguacagaaagccgccccgaauguagugucuccaaccccaugccccacuccccuuccugcuggcugcaacagacauuugcuuauucuguacaauggaaaauaguaagucuguccucuagauccacggggcuugcaugaucagccacgugacacauccggagauuguccuagccacucauaaaacugagacaguccucagucaggucugaggaaaugcugagacuggggagugauuuuacuugacuuucaugggucggccuacuuugaaauuaacacuguucuauucuccuugccucauuaaggccaaauuaucuuuaauuagcuucacauaaguauuagauauuaugccaaaugaaauuuugugucugcugcucagauugcugggugguuaaaucuuacuuacagaugaguugugugcauguguguuuucaaauuagcaaaucuaagauaaguguacaguucaaaauuacagcaucgcacuaaguggaagcucauugaaacaggaggcagcagagaggcugugaggcgcagcugggagagggacagaaccucucugcagaacaugagcaggaucuguagguagaaggucagccucccucgcgagccuggggaaccuacccgugcugggggagcugggagggaaaggugcagccuuuggccguauguaugguuuuggggguggggggcggcaguuagcacugguuucuuagaguugcuauguaugaaugccucagggagcaguugguuagucaucuaguuucacagugacuagaaacacauuggaucauuggguuggaaagcggaggccgugaccagaaggaauuccaagaggaauacauagaaagacaaggaaugaaagccucaccucagaagaggaaggggagccccggcccucaagaagccacagugucacugagucaucacagugaaaggcaagucuauuuuggaccauaguuuggaagguuuuagucaguggucagcuagcuccauugcuccauuggcccugaaguaaggcugaacaucacaacaucagaagccuguuuaccuggugauagugucaagaucaagaacaaugcacaguguggccccuggacuuggagaacagagaauggucuccauuuguuuguucauuacaggcuuucucucuguggaucagguuggccuugaacucagaaguccacuugucucugccuccuguggacuggaauuaaaagugugugccaccaccaccuggcugagaagggccuccuuaaucaaaguggguccauggaauggauccaggagagcaggcugaggaagguggaguacacagagguggagaagaacuccauggacuuggagagaggaaccagucgguaucagugcagaaucaaaagauuaugguuuggggcagaguuaacagggguccaauuuagauggguuuugcaaccaguaugggagaauuuacauuuuuuccuaugucaauuugguagccacagaaaaauuccaugaucagauuuuuaaauuuagaaagguaacuuaggcugccauggauuaauugaugugaacuuuggugaagaugaacuuuaguuuguuauaacagcaaaucuguguaugcagaauggagauacauagaucuguuagugugcaggcuuggguuagacaugcuacuuauugggagacuagggcgggggaugccugccuucucuuucuguaacugagugccacaguauauagcacuugcuccaagggcaggaagggaucccuuuguuacgauguaugacugguguuuuccauagccuuuuaauuugugguacugaggauugagcucaaggcuuugugcaugguggacaagcauugucgcagguaagguuuugcuguguaucccaggcuggucuucuugaacauucaguuucuucugucucugcuucuagagugcauuaguacuugucuuucugcuacaucacgugaccugaaagguuaggaaucaucucucuuucuacuauuucuaaugcuaauuaaaugucauuuggagaaggaguacuuacauauacugaaagcuaaauaaccagccugaggagccggacaccugauucuuuucucugccgucucucccaccuucauuggaauucagagcaugcuaggugggaacuacaucccuggcccuggguuauuuuucuauugaugccacagauuuaguagguuaagacaccauacuuuuuauuuuacagcuguaggacagaagugcaguguaggacucagcaaauuacagucaaggugucagcagguuggggugcugucuggauccacauccuuguccauugguuguaguaggauuugcucgauuguuugccgagcccuugccuugcugucaggugaauccccuucccagggggaaugagugucaguguuuggcuuccagcuuuccuuccuccaucuucagaaucugcugugacaagugcagacuguugcaugcucccagugucucugccuuucuccucaugacggacgucaggcccucagucagacccaugcuuguagaguugcuuugucuacauggcaugagaauugggguguuggaccaucacuguauuuacuauacauggguuuucuucucaaggacuuccugguuuguggcuccuuugguacuucccuaauuuuaagccacucuucuuugguuuuacuagauaaaacuauuguaaauuauaacuacuuaugugcuuaaugaauaagugaaagaagauuuaaugugguucucaaaauccacaguuauaaaaccaucuccagaaagacaaauccucaugaauucucucagcagagagagcgaggauuuuagagaaaugacuuaaguuuaugggguggcucaguaggagguuagggguuauauuaucaauaccauugauuucuaguagcucauuacuaucuauuguacagcaauacaccaagacugaguuacaaucuuuuguuuuauuuuuuaaaguuaaugugaggaaagcaaauggaaaugucuuuccacugcuuggcaucuuuuacagaaccauagaauugucaagcuggaagaaucuauaaucguuuccuuaaagcuaaauaaagggaagauugcuuccuaaaaaagaugggcuaaagaguuuggaauucgguagggcagcuuacauaguaguaaucucagcugcuauugcuuaagguggaggaaagcauuaagaggaaaaauguuccuugcuuuugauugaaaauggccggagucuauuacuuuugaaaaugcaaaauuauuuuuaaaagucucuauuguaggauaucugcaggaauaaauaguaagcucuaauaugauaugaauuaccuuaguuacugaagacuaagcuacaaagcacaaaaagagagucuaagguagagaaauacucagugcaugaaauugaggucgucugugcuggugauguaugacuuacagggaguaauaaagggggaggaguaaaugguguauuuuuaagcugauaggauccauuuuaagggaggaauuuaaauugcucuucuuuaaaaguugaguuuuuaguccacucaacauggggagggggugagaugaucaaaguagcuucuaaccucucccuuccaaccauacucuucuagcuaacaagugaccagugcuuguuugcgguuucugaggggugggguauugaugcucuuuuuggauagagacccuucuucucccuuagaagagacuggaggucaaccgcacgugccugggugucucuccaagccugaagcuggagccaguuggcagcauuugauuuuuuucaacaucuucaauacagauguuuugauuuuuuuuuuucuuuaaagaguaggaauuguguacuuuuauuaaugguauugaugauugauauugaauguucuuacuucaaaaaggcaacucuccuggugaguggaauuuuaugaagcaccuguuaagcuuuagggaggagaaccuuuuuggcaggaacccaaaauacauauuuaaacaaugaagcugccaaagucaggaaauuauaaaacaguuuugaaauuacagaaucugcuuucuuuauuaccccucgggcuucccuuugcagcuugguuauaaguucucucacaugggauuuucuaauguucuugcuauuuaaagaccagauuuuaaaaaaagaaauaauaaucaaguuuggagaucuccuugggguugugugaaaaagggccauuaguuuugaaauggagcugcuuuccagagccucagcucacacuguccccucacucauggaauccuggucuuguuccucuggggcuuucugcaaacuggacgugcagaauguugcuggguaaaaaaaaaaaaaagugcccaggguuguguggagcaacacauuguucaagcaagccgagggaaccugcccaggguggcuuccuaacguccugccugagucucuccuucagcucccaaacuccaugcuuguuccccugcuuuuagaauugaaacucagugacccaggaacuggauggcaguggauguucuucaucuguccuaguaguaaauguucuuugugugcuauguaaugagugaauucaucaagccacuuggaguuguagcauuccaaacagucucagcucuuuguuaaggcaggaucuugcuuuguacagaccgaccccugaaucauguuauuacaggugugcauccaccauacuaagcucaaccaguuuuuuguuuagccaucuuuuuuaauuuuauaugauuucaccacacagagaucaguuguuuggacaugguuaccacuauacagcacagcauccucaauggcugugggcacguggagguuagugacgaugacaggccaggcuacugcugcugcugcugcugcugcugcugcugcuacuacuacuucuucuucuucuucuucuucuuuuucucguucuccuccuccuccuauccuucuucuucuucccccaucccucucucuuucuuucucucuuucucucuuucucucuuucucucuuucucucuuucucucuuucucucuuucucucuuccuuucuuccuuucuuccuuucuuccuuucuuccucucuuccucucucucuuucuuucucucuuucucuuucuuucucucuuuuucuuucuaucuaucuaucuaucuaucuaucuaucuaucuaucuaucuaucuaucuaucuaucuaucuaucucucacucccucucacucccuucaaguccuaugagacugauagcugaaacugagauaagguucaggguuaccucagggaaagucucauacagucacuucauauacgcagggaaagaagucagagacaaagaagagaaaguaagcccgugcagcuacagcugguuuuguucucgaguuccuaaggcucacuggucggccucaguggcauccauugaaugaaggcaaugaggguuuuauaaacuaaggcacuauuuauugacagagcaauugcuuuguauugcaggacacccauccugucugaaguuuuguccugaguuaaccgcaaaugugaaggccuugagguggcagugcaucgagugcaagacgugcagcgcaugucgaguccagggcaaaaaugcagugaguacgcgccucacaucccagcgccagggcggugauggaggggggcucuuccuccaacacaauguugcaguguuuaaacauugguaauggcgcaccacacugggaaacuguggcuccuuuauuacaucuuaguuaaccugguaacuuggguguugauguucuucagcuggucuuagucucaacuagucucuaaucuguuguauuacaggauaacaugcuuuuuugugauuccugugauagaggauuccauauggagugcugugacccaccacuuuccagaaugccaaaaggugaacuuuccaaccauauuaaaaaugagcugggagugcaggugcgugguagagcacgugccuagcugugugaggccugguggaauucccagcacugugaagcaaacaggcaaaguccuuaccugcuaaccugcuugugaaguguggagauaccgcuccccaccccauguuguugcaggcuucaauagaagaguauuguaaagucauuuggucaggggaacaacacaagaauucagaccuugggaggaagaggacucucuugucaggagucaugacccugucuguauuagccaguaaaggcagugaauuuuguauuuauaaaauucacgaugacagugaugacuucagaguacuaaaacaggaagccagcaccagggucuggcuguugguugauguuuaaaugcacgaacaugggaauucucuguaucugguguaauauggaguucucuucucuguuugugugagucagccauguaccugcccucauguuuauaauaugguaaacauuuaagaaugagcuugcccuuuuauuaauaguauguauauauugacauuguagaagguauagagaauacaaacauaaaagaaauauaaaggcugggggacaaacaguuaguuaccaagagguucuugcuucuacucgcccuuuucaagggagcguucugcaaaugugugcguaaccuugaguuuuccucuucccaauaauagaugguaagcauccucaugccauugcucgcccuccuaaacaugauuuuacacaagucauguugagcaccauaacacggagcagggcuuccagaccugcuugugggccaugaauaagcuuuguuggcacgauccuuuucaauuuuaccuugaguugucucaauggggcaugcaugcuuugauuugucacccugucacugcucccuauugucacguguucuaauuugcuuuagucacaugcagucgaggugcuuccugaagguauuugauuuugcagccucagguauaaaugaaccauaauugauuuaauuaaccaauucucuacaguagauacuucaaguguuucccuuacaccugaagauaaauucguagagaggaauucucuaacuagaggccacuuacuugaaaggcugucaguuuuuauaccgaccaccaguguaugaggaauuauccucaugacaaagcuaauagaaccacugagccaaagacauacuuccuuuuuuaccuuuuaacaucuuuaaaauaauuuuuaucauaugaguaauaucuuagauuugauaaaacuauagucuuaauauuuuaaaucaguuugauaguaaggaaaaaaaucaugacuucuuuucccuuuuuuuaguugaggacaccgaacuucuguauuugauuauuuauucgcaucauugugaauaccuguuuuauacuauaaucauuuuuccauugagguucaaguacuuacaccuucagcuuuacagaaauauuaaucaguuuagauuccugguguuugccacauuuuauuuuucauguaggauucuuugccucaguuuaugugauuucuguccccaccccguggaaauuacauuuuaguagagagauguuugugcaaugaguuaucauuuuuaauuucuuuucuaguuaguguauaaacuuuuuguaacagguugugguaacucacaccuaugaucccagcacuugggagacugaggcaggagggucuagaguucaaguccagccugggcuacuugagaccuucucuaaugcagaggggaggggaagggagaggacugaaucguccucgugaagaauaggaaguagcucuucuccuuccagggaguucagcgaauuguuuccucauuuccccacugauuugaauuggagcuuuuugaucuacuaaacuugucuauaauagucacaucguuuguuuuuuuaauauucuagacauguaacuucaauuauuauagugccagagaccuaaaauuguuaaguuuuaauuuuaaaauacuuaaacucauaaccauuuuaguguuggaaauuucccaaagcgauugauaaaacaaacaauuuuuuuuucuccuaugaaaguucaaaagucugauugauugacuuaaaaacuuucucccaagugauaagaaagaaauaaaagauaaauagcuuauggcuugggcuggagagauggcuccgugguuagggacaugugcuguuuucccagaggaccaggcagugcgcaacugcauauaacaguuccaggggauccagugccuucucugaccuccgugggcauguacacauggcauucauucacacacagacagacaggcagacggacauucacagacacacauacgcacgcacgcgcgcgcacacacacacacacacacacacacacacacacacacagguuucccugggugaguaugggguguuggguggcuuaauggggaacagcuuuagggaagagugguaagccagguccagcuucugcucucaacaccuugaccuggggucuuugaccuucagcagugucuuuucuaaagagagcaacagggagugacccacuuuccuagagaaagagcugcauacagacauccuuggucagauuacaacuacagguuuauauuuaauaucuucaacuuaagugaaacauuaaauuuuuuuuucauauauauauuaauucagggauguggauuugccaagucugcagaccaaagaaaaagggaagaaaacuacuucaugagaaagcugcacaaauaaaacggcgauaugcaaaacccauuggacgaccgaaaaauaaauuaaagcaacgauuguuguagguugagaucuuauuaaaagaaaucuuuuauguugugcuuuaaaaaauguagguaauuguaauccccucgaauuuugucagauuuuuuuagcauaauuuuucuaaauucaauaaguauuuuccuuuugcauaagcugugggauuuuccccucaaaaauagcauuuguagcuacacuugguauuuuggggucuucucuuggcaguagcuuugauaccgagugacauguuucaagcagcaaagauggaaguguuguaagaacugcaaacuuccucagccuuuuuuauuggcugagcauuaaaacagcuuaauuuuauaaauauuuucacaggaauuuuuuuuaaaccaaaaaguauuuuguucaugucuuuagagaguuucauuaucauucuagauagcauuaaaaaaaauaaaucucccuucugaugcuaauguaauauuaccacuuuuuuuuuuuuuuuuuuuuuuuuuagauuucuucuccaaaauaguagcuucugagaaaccuauaaaugauuguccuguaaaaaguuagauggguccauucggcaagugcagauaaaauauuuugcaguaacccccaagucugcuaugauagucccauuuccaacuucuuucuguugucuaauugucauuaaagguuaguugaaaaaaagaugaagagaaugcauuuuuuaaccucuauagaauauagauucagcugucaguauuaagaaacacauacacagggcugagcaugguaguguaggccuuuaacccaagcacgugagaggaaaagaguuuuaggccaucuuggacuacagagugaguuuacuggacagcucaggcugucuugggggcuuaaggacagaggcccuguguuuuauauacaaaaagauauucuaccugccuugaaaacccacugugaauuuuccuuguaucucuuuucccccuucuuucacuguacggaagcucgucugcgcuucaucuuccaaaggagaaguagaaaguacaaaccccuucccagaggguuuuuuuguuguuauuguuguuggguguuuuuuuagugaaauuuaaugaaagcccuuuaacugaaaugguagacauuuuaaaauggauuuuuaguuguuaauuucuagaaacaaauauaaaacauuuaugaauaaaauuuuuuauuuuagugucauuugaaguagaaauuaugguuuuuucucucucauuuuucccauguaggcauuguucuugaaaagggaccauauccucaaggucuguuuauaaaaucuaaauuagaauauaaacuuucuaaacaaaggacacagcugaaaauuguaccuggcacggauccuaacuucucauuuguccagaauuguccuuugagcucaggaauuuuuaagacagucuggggagauuuucuuucacauguuuuauaagccuauuauccuuucuggccaaucuacuccagauccaguccagaugcagcuuuauaacgcagacauuuuagccuggaugaguuguuugucgcuaacccucacugugucuucuagugaccccagagaucuccaguguucaccugauguggcugaaauaguggugccaggugaaguuccuggcaguugagccaccucagaugaaccuuacagaaauugguucauuaaaucuuuguguacaagauaggcacuaaaacguggucgauuuguaauuauuuaagguguucugguaauuuguuaucauaccauucucaggcuuccauuucuccauuagcuuucagcuaaaugaguaacuuugagccucagcauugucaugaucauaugcaaaugguucuguugccuaaauuccuccugcaauguggguagcuucccaagccugcccaagggcgggugcagguggccaguccuguuccugugggcagcuguguuuguggagugaccuccuacagcaguauggccagaacccaacaucccacaaagugcgaugucagucccaguaggaggcagggguccuugggccaagugucugguaaugaccaugguaaaugugcugcuucuccgccagacuucccacuccauguccgaccugcugcagcuucucuuuaaucauuucuucaguuuuuuuguuuuuguuuuucuguuuuuuuuuuuuugcaauuguccuuuuuucagcaauauuuuaugcuguaauugucuuuucuccuaguauuauuggcuguuuaucaugcuaagcauaaacuagaagaguaaaccuuuauuuuauuuuucaguacaaauuuauagacauacccaaauuguacugcuguaguuuuucaaacuaagugaaaaauuacuucuaccuagaaaugaguauauucuucuacuuuggaucagacauacggccuacuuccucuaaggguucuuaaaggacauuucaggaaaucauaauuacuuguaacaacacuggggauuacuuauuuuuugucuaauuauaccgaaagcauuggguguuuuuaguaucugcaaaauucuucuuccuuguacuguccucgaguccauguggauucucuuaguaccuguugacaggcccugguaggagccugacacacaaauagaaucuguuuuccagccaagaaacacauaggugguggcacccacagaaacccagucuuaaaguugcagugaaucgucucaaguucaaguacauugacuaugcaucuaguuucuauagauuuguuauuagaugccuuuauaguucuguuauuuaaugcugauacuauucucuaaauucuugccuaggucuguaaccagugaugaaggauccaugagugcauucacaggaagggggucaccugguaggggucaaaagacuaaagucaguaccacaccuucaucuggucaugcugcgucugggaagcacucaagcagcagauuggcuguuacagaccccacccggccuggugccaccaccaaaaccaccaccuccuccaccuacauuucugccucuacacuuaaaguuaacaagaaaaccaaagggcucauugauggccuuacuaaguuuuuuacaccaucaccugauggucgcagaucccgaggugaaauaauagacuuuucaaagcacuaucguccaaggaaaaaggucucucagaaacagucaugcacuucucauguguuggcuacagguaccacacaaaagcuaaaaccugcaccuucugcacuucugcccccugcccccaucucuggucagagccccaguucacaaaaguccagcucuuccaccuccucuaccucuacccagagcucuuccagccaguccggugagcccuccuuuagcagucuuacuaacaacagccagcugaaggcucucuuugauggacuuucucauaucuauaccacucagggacagucucgaaaaaagggacacccaagcuaugcaccacccaaacgcaugcgucguaaaacugaauucucuuccacggcaaaggcuaaagcccguuucuuuggaaaacgagauuuuaggagcaggcuucucucucacuccuccuguagcugggggaugacuagaggacauauuuuuaaagccauugcucacuucaagcgaacaacuuuucuuaaaaagcacaggaugcuaggcagauuaaaauauaaagugaccccucagauggggaccccgucaucagggaaggggagcuuggcagacggaaggauuaacccugaucaggauaaugguaagcaaaaggugaaagcuccagcccaaccucugcccgccccucucccaccccaaagagccaggaaaucagcucugcccgggacauaggcucuggcucgcucgcucucucucucugcuccucacuuugacacacaugcagugagacuuugaccuuuuucuaauucugucuaaaccuccaaaaaaguguuuuuucaacuaauaucuccagccuccuauuauuuauuuccauucguaguggcacuaggcacuucccccuccagauaccuucauagcguugcucccagcuuuguaguccgcaugaguagccaccaccaugcuucugccgugcucucuccugugccgccucaaguagccagugcugccuuguugugugcuggcaaugcuuccagccagguuucagcucugccucucccuccgcuccauugcuuucucauggcaaaguucauccugcguccgucucagcagagccugaucugugcuucuguggagugugcauuggauuugaguguguuugcauguuuacccauucaccuuaggaaggagaccgauuucaaaaguucagugaacaaguuggcccauuacauuuguuacccuuuauccaacaaaaagccaaaauaugucauguggaggaauagguagauuuugugagcucaaaacuaaugaugguaauguuguaacuagacaucacuucuuaucuugguugaagaauauguuuugcuuuguauuguucuuacguucccucguauuuguuauagaaagaugacagugauguauguaguagggaaagaguuacugcuggaucugugagcaggguuagcuauauaagcuuauaccgcucaaugcagaaagagaucccauugcccacugugcggauucgguacuguuguugguaaugugcacuggucacccaugcuucaaaucacugaacacccuuucuucugguuucaaaugacagauacugauauuaaaauaagcaucaaacaagaaagugcagaugugagucuggugggaaacaaggagcucgugacugaagaggaucuggacguuuuuaagcaggcccaggaacugucuugggagguaaggcccagacccaacacagcaguaaugagaucugugggacuucuaaccuuugcagugaggcuguagaguccuuuguggcucuuuaaugcuuaugcggguuuuuguuucuuucuuuauuuuuuagcuauggcaauaaauguagauuaucuauucuucucaaaauagaagaagacuugacugaucucacaaagcagaccaaagcaguacuaguuauacagauagaacaagaauuauagaauaauaauuaacuggcugugguggcacacgucuucaaucccaacauuccagagacgggugcaggccuagcucugaauucaaggccagccuggucuacagaucgaauuucaggacagcaggggcuacauagagaaaaaccaaaaaauuaauaguaauggcagaaagauggcuuuguggguaaaggcauuugcuuugcaaaccugacagccgaguucaaaacacagguaugguggaaagagccagcucccaaaaguuguucucugaagcucagcacagcgcagagguccacacaagcaugcauucucucaaacacagaauaaagaauaagauaaagcuucuaaaacgguuucuaauaauuuuuguccacauuuggaaaauagcaauuucaaauuguaaccaaaaagcacaucccuucucaguuuaccagugguccugacgcagauggcuugccauaugaaaauguguccauuuuuagcuuucuggcauugaugagcgcacugucgucuuuuauaaucaauugaagucaucuucauuuuuacugucuaguaauuucucuaaaugguuccgcuuaccaugucagguccacuuggguuacucucagcagacgugaagaaguaaggcuauaggcgucucaaaggcauacaguaaucacacugucuuaccaucaguagacaguaagugguguguggccagcggucccccuccgucccuuucagucacccugucugccuggguuucuagcuuuguuuuuagcagcacccagucaugcugaagacuugugguaccauugaucugaagaaauaguauggauuauggauugucauuccuuauucugcccuugacagacacuuuguguuuguucuccugcagcuauagcaaaugucagauuucucucuuuaacauuuuucuuuguguauggagugaggauauucauauagaaaaguaagggacaauagucacuaucuggaugauaaugcaacccuaaagcccuuuauaacauaacaaagcuuauuuuuaaaaauugcauuaaucucuuugucaggggagauggggccugcauuaccagugccuugguacaggcauggaggucagaggacaguuuacaggaaugaauucucuuucuuucaucuggguucuagagagcagguuauccaucuuggcagcaaacaccucaccuaagccaucuugccagcuccaaagcuagggguuguauucaagauguauguccuuuuauaucugccagacaguaugguagacacugaggcugccaccgugacugcacagccucaucucauguagcuugcuucauggcagaaggagaaguaacagggcuucuccacucgugaucacucgcaggagcugacauacagcuuccugucggagcagggaccggcaagggauggagcagcagcugcgccaucuccuacuugcagucggaugcauugcaguuuguuguuauacccaggucuauagacuuuggaauuuacuugcaucacacacuuauaacccauuugucauauuuguuggauauuauuuucgugcauacagauuuuguacaaaggugcuuaauguuaucugucuuaacaauauaaaaauuaacuaauuaagaucaauggcauguuuggguagcuucaaaugaaaaagaagaaaccauguaaaugaaauacucucuuuucuuggaauuuguauuuuaucaugauuuguuguuguuguuguuguuguuguuuaucagaaaauagagugugaaaguggaguggaagacuguggucgguaccccucaguaauagaguucgggaaauacgagauccaaaccugguacuccucgccuuacccacaggaauaugcaagguaggggcggagccuggcggcugugugggaaggccuggggagcucuguucuacagcagaagugaaaugcuuugaggagagaggagaaguacacuuggguacagggaugcugcucagcugggagagugcuugcugaguaugccuggcuuccaucaccaugccccacggaaaacaggucauggugugagcaccuauucgugagcgccuuggaguuaaggcggaaggucagagguugaaggccauuuugucaguauauauucuguugauagccaugaacuugucuccaaaaaguagugagugagugagugaauaaacaaacauaaauuuugguagucaggcagaagucuuugccauuagcguacuuuuguaguguguuuguacuguuuguguauauuccuuaacucguaagaaccacggguacuguaaauuucucuuugagccaggagguaguggcacucaccuuuaaucccagcacucaaggaggcagaggcagaggcaggcagaucucugaguucaaggcuagccaggucuacagaucuaguuccagaacagccaggacuacacaaaaaaacgcuugucuccagaaaaaacaaacaaaaaacagagauaaauaaacuuuucuuugacuuuugaggccauccuguuuuuguucgguuaguaggacaauugcugguuuuauauagaacaaaucagagaaaacaacggucgguuagaggugcuugauauauucacuacacuggcugucuuuuaguuaaggauauagguuuuaucaauaauuucucaucccuuguuuuuuucgugguucuucucccagaaauuaagcaaaauagaaaaaguaggaggaaguaguagguggcagguaacuuucagagacccuucccaagucacucaaagccauuuacagccaacauucuaaaaauaacagaaauuguugucaguuuccugcuuuucuugaacuaagauuagagugucuuagcaaccaacuauaucacccaacauuucuuuucuucugaugcccacaucaagucacaugguauuaguagaaucuuggggcuuuacccucccaaccaaaacuacaaagugagauuacaucucaaaaaugguuuuguuaaagaagaaggagaaggagaaggagaaggagaaggagaaggcgaaggaagaagaagaagaagaagaagaagaagaagaagaagaagaagaagaagaagaagaagaagaagaagaagaagaagaugauuauucuaagucucaguggaagaccagcuuagcugagauuucaugaauaaaaaugaggucgauaggagaguaaggacugugucuaccucacaaauauaccuauuaccuaacacuugauaccacguauguacauaaacguaugugugugugcauaguuuacauaucuguguaauaugugcauauagcuuaaagugucuggaaagauuuaauggccggaucacugaaguggaugucuauaaaauggguguuagcaugccucagcccuuuguuggugcuauguaaacaguucuguuacuuucugaagauuaaagagcgugugcuuagugauucuguagcacugagugcagauaacugaguuaagaauauaacacugcagacaaaaacccaaaacacuucuuaauuuaagaauuaaagcagcaguggaauugguaggaaacaaaugugagcuuuugacugucggacuugcguccacuacuuuagacuauuacauuauauagcuuccucauccagaggcagaaauaaaagccaccuuuuaggaccucugccucauagauauccauaucauuuuaaagauaauaaauucacuuauaaauaaaauauuacucuagguacagcagucugcauuaagaauauuuaaaaauacagcauuaaaucugaauuuuuaaaaauauacuuggucacacuaaagaauagcauucugaauuguugauuuuucaggccugaaaaaccugaugguaggucauagaguaaaauaagaacacauuauuauaagcuuuauuuaaaauauuuuaaggucuuuauauuucuuuauuacuggauucuccacaccccgcccccugccguuuuguuuuguuuuguuguguuguauuguguuguguugagacaggcucuuacuguguagcucuggcuggucaggaauuagcuguguagaccaagcuggccuaaagcucacagagacccuucccuccugccucugagaccgacuguugggguugaggcuauaugccacuauaccuggcuucuuuuucccuuuuugaaaauguuuucaaaagauuuuauagccauuuuaugucuagaaaacauugaacaauguuuagcuuuucucucuugaacaguauagucacucuaauagacuuucugauuuuuaaacuuugacagauuaccaaagcuuuaccugugugaauucugucuuaaauauaugaagaguaaaaauauuuugcuaagacacucaaagaaguguggaugguuucauccuccggccaaugagauuuaccgaaggaaagaccuuucaguauucgagguaagcaaguauaaacaaaaacauggucuuuuugaacccuaauauuccuaacuguugacugugugcuuggaugguuuguguauagauagcacaguguguauucaaucuuagcaucggaauucacacugcucuuuaagauagcgccaugguuuagcauauuuaucugacuacauuaagcaaccauuuagacugaugaagaauucuuacuucaucacaucaacuuuuuuggggcuuuuuaaaaucccuuucuacagcacaguaugcaccagugaauuaguggucuccuuggcucuuuguaaauuccacauucuuuggcaggaggaauuagcuuuguuuagcagcuccagccagugucuggcagguacucccucuuccagggaauugagcagcuguacguaucugcuuagcacacaaacaccugugcuucuguccaguucuugccaggguggauaaauccucugggcgagaucccagcagauguugggacucuuccccagucucuguggacagcuacccuagagaaccuugccguucccaggaagcccuguguuccugggucucauuguagguuucuugaagauauuuuguguuuucagagcagacguaguagcagaaagucucugcuuuauuuucauuguuuagccaggcuucugcugccaggcucggggaucuagcuuagcugaucagcuguauacugaggacuccaggcucuccuuuggugguccugucuguucagagggucacuguccguucucggcauuaauccuccucacuguagcugcacauuucugugcuuugcuguauuggccucuuuguuaccauccugguguguuguuuacucuucagggucucagaucaagccuuccuccuacggcagacaugaugucuucuuuuucugaaaaccaguguccuuucucuuuccagugcucauguugcuguguaucauucugcugcacagcugccguuugcucuggccuccagugucccuccauuauaauaagggagggucaucaguuucccaugugucuaagaggcuucucaggcagggcuuucccucucuagacuggucagguaccuacugcugugguguuuuuuaagcaccuuccugcucuuucuagugagcuugaagggcaaguggaauucuuugugaggcugcgcuauuacuucuuauuaaaggccaagcacaggcugcucagccugaguacuacuggcauuucaagcugaauaauauauugcauaggaacuguaguauacuuuuuaagguguuuagcagcauccugccgucuaccuccuggcugcugcugcuggugccuccuguccauucgugacaaccaaaaaugccucagcagccacauaucugagcagaaagagggugggaggugaaggauaccaaguacagguuaccccacuugauguacugucgggcugccacucaggcagccccaagaaggcaggggagagaguuggucucagggagccuuugcguugugccagcuuuacuguuugguccuuuccucgugcccuggaugcuuuuccuccaaccgaaagaaaauugaaacgacuguucaucuuuucccagacagcaaaacacauuguuugccuuaaguaauuauugaauaaaucaucaugaguaaggcuguguguggacgcucuaaucuaucaggaagucaucugggcaggauaaucagucuuguuagacauguguuugaaagcacagagaugaaagucgcccaggaguguaguucauuccuacacugaggguguggaggaaacccuaaggcccuauucuagcaucuugauugaagguaucagcuuuggaaaggaaacuuucggaucuuuucugugauuuagaaagaaguaaaccguaucugugauuuugguuuugugagucucuucuguaccugucucuuuuccuagacuucugauugaucggagauuguuucaguguuuucauuucuguuucugaugcacagauguacaucgccauuaguucuuguguacggcacuguuuccaaaaggaccauacucccaaauacaucaaaacguccuuuaauuaaagagagaauuguauccucagugccaguugccuguauuugauuauguugcuaugugugggacuaagguucuguccaagggaaauaguuauaugaaaucuaaaaauaauuugugcaguauaagaaccaguaugguccacaggagaccugggaauggucaaguucauugucaaagagcucggguuagcaaaaccugacuccccuaagaagaguguggggucuguuuggcucucuguuucagcaagucacuacauuugaucaaagacauugguuucugugccuuagcuccuguggaggccucggugucccagcuugagucuuuuauuuugaagagaaguagacuauaaucauuacacuuacuguagguuuaaauucaccugacucucucuguaauuauucccaacacagagauuguauauucuccaguuauauuaaaaugauacuugggauaaaacuaaaauggaugccucugcuguuuaauccacacuuuugaagaaucagaauaacucaggcgguucauuuauauuauuuuuauuugaaguccuuuugaaaauaacaaaaguuuggcaugcaugaugaaauuuuuauuuguuuuuuuaauuuucagauuuacuuggcuccaauuuaaaaguaagagggcaugccugauaaauuuuaacucauaauaaauugcaagugaaagugacuuugcuaacguugcuguuucuugaacgagcuuaaggaggagacguuagcugucuugaauuuaccuuaacaagaggaaagaugggauucuggcucugcaaguaacagcuguucccugguuaacacugucuuuguuuaauggaguauuuuaaucuuagaguguaggauuuagaaauaaaauuauauacuuuuuaaaaugauauacagaagaagcaaguuuauauucugaugauacuuuuauguuaaauaauguugucuguuucucuuuuucuagguugaugggaauaugaguaaaauuuauugccaaaaccuuugcuuguuagccaagcucuuccuggaccacaaaacauuguauuaugauguugagccauuccuuuuuuauguccuuacaaaaaaugaugaaaaaggcugucaucugguuggauacuucuccaagguaaaccacgagccagcauggccuucucucgcuugcuugcaaauguuuuuaguggagcucaggucuuugaacaggguuuuuuuguuuuguuuucucuuguuuuuguauuuuuaugacaauaauuugaguaaguggcucauguuucugaaaaccucagcuuuuuguuuaaagcucauuugaaaggacacaaacaagaaacaaaacaaauaacaacaaaaggugccuaggaaguguguaaaggaccccagaacccugugcugugcugacagugaccaugcgacauuucauuaccaccuuguagacugccucgcagcuuugauuuccaaauguugagcuucuuucuucuuuuaaguggugugcacaugaagcuuucugugauggagcacuuaagaccucagccucucuggcucauuuccuaccucguggucagcaguauccaguguuagagcauuggugugggcugcugagauggcuccugagaaacguccaggaccugcuugguaggagagaacugacucccagaaguuguccgcaugcacccuacccugcccugccucccaccccacacacaccaaggaauacauguaauuaaaacaaaaacaaaaacaccacuggcaauugauggccuaguugauagguggcugguuuuccaccgcugccucucaugaucugugcugugguuuuuaaguucuaagggagucuugccuguaggaaaccuaccugucucuagcagucaacauggggaagaacuugcauacuaaggcacaguggcucgucuuuucacugguucagagcucuucuccagaagaaacugcucagaaacugcuguugcuaagucaugcaccuugaaagagagcugguuuggaauguguuugccagguguugaacuuucccuggguaugcacccaagaaugguuacagaaacagagaugguaauuauccagacgcucagcagaugagugacuuuauuggaucugcuuuucuuuaauguucaugaugaaacacuccauagaagugcuguuuucacaggaaauaagaagcuagacuaucuucccgguguguuggcauaugcugcuaauauaaauacucagagggcuaagacaagggaucaccaguuuguggucagccaagacggcauggcaagacuguccaugucccucaguguucucucccuccagacacaugaaccauccagagguccuccugucucaucccugugugcagcuauuuugacugacucucuuuccuucuuucuuucuuucuuucuuucuuucucucucucucucucucucucucucucucucucucucccucucucucucucuuucuuucuuucuuucuucauuguuuauuuguuuuuguuuuuugaacagaaucacacuauuuagcucuggcuaugcuagaauucagagaucugccugucuucugccuccugaacauccacuccccacccacuccagacaguguuucucugugcaacagcccuggcuuuacuggaacucucucuguagaccaggcuguccuggaacuuaccaagaaauaccugccucugccucugcgucccgagugcugggauuagaagguacaccaccaagucuggcagcccuucuguucaauguggauuuaagccucgugcuccuggaggcucacaccggcacagcaggcuuuuuacuuacuuacugggcuagguccaucuauuaagaaaaggaaguggauugcuguuggauuauauuucagugaacucucauggcugagaacaguucuggacagagaaagggcuggcaucaaggauauaaauccucuuugcccagaguacaucucuuuuuagauagagugacccauuuaucuuacuuugcacaguaaaauuaauuauuugagccuuuacuauuggcaugcacauccagggaugggcaauuuaucuccuagagucucguuguuacuucucaaggcuuagagaugccacagacagcuacaaguacacaaaaguggggcucaucuucuuucauuuuugcccuuuagacuuuuuuccacaguuguuuccuguggucuuugaaacugguucguuaaagaucugaguguucugaagugaucuugugaugugguucuauuugugagcagccucauuugugguuuauauuuggccacagcacucacggccucagaagccuuuuccagaucuucucuguguagguuuugguggugucuguguacugugaauucgauauugcgauugugaacccuuaguucuuagagcuguccagagcucuacucagacccccuccuggcuuuagccuguugauaggauuuccgucucacuguuguucagaggcuuugggguuucuuggugucuuuguuguuguuugauuuuccugguuugaggugccgacuuuaauuauuucuacuuggccuucugacucacaggagacacauuuguuuguguguccacucacgugucugccauuccagugccacugggggauuuacucagaggcagaggccagcuugccauugucgaguuguagauuaucacgcaguagggcugcccgccaaagcccaguuuacuccacuggguggacuaggugguguuuucuccguuucugcaguugugugagcaaggagagcgucguucccuccuguggcgguucuuucacccugcacacauuuccuagauucccuauacggauuuuaugcuccuaacuuuguagaaugcagauacaucugagaagcauagccagagagggugcuuuguuguuacuuacuugaucagcaugguaggauuacucugauugguccugacccaagccacuguuugaccuuagcggauagcuuuacaaggacgguggcagguacugggacuugcccacugcagcagagcucugacauacuuacuaugcuucuuuuucccauaggaaaagcucugccagcagaaguauaauguguccugcauaaugaucaugccccagcaccaaaggcaaggauuuggacgcuuucucauugauuucaguaagugaaauacauuacuuccuuccagaguagcugccggcuguuucaggaaacuguaccgcauaaagcuuuauuuaaccugcugugcuguuuucuuuuuguaaucguacauagugggucuucuguuuauaaccaccugaguuagaagaucuuccucacgugacaguuucccugacacccacuuacacucagggaaaaugagacuagaucucaccacagugcccuugccucagaaagccauuaccugcaaugagcugguagaguucuguggcacugugcucacuauaccauuagguaauuauugggaauaagcacaagcgauuguuaguuacaaggaguuuucgcuuucucagauuuugcccaguagucuuuguggagcagaggagagcagggguaaagagagccuguucaccugaggaggcucuaguuacuucccucucacuguugcagaagcuguugguaacgagguuucucaggagcugcuggcuucauaugcacuuguagcccugagccucucugguuaaagcuggaugcuugcaacagugcagcggcuggaugcuugcaacaaugcagcggcuggaugcuugcaacaaugcagcggcuggaugcuugcaacaaugcagcggcugugcuucuuucuuagccgcugucucucuucuugcuuauuucauacuaaggcucaagcugcauuuagagagauaguagccugugagccccuuacccugugaugauaggacucucuagcuauaugacagucugucacuuagugcacgugaauucguagguuguuagcuggauaaaggaaauuugaauauaugugcaggaaaugcaaggccuugcauguagguaugcugugaggguccauaaggaaguauguugacucuauaagucucuaucauuagauucugaaauguugaagucugcagauaaauuuuagacugauuuuguauaauuuccugaccaaaaaaauauaaaauuaaaaaggauuuuggguugauuauuuuuauaccuucagauaguauuuccaauuauuaauuuguuuuccuagucuuacuguuuuggccuaguuauccaggagacuaauuguccaaggagggcuauauacuagcucacugucguuccuuuccacauccucgcuguaaucagacucuuuuucuucuuuaguuuuccauguuuuaaaucacuguucccugagccuuccauacuuguaccuaaugcacugauugcuccucuccugcccucccucuucccucccucaucccucacccccuuguuugcuacuuaaucucuuucuuguauucaugucuuuuuaucuaugucccucuggguuugaccaaguccauguauguggcuuuaguuccuggugguguaggaguggguacacaugugaagaccaucauuacaugagguuuuuuuuaagggggggggguucuucuuguuuauauuggauaaguaaauguacaguuacauucgaguuaaaucccugcuacagcuauuuggaaaggcagaauuagcugacucuuuauggaauauuuuacagucaucauguaugaggcgcucaucuauaacuacacuuucugggauacaucacaaccaugcaggucuaagcuugcugacaguguucucgugucucuagacuaaaaggacguuccaggagacagcuccaggcuaccuuuuaagcuuuuugacucaacaguuugcuucucugaguucuuuuucugugcauggccuuuccugacauggccccuuccucuugccuguucaaaaccaugcucauuugguaacaacucaagaaccucuuaucucuaaugcugucuuuguaaguucuaucuuauaccgucccagcuauguucuauacgagcaugcuuagaccguguuuguccuuuugugcuaaacaucaguauaucgugcuucugaguuaccgugaucuccuuggaaacuuuuuuggaucagcauaguuccuauaacaauuuguauuagaugucguuuugcugauaugaagugauaaugaagcuaucuaaagugaugccuagauuauaaaggaacugguaccaccagguaaaaaagucaagcucuaaauacagugauauaauuacaggggacauacaugaauguacauguauggauaacccaggguucccuuuaagugcuaaaacuauuuuaaaacuucagacaugaaaaaacaagguggacuugaacuuuucuuuccuuugagaccaggucucauuuuauacuucuggcugacuuggaauucacuuugcagaccaggcuggucuucaucuuccagagaucugccugucucugccucccauguacuaagaucugaggugugcagcaccauuccuaaccaccacccuguaauuucagacaugaaauacaggacacacuggaauacuuuuggggacauuugcggucauuaugaaugccauccuccggaugugacuggguuuaguaguccugacagucuuguagaacccuuggccuugucucuccacuagagugcuuaagcaccaugaugaaagauuuuaguauaguugaaaggugggguggggaauaguuugaagggaauugguauuguuuuacaguacucacaagaaaacgggaccgaguguaagcccaauaaaaauucacuuuaaaaacagaauuauuccuugaccaaccauuguaaagaagacaggguaugcuguugaaaaauuaauagcaucuccuugguagucacuuaaaauauuaguagguaaauaucuuuccagaaccauuuggauccaggcauucacagagggggguggggggggagcacauaaccucucaucaguuuuuccucacaggucagugcucuggguaagaaagaugagcaggacuuguaagauuucuaaaauauguucuguuccauuaaaaggaccucuuaauaaugguuuggguucuguuguguaaggcugggaccuguugauuaagguuguauuuucaguuagucagagcaacuguaaaguagggaaguccuugucaauaaugauuguaauuuagcaaaggaaaacagcauacugcaccuggacuuuuauauauguuccaauagaguguguguguguguguguguguguguguguguguguguguguguguguguauacgcucuugagugcgugugucuguuugucugucugucugaaaaaugcaugcacaagauuuuggcacuguuguccgguacaguaagagaacugaugggguuguccacaggcccaaaugcuacccuuccaagaagcugucucuugcuucugggacagcuuaucuggcacuugucagagugaggucucucaggaggcuguuugcacaucuuggccagagugaguaaaaggugccagcaucucagagacagccugcucauagacagacucaggguucaugacugcucaagaagcgauggacacaggcugcaggggucucuucuccuggauucugagauuuccucucccuuagucaaaaacuuuaaagcccuccuacacacacacagacaacucuccacccucacuagacaugucaagacuucaaagaagcccacuucccacaaaacuucugcuacuuuuugccucccacggacaaggaaaauagcugcucuucccacggggaacagcuaggcacuggggagcuagaauguuccuuccugagcccuggccugcuccugcuguuagagcugcccagcaaugccuuauauauuucacuguuucuuuauuuugaaagaaaauucagacuugagagaaaaguuacaauauugugccuagaauuuccaugaauucuuuaccuggauccccugggcguuggcauguauagugucuguucuuuuauucuccuucuucucucucauacgucucuuuccugaauugugaugaggaugaaccgcguguguuaguccaucuuuaaagauccucugcuguguaucccacaaacucucagaaccaaaauaucccuaucagcaggcacucuguaugagugagugugcuagauucagguuucgucuugccagugcuuccugcuguccuuuugggggaaauaccucucaguguggguuuauuucucaccacauucagucacugggucucuuaaauuucccaagaucagggguauugguggguuugucuugauuuuaguuccuuggacauuguaaagugugcggggaccuauucuguacaguaccugccuucccauuggggcuucucugauauuagauuugggugguaagcuuuggggagaaguacuagagaaacuaagguuccuccuccuuggcauacaaaaugugcugaccauguuaugcggugguaccugccaagucauuguaauagugucugguaagaagauaccuugagguuauguaaauaccauuucucccaucuuuuccuccuaguuucauugaugggauuuuuuuuuuuuaauuugguguuuggaggcagagccucacauaaccuaggcuguccuuugacuucugacacuccuucccucaccuccugaguuuaggaugacagguguguaucugcccaaccuaaagaaugauuuucacgagggcuggagagauggguuagcaguuaaaagcacuggcugcuguugaccaaagauccguucaguucccagaacucacguaguaccucacaucugugugugacucuaguuccacggggaucugggcucucuucuggcuucugugggcaccagugcuuccaugguacacagacaaauguuccugcaggcacaagagccauccacauaaaaaugauggauggauggauggauggauggauggauggauagauagauagauagauagauagauagauagauagauagauagauagauagauagauagauagauagauagcagagcugugcuccucccuuuuccguaggucaccggcuacacucaucucuaggugcucccuccucuccguuuuguacugaugagcauguaggugugcccuuucuuacuacuacuacuacuacuacuacuacuacuucuacuacuacuacuacuucuacuacuucuacuucuacuacuacuacuacuacuacuacuacuucuucuucuucuucuccuuccuccuccuccucuuccucuucuucuuccuccuccuccucuuugcauaaaacauauuacacuauagccuuuuggauucuguucuuuugcauuuuuuagucuguaccagaaaucacuuaauguaaagaaaagauucucuugaugcacauccuguggcuauauacacaguugauuucacccaucccuauguacauaugaguuaucucuaguauucugcucucugcacacacgugagugugugugugugugcccauaggugcauaaguaucacauacccagaacacauggaggccagagaccuuaagauuuauuuuauuuuauuuuuaauuacguguguguguguguguguguguguguguguguguguauguaaguaaguauggguucccucagagauauuucaccaccaccacccccagcuggaguuacaggagauugugagaugccccacauaggugcuggacgguccuugggaaguaaaauaugcauucuuaaaaccugggccaggggcuggugagauggcucaguggguaagagcacccgacugcucuuccgaagguccagaguucaaaucccagcaaccacaugguggcucacaaccauccguaaugagaucugacucccucuucuggagugucugaagacagcuacaguguacuuacauauaaucaauaaauaaaucuuuaaaaaaaaaaaaaaaaaaaaaaaaaaaaaaaccugggccaugcuuggcucacugucucaagccuuagugauugggaugccugagguacacuccagugaauacuugaauaccagugacuagguuaaaugcucuugcugaugucucuguugacuugucagccaacaguggcuguaugcagcagcauuaucuguguagcguaugcagcauaucuguguagcguguauucagagcuaacaagccaggcugaagguugaacuccaagcucagggaacugacaugccccagaacaugccuucaugagcaugcauguuagauguuucacauacuacaggcagauuaaagacucaaggagucuugugcucagcaaagggucugcauuaaaaaaagcuaguagaaguuagugggcaugcuagauaacagcuggaguaagaacagccaagggguccaugaggcuggggaacguggcuuugagauuccagaaaacaaaggagaugaguguuucagcacugacugauccuagcacagcugggauuugugaaauucuuucugugugucaccugaauugcacaugugagcccaauucucacagauaacuauggggaaagugacacaaaaaaacagucauagauccucagugucccaaaggaaaagguguaagcaguauaccuggaggacuguggccuaaguggaauuuuaaaaacaugaaucuggggcugggauuaaaagcacuugcuguaugagccugacaacaugaguuugauuucuggaaugcaguccauggggggagugaagaucugaguccagaaggguuuccacuaacuuucauguacaaacacagcccacacacaacaaggggaauguuauaaagaaguggauuuacccaagaaugauggcccacgucuguuauucucgguuauggcagaggauugccauggguucuaggccugcuuggacuacaaaaugagacccugucucaacaaaacacagagcagggagaagggugguucagaaagcuugacuuuccagagcugggggcaacauggugggguuguuuuuauacuguaaagacuaggacacuggauucgagagugugugggugucugugugucuguguguguguguguguguguguguguguaugugugugcgugcacgcgcgcgcguauguacaaauguguuagggaacacugaugagaaagauugaaguaaaaacaaaaguaaugcccaggugcaguuuucauuacaaagucauaaacgaaaggcauuuagugaaauuaguugcacuuuccuagcuaaaagacuaaaaacucacuaacuagaacuauagauucuagagucagcaagauaaccagcucaguggguauacgugcuugcugugugacucuggugaccugaguucagucccaggaacccagaggguaaagaggggaaccaaguccugaaaguuaccuucugaccucuauauauagucuggcaucuacaugaagauggugauagagaacauuuuuaauuaaaaauauuuuguuuacacaugggcugcuucagggcugcugagauagaccugugguuauaaccauauucuucucuuccagaggccccaggcucaguucucagcguccacauggccucuuaacaaccuucuguaacuccaguuccaggacaccaacccccucuucuggccgcuguggcacuaggcaucuacauggugaauagucaugcaugcaggccaaacacucauacauauaaaauaauaauacaggaggggaaagaaaaagaagagucugcuugcugagucuggugauaaccggucuuuaaucccaguacucagaaggcagaagcaguaaggucguugagggguugaguggugguauugcacaguucaccuaugcuaccuacucacugcaguuuuucuuucuuaccuuuuuaaagugguccugaccauuaaaaaaaaaagaacaaacaaacaaagccacugucccagccccuagcuguguguggcacccaguguugcuggucuuccucccgucugagguugucauuggaaugaaggcuguuucuugaguucacuuacuuaaguugcaacaggaaggaucguuguucucaacugccaaucuugggcagagagaagagacuaaguugguugaagagauguuucucuuucccuuccucuugacagguaguucauuucuuggcacauuuauuuuagaaggaagguuccaguguuagaccucagaaacagucagcucuguccgcucccuuucucugccacucuucucccagucagugcaaccaaggcaaucauuaaagagaaacaagauguccuugugaaguggcguugagguccuuccagcucucggauagagaccucucccuugacacuuggaagagcucgggccagccacugucacuggaaggcuuguuuugaucugugcaauuaaguuugaugaugacauauuuuaauagagucuagucuauaauagaauaaggaaagugaacaucuuuccuuauuuccucauuguaauaaguuucuccaaaagccuuugccacuacuguuuuaguacacggagcugaucugugauacauuuuaauaugcuaaagauaauauggagguggaaaauugagucuguggugauuuauucagagguugacugcuacugaauacauagacaugcauugcaugaggcagugcagccaauguuuuuauguaucuuuuuuuucaaauaaacuagguuuaucauaaauaagaacaaauaaauaguuuguauagacuaguguguaucauugcuucagugaaaacaugacuaugaaacauggggucugccaucucauucuuuucugaacaccacuuacuugcuuuacauaccucaggcuuuuccaggguuuggcacacagguggauguuguugccguguaaccuuuguucagauugcuacccagugggcauaugcagcgaguaguguuggaacccacuacugggcaaauuccauuccgauaaccaauaagcaucaguuggcaguggcauccugaagacagggacuuuugccggguugaaugcccagccauaagcacagugcuugucagucacauaaugggcaugcagugcuugucacauaaugggcaugcaauaaacaaccguuaagggaagaaaugagugucugacucugcucuuuguacuacugggaguaccuccaaguacacacagccagcuucugacagaauuagcucuugaucugagauuuucucauggccuucugucuugucacauguacaccuuuauucuuccuucugcagacaugcuuuggacggacuuuggccagcguggccucggugacgcagccaagaggguacaugauccaggccuuguuguggggugucagacacaggguucauaacucaucucugcggucuuaggugugaggguauacugaggcuucgcagugggaagugcuuccaacucgcuuucacuggccccguuaugguauuuguaaggcagagcaagaucacacaagcuuuguucuuagugcuugaaacuagugcuuuccugauuuugguuccaaggagacuauuaccuuuaaaucuguuuuccagcugauaaaagaagcaaugggcuuaauguuuuaagugaaaaacaaucuacuauaaaaguuugcuugcagggcaaugguggcgcacgccuuuaaucccagcacuugggaggcagaggcagguggauuucugaguucgaagccagccuggucuacagugugaguuucaggacagccagagcuacacagagaaacccugucuccaguuugcuuaccucuucaggauaauuuugauaaugcagaugacugggucagaaaaugguuacauuuucuuguuugcuccuuuaauuuugcuuugggagaaaauauguuuuucuuuauuugcuuagaguuauauuagagaaauacaguuuuacacuauaucauacuacacuguuguguuuaauaacauaaaaacuuaaguuuuauaauuauuuauguugcaucuugcuuuggauuaacauuaaagaagaccuuuucuucaacaaaauuguuuuaauuaauauuuuuaaaguacauaaaaguaauugagugaauuaaauaauuuuauuauuuauauagcaauauguuguccauauugaaacaaaugcgcaacauaguuauacuguagcaggaaccaaagauaagguugcuaaaauugugaugcccauguaccugggaacuaaguaggguuccuuaugugaaaauggauuguucuggaauagggggaaugauacuaaaaacuaaucugaacaaugaaaagaaccaguucauugucuuaaagcuggugaaugaagcauuuauccuguuuccccugucugagcuguaccacuaggugaccaaguggugcuugagaaaagcaaucucuucccaugaauuaauggauccguacauugaacaucaaauagcugcaaauugcacaaagaggagcaaacagacaugaucaaacuucuauucugucuugcuggaaaagacauagaagaacauggugaacgauaauacaagcacaccacgagaaagccccaagaucaggaaccgauaggaaagaaagaauaugggguagaaggagaaauccacacauuaaaagaaaguuaagucuuugucuuaaauggacacaacugcauuggcaccuugauauuguggugguaaaggcauaacaauagcaauagagccugagagaugugucagucagugguuaauagcacugaccacucuuccagaggacacagguucaauucccagcaucugcaugauagccuacaaacauuuguaacuccaguuccaaaggauccagugcccuccuuagccucugagcaccaggcaugcacauaauacaccaauacuugcaggcaaccauucauaaaauaaacaaagcuaacccaggaggugguggcacacaccuuuaaucccaguguuugggaggcagaggcaggcugaucucuguaaauuuggagcccaucuggucuacagauccagcuccaggacagccagagcuacacagagaaaacaaaagcaauaaaucuaaaaauaguaagaauaauaaaaaccuaucccugauugcuaggaaaaggcuuucaguaguuauugaugagagaaggggaaggagguauugccugggccaaacagaagauugcuugguggugaucagcaaaauccuaagugauagucccaagggcaguugccuuuugguaauccacuaagcuauacauuguaugugguugucuguguucguuggaggcguguuuuguuuuaaagugggaggucauauacccuauggcauuuguuuuauggcuguaacccuuaaaacucucaaaacagccuuuuuuuauuuauuggugguauuacaucagugguguuguaaagagagagagaguucuucaccuuuacugcucuacauaagaaacauuaagugcauaagugcuuggugcuuggcaccagcuuccugucagccuuugcaaagcuguuuuuaugugaagcaauugcaccaaacaucacugagacugaggcccucaaguguugaaucucuuagagaacggccuuccuguaacuucugcuuccacuguuaaacaugauugaagacugaagggugaugaaauggaagauucagguaagaaauacuugucugggacuugagagguggcuuagcaguuaaaaguacuggcuucucucacaggacccagguuuaauucccagaacccacaugcaucucgcgacagucugacuccaguuuccggggauccaguuuucucuuuuggccuccauagauagacaccaggcacccccacgaggugcacagacauugcaugugggcaaaauauucauacucauaagaaauauaaaauagccuuaaaauuuuuaaauacuaagaaagaaauguuucugccgugagguggaaagucagaggugaagccgagacgagacauuccagccugggcacucaugcuuuguucuccuacuguugauuacacuccagagugaacgaauauaguucugucagacacugcaagugggagugggaugcccucuccuuccagggcuaaugcacuugugaaauuuggauauuuaaaaaacagugcuuacagaagagaaaaugggaacgaaaaggcuuagguugccagaaugaagcugugcuaggugagauuaaggaagacaccuagaguuaucuguggcuucucccucucuguccccucucucuccccaucucucccccuccucccucucuucucucucccccucccucucucccccucuccccccccaucucucccccuccucccucucuucucucucccccccccacuuucucccucuuccucucucuaacacacacauacauacacaccacaguggggggugggggggugugugugccaaccacaagauggcuuucuguucuuccugcccuuugcuuuguccaauacaggaucuuuccucuugaauucaaggaaguuaauuuuauuuucuguaccacaguagaagguacaucagaggacucugugccagccugccuugcacccugcagauuuucauuugcuuccaguuaaaaacuuacagaccauagcaaguacuuuuagagaagagauaaaaugaauggugcuugugaacuguuuuaaacaccauuuagaauacaguuuagaaaacucuucccugaagaaaagucacuagcuuucaucacuacugggaacuuuucagagaauuuucucugaaauaccuuccugccacaucuccauaaauuaacuuucuuugaccucaucacacauaaugcuaaaggguuaaaaccaaggaaaaaguaauugugugucucagccucuuucucugcagauugcacaggaaguuuguuccugucugcagcaggguaauuacaagagaugguuccauaauuuacaguugaguguacuuguccauaaucacacaccuccaccuuggcgugcagacccuccugugugugcccuguccuuuuauuuguaaaugauuaccauaugaucucuugcagugcagcauugaauugaguuaucaguaaugaacuucagcuauuacuguguaugugugaauuccuguuauuuaugugauuaguggcucuuagauuuaaguugccugguaaugaacaaauuaaacucccugcgauuugucucuagcuaaauaguccugggcacccuaaccagaauagugacuagugugcccgcaguagagauucaaccacugaaaccuuccuucccuguacauucaagaaccuucaaaguuggugauuuggugauuaacaauguccacacaauagaaagacucgugggaaugauaacugugauauuauggauaaugccgugcucauauuaauauauuguuacugauggcucaacucuagcugcauccaguguuagagucagucugaacagcagcagaauuguaccuugugcaaggaacucagagaaauguacugucugcaagcucaaaaggcaaugaugucuuuuaauacuguuuguaauaaguugggcacaaaggcacacaucuguaaugccagugcacuggaggcuaaggcugguagaucauuaguucaaggccacgccauagcaagauucugucuuuaaaaaauaauuccaaggggcuggagagauggcucagugguuaagagcacugacugcucuuccagagguccugaguucaauucccagcaaccacaugguggcucacaaccaucuguaauagaaucugaugcccucuucuaguguuucugaagagagcaauggugaacucauauacauaaauaaauuaaaucuuuuaaaaaaaaauccaagaugugugugguggugcuugcccguaaggagaucgagucaggagaauugugagcuggaggccagccuggucuacagcacaaguuccaggccagccaggacuacaaagugauaccuugucucaaaagcaaugauaauuauaauaaacccuuguuauugcuucugaaaacccugcuuguaugauacagcauauauucuuguuucucucacagaaacaucuaacauagccagacuaaauguuugaguucuaugaccaaagcuacuggcaagucagccaaccacugaaguacgugucccacccaccccuaguucccacacccagcacacacuguccuauuggcaguggcugagccacugcccugacacagcuaucuauuuccagaagcuuugugccucagaguguguucaaaagcauguagcaugugcaugcgggaggggugcgagcauuugucucgcuaacuuggggauacuaaagaugcuucugagccuugagcagaucagaggacgggcugggcuuugauuuuagaaaguugucucaaagacugacaacucccgcuugagauguacuuuguuugaaaacaaagggaaaauggaaagagauuuguucuuccacuuuuccugaugccaugcuuuacacagucugugucugcuaggugagcgcucaguuucuagcccugggugcugguguguguguguguguguguguguguguguguguguguguguguguguacaccagacagagagacgggcaggcagacaauauuuguagagcuguaaaagguaagagaauggccugggauggggagagggaaacagaaauggacuuacaauggacuuacacguguaacuuguaaccgcccugucuucuagagccugagucuugucuuaguaguauucggcuuugaaccuaccucacacgugcuagguacacacuuuaccacgaaccacaucacaucccuuuuaacuguugauagcaaugaguugcccaggcuggccucgaacaauuaauccucccauaacuuccugaguagcuagaauauagauacugugcuaccaagauggcuucugagccugauucaggagcaguggcagcauccacaguaguauaaacaacugcccuccccgauaaacacaaacacauacauacacacacacacacacacacacacacacacacacacacacacucauacucgcucgcacacgcagacucucucucacacgcacgcacacacacacacagcuuuguugggcuagcugagcugugcauuuacugggcucagcuaacugggcugccccuccaguggcuagaagugaagcccuuccaguucacucgguugugggaucuuggcgccagggcaguuucaugccauuugaugaaagugugcuuggucuaugaguuuugugagaauuuugaaaucauguagcuuuucaauaggaaagucuugugaggauuuuguacuuguauguagaauuuuauucaagguuucaacuuggauagcaauuuagggugccuuuuugcugauagguguuauuuuuuagaauauuuuuucaagcagucuuuagugugaagaaaauuuuuucuaaaagaagaaauuaguuuuaaauaccaaauuacuucuuaaguuuucucuuuuguaaaccugugcucuuccuaaaauauccuagaauuuaaaauacugcuauugcauuuaaaugugugugugugugccacagugcacauguggggaccagaggacaacuuguggaagugaguucgccugcuguguggugcucagggauucagcucaucagcaacagccuuuaccugcuaaggcuaucagaaguuaacagcauccugucuccauuucugucucaucaaaaacaguggcuccuaguacucuaccaucucccagugaaguugccucugggaacaaaccggcuugacugauauuugggaauaguaguuggcuuugugaacaaugugauuccuucugaaauauauuuaugaaaacauuuuuaaaaaaucauuuaauuuaaaaaauuuuuaaaugcuuuuagcuugguuauaugugucauugguagaguauuccucucucauucuacaacaucuucuccuauaccccaggaccuuauuucccuaacaaggaaguuauggauugaauucaacaguugaucaucuacucaggaaaagaauucagcacucaggaggcagaggcaggcagaucucugugaguuugaggccagccaggacuauuacacagaaaaacugucuugaaaaaccaaaacaaaaaggcugaguguaguuugcauugacauaccuuacccuagcagacugcaccuguuggcuucagccaucacuugacauagcuaaagccaucccaggaagucuucauugagggauuacucagauccgauuggccuauggcuaggucucugagagauugucuuaauuauccaugugggagggcccagugugggcagggcugccccucugcaggcuuucuaagaaagcuaaacuaacagccuggcaugguggcacauaccuuuaagcccagcacuagagagacaggcaggaggaucucucugugaguucaaaaccagccuggucuacauagugaccucuauggcagccaggacuacauugggagacuacauagaaaggaaggcuagcugaacaggaaucagcaaacaguacuucagcagugauuucagcuucagguccuguccugacuuaccucaaaugaaccucuucuuagucuguaagccaaauaagcuccucccccaagcagcuuuugaucagagugguuucuucccagccacagaagaggaaacuggagcacacucaguccccgguucuguuugacugagagaaaccucugugcagugcaugccacacccucuuuacuaaaacuuuaccuucugcccaggcucuuccuacacgucaggcccacccuuuaaaguucuggguuaaaggcacuccucaagacuuuugcuuaauacuguaucugaaaccaaacucucgugggggaaagaguugagauuuaaugagacggacaugaaggucaggaagugauucuaacgugcagcuauggaugagaaccguagcuagacccaagcacagggaaggaagcuggggagagcucccacuaaagcggguggucgguuauaaagacaccauggacucaguagugucuuggggaugugugucuggcccucagacugcucccauggagcagaugcugccccggucaccaagcucagcagcaugucacagaugugcagcacccucugugacaggcauagcaggaggaggaggaaaguccuaacuucgagucuacaucucaacacccuacaucucaucuccccuugguaucugaugcagaucaacuacuagagcauccacagccaccagggagccaucaaaauuguuuggcaaacccccacgugcucuguaggcuugggcacaugugccaguacagggccaugucucuagugcaggccucccuuugggaggaacaugcagaccauucuucucuggaguaggcgucggguaguggggauauucaguaaggaacacuagugacuuuguuccacauaacugagggagagcuuagcaguggagugcucuucaggaagcuagugcaucuucaagaugucuacggcugagaugugacucagccaacagaacuuucccaaagacagcaugucccuggguuuucaggccgguuuucccaggacacacuugagucuucuagaaucugcgagucuuuguuauauuucucugggagcuugugggucugcugaagccucgggcagccacuguguuuguggguugaugggcuaguuguucauucaggguagucauugaaauaaauacuugacagccaaaaggaauuugggagccaauuauguuugcugggaauuuucaguaguuaauuucuugacuauuccugaggccaaaggagaaggggcuuuuccuuuaauuaaauuuauauuugggugguaggaaacuucugaggcaguagaauggucuugagguagcucaagcaaacguaggaauaggaaggaggcucaucucaguccgacgccaaagagcucuuugacuucuuccucuccacauucucuuaauuuccccuacauuaggaguuuuuagucaucuaaaugaacgccuauagauauaacccuuaauagcuaaucuuuaagccaagcauuauucuguguuuuuauuaacccauguaaugcuuccaguaacuugaaaagauaagugugauuauuaacuguguggucuaaaugaggauucagacauacacagagauuaaagaagugccuuggguuacauagcuguuacaugguagguccugaauucugccacacagcuuguggcuccacagccugugcuccuagccuccugugagcugucgcaauauaugacaguucugagguucuuauggucucauugcccugcuucucaacguuuguauuauucauauauacagauagucugaguacaguucaggcagucugagguauuccauaaguauuccaaaguaaugcuacuuuccucuuuaacucuuuuucauucgugacaguaaaguggaauuuuccagaaaugucaugacacaacagaugagggaccaaaguagauauugacuggaguguaaaauguaaagcaagcuuucuccucucuaguuuguuuauauuuuuaaaaaugcagggaaggcuuuuuuuaaauuaucgaaaauuagaguaacacuagguucguugcuguuuuaaaauuaaucaaugucacuucucuguaaaaaucaacagauacagccuuuauaaacaaaagcucuuuggagucuuaaauaaguguuuaaacuacaaaguucugaagccaagaugucuuagaaccccaccaguguaucucagcagguauagugacaugagcccugguuagagaugcaugcucucaggccucucucuaccuucuaaguuguaauucauguuguagccagaauucuuuuguagugacauccaggcauagaacagagcaaucagccacucauugacucuagcuaacccacauagccugauagggcuuuaggaaauccaucuauucuauucucucccaguaaggaacugaugggaccugacuuaucccauuguacauucagugucucucccacacaagccuguuugccuagcagcuccagagcagguccucaagggcccugaccuugagucaccuuuagggucugugagagugcagguugcucggcgauuagucuaguugcuauguaauuacacugggcccaaagaauuaugguaaagagugucucaaacuuccaguuucaaauccagucuguuucaaaaugucuacuuugagagacauucucaaucuuuugguaaggucaucuuucagacacaucacaggucauuuggaacagggcucucuuaaagauacuaacuucaggaucagcacugaauuuaaacaaaagacggccccucaaauccacucugguaaugaaacugcuaaccgucuacauggucacagugcugcuagcccaggaaacgaauaacagaccacauggcccagugaacugccaccuccaaggaacuccauggcuaaaggcauuggcuuaccuccuaaguuaacaugagcccauggcuggugucaauccccaggccugcaaagcccaggcuguguucuguugugggucuuccauuggcgucugcugagcucagcagguguuggugaaagguauauaauccuuggagauuaucuccccuaaagcaacugaaagcuuugaauucacauaauccagacagaugggagcuggaacugaguagcaagccaaaguuuaugcugugugucugaggagguucagaugguuuggaagcagacaaugacagauggaaguguacacggaugaggggggacacuugugaagaucucugucacacccuugccucuuuuuacucuugcuccacuauaucauccugcauagcacuuguucaaaacgagggaaguuccaaauaaaugagaguugggaucaaauugauuuugauuuauucaugacugccaaaacaaacuuugaccucaucaaauaguuaccuccauaaagugggucuacccugcuuuccuagaggcaguuagccauucagucucuggucaggaccaggcagcgagaacugauacuuuaggccguccucaauggaggccagguggccuguaugcucugcuuggaaaugcuuuuuucccugcaagaggaucaucucugagucaagcaugagagacuuccgcugccccuucgaccucaccuuuccccugguaugcaguuccagugacgcagaggaggaaguggaucaugcuaguuuggggugguuaaugcaggggauggugugugggcuacuccguuuccauuacgagguucucacucaugacugagugcucguugccugaaucuuuggcucaccgacaaguucaagggaauauucgcaccagcaguuaauuauccugaagcuccugggacuugucuuccacacgucacuuuucgucugaaacaguagguuuccccagggguaguugaaguuuucugauugaaaguguccugcguuaaggagaggugugagcacgccguggggaucuauucaccagggguguauuguacuuguuucagaugcuucaggacaauacaccggcuuccaagauaagugcuuuuuauuucccugcaucuuagaucaauuauuuggaaucuuuuugguaaguuaaacuuaagagcuuaaaccaucacaucucuguaauuaauaagucaaauguucuuaccaaaauuuacugugucugcuuuauauuguaacugugcuuugaggagcugagagaaaguaggaagggacagaagguggcaagaagccccucacuuaacacccaugucgcgaaggacagcauaggucagcaucagcagcucagcuccuuccaggcaagcgccugccgcagaugacauuuauagccagccgcucuucugucgucagugcacaaccaggaggcacagcaccuuuccaaacagcacagauugucauucugcaugccauuucagucaacuaguaagaaauaagacauguguucauggucauuuuuacuguuccugguggauucuguuuaacaucagagcauccuccgucauggggagauuccaaauaguucucggcaaaagugccauuuucuuccuggcugcaacuucuuugagggucucuggauucccagaggaggaggagacacacuacaagcagggccaggcaccucagggcauuggcuuugggugguguuuggugcucaucaucccugggaugugugcaggagguucugacuaaacauuggguuuccagucauauucucggcacccugaaaaguaucccucccaacaagugcuugcagagucccugccucuucacagccucugagugcacacacaacaggagggugcuuugcugggagagaccagugggcucaauguccaugacacauagagcguguuaccuuccaccuauggggcagcaguccugcgcugcagucaaaaggccaaggaauugucaggagucagccuuuugacacugcaggaguggaggguacugaaagguuuguacuccagugcuccccaggggcucagcuugcuggcucgccuaaauuaccgcaugcuuuuuagacucgggguacaagaacagcuagguaaaauugaaagggagggugggaaugcuucccucuuaggucaaagugugggaacauagagacauaauaaaaaccgugccuccaggguaagguaguucuguguaguggugagcguaggugggagggggaacugcuuguaggccaaauuucugccuucaacagugggauucacaugaaucagugagggccuggggacuuccauaguuagucacugcagggaacuuuuaauugugggaucuuguggacaaagggaacaguuaucauccaugguucuauaccugcgccucacccccccacccccggcagaaguacagagcuggggcucccagcugacuaaguaaauuucucaggcuaugccaagcacuuagggagcaggugacgggauacgccaguuuucugugcugagguuugggcuuccuccacugcucuggcaacgcagcacucuccauguugacaggacacgauaugggcuggcugcagcacagcagcuguccacguuagcauuccugacaccgcuguugaaaaccucaguguggcagagcggcacgcgccgacaguggcuuggcuguuaaagucugguguuuguuugcauucaauacuuaaacaggacgagaggaguuaaaccaaaaaucuuaggcaaaacacgaugcuuauuuuauuucuauucuguaugaugacauucaaauaaaagcugucaagaugcagcaugcuguugagguagagugucuuuuucuagauuucugcauuauuugcaagugguuuugagaaacaggaagaaaauggauccaaggcauugauuucucuuuguaacaacaacagaaaaacuaaaacagaaaauucuugcaagugcagccauuuuggaacuguagaugaaggggaggaacgcugaugucuggguugguguagaguggccugguuuggugagugcugccaccuacugucugugcugauguuuguuuacacgcaggagguucacggaggugaaccucagggaggugaggcuguugaaacaauuagagcaaagaagccaucacuacuugacagucaauucuucucuccuccauuacugccucuuaauuaccgagacagccaccagcuuccguucauuuccucuaagugggcuuaaagucuucucauuucagaguuucuuugccagaaaagcugugcgguucgagcuucaugugcucguguauuuuauuuguaauuguaggagccacauucucagguuggcuuaguuuuuaugagaaggguaaaaauagagcuagcaucguagauuugcguuugccaccauaggcgugaaagccaguguuuuauuaauacuaaaacagcuucaaaucagccgcugguuaaacggaacaggcagugcaggcugugucagccgaagccccuucacuaagccccagcugucaaagggucaucggguccucuguggaaaacaaccugcccauuaaugucgggguggucccuccccaggauccgagagauccugacauugaguauccgagagaauuucaggcuugcaggggauuuauguguggagauuccccagaagucucuuuagucuuagcuuucaaccuccgugacacacaacaccauguauguuagcugccaccagcugugugaauucgcuuacagugucaccacaaaaguugacaagcagaaauuugacgaggugacaucacuguaauugagagaggugacgagcuugacaggacacacuugaccugugugaugcuuuuaccuuguggcugaugacauuguuccuaguccuggcccuagcucugacaaccaagcugagugcaguuuugcuuuuccugccuaggcuauuugcuuucucgaagagaaggccaagcagggucucccgaaaagccgcucucugaccugggccggcucuccuaccuggccuacuggaaaagugucaucuuggaauaccucuaccgccaccacgagaggcacaucagcaucaaggccauuagcagagccacaggcaugugcccacaugacaucgccaccacucugcagcaccuccacaugauugacaggagggauggcaggugagugcccugcuuucugcuuucuugauccacagcaggaucaagccuguuguuguugcuuuugcugguuuuccauuuucauaaccugggucaaaggaaucuggauuggccagggacuuuguucuuuuaaaacaguagcccagguaaccuucaaacucaugcgauccuccugccucaguucuggauuacagguaugcaccagcauguccaccauuuaaucuugaguugguuugguuugguuugguuugguuugguuugguuuucuagacagggccucacuguauagcccuggcaucccuccaucucaguuuguuagaccaggcuggccuugaacucacagagagucuccugccucugccucccccaagugcuaagguuaaagguguaugcaaccacaccccacuagcucucaguuuuuuuaaucucacuuugucuugucucccuauauuacagguuugucaucauuagaagggaaaaguugauauugggccacauggaaaagcugaagaacuguucccgacccaaugaacuugauccggagagucuaagauggaccccaauguuaauuucuaaugcugugguuucugaggaagagcgagaagcugagaaggaggugaugacgagucauccugaguggugacuuuugucuuguaguugcuuaagcuaagagagucauuugcgucauugugaaagcucaguuauaacgcuuaugaaacgauacagcgcuaauuuauccuaaccgauuaagacaugauaauuuuauugaauuaaguaugaaaaaugagacauuuaucauugaucacaccgaggcacucagcacugacaguauguaaucagaucagacuuggugcugggcugcagugcugccauguuaaucgauucuuuguguuuauaaacuugcguagagugcuccaugccagugagcauguaauguagugauaaagagcuugaaucaauucacugcaucguuaacaccacuuacuaucccaugaaacccagccguaacaccacuuacuaucccaugaaacccagccgucuuaggucugcucuccuaacugauacagcuggaaugugcuugaccagcuggucagaacucacuuagagagagauccuuuuucauugauccuggaggcuccagccguguaacugaccucaccgaugaccauuuugcuccccaccccaggcugaacgacuaauggaacaagccagcugcugggagaaggaggagcaagagauccugucguccagaguuagcaguaggcaaucgucugcaaaaguacaaucaaagaauaaguaccugcacuccccagagaggcggccaguggccggggagcgaggacaguuguuagagcuguccaaagagagcagugaggaagaggaggaggaggaggaggaagaugaugaggaagaggaggaggaggaagaggaggagagcauucagacaucucccccucgguugacuaagccacagucaguuuccauuaaaagaaagguguguaugcagauaagcuguuuucuggucugucuggcuucucuucacaguuuuuguuucacucucuguaguuucccuguaguuuacaucucagugguccagugucacaaucguuuaucuuacacuugugguucugcuuacugcuaacgugugcagcaugcuaaccacccuagucugguguucacugccaccugcuggucugcaggacaccucagaggccugggggggucagaccagaccaggucacaugacucacuagagggccagccacaccucagagcuccaaguccagcguuccugcauuagugucccuuauucucacauaggguucuuagguauuccgcacccuuuaguuugcugcugguguucugcuuguguggccagugacacggaaguaaaacucuucauauccuggguaccagguagucuccucagacagcgccaguuccugcccagugggauagaaagcgcaacauugguuuguguggggguggggguaaauguucuuccacaucugcuaucuuugucugcaguuucuaucugugacauacagcagggcagauauuauuaauacagccuugacaaggagggauaacacgguagaaaugaaagcucuucccaggggcuguccuaagaaguauuuuccaggcaguuugcuagucuaacucccaacuagguucuuucuucugaccucacaguuggaguuagcagagggagcaccccgugaagugcacuuguggcuacucagcauuuuaacuucuuauacagagaagucagucuuguguuauggguagaaugagaggaaggagaucuauaaacagagucauuccagucauggugugggccacagcucuccguauggauucaccugaaggaaaccagcucuuuauauuggcugcacuugcguuugggggaaaggugugggggcuuagggagcagauaacagcaaguguuaaaugacuaauacgguuagauuuuagaauguuaauaggccuguaugugcucuuuaagaacauugaaagcauuaaaaguguaagaugcaggaauucuucaguacuguuuaucuggaaauagugccccccccacccccaccaugcugggaggggagcccagugccuuuugcaugagagguaagugcucugcuagugagcuacacccuggcccuggcccgaagcugacauucacguagacauacugagcccucacagagcagcauucugccaauuucaugguucauugacacauaucuuaacauugaaucuaccuguuccuuuauuuaaauuuuguauauuagaugggugucccccccccuugggaaaauagcuuauuguugcaaccacgggaagucauuugugccauuaucuuauucagagacugcguuacuuuuuaagguaucuuccauaucaaaauagucuauaaaauuuuuaacugcccacaucccaguagccaagacucucuaacucugcaguuuucuagccaguaauuauucaagcaccuuuucauuuuggggacaaggaaguucaccuucagccccaccauguuucucauagugccuaucaugccgugggcaucuccagagcaguuacaagguaauaaaugacugaccugauagccgauuguugcaacauuuauaaaagcguuucuagaaucaucugugauaugccagauacugaagcuggugagugccacuuaaaaaauaggugcuggaaaagcaaugcucagcuuuuaaaaucugcaguugaguugcuaggauguucucucucaaagcaucugcuugaguaaacaaguguuuuauuuggaaaacauaugccuguguucuuggcacccaagagggauguucaacaucaaauggaagguuaaguacaaaggcauugaagaaguccugacauguaagagucucgggcgcacgucaguacacguuuacugcguaucaccucagcuguuuaauuccucaggagcacuuauguauuauguuuugaauuaauuucagaggccuuuuguaguaaagaagaaaaggggucguaaacgcaggaggaucaacagcagugucaccaccgagaccauuuccgagacgacagaagugcucaaugagcccuucgacaacucggaugaggagaggccaaugccgcagcuggagccuaccugugagaucccaguggaggagggcggcaggaagccaguucugaggaaagcauucccacaucagccagggaagaaaaggcagacagaggaagaggaaggggaagacaaucauuucuucaagaccgcugcccuuuguagaaguaaguggaggguuaguucgccgcagggugugccagugcaccugagacacaugccagcccauccuuucucauucccagcgucucgccccuuuuuccuugcaaugggguacuuuguuucuaaaucagaauaauccuguaggugguuucuucuuacucuguagaaauugccucacccuaaacucugaaggcuaguaagaaacacagcacacguucccugauacugcucugugaucuaccuaguuagcauuuuuggacaucaggguauuuguuaccagugugcacuucuguuuuccuugaaaacaacuucucagugcaucaggguguauccuaauauuccucugugugauccagaagcaccugaacuucaaacacccucaauaucagcguugguaauaugggaugauacagaaaucccaaagacagacuuucuuuugaaguugacagggauacccucuucuacaaacauaccagacucaagugaauugucucugaugcccuguuuuaaagcacguaucccuuacucugcuagcacagguacuccaagauggacggugaggagcuguaggacagcuccugguagcuggaaggcugaaaugacucugucuaaaacuugcugcagccuagggaacaacucgccuccuuucucugggaaccacaggaauugcugucuaugucucuuuuucaaagcauaagccagcacuucccugacuccuuagugaauauuugcuaucuccuguuucauuuuuuaaaauuuuauccuuuccuuuuuuaaagacaggcucucacuauguagccccagcuggccuggaacucacuauauagacacacuggccucaagcucugaggucagccuuucccugcccuucaggugcugggauugaccagcauaccugacccauucucccucuccuucucuccucuuuucaucucacucucuaucccucucuucuugucugucucugucucugucucucucugucucugucucucucugucucugugugucucucucugucucuaucucucucucucucucucucucucucucucccucucccccucccccucccucccucccucuccaguuuuacuuagaauucaaccuguuugugccggucuuguaccuggugagcccccaagaccugucaguuuuccucugcccccucaguacugguuccgggcauaagacagcccacauugcccguauguguguaugaggaaucugaaugcaagccuucagcacuguguggcaagcucuuacacugcacccacugcgccuucuccccagacuccuguguacaugugaggcucauggagagcucccucugcagauguggacgcugagccugacucucacuuggaggugucggcucggaagccugcagaugagcugcugcugcugccucucaccuuggcuuuguucucuuuaccuuugauggucacauuccaccauauuucuuucacgauccucuccuuaaaggagauuauuagaaaacucaucuucucaucuagggauguauuccuauagaaacuguauggccagugacucauagaauaaacguggguaaaggcacuugcuaccaagccugacagccugauuuugaucccaaaaacucacaugguagcaagaggaaaccaguuccuucaaguuggugaugcucgucuucaaucccaauacucaggcagagacagaggcaagcagaucucugaguucaaggccagccuggucuacagugcuguuucuaggacagccacagcuacacaaagaaacugucaccaaaaggggugaggaggggcgcuaagagacauugagauggcugauuccugccauugugaaugaaaggaaguggugugaguauccuuggggaaguggccaagcucuggagcuuguacagaguccucucuaaaucaaguacaugcugucagcuaguggugagcucgaugucuguagggaaguuuaugugcccucacuuuauuauauaaaugagcugaucuugcuggacuccagccauucuggcaucaacuuugugacuuugcuuuuauuauccucuaaaauacuguuuguuuguuuguuuguuuguuuguuugcuugcuugcuugcuugcuugcuugcuugcuugcuugcuugcuugcuugcuugcagacagaagcuguccuagaacucacuguauagaccaggcaccaccacccagcaaaaauaguguuuuaauaagaaaugucuuaaggccccaguguuuuaugucuacauacuuauucaugaauaugucuauuuguuugcuguauuuuuaguagcaaacauucguuuuguuuuguuuuguuuuguuuuguuuauuccucucagaauuuuauaagguggaguuugggugagagaaaacccugaagcaguugucugccuguacagggcaacugguauagagagccuuugaaacaaacauucuuauuucuguguacauagagguccagaagaauagguuuuagacuuguaagaaaauguucacuuccaucugguugcugauugucauucuaaaucagaucuuauauuugaacagcagacugaucccuaauauaccaugaacagaaucccugauuuaaaacaacaaugggggcuggagagcuagcucagcggguaagaguacugacugcucuuccagagguccugaguucauguccuggcaaccacaugguggcucacaaccaucuguaauggguucugaugcccuuuucuggugugucugaagacagcgaugguauacucacaugcaucaaauaaauauuuaaaaacaacaacaacaaaaaccccuguguuuuaaauauucaguaauauuaugguaauuguauuuuagcuugugucauugauaaauugugaugcuaacaaugacagugauuacaacugcgcuguucuguguagucacucaugcaguucagagguacacaguaaguaaugucugggcuggagagaugcuuuggugguaagagcaguggcugcucuuccagaggacccaagcuccauccccagcacgcacauagugguagacagccaucuauaacuccaguuccaggggaucugaugcccucuucuggccuucauaucaggcauguguaugguacauagacaugcauacaugcaagcaaaacacccacacacauaaaauaaaaugaacaauaaauaauaagaacaaaguuaugucagcugggaucaucuaaaucuagcaaauguucacagagaggagguccuuuccuccggaugguaccagauuaacccuuugagugcagugaugguuuggguaugaccuaacauuaauccuguccugugguauuuucagauuuguugauguugaaauugauuguuuuacuuuuuuaguauuguggagcucccaguuuuugcaucuuagaaugucuuugacuuccuaggccuagguuacucggguuggcuuauuccacaauauuccuaguuaccucucucaucaacucuuaaagugcuaaaguaaagcagugcuugcuuauuuaaaaggguguguuaaguugucucugguuuuccuuccuaaaauguguguuuuucugucuuuuugucuccucauuaagaagauguagaugaugaugcagaacacuugaaagaaggcagcaaagacaauccugagccucuaaagugcagacaaguguggccaaaaggagcgaagcgagggcucuccaaguggaagcaaagcaaggagaggaagacgggcuucaagcugaaccuguacaccccaccagagacacccauggagccagaggaccaggugacgaucgaagagcagaaggagcuuucagaggacaagggcagccccguggggauggaacgggaggugacagagaccguggaugccuugcugccucaggaggggagcagaagggaagagacaggcauacccgugaguccacauaaaucaccagguggaaagguagaugaggaggaccucaucagaggugaggaggagggagaggaagagggagaggaggagggagaacgagaagaacaggaagaggaagaagaaguaacuacagaaaaagaccuagauggugcuaaaaguaaagagaacccggagccugagaucuccauggaaaaggaagacccugugcaucugggugaccaugaagaggacgaggaugaggaggaagagccaucucacaaugaggaccaugaugcagaugaugaagaugauggccacauggaggcugccaacauggagaggggagaccucccaagagaaaccuucaaagacgcacuagagggccaggaggcuuuuuuagaccugagcauucagccgagucacucgaacccugaagucuugaugaacugcgguguugaucucacaauguccuguaacagugagccaaaggagcuugcuggggacacuggaacugcaccugagucugacgcggagcccccggaagaacagacacagaagcaggaccaaaagaacagcgaugguguggaugcugagcucgaagagggaggcccagccgcuguggaaauugacuccgagaccgcccaggcuguucagucuuugacccaagaaaacagggagcacgaugacaccuuuccagauugugcugagacucaagaggccuguagaagccugcagaacuauacacacacagaccaaaguccucaaauugccaccacgcuggacgagugccaacagucagaccacaguagcccaguuucaucuguccauucccauccuggccagucaguucguucugucaauagccccagugucccugcccuagagaauagcuaugcccaaaucagccccgaucagacugccaucacagugccaccucugcagaacauggagaccaguccaaugauggacgucccgucagugucagaucacucacagcaggucguugacagcggauucagugaccugggcaguauugagagcacaacagagaacuaugagaacccaagcagcuaugacucaaccaugggaggcaguaucuguggaaacggcucuucccagaacagcugcuccuacagcagucucaccucuagcaaucugacacagaacagcugugcugucacccagcagauguccaacaucagugggagcugcagcaugcugcagcagaccagcaucagcuccccuccaaccugcagcgucaagucuccccaaggcugugugguggagaggccucccaguagcagccagcagcuggcucagugcagcauggccgccaauuucaccccacccaugcagcuggcugacauccccgagaccagcaaugccaacauuggcuuauaugagcgaaugggucaaagugauuuuggggcugggcacuacccacagccaucugccaccuucagccuugccaaacugcagcaguuaacuaauacacuuauugaucauucauugccuuacagccauuccgcugcugugaccuccuaugcaaacagugccucuuuguccacaccauuaaguaacacagggcuuguucagcuuucgcagucuccacacucugucccuggagggccccaagcacaagcuaccaugaccccacccccuaaccugacuccuccucccaugaaucugccaccaccucuccugcagcggaacauggcugcaucaaauauuggcaucucccacagccaaagacugcaaacucagauugccagcaagggccacgucuccaugagaaccaaggcggcaucucugucaccagcugccgccacccaucagucacaaaucuaugggcguucccagacuguagccaugcaggguccugcacggacuuuaacgaugcaaagaggcaugaacaugagugugaacuugaugccagcgccagccuacaaugucaacucggugaacaugaacaugaacacucugaaugccaugaauggguauagcaugucccagccgaugaugaacagugguuaccacagcaaccacggcuauaugaaucaaaccccccaguacccuaugcagaugcagaugggcaugaugggaagccagccauacgcccagcagccaaugcagaccccaccccacgcuaacaugauguacacggcccccggacaccacggcuacaugaacacaggcauguccaaacagucucucaauggguccuacaugagaagguagacagccuggcagcccacccagcccacugggccccacuauuggauugaucugcacaaauaccuuugaagaguacgauuucaaaaccagcauuggugugaaugcaaaaacauuuguuggcaccauuuauuuaaaaaaaaaaaagcuguaugcagcagaaagaaagccuuauacaaguuguuuuucuuuuuuccuuuuuuucuuuuuugguaccuuuauuucuguuacuuuuauauaaaauucucugcaaaggaaggccucucuuaggacucuaguuggcagcggccacacgucgugccugcuuccauuaaacaguguggauacaagccccuccccaaaucaccuguuuuaauacugaaccuccagcuuuucuccuuccugucuacuccauggaaaugccuuuagcauuucaauuacuguauauuuuguuuaaggugacccuucagcaugccgcuaaugucuuuguuagugacagugcauuuuguaguacuguacaaguguugugcuaacgguaagccauuucuuaaguuuuuugccuugauuaggguacccuaauuugaggguuaaaaaaaacaaaacaaaacaaagcucuauuuuuguuaauuauaaaacuguaaagagcuacagagcuauccccgucugguuagugaaggggguuuaucgcuaaauguuugguguaaaguugagaagaccuuuuuccauuuugguggcaggcuccuuuggggggaggcagcuuucuguuuuauaaaugcacacuucuguuuauugaaugaagcauaucucaguguuuaucugucagguuuugaagcauuucauauauguccaaauacuuggcaggauuuaaaaaaaaauagugaauuugguguaaaguugcuauuuuauggaaaugccucuaacuuuacauuuucauuccaucuguagauuuuucuaucuuuauaaaauauuggaguuauuuuuuaaggaaaaauagaaaaguagcuugugaauagcucaaacuaagcuuacaaaucgcauguaaaaaagcagaaaaguuauuugugucuguuucuauugcguccuuuuuuagccuuuguaccuggacaggugacaguaagggccaagcaggagaggcgggcgcggccuuguauaaaauaggagccagcgggacucuuguaucuaccuguucucuuuuuagucaguuacuucaaaaaaaagaaaaagcaaaaacaaaaaaacaaaagcuguacauuuuaacauaaaauaaauuaugaugagccauuucuagccucucguguccugucauguuaugauugauggagaaugaccagcugagcugugucaugugucacauuucagaacacauacacgaugggggaaauaaauuauuuaguguaaauugaaguuaugagauuuuuuuuuucugauuuguuuugacuuugggggagggguuggcaauaaguaugaaugaguacuaucuaauaaaaccaucaccuauaccaaauaccuauuuaauaaauuaauuuauaauggauuuuaaugcuuuuccaugaaaguugacuuuaugcuggugcauaccuucuguaugccaaucauugucuuuaaauaaagugaguuugguuuuuucuuuuug

SEQ ID NO: 7299 - RNA, 191047 nt, Mus musculus
caaaaagaaaaaaccaaacucacuuuauuuaaagacaaugauuggcauacagaagguaugcaccagcauaaagucaacuuucauggaaaagcauuaaaauccauuauaaauuaauuuauuaaauagguauuugguauaggugaugguuuuauuagauaguacucauucauacuuauugccaaccccucccccaaagucaaaacaaaucagaaaaaaaaaaucucauaacuucaauuuacacuaaauaauuuauuucccccaucguguauguguucugaaaugugacacaugacacagcucagcuggucauucuccaucaaucauaacaugacaggacacgagaggcuagaaauggcucaucauaauuuauuuuauguuaaaauguacagcuuuuguuuuuuuguuuuugcuuuuucuuuuuuuugaaguaacugacuaaaaagagaacagguagauacaagagucccgcuggcuccuauuuuauacaaggccgcgcccgccucuccugcuuggcccuuacugucaccuguccagguacaaaggcuaaaaaaggacgcaauagaaacagacacaaauaacuuuucugcuuuuuuacaugcgauuuguaagcuuaguuugagcuauucacaagcuacuuuucuauuuuuccuuaaaaaauaacuccaauauuuuauaaagauagaaaaaucuacagauggaaugaaaauguaaaguuagaggcauuuccauaaaauagcaacuuuacaccaaauucacuauuuuuuuuuaaauccugccaaguauuuggacauauaugaaaugcuucaaaaccugacagauaaacacugagauaugcuucauucaauaaacagaagugugcauuuauaaaacagaaagcugccuccccccaaaggagccugccaccaaaauggaaaaaggucuucucaacuuuacaccaaacauuuagcgauaaacccccuucacuaaccagacggggauagcucuguagcucuuuacaguuuuauaauuaacaaaaauagagcuuuguuuuguuuuguuuuuuuuaacccucaaauuaggguacccuaaucaaggcaaaaaacuuaagaaauggcuuaccguuagcacaacacuuguacaguacuacaaaaugcacugucacuaacaaagacauuagcggcaugcugaagggucaccuuaaacaaaauauacaguaauugaaaugcuaaaggcauuuccauggaguagacaggaaggagaaaagcuggagguucaguauuaaaacaggugauuuggggaggggcuuguauccacacuguuuaauggaagcaggcacgacguguggccgcugccaacuagaguccuaagagaggccuuccuuugcagagaauuuuauauaaaaguaacagaaauaaagguaccaaaaaagaaaaaaaggaaaaaagaaaaacaacuuguauaaggcuuucuuucugcugcauacagcuuuuuuuuuuuuaaauaaauggugccaacaaauguuuuugcauucacaccaaugcugguuuugaaaucguacucuucaaagguauuugugcagaucaauccaauaguggggcccagugggcugggugggcugccaggcugucuaccuucucauguaggacccauugagagacuguuuggacaugccuguguucauguagccgugguguccgggggccguguacaucauguuagcgugggguggggucugcauuggcugcugggcguauggcuggcuucccaucaugcccaucugcaucugcauaggguacugggggguuugauucauauagccgugguugcugugguaaccacuguucaucaucggcugggacaugcuauacccauucauggcauucagaguguucauguucauguucaccgaguugacauuguaggcuggcgcuggcaucaaguucacacucauguucaugccucuuugcaucguuaaaguccgugcaggacccugcauggcuacagucugggaacgcccauagauuugugacugauggguggcggcagcuggugacagagaugccgccuugguucucauggagacguggcccuugcuggcaaucugaguuugcagucuuuggcugugggagaugccaauauuugaugcagccauguuccgcugcaggagaggugguggcagauucaugggaggaggagucagguuaggggguggggucaugguagcuugugcuuggggcccuccagggacagaguguggagacugcgaaagcugaacaagcccuguguuacuuaaugguguggacaaagaggcacuguuugcauaggaggucacagcagcggaauggcuguaaggcaaugaaugaucaauaaguguauuaguuaacugcugcaguuuggcaaggcugaagguggcagauggcuguggguagugcccagccccaaaaucacuuugacccauucgcucauauaagccaauguuggcauugcuggucucggggaugucagccagcugcauggguggggugaaauuggcggccaugcugcacugagccagcugcuggcugcuacugggaggccucuccaccacacagccuuggggagacuugacgcugcagguuggaggggagcugaugcuggucugcugcagcaugcugcagcucccacugauguuggacaucugcugggugacagcacagcuguucugugucagauugcuagaggugagacugcuguaggagcagcuguucugggaagagccguuuccacagauacugccucccaugguugagucauagcugcuuggguucucauaguucucuguugugcucucaauacugcccaggucacugaauccgcugucaacgaccugcugugagugaucugacacugacgggacguccaucauuggacuggucuccauguucugcagagguggcacugugauggcagucugaucggggcugauuugggcauagcuauucucuagggcagggacacuggggcuauugacagaacgaacugacuggccaggaugggaauggacagaugaaacugggcuacuguggucugacuguuggcacucguccagcgugguggcaauuugaggacuuuggucuguguguguauaguucugcaggcuucuacaggccucuugagucucagcacaaucuggaaaggugucaucgugcucccuguuuucuugggucaaagacugaacagccugggcggucucggagucaauuuccacagcggcugggccucccucuucgagcucagcauccacaccaucgcuguucuuuugguccugcuucugugucuguucuuccgggggcuccgcgucagacucaggugcaguuccaguguccccagcaagcuccuuuggcucacuguuacaggacauugugagaucaacaccgcaguucaucaagacuucaggguucgagugacucggcugaaugcucaggucuaaaaaagccuccuggcccucuagugcgucuuugaagguuucucuugggaggucuccccucuccauguuggcagccuccauguggccaucaucuucaucaucugcaucaugguccucauugugagauggcucuuccuccucauccucguccucuucauggucacccagaugcacagggucuuccuuuuccauggagaucucaggcuccggguucucuuuacuuuuagcaccaucuaggucuuuuucuguaguuacuucuucuuccucuuccuguucuucucguucucccuccuccucucccucuuccucucccuccuccucaccucugaugagguccuccucaucuaccuuuccaccuggugauuuauguggacucacggguaugccugucucuucccuucugcuccccuccugaggcagcaaggcauccacggucucugucaccucccguuccauccccacggggcugcccuuguccucugaaagcuccuucugcucuucgaucgucaccugguccucuggcuccaugggugucucuggugggguguacagguucagcuugaagcccgucuuccucuccuugcuuugcuuccacuuggagagcccucgcuucgcuccuuuuggccacacuugucugcacuuuagaggcucaggauugucuuugcugccuucuuucaaguguucugcaucaucaucuacaucuucuuaaugaggagacaaaaagacagaaaaacacacauuuuaggaaggaaaaccagagacaacuuaacacacccuuuuaaauaagcaagcacugcuuuacuuuagcacuuuaagaguugaugagagagguaacuaggaauauuguggaauaagccaacccgaguaaccuaggccuaggaagucaaagacauucuaagaugcaaaaacugggagcuccacaauacuaaaaaaguaaaacaaucaauuucaacaucaacaaaucugaaaauaccacaggacaggauuaauguuaggucauacccaaaccaucacugcacucaaaggguuaaucugguaccauccggaggaaaggaccuccucucugugaacauuugcuagauuuagaugaucccagcugacauaacuuuguucuuauuauuuauuguucauuuuauuuuauguguguggguguuuugcuugcauguaugcaugucuauguaccauacacaugccugauaugaaggccagaagagggcaucagauccccuggaacuggaguuauagauggcugucuaccacuaugugcgugcuggggauggagcuuggguccucuggaagagcagccacugcucuuaccaccaaagcaucucuccagcccagacauuacuuacuguguaccucugaacugcaugagugacuacacagaacagcgcaguuguaaucacugucauuguuagcaucacaauuuaucaaugacacaagcuaaaauacaauuaccauaauauuacugaauauuuaaaacacagggguuuuuguuguuguuguuuuuaaauauuuauuugaugcaugugaguauaccaucgcugucuucagacacaccagaaaagggcaucagaacccauuacagaugguugugagccaccaugugguugccaggacaugaacucaggaccucuggaagagcagucaguacucuuacccgcugagcuagcucuccagcccccauuguuguuuuaaaucagggauucuguucaugguauauuagggaucagucugcuguucaaauauaagaucugauuuagaaugacaaucagcaaccagauggaagugaacauuuucuuacaagucuaaaaccuauucuucuggaccucuauguacacagaaauaagaauguuuguuucaaaggcucucuauaccaguugcccuguacaggcagacaacugcuucaggguuuucucucacccaaacuccaccuuauaaaauucugagaggaauaaacaaaacaaaacaaaacaaaacaaaacgaauguuugcuacuaaaaauacagcaaacaaauagacauauucaugaauaaguauguagacauaaaacacuggggccuuaagacauuucuuauuaaaacacuauuuuugcugggugguggugccuggucuauacagugaguucuaggacagcuucugucugcaagcaagcaagcaagcaagcaagcaagcaagcaagcaagcaagcaagcaagcaaacaaacaaacaaacaaacaaacaaacaguauuuuagaggauaauaaaagcaaagucacaaaguugaugccagaauggcuggaguccagcaagaucagcucauuuauauaauaaagugagggcacauaaacuucccuacagacaucgagcucaccacuagcugacagcauguacuugauuuagagaggacucuguacaagcuccagagcuuggccacuuccccaaggauacucacaccacuuccuuucauucacaauggcaggaaucagccaucucaaugucucuuagcgccccuccucaccccuuuuggugacaguuucuuuguguagcuguggcuguccuagaaacagcacuguagaccaggcuggccuugaacucagagaucugcuugccucugucucugccugaguauugggauugaagacgagcaucaccaacuugaaggaacugguuuccucuugcuaccaugugaguuuuugggaucaaaaucaggcugucaggcuugguagcaagugccuuuacccacguuuauucuaugagucacuggccauacaguuucuauaggaauacaucccuagaugagaagaugaguuuucuaauaaucuccuuuaaggagaggaucgugaaagaaauaugguggaaugugaccaucaaagguaaagagaacaaagccaaggugagaggcagcagcagcagcucaucugcaggcuuccgagccgacaccuccaagugagagucaggcucagcguccacaucugcagagggagcucuccaugagccucacauguacacaggagucuggggagaaggcgcagugggugcaguguaagagcuugccacacagugcugaaggcuugcauucagauuccucauacacacauacgggcaaugugggcugucuuaugcccggaaccaguacugagggggcagaggaaaacugacaggucuugggggcucaccagguacaagaccggcacaaacagguugaauucuaaguaaaacuggagagggagggagggagggggagggggagagggagagagagagagagagagagagagagagauagagacagagagagacacacagagacagagagagacagagacagagagagacagagacagagacagacaagaagagagggauagagagugagaugaaaagaggagagaaggagagggagaaugggucagguaugcuggucaaucccagcaccugaagggcagggaaaggcugaccucagagcuugaggccagugugucuauauagugaguuccaggccagcuggggcuacauagugagagccugucuuuaaaaaaggaaaggauaaaauuuuaaaaaaugaaacaggagauagcaaauauucacuaaggagucagggaagugcuggcuuaugcuuugaaaaagagacauagacagcaauuccugugguucccagagaaaggaggcgaguuguucccuaggcugcagcaaguuuuagacagagucauuucagccuuccagcuaccaggagcuguccuacagcuccucaccguccaucuuggaguaccugugcuagcagaguaagggauacgugcuuuaaaacagggcaucagagacaauucacuugagucugguauguuuguagaagaggguaucccugucaacuucaaaagaaagucugucuuugggauuucuguaucaucccauauuaccaacgcugauauugaggguguuugaaguucaggugcuucuggaucacacagaggaauauuaggauacacccugaugcacugagaaguuguuuucaaggaaaacagaagugcacacugguaacaaauacccugauguccaaaaaugcuaacuagguagaucacagagcaguaucagggaacgugugcuguguuucuuacuagccuucagaguuuagggugaggcaauuucuacagaguaagaagaaaccaccuacaggauuauucugauuuagaaacaaaguaccccauugcaaggaaaaaggggcgagacgcugggaaugagaaaggaugggcuggcaugugucucaggugcacuggcacacccugcggcgaacuaacccuccacuuacuucuacaaagggcagcggucuugaagaaaugauugucuuccccuuccucuuccucugucugccuuuucuucccuggcugaugugggaaugcuuuccucagaacuggcuuccugccgcccuccuccacugggaucucacagguaggcuccagcugcggcauuggccucuccucauccgaguugucgaagggcucauugagcacuucugucgucucggaaauggucucgguggugacacugcuguugauccuccugcguuuacgaccccuuuucuucuuuacuacaaaaggccucugaaauuaauucaaaacauaauacauaagugcuccugaggaauuaaacagcugaggugauacgcaguaaacguguacugacgugcgcccgagacucuuacaugucaggacuucuucaaugccuuuguacuuaaccuuccauuugauguugaacaucccucuugggugccaagaacacaggcauauguuuuccaaauaaaacacuuguuuacucaagcagaugcuuugagagagaacauccuagcaacucaacugcagauuuuaaaagcugagcauugcuuuuccagcaccuauuuuuuaaguggcacucaccagcuucaguaucuggcauaucacagaugauucuagaaacgcuuuuauaaauguugcaacaaucggcuaucaggucagucauuuauuaccuuguaacugcucuggagaugcccacggcaugauaggcacuaugagaaacaugguggggcugaaggugaacuuccuuguccccaaaaugaaaaggugcuugaauaauuacuggcuagaaaacugcagaguuagagagucuuggcuacugggaugugggcaguuaaaaauuuuauagacuauuuugauauggaagauaccuuaaaaaguaacgcagucucugaauaagauaauggcacaaaugacuucccgugguugcaacaauaagcuauuuucccaagggggggggacacccaucuaauauacaaaauuuaaauaaaggaacagguagauucaauguuaagauaugugucaaugaaccaugaaauuggcagaaugcugcucugugagggcucaguaugucuacgugaaugucagcuucgggccagggccaggguguagcucacuagcagagcacuuaccucucaugcaaaaggcacugggcuccccucccagcaugguggggguggggggggcacuauuuccagauaaacaguacugaagaauuccugcaucuuacacuuuuaaugcuuucaauguucuuaaagagcacauacaggccuauuaacauucuaaaaucuaaccguauuagucauuuaacacuugcuguuaucugcucccuaagcccccacaccuuucccccaaacgcaagugcagccaauauaaagagcugguuuccuucaggugaauccauacggagagcuguggcccacaccaugacuggaaugacucuguuuauagaucuccuuccucucauucuacccauaacacaagacugacuucucuguauaagaaguuaaaaugcugaguagccacaagugcacuucacggggugcucccucugcuaacuccaacugugaggucagaagaaagaaccuaguugggaguuagacuagcaaacugccuggaaaauacuucuuaggacagccccugggaagagcuuucauuucuaccguguuaucccuccuugucaaggcuguauuaauaauaucugcccugcuguaugucacagauagaaacugcagacaaagauagcagauguggaagaacauuuacccccacccccacacaaaccaauguugcgcuuucuaucccacugggcaggaacuggcgcugucugaggagacuaccugguacccaggauaugaagaguuuuacuuccgugucacuggccacacaagcagaacaccagcagcaaacuaaagggugcggaauaccuaagaacccuaugugagaauaagggacacuaaugcaggaacgcuggacuuggagcucugagguguggcuggcccucuagugagucaugugaccuggucuggucugacccccccaggccucugagguguccugcagaccagcagguggcagugaacaccagacuagggugguuagcaugcugcacacguuagcaguaagcagaaccacaaguguaagauaaacgauugugacacuggaccacugagauguaaacuacagggaaacuacagagagugaaacaaaaacugugaagagaagccagacagaccagaaaacagcuuaucugcauacacaccuuucuuuuaauggaaacugacuguggcuuagucaaccgagggggagaugucugaaugcucuccuccucuuccuccuccuccucuuccucaucaucuuccuccuccuccuccuccucuuccucacugcucucuuuggacagcucuaacaacuguccucgcuccccggccacuggccgccucucuggggagugcagguacuuauucuuugauuguacuuuugcagacgauugccuacugcuaacucuggacgacaggaucucuugcuccuccuucucccagcagcuggcuuguuccauuagucguucagccugggguggggagcaaaauggucaucggugaggucaguuacacggcuggagccuccaggaucaaugaaaaaggaucucucucuaagugaguucugaccagcuggucaagcacauuccagcuguaucaguuaggagagcagaccuaagacggcuggguuucaugggauaguaagugguguuacggcuggguuucaugggauaguaagugguguuaacgaugcagugaauugauucaagcucuuuaucacuacauuacaugcucacuggcauggagcacucuacgcaaguuuauaaacacaaagaaucgauuaacauggcagcacugcagcccagcaccaagucugaucugauuacauacugucagugcugagugccucggugugaucaaugauaaaugucucauuuuucauacuuaauucaauaaaauuaucaugucuuaaucgguuaggauaaauuagcgcuguaucguuucauaagcguuauaacugagcuuucacaaugacgcaaaugacucucuuagcuuaagcaacuacaagacaaaagucaccacucaggaugacucgucaucaccuccuucucagcuucucgcucuuccucagaaaccacagcauuagaaauuaacauugggguccaucuuagacucuccggaucaaguucauugggucgggaacaguucuucagcuuuuccauguggcccaauaucaacuuuucccuucuaaugaugacaaaccuguaauauagggagacaagacaaagugagauuaaaaaaacugagagcuaguggggugugguugcauacaccuuuaaccuuagcacuugggggaggcagaggcaggagacucucugugaguucaaggccagccuggucuaacaaacugagauggagggaugccagggcuauacagugaggcccugucuagaaaaccaaaccaaaccaaaccaaaccaaaccaaaccaacucaagauuaaaugguggacaugcuggugcauaccuguaauccagaacugaggcaggaggaucgcaugaguuugaagguuaccugggcuacuguuuuaaaagaacaaagucccuggccaauccagauuccuuugacccagguuaugaaaauggaaaaccagcaaaagcaacaacaacaggcuugauccugcuguggaucaagaaagcagaaagcagggcacucaccugccaucccuccugucaaucauguggaggugcugcagagugguggcgaugucaugugggcacaugccuguggcucugcuaauggccuugaugcugaugugccucucgugguggcgguagagguauuccaagaugacacuuuuccaguaggccagguaggagagccggcccaggucagagagcggcuuuucgggagacccugcuuggccuucucuucgagaaagcaaauagccuaggcaggaaaagcaaaacugcacucagcuugguugucagagcuagggccaggacuaggaacaaugucaucagccacaagguaaaagcaucacacaggucaaguguguccugucaagcucgucaccucucucaauuacagugaugucaccucgucaaauuucugcuugucaacuuuuguggugacacuguaagcgaauucacacagcugguggcagcuaacauacaugguguugugugucacggagguugaaagcuaagacuaaagagacuucuggggaaucuccacacauaaauccccugcaagccugaaauucucucggauacucaaugucaggaucucucggauccuggggagggaccaccccgacauuaaugggcagguuguuuuccacagaggacccgaugacccuuugacagcuggggcuuagugaaggggcuucggcugacacagccugcacugccuguuccguuuaaccagcggcugauuugaagcuguuuuaguauuaauaaaacacuggcuuucacgccuaugguggcaaacgcaaaucuacgaugcuagcucuauuuuuacccuucucauaaaaacuaagccaaccugagaauguggcuccuacaauuacaaauaaaauacacgagcacaugaagcucgaaccgcacagcuuuucuggcaaagaaacucugaaaugagaagacuuuaagcccacuuagaggaaaugaacggaagcugguggcugucucgguaauuaagaggcaguaauggaggagagaagaauugacugucaaguagugauggcuucuuugcucuaauuguuucaacagccucaccucccugagguucaccuccgugaaccuccugcguguaaacaaacaucagcacagacaguagguggcagcacucaccaaaccaggccacucuacaccaacccagacaucagcguuccuccccuucaucuacaguuccaaaauggcugcacuugcaagaauuuucuguuuuaguuuuucuguuguuguuacaaagagaaaucaaugccuuggauccauuuucuuccuguuucucaaaaccacuugcaaauaaugcagaaaucuagaaaaagacacucuaccucaacagcaugcugcaucuugacagcuuuuauuugaaugucaucauacagaauagaaauaaaauaagcaucguguuuugccuaagauuuuugguuuaacuccucucguccuguuuaaguauugaaugcaaacaaacaccagacuuuaacagccaagccacugucggcgcgugccgcucugccacacugagguuuucaacagcggugucaggaaugcuaacguggacagcugcugugcugcagccagcccauaucguguccugucaacauggagagugcugcguugccagagcaguggaggaagcccaaaccucagcacagaaaacuggcguaucccgucaccugcucccuaagugcuuggcauagccugagaaauuuacuuagucagcugggagccccagcucuguacuucugccgggggugggggggugaggcgcagguauagaaccauggaugauaacuguucccuuuguccacaagaucccacaauuaaaaguucccugcagugacuaacuauggaaguccccaggcccucacugauucaugugaaucccacuguugaaggcagaaauuuggccuacaagcaguucccccucccaccuacgcucaccacuacacagaacuaccuuacccuggaggcacgguuuuuauuaugucucuauguucccacacuuugaccuaagagggaagcauucccacccucccuuucaauuuuaccuagcuguucuuguaccccgagucuaaaaagcaugcgguaauuuaggcgagccagcaagcugagccccuggggagcacuggaguacaaaccuuucaguacccuccacuccugcagugucaaaaggcugacuccugacaauuccuuggccuuuugacugcagcgcaggacugcugccccauagguggaagguaacacgcucuaugugucauggacauugagcccacuggucucucccagcaaagcacccuccuguugugugugcacucagaggcugugaagaggcagggacucugcaagcacuuguugggagggauacuuuucagggugccgagaauaugacuggaaacccaauguuuagucagaaccuccugcacacaucccagggaugaugagcaccaaacaccacccaaagccaaugcccugaggugccuggcccugcuuguagugugucuccuccuccucugggaauccagagacccucaaagaaguugcagccaggaagaaaauggcacuuuugccgagaacuauuuggaaucuccccaugacggaggaugcucugauguuaaacagaauccaccaggaacaguaaaaaugaccaugaacacaugucuuauuucuuacuaguugacugaaauggcaugcagaaugacaaucugugcuguuuggaaaggugcugugccuccugguugugcacugacgacagaagagcggcuggcuauaaaugucaucugcggcaggcgcuugccuggaaggagcugagcugcugaugcugaccuaugcuguccuucgcgacauggguguuaagugaggggcuucuugccaccuucugucccuuccuacuuucucucagcuccucaaagcacaguuacaauauaaagcagacacaguaaauuuugguaagaacauuugacuuauuaauuacagagaugugaugguuuaagcucuuaaguuuaacuuaccaaaaagauuccaaauaauugaucuaagaugcagggaaauaaaaagcacuuaucuuggaagccgguguauuguccugaagcaucugaaacaaguacaauacaccccuggugaauagauccccacggcgugcucacaccucuccuuaacgcaggacacuuucaaucagaaaacuucaacuaccccuggggaaaccuacuguuucagacgaaaagugacguguggaagacaagucccaggagcuucaggauaauuaacugcuggugcgaauauucccuugaacuugucggugagccaaagauucaggcaacgagcacucagucaugagugagaaccucguaauggaaacggaguagcccacacaccauccccugcauuaaccaccccaaacuagcaugauccacuuccuccucugcgucacuggaacugcauaccaggggaaaggugaggucgaaggggcagcggaagucucucaugcuugacucagagaugauccucuugcagggaaaaaagcauuuccaagcagagcauacaggccaccuggccuccauugaggacggccuaaaguaucaguucucgcugccugguccugaccagagacugaauggcuaacugccucuaggaaagcaggguagacccacuuuauggagguaacuauuugaugaggucaaaguuuguuuuggcagucaugaauaaaucaaaaucaauuugaucccaacucucauuuauuuggaacuucccucguuuugaacaagugcuaugcaggaugauauaguggagcaagaguaaaaagaggcaagggugugacagagaucuucacaaguguccccccucauccguguacacuuccaucugucauugucugcuuccaaaccaucugaaccuccucagacacacagcauaaacuuuggcuugcuacucaguuccagcucccaucugucuggauuaugugaauucaaagcuuucaguugcuuuaggggagauaaucuccaaggauuauauaccuuucaccaacaccugcugagcucagcagacgccaauggaagacccacaacagaacacagccugggcuuugcaggccuggggauugacaccagccaugggcucauguuaacuuaggagguaagccaaugccuuuagccauggaguuccuuggagguggcaguucacugggccauguggucuguuauucguuuccugggcuagcagcacugugaccauguagacgguuagcaguuucauuaccagaguggauuugaggggccgucuuuuguuuaaauucagugcugauccugaaguuaguaucuuuaagagagcccuguuccaaaugaccugugaugugucugaaagaugaccuuaccaaaagauugagaaugucucucaaaguagacauuuugaaacagacuggauuugaaacuggaaguuugagacacucuuuaccauaauucuuugggcccaguguaauuacauagcaacuagacuaaucgccgagcaaccugcacucucacagacccuaaaggugacucaaggucagggcccuugaggaccugcucuggagcugcuaggcaaacaggcuugugugggagagacacugaauguacaaugggauaagucaggucccaucaguuccuuacugggagagaauagaauagauggauuuccuaaagcccuaucaggcuauguggguuagcuagagucaaugaguggcugauugcucuguucuaugccuggaugucacuacaaaagaauucuggcuacaacaugaauuacaacuuagaagguagagagaggccugagagcaugcaucucuaaccagggcucaugucacuauaccugcugagauacacuggugggguucuaagacaucuuggcuucagaacuuuguaguuuaaacacuuauuuaagacuccaaagagcuuuuguuuauaaaggcuguaucuguugauuuuuacagagaagugacauugauuaauuuuaaaacagcaacgaaccuaguguuacucuaauuuucgauaauuuaaaaaaagccuucccugcauuuuuaaaaauauaaacaaacuagagaggagaaagcuugcuuuacauuuuacacuccagucaauaucuacuuuggucccucaucuguugugucaugacauuucuggaaaauuccacuuuacugucacgaaugaaaaagaguuaaagaggaaaguagcauuacuuuggaauacuuauggaauaccucagacugccugaacuguacucagacuaucuguauauaugaauaauacaaacguugagaagcagggcaaugagaccauaagaaccucagaacugucauauauugcgacagcucacaggaggcuaggagcacaggcuguggagccacaagcuguguggcagaauucaggaccuaccauguaacagcuauguaacccaaggcacuucuuuaaucucuguguaugucugaauccucauuuagaccacacaguuaauaaucacacuuaucuuuucaaguuacuggaagcauuacauggguuaauaaaaacacagaauaaugcuuggcuuaaagauuagcuauuaaggguuauaucuauaggcguucauuuagaugacuaaaaacuccuaauguaggggaaauuaagagaauguggagaggaagaagucaaagagcucuuuggcgucggacugagaugagccuccuuccuauuccuacguuugcuugagcuaccucaagaccauucuacugccucagaaguuuccuaccacccaaauauaaauuuaauuaaaggaaaagccccuucuccuuuggccucaggaauagucaagaaauuaacuacugaaaauucccagcaaacauaauuggcucccaaauuccuuuuggcugucaaguauuuauuucaaugacuacccugaaugaacaacuagcccaucaacccacaaacacaguggcugcccgaggcuucagcagacccacaagcucccagagaaauauaacaaagacucgcagauucuagaagacucaaguguguccugggaaaaccggccugaaaacccagggacaugcugucuuugggaaaguucuguuggcugagucacaucucagccguagacaucuugaagaugcacuagcuuccugaagagcacuccacugcuaagcucucccucaguuauguggaacaaagucacuaguguuccuuacugaauauccccacuacccgacgccuacuccagagaagaauggucugcauguuccucccaaagggaggccugcacuagagacauggcccuguacuggcacaugugcccaagccuacagagcacguggggguuugccaaacaauuuugauggcucccugguggcuguggaugcucuaguaguugaucugcaucagauaccaaggggagaugagauguaggguguugagauguagacucgaaguuaggacuuuccuccuccuccugcuaugccugucacagagggugcugcacaucugugacaugcugcugagcuuggugaccggggcagcaucugcuccaugggagcagucugagggccagacacacauccccaagacacuacugaguccauggugucuuuauaaccgaccacccgcuuuagugggagcucuccccagcuuccuucccugugcuugggucuagcuacgguucucauccauagcugcacguuagaaucacuuccugaccuucauguccgucucauuaaaucucaacucuuucccccacgagaguuugguuucagauacaguauuaagcaaaagucuugaggagugccuuuaacccagaacuuuaaagggugggccugacguguaggaagagccugggcagaagguaaaguuuuaguaaagaggguguggcaugcacugcacagagguuucucucagucaaacagaaccggggacugagugugcuccaguuuccucuucuguggcugggaagaaaccacucugaucaaaagcugcuugggggaggagcuuauuuggcuuacagacuaagaagagguucauuugagguaagucaggacaggaccugaagcugaaaucacugcugaaguacuguuugcugauuccuguucagcuagccuuccuuucuauguagucucccaauguaguccuggcugccauagaggucacuauguagaccaggcugguuuugaacucacagagagauccuccugccugucucucuagugcugggcuuaaagguaugugccaccaugccaggcuguuaguuuagcuuucuuagaaagccugcagaggggcagcccugcccacacugggcccucccacauggauaauuaagacaaucucucagagaccuagccauaggccaaucggaucugaguaaucccucaaugaagacuuccugggauggcuuuagcuaugucaagugauggcugaagccaacaggugcagucugcuaggguaagguaugucaaugcaaacuacacucagccuuuuuguuuugguuuuucaagacaguuuuucuguguaauaguccuggcuggccucaaacucacagagaucugccugccucugccuccugagugcugaauucuuuuccugaguagaugaucaacuguugaauucaauccauaacuuccuuguuagggaaauaagguccugggguauaggagaagauguuguagaaugagagaggaauacucuaccaaugacacauauaaccaagcuaaaagcauuuaaaaauuuuuuaaauuaaaugauuuuuuaaaaauguuuucauaaauauauuucagaaggaaucacauuguucacaaagccaacuacuauucccaaauaucagucaagccgguuuguucccagaggcaacuucacugggagaugguagaguacuaggagccacuguuuuugaugagacagaaauggagacaggaugcuguuaacuucugauagccuuagcagguaaaggcuguugcugaugagcugaaucccugagcaccacacagcaggcgaacucacuuccacaaguuguccucugguccccacaugugcacuguggcacacacacacacauuuaaaugcaauagcaguauuuuaaauucuaggauauuuuaggaagagcacagguuuacaaaagagaaaacuuaagaaguaauuugguauuuaaaacuaauuucuucuuuuagaaaaaauuuucuucacacuaaagacugcuugaaaaaauauucuaaaaaauaacaccuaucagcaaaaaggcacccuaaauugcuauccaaguugaaaccuugaauaaaauucuacauacaaguacaaaauccucacaagacuuuccuauugaaaagcuacaugauuucaaaauucucacaaaacucauagaccaagcacacuuucaucaaauggcaugaaacugcccuggcgccaagaucccacaaccgagugaacuggaagggcuucacuucuagccacuggaggggcagcccaguuagcugagcccaguaaaugcacagcucagcuagcccaacaaagcugugugugugugugcgugcgugugagagagagucugcgugugcgagcgaguaugaguguguguguguguguguguguguguguguguguguguguguauguauguguuuguguuuaucggggagggcaguuguuuauacuacuguggaugcugccacugcuccugaaucaggcucagaagccaucuugguagcacaguaucuauauucuagcuacucaggaaguuaugggaggauuaauuguucgaggccagccugggcaacucauugcuaucaacaguuaaaagggaugugaugugguucgugguaaaguguguaccuagcacgugugagguagguucaaagccgaauacuacuaagacaagacucaggcucuagaagacagggcgguuacaaguuacacguguaaguccauuguaaguccauuucuguuucccucuccccaucccaggccauucucuuaccuuuuacagcucuacaaauauugucugccugcccgucucucugucugguguacacacacacacacacacacacacacacacacacacacacacacacaccagcacccagggcuagaaacugagcgcucaccuagcagacacagacuguguaaagcauggcaucaggaaaaguggaagaacaaaucucuuuccauuuucccuuuguuuucaaacaaaguacaucucaagcgggaguugucagucuuugagacaacuuucuaaaaucaaagcccagcccguccucugaucugcucaaggcucagaagcaucuuuaguauccccaaguuagcgagacaaaugcucgcaccccucccgcaugcacaugcuacaugcuuuugaacacacucugaggcacaaagcuucuggaaauagauagcugugucagggcaguggcucagccacugccaauaggacagugugugcugggugugggaacuaggggugggugggacacguacuucagugguuggcugacuugccaguagcuuuggucauagaacucaaacauuuagucuggcuauguuagauguuucugugagagaaacaagaauauaugcuguaucauacaagcaggguuuucagaagcaauaacaaggguuuauuauaauuaucauugcuuuugagacaagguaucacuuuguaguccuggcuggccuggaacuugugcuguagaccaggcuggccuccagcucacaauucuccugacucgaucuccuuacgggcaagcaccaccacacacaucuuggauuuuuuuuuaaaagauuuaauuuauuuauguauaugaguucaccauugcucucuucagaaacacuagaagagggcaucagauucuauuacagaugguugugagccaccaugugguugcugggaauugaacucaggaccucuggaagagcagucagugcucuuaaccacugagccaucucuccagccccuuggaauuauuuuuuaaagacagaaucuugcuauggcguggccuugaacuaaugaucuaccagccuuagccuccagugcacuggcauuacagaugugugccuuugugcccaacuuauuacaaacaguauuaaaagacaucauugccuuuugagcuugcagacaguacauuucucugaguuccuugcacaagguacaauucugcugcuguucagacugacucuaacacuggaugcagcuagaguugagccaucaguaacaauauauuaauaugagcacggcauuauccauaauaucacaguuaucauucccacgagucuuucuauuguguggacauuguuaaucaccaaaucaccaacuuugaagguucuugaauguacagggaaggaagguuucagugguugaaucucuacugcgggcacacuagucacuauucugguuagggugcccaggacuauuuagcuagagacaaaucgcagggaguuuaauuuguucauuaccaggcaacuuaaaucuaagagccacuaaucacauaaauaacaggaauucacacauacacaguaauagcugaaguucauuacugauaacucaauucaaugcugcacugcaagagaucauaugguaaucauuuacaaauaaaaggacagggcacacacaggagggucugcacgccaagguggaggugugugauuauggacaaguacacucaacuguaaauuauggaaccaucucuuguaauuacccugcugcagacaggaacaaacuuccugugcaaucugcagagaaagaggcugagacacacaauuacuuuuuccuugguuuuaacccuuuagcauuaugugugaugaggucaaagaaaguuaauuuauggagauguggcaggaagguauuucagagaaaauucucugaaaaguucccaguagugaugaaagcuagugacuuuucuucagggaagaguuuucuaaacuguauucuaaaugguguuuaaaacaguucacaagcaccauucauuuuaucucuucucuaaaaguacuugcuauggucuguaaguuuuuaacuggaagcaaaugaaaaucugcagggugcaaggcaggcuggcacagaguccucugauguaccuucuacugugguacagaaaauaaaauuaacuuccuugaauucaagaggaaagauccuguauuggacaaagcaaagggcaggaagaacagaaagccaucuugugguuggcacacacacccccccaccccccacugugguguguauguauguguguguuagagagaggaagagggagaaagugggggggggagagagaagagagggaggagggggagagauggggggggagagggggagagagggagggggagagagaagagagggaggagggggagagauggggagagagaggggacagagagggagaagccacagauaacucuaggugucuuccuuaaucucaccuagcacagcuucauucuggcaaccuaagccuuuucguucccauuuucucuucuguaagcacuguuuuuuaaauauccaaauuucacaagugcauuagcccuggaaggagagggcaucccacucccacuugcagugucugacagaacuauauucguucacucuggaguguaaucaacaguaggagaacaaagcaugagugcccaggcuggaaugucucgucucggcuucaccucugacuuuccaccucacggcagaaacauuucuuucuuaguauuuaaaaauuuuaaggcuauuuuauauuucuuaugaguaugaauauuuugcccacaugcaaugucugugcaccucgugggggugccuggugucuaucuauggaggccaaaagagaaaacuggauccccggaaacuggagucagacugucgcgagaugcauguggguucugggaauuaaaccuggguccugugagagaagccaguacuuuuaacugcuaagccaccucucaagucccagacaaguauuucuuaccugaaucuuccauuucaucacccuucagucuucaaucauguuuaacaguggaagcagaaguuacaggaaggccguucucuaagagauucaacacuugagggccucagucucagugauguuuggugcaauugcuucacauaaaaacagcuuugcaaaggcugacaggaagcuggugccaagcaccaagcacuuaugcacuuaauguuucuuauguagagcaguaaaggugaagaacucucucucucuuuacaacaccacugauguaauaccaccaauaaauaaaaaaaggcuguuuugagaguuuuaaggguuacagccauaaaacaaaugccauaggguauaugaccucccacuuuaaaacaaaacacgccuccaacgaacacagacaaccacauacaauguauagcuuaguggauuaccaaaaggcaacugcccuugggacuaucacuuaggauuuugcugaucaccaccaagcaaucuucuguuuggcccaggcaauaccuccuuccccuucucucaucaauaacuacugaaagccuuuuccuagcaaucagggauagguuuuuauuauucuuacuauuuuuagauuuauugcuuuuguuuucucuguguagcucuggcuguccuggagcuggaucuguagaccagaugggcuccaaauuuacagagaucagccugccucugccucccaaacacugggauuaaaggugugugccaccaccuccuggguuagcuuuguuuauuuuaugaaugguugccugcaaguauugguguauuaugugcaugccuggugcucagaggcuaaggagggcacuggauccuuuggaacuggaguuacaaauguuuguaggcuaucaugcagaugcugggaauugaaccuguguccucuggaagaguggucagugcuauuaaccacugacugacacaucucucaggcucuauugcuauuguuaugccuuuaccaccacaauaucaaggugccaaugcaguuguguccauuuaagacaaagacuuaacuuucuuuuaauguguggauuucuccuucuaccccauauucuuucuuuccuaucgguuccugaucuuggggcuuucucguggugugcuuguauuaucguucaccauguucuucuaugucuuuuccagcaagacagaauagaaguuugaucaugucuguuugcuccucuuugugcaauuugcagcuauuugauguucaauguacggauccauuaauucaugggaagagauugcuuuucucaagcaccacuuggucaccuagugguacagcucagacaggggaaacaggauaaaugcuucauucaccagcuuuaagacaaugaacugguucuuuucauuguucagauuaguuuuuaguaucauucccccuauuccagaacaauccauuuucacauaaggaacccuacuuaguucccagguacaugggcaucacaauuuuagcaaccuuaucuuugguuccugcuacaguauaacuauguugcgcauuuguuucaauauggacaacauauugcuauauaaauaauaaaauuauuuaauucacucaauuacuuuuauguacuuuaaaaauauuaauuaaaacaauuuuguugaagaaaaggucuucuuuaauguuaauccaaagcaagaugcaacauaaauaauuauaaaacuuaaguuuuuauguuauuaaacacaacaguguaguaugauauaguguaaaacuguauuucucuaauauaacucuaagcaaauaaagaaaaacauauuuucucccaaagcaaaauuaaaggagcaaacaagaaaauguaaccauuuucugacccagucaucugcauuaucaaaauuauccugaagagguaagcaaacuggagacaggguuucucuguguagcucuggcuguccugaaacucacacuguagaccaggcuggcuucgaacucagaaauccaccugccucugccucccaagugcugggauuaaaggcgugcgccaccauugcccugcaagcaaacuuuuauaguagauuguuuuucacuuaaaacauuaagcccauugcuucuuuuaucagcuggaaaacagauuuaaagguaauagucuccuuggaaccaaaaucaggaaagcacuaguuucaagcacuaagaacaaagcuugugugaucuugcucugccuuacaaauaccauaacggggccagugaaagcgaguuggaagcacuucccacugcgaagccucaguauacccucacaccuaagaccgcagagaugaguuaugaacccugugucugacaccccacaacaaggccuggaucauguacccucuuggcugcgucaccgaggccacgcuggccaaaguccguccaaagcaugucugcagaaggaagaauaaagguguacaugugacaagacagaaggccaugagaaaaucucagaucaagagcuaauucugucagaagcuggcuguguguacuuggagguacucccaguaguacaaagagcagagucagacacucauuucuucccuuaacgguuguuuauugcaugcccauuaugugacaagcacugcaugcccauuaugugacugacaagcacugugcuuauggcugggcauucaacccggcaaaagucccugucuucaggaugccacugccaacugaugcuuauugguuaucggaauggaauuugcccaguaguggguuccaacacuacucgcugcauaugcccacuggguagcaaucugaacaaagguuacacggcaacaacauccaccugugugccaaacccuggaaaagccugagguauguaaagcaaguaagugguguucagaaaagaaugagauggcagaccccauguuucauagucauguuuucacugaagcaaugauacacacuagucuauacaaacuauuuauuuguucuuauuuaugauaaaccuaguuuauuugaaaaaaaagauacauaaaaacauuggcugcacugccucaugcaaugcaugucuauguauucaguagcagucaaccucugaauaaaucaccacagacucaauuuuccaccuccauauuaucuuuagcauauuaaaauguaucacagaucagcuccguguacuaaaacaguaguggcaaaggcuuuuggagaaacuuauuacaaugaggaaauaaggaaagauguucacuuuccuuauucuauuauagacuagacucuauuaaaauaugucaucaucaaacuuaauugcacagaucaaaacaagccuuccagugacaguggcuggcccgagcucuuccaagugucaagggagaggucucuauccgagagcuggaaggaccucaacgccacuucacaaggacaucuuguuucucuuuaaugauugccuugguugcacugacugggagaagaguggcagagaaagggagcggacagagcugacuguuucugaggucuaacacuggaaccuuccuucuaaaauaaaugugccaagaaaugaacuaccugucaagaggaagggaaagagaaacaucucuucaaccaacuuagucucuucucucugcccaagauuggcaguugagaacaacgauccuuccuguugcaacuuaaguaagugaacucaagaaacagccuucauuccaaugacaaccucagacgggaggaagaccagcaacacugggugccacacacagcuaggggcugggacaguggcuuuguuuguuuguucuuuuuuuuuuaauggucaggaccacuuuaaaaagguaagaaagaaaaacugcagugaguagguagcauaggugaacugugcaauaccaccacucaaccccucaacgaccuuacugcuucugccuucugaguacugggauuaaagaccgguuaucaccagacucagcaagcagacucuucuuuuucuuuccccuccuguauuauuauuuuauauguaugaguguuuggccugcaugcaugacuauucaccauguagaugccuagugccacagcggccagaagaggggguugguguccuggaacuggaguuacagaagguuguuaagaggccauguggacgcugagaacugagccuggggccucuggaagagaagaauaugguuauaaccacaggucuaucucagcagcccugaagcagcccauguguaaacaaaauauuuuuaauuaaaaauguucucuaucaccaucuucauguagaugccagacuauauauagaggucagaagguaacuuucaggacuugguuccccucuuuacccucuggguuccugggacugaacucaggucaccagagucacacagcaagcacguauacccacugagcugguuaucuugcugacucuagaaucuauaguucuaguuagugaguuuuuagucuuuuagcuaggaaagugcaacuaauuucacuaaaugccuuucguuuaugacuuuguaaugaaaacugcaccugggcauuacuuuuguuuuuacuucaaucuuucucaucaguguucccuaacacauuuguacauacgcgcgcgcgugcacgcacacacauacacacacacacacacacacacacacacagacacacagacacccacacacucucgaauccaguguccuagucuuuacaguauaaaaacaaccccaccauguugcccccagcucuggaaagucaagcuuucugaaccacccuucucccugcucuguguuuuguugagacagggucucauuuuguaguccaagcaggccuagaacccauggcaauccucugccauaaccgagaauaacagacgugggccaucauucuuggguaaauccacuucuuuauaacauuccccuuguugugugugggcuguguuuguacaugaaaguuaguggaaacccuucuggacucagaucuucacuccccccauggacugcauuccagaaaucaaacucauguugucaggcucauacagcaagugcuuuuaaucccagccccagauucauguuuuuaaaauuccacuuaggccacaguccuccagguauacugcuuacaccuuuuccuuugggacacugaggaucuaugacuguuuuuuugugucacuuuccccauaguuaucugugagaauugggcucacaugugcaauucaggugacacacagaaagaauuucacaaaucccagcugugcuaggaucagucagugcugaaacacucaucuccuuuguuuucuggaaucucaaagccacguuccccagccucauggaccccuuggcuguucuuacuccagcuguuaucuagcaugcccacuaacuucuacuagcuuuuuuuaaugcagacccuuugcugagcacaagacuccuugagucuuuaaucugccuguaguaugugaaacaucuaacaugcaugcucaugaaggcauguucuggggcaugucaguucccugagcuuggaguucaaccuucagccuggcuuguuagcucugaauacacgcuacacagauaugcugcauacgcuacacagauaaugcugcugcauacagccacuguuggcugacaagucaacagagacaucagcaagagcauuuaaccuagucacugguauucaaguauucacuggaguguaccucaggcaucccaaucacuaaggcuugagacagugagccaagcauggcccagguuuuuuuuuuuuuuuuuuuuuuuuuuuuuuuaaagauuuauuuauugauuauauguaaguacacuguagcugucuucagacacuccagaagagggagucagaucucauuacggaugguugugagccaccaugugguugcugggauuugaacucuggaccuucggaagagcagucgggugcucuuacccacugagccaucucaccagccccuggcccagguuuuaagaaugcauauuuuacuucccaaggaccguccagcaccuauguggggcaucucacaaucuccuguaacuccagcuggggguggugguggugaaauaucucugagggaacccauacuuacuuacauacacacacacacacacacacacacacacacacacacguaauuaaaaauaaaauaaaauaaaucuuaaggucucuggccuccauguguucuggguaugugauacuuaugcaccuaugggcacacacacacacacucacgugugugcagagagcagaauacuagagauaacucauauguacauagggaugggugaaaucaacuguguauauagccacaggaugugcaucaagagaaucuuuucuuuacauuaagugauuucugguacagacuaaaaaaugcaaaagaacagaauccaaaaggcuauaguguaauauguuuuaugcaaagaggaggaggaggaagaagaagaggaagaggaggaggaggaaggagaagaagaagaagaaguaguaguaguaguaguaguaguaguagaaguagaaguaguagaaguaguaguaguaguagaaguaguaguaguaguaguaguaguaguaguaagaaagggcacaccuacaugcucaucaguacaaaacggagaggagggagcaccuagagaugaguguagccggugaccuacggaaaagggaggagcacagcucugcuaucuaucuaucuaucuaucuaucuaucuaucuaucuaucuaucuaucuaucuaucuaucuaucuaucuauccauccauccauccauccauccauccauccaucauuuuuauguggauggcucuugugccugcaggaacauuugucuguguaccauggaagcacuggugcccacagaagccagaagagagcccagauccccguggaacuagagucacacacagaugugagguacuacgugaguucugggaacugaacggaucuuuggucaacagcagccagugcuuuuaacugcuaacccaucucuccagcccucgugaaaaucauucuuuagguugggcagauacacaccugucauccuaaacucaggaggugagggaaggagugucagaagucaaaggacagccuagguuaugugaggcucugccuccaaacaccaaauuaaaaaaaaaaaaucccaucaaugaaacuaggaggaaaagaugggagaaaugguauuuacauaaccucaagguaucuucuuaccagacacuauuacaaugacuuggcagguaccaccgcauaacauggucagcacauuuuguaugccaaggaggaggaaccuuaguuucucuaguacuucuccccaaagcuuaccacccaaaucuaauaucagagaagccccaaugggaaggcagguacuguacagaauagguccccgcacacuuuacaauguccaaggaacuaaaaucaagacaaacccaccaauaccccugaucuugggaaauuuaagagacccagugacugaauguggugagaaauaaacccacacugagagguauuucccccaaaaggacagcaggaagcacuggcaagacgaaaccugaaucuagcacacucacucauacagagugccugcugauagggauauuuugguucugagaguuugugggauacacagcagaggaucuuuaaagauggacuaacacacgcgguucauccucaucacaauucaggaaagagacguaugagagagaagaaggagaauaaaagaacagacacuauacaugccaacgcccaggggauccagguaaagaauucauggaaauucuaggcacaauauuguaacuuuucucucaagucugaauuuucuuucaaaauaaagaaacagugaaauauauaaggcauugcugggcagcucuaacagcaggagcaggccagggcucaggaaggaacauucuagcuccccagugccuagcuguuccccgugggaagagcagcuauuuuccuuguccgugggaggcaaaaaguagcagaaguuuugugggaagugggcuucuuugaagucuugacaugucuagugaggguggagaguugucuguguguguguaggagggcuuuaaaguuuuugacuaagggagaggaaaucucagaauccaggagaagagaccccugcagccuguguccaucgcuucuugagcagucaugaacccugagucugucuaugagcaggcugucucugagaugcuggcaccuuuuacucacucuggccaagaugugcaaacagccuccugagagaccucacucugacaagugccagauaagcugucccagaagcaagagacagcuucuuggaaggguagcauuugggccuguggacaaccccaucaguucucuuacuguaccggacaacagugccaaaaucuugugcaugcauuuuucagacagacagacaaacagacacacgcacucaagagcguauacacacacacacacacacacacacacacacacacacacacacacacacacucuauuggaacauauauaaaaguccaggugcaguaugcuguuuuccuuugcuaaauuacaaucauuauugacaaggacuucccuacuuuacaguugcucugacuaacugaaaauacaaccuuaaucaacaggucccagccuuacacaacagaacccaaaccauuauuaagagguccuuuuaauggaacagaacauauuuuagaaaucuuacaaguccugcucaucuuucuuacccagagcacugaccugugaggaaaaacugaugagagguuaugugcuccccccccaccccccucugugaaugccuggauccaaaugguucuggaaagauauuuaccuacuaauauuuuaagugacuaccaaggagaugcuauuaauuuuucaacagcauacccugucuucuuuacaaugguuggucaaggaauaauucuguuuuuaaagugaauuuuuauugggcuuacacucggucccguuuucuugugaguacuguaaaacaauaccaauucccuucaaacuauuccccaccccaccuuucaacuauacuaaaaucuuucaucauggugcuuaagcacucuaguggagagacaaggccaaggguucuacaagacugucaggacuacuaaacccagucacauccggaggauggcauucauaaugaccgcaaauguccccaaaaguauuccaguguguccuguauuucaugucugaaauuacaggguggugguuaggaauggugcugcacaccucagaucuuaguacaugggaggcagagacaggcagaucucuggaagaugaagaccagccuggucugcaaagugaauuccaagucagccagaaguauaaaaugagaccuggucucaaaggaaagaaaaguucaaguccaccuuguuuuuucaugucugaaguuuuaaaauaguuuuagcacuuaaagggaacccuggguuauccauacauguacauucauguauguccccuguaauuauaucacuguauuuagagcuugacuuuuuuaccuggugguaccaguuccuuuauaaucuaggcaucacuuuagauagcuucauuaucacuucauaucagcaaaacgacaucuaauacaaauuguuauaggaacuaugcugauccaaaaaaguuuccaaggagaucacgguaacucagaagcacgauauacugauguuuagcacaaaaggacaaacacggucuaagcaugcucguauagaacauagcugggacgguauaagauagaacuuacaaagacagcauuagagauaagagguucuugaguuguuaccaaaugagcaugguuuugaacaggcaagaggaaggggccaugucaggaaaggccaugcacagaaaaagaacucagagaagcaaacuguugagucaaaaagcuuaaaagguagccuggagcugucuccuggaacguccuuuuagucuagagacacgagaacacugucagcaagcuuagaccugcaugguugugauguaucccagaaaguguaguuauagaugagcgccucauacaugaugacuguaaaauauuccauaaagagucagcuaauucugccuuuccaaauagcuguagcagggauuuaacucgaauguaacuguacauuuacuuauccaauauaaacaagaagaaccccccccccuuaaaaaaaaccucauguaaugauggucuucacauguguacccacuccuacaccaccaggaacuaaagccacauacauggacuuggucaaacccagagggacauagauaaaaagacaugaauacaagaaagagauuaaguagcaaacaagggggugagggaugagggagggaagagggagggcaggagaggagcaaucagugcauuagguacaaguauggaaggcucagggaacagugauuuaaaacauggaaaacuaaagaagaaaaagagucugauuacagcgaggauguggaaaggaacgacagugagcuaguauauagcccuccuuggacaauuagucuccuggauaacuaggccaaaacaguaagacuaggaaaacaaauuaauaauuggaaauacuaucugaagguauaaaaauaaucaacccaaaauccuuuuuaauuuuauauuuuuuuggucaggaaauuauacaaaaucagucuaaaauuuaucugcagacuucaacauuucagaaucuaaugauagagacuuauagagucaacauacuuccuuauggacccucacagcauaccuacaugcaaggccuugcauuuccugcacauauauucaaauuuccuuuauccagcuaacaaccuacgaauucacgugcacuaagugacagacugucauauagcuagagaguccuaucaucacaggguaaggggcucacaggcuacuaucucucuaaaugcagcuugagccuuaguaugaaauaagcaagaagagagacagcggcuaagaaagaagcacagccgcugcauuguugcaagcauccagccgcugcauuguugcaagcauccagccgcugcauuguugcaagcauccagccgcugcacuguugcaagcauccagcuuuaaccagagaggcucagggcuacaagugcauaugaagccagcagcuccugagaaaccucguuaccaacagcuucugcaacagugagagggaaguaacuagagccuccucaggugaacaggcucucuuuaccccugcucuccucugcuccacaaagacuacugggcaaaaucugagaaagcgaaaacuccuuguaacuaacaaucgcuugugcuuauucccaauaauuaccuaaugguauagugagcacagugccacagaacucuaccagcucauugcagguaauggcuuucugaggcaagggcacuguggugagaucuagucucauuuucccugaguguaagugggugucagggaaacugucacgugaggaagaucuucuaacucaggugguuauaaacagaagacccacuauguacgauuacaaaaagaaaacagcacagcagguuaaauaaagcuuuaugcgguacaguuuccugaaacagccggcagcuacucuggaaggaaguaauguauuucacuuacugaaaucaaugagaaagcguccaaauccuugccuuuggugcuggggcaugaucauuaugcaggacacauuauacuucugcuggcagagcuuuuccuaugggaaaaagaagcauaguaaguaugucagagcucugcugcagugggcaagucccaguaccugccaccguccuuguaaagcuauccgcuaaggucaaacaguggcuugggucaggaccaaucagaguaauccuaccaugcugaucaaguaaguaacaacaaagcacccucucuggcuaugcuucucagauguaucugcauucuacaaaguuaggagcauaaaauccguauagggaaucuaggaaaugugugcagggugaaagaaccgccacaggagggaacgacgcucuccuugcucacacaacugcagaaacggagaaaacaccaccuaguccacccaguggaguaaacugggcuuuggcgggcagcccuacugcgugauaaucuacaacucgacaauggcaagcuggccucugccucugaguaaaucccccaguggcacuggaauggcagacacgugaguggacacacaaacaaaugugucuccugugagucagaaggccaaguagaaauaauuaaagucggcaccucaaaccaggaaaaucaaacaacaacaaagacaccaagaaaccccaaagccucugaacaacagugagacggaaauccuaucaacaggcuaaagccaggagggggucugaguagagcucuggacagcucuaagaacuaaggguucacaaucgcaauaucgaauucacaguacacagacaccaccaaaaccuacacagagaagaucuggaaaaggcuucugaggccgugagugcuguggccaaauauaaaccacaaaugaggcugcucacaaauagaaccacaucacaagaucacuucagaacacucagaucuuuaacgaaccaguuucaaagaccacaggaaacaacuguggaaaaaagucuaaagggcaaaaaugaaagaagaugagccccacuuuuguguacuuguagcugucuguggcaucucuaagccuugagaaguaacaacgagacucuaggagauaaauugcccaucccuggaugugcaugccaauaguaaaggcucaaauaauuaauuuuacugugcaaaguaagauaaaugggucacucuaucuaaaaagagauguacucugggcaaagaggauuuauauccuugaugccagcccuuucucuguccagaacuguucucagccaugagaguucacugaaauauaauccaacagcaauccacuuccuuuucuuaauagauggaccuagcccaguaaguaaguaaaaagccugcugugccggugugagccuccaggagcacgaggcuuaaauccacauugaacagaagggcugccagacuuggugguguaccuucuaaucccagcacucgggacgcagaggcagaggcagguauuucuugguaaguuccaggacagccuggucuacagagagaguuccaguaaagccagggcuguugcacagagaaacacugucuggaguggguggggaguggauguucaggaggcagaagacaggcagaucucugaauucuagcauagccagagcuaaauagugugauucuguucaaaaaacaaaaacaaauaaacaaugaagaaagaaagaaagaaagagagagagagagggagagagagagagagagagagagagagagagagagagaaagaaagaaagaaagaaagaaagaaggaaagagagucagucaaaauagcugcacacagggaugagacaggaggaccucuggaugguucaugugucuggagggagagaacacugagggacauggacagucuugccaugccgucuuggcugaccacaaacuggugaucccuugucuuagcccucugaguauuuauauuagcagcauaugccaacacaccgggaagauagucuagcuucuuauuuccugugaaaacagcacuucuauggaguguuucaucaugaacauuaaagaaaagcagauccaauaaagucacucaucugcugagcgucuggauaauuaccaucucuguuucuguaaccauucuugggugcauacccagggaaaguucaacaccuggcaaacacauuccaaaccagcucucuuucaaggugcaugacuuagcaacagcaguuucugagcaguuucuucuggagaagagcucugaaccagugaaaagacgagccacugugccuuaguaugcaaguucuuccccauguugacugcuagagacagguagguuuccuacaggcaagacucccuuagaacuuaaaaaccacagcacagaucaugagaggcagcgguggaaaaccagccaccuaucaacuaggccaucaauugccagugguguuuuuguuuuuguuuuaauuacauguauuccuugguguguguggggugggaggcagggcaggguagggugcaugcggacaacuucugggagucaguucucuccuaccaagcagguccuggacguuucucaggagccaucucagcagcccacaccaaugcucuaacacuggauacugcugaccacgagguaggaaaugagccagagaggcugaggucuuaagugcuccaucacagaaagcuucaugugcacaccacuuaaaagaagaaagaagcucaacauuuggaaaucaaagcugcgaggcagucuacaaggugguaaugaaaugucgcauggucacugucagcacagcacaggguucugggguccuuuacacacuuccuaggcaccuuuuguuguuauuuguuuuguuucuuguuuguguccuuucaaaugagcuuuaaacaaaaagcugagguuuucagaaacaugagccacuuacucaaauuauugucauaaaaauacaaaaacaagagaaaacaaaacaaaaaaacccuguucaaagaccugagcuccacuaaaaacauuugcaagcaagcgagagaaggccaugcuggcucgugguuuaccuuggagaaguauccaaccagaugacagccuuuuucaucauuuuuuguaaggacauaaaaaaggaauggcucaacaucauaauacaauguuuugugguccaggaagagcuuggcuaacaagcaaagguuuuggcaauaaauuuuacucauauucccaucaaccuagaaaaagagaaacagacaacauuauuuaacauaaaaguaucaucagaauauaaacuugcuucuucuguauaucauuuuaaaaaguauauaauuuuauuucuaaauccuacacucuaagauuaaaauacuccauuaaacaaagacaguguuaaccagggaacagcuguuacuugcagagccagaaucccaucuuuccucuuguuaagguaaauucaagacagcuaacgucuccuccuuaagcucguucaagaaacagcaacguuagcaaagucacuuucacuugcaauuuauuaugaguuaaaauuuaucaggcaugcccucuuacuuuuaaauuggagccaaguaaaucugaaaauuaaaaaaacaaauaaaaauuucaucaugcaugccaaacuuuuguuauuuucaaaaggacuucaaauaaaaauaauauaaaugaaccgccugaguuauucugauucuucaaaaguguggauuaaacagcagaggcauccauuuuaguuuuaucccaaguaucauuuuaauauaacuggagaauauacaaucucuguguugggaauaauuacagagagagucaggugaauuuaaaccuacaguaaguguaaugauuauagucuacuucucuucaaaauaaaagacucaagcugggacaccgaggccuccacaggagcuaaggcacagaaaccaaugucuuugaucaaauguagugacuugcugaaacagagagccaaacagaccccacacucuucuuaggggagucagguuuugcuaacccgagcucuuugacaaugaacuugaccauucccaggucuccuguggaccauacugguucuuauacugcacaaauuauuuuuagauuucauauaacuauuucccuuggacagaaccuuagucccacacauagcaacauaaucaaauacaggcaacuggcacugaggauacaauucucucuuuaauuaaaggacguuuugauguauuugggaguaugguccuuuuggaaacagugccguacacaagaacuaauggcgauguacaucugugcaucagaaacagaaaugaaaacacugaaacaaucuccgaucaaucagaagucuaggaaaagagacagguacagaagagacucacaaaaccaaaaucacagauacgguuuacuucuuucuaaaucacagaaaagauccgaaaguuuccuuuccaaagcugauaccuucaaucaagaugcuagaauagggccuuaggguuuccuccacacccucaguguaggaaugaacuacacuccugggcgacuuucaucucugugcuuucaaacacaugucuaacaagacugauuauccugcccagaugacuuccugauagauuagagcguccacacacagccuuacucaugaugauuuauucaauaauuacuuaaggcaaacaauguguuuugcugucugggaaaagaugaacagucguuucaauuuucuuucgguuggaggaaaagcauccagggcacgaggaaaggaccaaacaguaaagcuggcacaacgcaaaggcucccugagaccaacucucuccccugccuucuuggggcugccugaguggcagcccgacaguacaucaagugggguaaccuguacuugguauccuucaccucccacccucuuucugcucagauauguggcugcugaggcauuuuugguugucacgaauggacaggaggcaccagcagcagcagccaggagguagacggcaggaugcugcuaaacaccuuaaaaaguauacuacaguuccuaugcaauauauuauucagcuugaaaugccaguaguacucaggcugagcagccugugcuuggccuuuaauaagaaguaauagcgcagccucacaaagaauuccacuugcccuucaagcucacuagaaagagcaggaaggugcuuaaaaaacaccacagcaguagguaccugaccagucuagagagggaaagcccugccugagaagccucuuagacacaugggaaacugaugacccucccuuauuauaauggagggacacuggaggccagagcaaacggcagcugugcagcagaaugauacacagcaacaugagcacuggaaagagaaaggacacugguuuucagaaaaagaagacaucaugucugccguaggaggaaggcuugaucugagacccugaagaguaaacaacacaccaggaugguaacaaagaggccaauacagcaaagcacagaaaugugcagcuacagugaggaggauuaaugccgagaacggacagugacccucugaacagacaggaccaccaaaggagagccuggaguccucaguauacagcugaucagcuaagcuagauccccgagccuggcagcagaagccuggcuaaacaaugaaaauaaagcagagacuuucugcuacuacgucugcucugaaaacacaaaauaucuucaagaaaccuacaaugagacccaggaacacagggcuuccugggaacggcaagguucucuaggguagcuguccacagagacuggggaagagucccaacaucugcugggaucucgcccagaggauuuauccacccuggcaagaacuggacagaagcacagguguuugugugcuaagcagauacguacagcugcucaauucccuggaagagggaguaccugccagacacuggcuggagcugcuaaacaaagcuaauuccuccugccaaagaauguggaauuuacaaagagccaaggagaccacuaauucacuggugcauacugugcuguagaaagggauuuuaaaaagccccaaaaaaguugaugugaugaaguaagaauucuucaucagucuaaaugguugcuuaauguagucagauaaauaugcuaaaccauggcgcuaucuuaaagagcagugugaauuccgaugcuaagauugaauacacacugugcuaucuauacacaaaccauccaagcacacagucaacaguuaggaauauuaggguucaaaaagaccauguuuuuguuuauacuugcuuaccucgaauacugaaaggucuuuccuucgguaaaucucauuggccggaggaugaaaccauccacacuucuuugagugucuuagcaaaauauuuuuacucuucauauauuuaagacagaauucacacagguaaagcuuugguaaucugucaaaguuuaaaaaucagaaagucuauuagagugacuauacuguucaagagagaaaagcuaaacauuguucaauguuuucuagacauaaaauggcuauaaaaucuuuugaaaacauuuucaaaaagggaaaaagaagccagguauaguggcauauagccucaaccccaacagucggucucagaggcaggagggaagggucucugugagcuuuaggccagcuuggucuacacagcuaauuccugaccagccagagcuacacaguaagagccugucucaacacaacacaauacaacacaacaaaacaaaacaaaacggcagggggcgggguguggagaauccaguaauaaagaaauauaaagaccuuaaaauauuuuaaauaaagcuuauaauaauguguucuuauuuuacucuaugaccuaccaucagguuuuucaggccugaaaaaucaacaauucagaaugcuauucuuuagugugaccaaguauauuuuuaaaaauucagauuuaaugcuguauuuuuaaauauucuuaaugcagacugcuguaccuagaguaauauuuuauuuauaagugaauuuauuaucuuuaaaaugauauggauaucuaugaggcagagguccuaaaagguggcuuuuauuucugccucuggaugaggaagcuauauaauguaauagucuaaaguaguggacgcaaguccgacagucaaaagcucacauuuguuuccuaccaauuccacugcugcuuuaauucuuaaauuaagaaguguuuuggguuuuugucugcaguguuauauucuuaacucaguuaucugcacucagugcuacagaaucacuaagcacacgcucuuuaaucuucagaaaguaacagaacuguuuacauagcaccaacaaagggcugaggcaugcuaacacccauuuuauagacauccacuucagugauccggccauuaaaucuuuccagacacuuuaagcuauaugcacauauuacacagauauguaaacuaugcacacacacauacguuuauguacauacgugguaucaaguguuagguaauagguauauuugugagguagacacaguccuuacucuccuaucgaccucauuuuuauucaugaaaucucagcuaagcuggucuuccacugagacuuagaauaaucaucuucuucuucuucuucuucuucuucuucuucuucuucuucuucuucuucuucuucuucuucuucuucuucuucuuccuucgccuucuccuucuccuucuccuucuccuucuccuucuucuuuaacaaaaccauuuuugagauguaaucucacuuuguaguuuugguugggaggguaaagccccaagauucuacuaauaccaugugacuugaugugggcaucagaagaaaagaaauguugggugauauaguugguugcuaagacacucuaaucuuaguucaagaaaagcaggaaacugacaacaauuucuguuauuuuuagaauguuggcuguaaauggcuuugagugacuugggaagggucucugaaaguuaccugccaccuacuacuuccuccuacuuuuucuauuuugcuuaauuucugggagaagaaccacgaaaaaaacaagggaugagaaauuauugauaaaaccuauauccuuaacuaaaagacagccaguguagugaauauaucaagcaccucuaaccgaccguuguuuucucugauuuguucuauauaaaaccagcaauuguccuacuaaccgaacaaaaacaggauggccucaaaagucaaagaaaaguuuauuuaucucuguuuuuuguuuguuuuuucuggagacaagcguuuuuuuguguaguccuggcuguucuggaacuagaucuguagaccuggcuagccuugaacucagagaucugccugccucugccucugccuccuugagugcugggauuaaaggugagugccacuaccuccuggcucaaagagaaauuuacaguacccgugguucuuacgaguuaaggaauauacacaaacaguacaaacacacuacaaaaguacgcuaauggcaaagacuucugccugacuaccaaaauuuauguuuguuuauucacucacucacucacuacuuuuuggagacaaguucauggcuaucaacagaauauauacugacaaaauggccuucaaccucugaccuuccgccuuaacuccaaggcgcucacgaauaggugcucacaccaugaccuguuuuccguggggcauggugauggaagccaggcauacucagcaagcacucucccagcugagcagcaucccuguacccaaguguacuucuccucucuccucaaagcauuucacuucugcuguagaacagagcuccccaggccuucccacacagccgccaggcuccgccccuaccuugcauauuccuguggguaaggcgaggaguaccagguuuggaucucguauuucccgaacucuauuacugagggguaccgaccacagucuuccacuccacuuucacacucuauuuucugauaaacaacaacaacaacaacaacaacaaaucaugauaaaauacaaauuccaagaaaagagaguauuucauuuacaugguuucuucuuuuucauuugaagcuacccaaacaugccauugaucuuaauuaguuaauuuuuauauuguuaagacagauaacauuaagcaccuuuguacaaaaucuguaugcacgaaaauaauauccaacaaauaugacaaauggguuauaagugugugaugcaaguaaauuccaaagucuauagaccuggguauaacaacaaacugcaaugcauccgacugcaaguaggagauggcgcagcugcugcuccaucccuugccggucccugcuccgacaggaagcuguaugucagcuccugcgagugaucacgaguggagaagcccuguuacuucuccuucugccaugaagcaagcuacaugagaugaggcugugcagucacgguggcagccucagugucuaccauacugucuggcagauauaaaaggacauacaucuugaauacaaccccuagcuuuggagcuggcaagauggcuuaggugagguguuugcugccaagauggauaaccugcucucuagaacccagaugaaagaaagagaauucauuccuguaaacuguccucugaccuccaugccuguaccaaggcacugguaaugcaggccccaucuccccugacaaagagauuaaugcaauuuuuaaaaauaagcuuuguuauguuauaaagggcuuuaggguugcauuaucauccagauagugacuauugucccuuacuuuucuauaugaauauccucacuccauacacaaagaaaaauguuaaagagagaaaucugacauuugcuauagcugcaggagaacaaacacaaagugucugucaagggcagaauaaggaaugacaauccauaauccauacuauuucuucagaucaaugguaccacaagucuucagcaugacugggugcugcuaaaaacaaagcuagaaacccaggcagacagggugacugaaagggacggagggggaccgcuggccacacaccacuuacugucuacugaugguaagacagugugauuacuguaugccuuugagacgccuauagccuuacuucuucacgucugcugagaguaacccaaguggaccugacaugguaagcggaaccauuuagagaaauuacuagacaguaaaaaugaagaugacuucaauugauuauaaaagacgacagugcgcucaucaaugccagaaagcuaaaaauggacacauuuucauauggcaagccaucugcgucaggaccacugguaaacugagaagggaugugcuuuuugguuacaauuugaaauugcuauuuuccaaauguggacaaaaauuauuagaaaccguuuuagaagcuuuaucuuauucuuuauucuguguuugagagaaugcaugcuuguguggaccucugcgcugugcugagcuucagagaacaacuuuugggagcuggcucuuuccaccauaccuguguuuugaacucggcugucagguuugcaaagcaaaugccuuuacccacaaagccaucuuucugccauuacuauuaauuuuuugguuuuucucuauguagccccugcuguccugaaauucgaucuguagaccaggcuggccuugaauucagagcuaggccugcacccgucucuggaauguugggauugaagacgugugccaccacagccaguuaauuauuauucuauaauucuuguucuaucuguauaacuaguacugcuuuggucugcuuugugagaucagucaagucuucuucuauuuugagaagaauagauaaucuacauuuauugccauagcuaaaaaauaaagaaagaaacaaaaacccgcauaagcauuaaagagccacaaaggacucuacagccucacugcaaagguuagaagucccacagaucucauuacugcuguguugggucugggccuuaccucccaagacaguuccugggccugcuuaaaaacguccagauccucuucagucacgagcuccuuguuucccaccagacucacaucugcacuuucuuguuugaugcuuauuuuaauaucaguaucugucauuugaaaccagaagaaaggguguucagugauuugaagcaugggugaccagugcacauuaccaacaacaguaccgaauccgcacagugggcaaugggaucucuuucugcauugagcgguauaagcuuauauagcuaacccugcucacagauccagcaguaacucuuucccuacuacauacaucacugucaucuuucuauaacaaauacgagggaacguaagaacaauacaaagcaaaacauauucuucaaccaagauaagaagugaugucuaguuacaacauuaccaucauuaguuuugagcucacaaaaucuaccuauuccuccacaugacauauuuuggcuuuuuguuggauaaaggguaacaaauguaaugggccaacuuguucacugaacuuuugaaaucggucuccuuccuaaggugaauggguaaacaugcaaacacacucaaauccaaugcacacuccacagaagcacagaucaggcucugcugagacggacgcaggaugaacuuugccaugagaaagcaauggagcggagggagaggcagagcugaaaccuggcuggaagcauugccagcacacaacaaggcagcacuggcuacuugaggcggcacaggagagagcacggcagaagcauggugguggcuacucaugcggacuacaaagcugggagcaacgcuaugaagguaucuggagggggaagugccuagugccacuacgaauggaaauaaauaauaggaggcuggagauauuaguugaaaaaacacuuuuuuggagguuuagacagaauuagaaaaaggucaaagucucacugcaugugugucaaagugaggagcagagagagagagcgagcgagccagagccuaugucccgggcagagcugauuuccuggcucuuuggggugggagaggggcgggcagagguugggcuggagcuuucaccuuuugcuuaccauuauccugaucaggguuaauccuuccgucugccaagcuccccuucccugaugacgggguccccaucugaggggucacuuuauauuuuaaucugccuagcauccugugcuuuuuaagaaaaguuguucgcuugaagugagcaauggcuuuaaaaauauguccucuagucaucccccagcuacaggaggagugagagagaagccugcuccuaaaaucucguuuuccaaagaaacgggcuuuagccuuugccguggaagagaauucaguuuuacgacgcaugcguuuggguggugcauagcuugggugucccuuuuuucgagacugucccugagugguauagauaugagaaaguccaucaaagagagccuucagcuggcuguuguuaguaagacugcuaaaggagggcucaccggacuggcuggaagagcucuggguagagguagaggagguggaagagcuggacuuuugugaacuggggcucugaccagagaugggggcagggggcagaagugcagaaggugcagguuuuagcuuuugugugguaccuguagccaacacaugagaagugcaugacuguuucugagagaccuuuuuccuuggacgauagugcuuugaaaagucuauuauuucaccucgggaucugcgaccaucaggugaugguguaaaaaacuuaguaaggccaucaaugagcccuuugguuuucuuguuaacuuuaaguguagaggcagaaauguagguggaggagguggugguuuuggugguggcaccaggccggguggggucuguaacagccaaucugcugcuugagugcuucccagacgcagcaugaccagaugaaggugugguacugacuuuagucuuuugaccccuaccaggugacccccuuccugugaaugcacucauggauccuucaucacugguuacagaccuaggcaagaauuuagagaauaguaucagcauuaaauaacagaacuauaaaggcaucuaauaacaaaucuauagaaacuagaugcauagucaauguacuugaacuugagacgauucacugcaacuuuaagacuggguuucugugggugccaccaccuauguguuucuuggcuggaaaacagauucuauuugugugucaggcuccuaccagggccugucaacagguacuaagagaauccacauggacucgaggacaguacaaggaagaagaauuuugcagauacuaaaaacacccaaugcuuucgguauaauuagacaaaaaauaaguaauccccaguguuguuacaaguaauuaugauuuccugaaauguccuuuaagaacccuuagaggaaguaggccguaugucugauccaaaguagaagaauauacucauuucuagguagaaguaauuuuucacuuaguuugaaaaacuacagcaguacaauuuggguaugucuauaaauuuguacugaaaaauaaaauaaagguuuacucuucuaguuuaugcuuagcaugauaaacagccaauaauacuaggagaaaagacaauuacagcauaaaauauugcugaaaaaaggacaauugcaaaaaaaaaaaaacagaaaaacaaaaacaaaaaaacugaagaaaugauuaaagagaagcugcagcaggucggacauggagugggaagucuggcggagaagcagcacauuuaccauggucauuaccagacacuuggcccaaggaccccugccuccuacugggacugacaucgcacuuugugggauguuggguucuggccauacugcuguaggaggucacuccacaaacacagcugcccacaggaacaggacuggccaccugcacccgcccuugggcaggcuugggaagcuacccacauugcaggaggaauuuaggcaacagaaccauuugcauaugaucaugacaaugcugaggcucaaaguuacucauuuagcugaaagcuaauggagaaauggaagccugagaaugguaugauaacaaauuaccagaacaccuuaaauaauuacaaaucgaccacguuuuagugccuaucuuguacacaaagauuuaaugaaccaauuucuguaagguucaucugagguggcucaacugccaggaacuucaccuggcaccacuauuucagccacaucaggugaacacuggagaucucuggggucacuagaagacacagugaggguuagcgacaaacaacucauccaggcuaaaaugucugcguuauaaagcugcaucuggacuggaucuggaguagauuggccagaaaggauaauaggcuuauaaaacaugugaaagaaaaucuccccagacugucuuaaaaauuccugagcucaaaggacaauucuggacaaaugagaaguuaggauccgugccagguacaauuuucagcuguguccuuuguuuagaaaguuuauauucuaauuuagauuuuauaaacagaccuugaggauauggucccuuuucaagaacaaugccuacaugggaaaaaugagagagaaaaaaccauaauuucuacuucaaaugacacuaaaauaaaaaauuuuauucauaaauguuuuauauuuguuucuagaaauuaacaacuaaaaauccauuuuaaaaugucuaccauuucaguuaaagggcuuucauuaaauuucacuaaaaaaacacccaacaacaauaacaacaaaaaaacccucugggaagggguuuguacuuucuacuucuccuuuggaagaugaagcgcagacgagcuuccguacagugaaagaagggggaaaagagauacaaggaaaauucacaguggguuuucaaggcagguagaauaucuuuuuguauauaaaacacagggccucuguccuuaagcccccaagacagccugagcuguccaguaaacucacucuguaguccaagauggccuaaaacucuuuuccucucacgugcuuggguuaaaggccuacacuaccaugcucagcccuguguauguguuucuuaauacugacagcugaaucuauauucuauagagguuaaaaaaugcauucucuucaucuuuuuuucaacuaaccuuuaaugacaauuagacaacagaaagaaguuggaaaugggacuaucauagcagacuuggggguuacugcaaaauauuuuaucugcacuugccgaauggacccaucuaacuuuuuacaggacaaucauuuauagguuucucagaagcuacuauuuuggagaagaaaucuaaaaaaaaaaaaaaaaaaaaaaaaagugguaauauuacauuagcaucagaagggagauuuauuuuuuuuaaugcuaucuagaaugauaaugaaacucucuaaagacaugaacaaaauacuuuuugguuuaaaaaaaauuccugugaaaauauuuauaaaauuaagcuguuuuaaugcucagccaauaaaaaaggcugaggaaguuugcaguucuuacaacacuuccaucuuugcugcuugaaacaugucacucgguaucaaagcuacugccaagagaagaccccaaaauaccaaguguagcuacaaaugcuauuuuugaggggaaaaucccacagcuuaugcaaaaggaaaauacuuauugaauuuagaaaaauuaugcuaaaaaaaucugacaaaauucgaggggauuacaauuaccuacauuuuuuaaagcacaacauaaaagauuucuuuuaauaagaucucaaccuacaacaaucguugcuuuaauuuauuuuucggucguccaauggguuuugcauaucgccguuuuauuugugcagcuuucucaugaaguaguuuucuucccuuuuucuuuggucugcagacuuggcaaauccacaucccugaauuaauauauauaugaaaaaaaaauuuaauguuucacuuaaguugaagauauuaaauauaaaccuguaguuguaaucugaccaaggaugucuguaugcagcucuuucucuaggaaagugggucacucccuguugcucucuuuagaaaagacacugcugaaggucaaagaccccaggucaagguguugagagcagaagcuggaccuggcuuaccacucuucccuaaagcuguuccccauuaagccacccaacaccccauacucacccagggaaaccugugugugugugugugugugugugugugugugugugugcgcgcgcgugcgugcguaugugugucugugaauguccgucugccugucugucugugugugaaugaaugccauguguacaugcccacggaggucagagaaggcacuggauccccuggaacuguuauaugcaguugcgcacugccugguccucugggaaaacagcacaugucccuaaccacggagccaucucuccagcccaagccauaagcuauuuaucuuuuauuucuuucuuaucacuugggagaaaguuuuuaagucaaucaaucagacuuuugaacuuucauaggagaaaaaaaaauuguuuguuuuaucaaucgcuuugggaaauuuccaacacuaaaaugguuaugaguuuaaguauuuuaaaauuaaaacuuaacaauuuuaggucucuggcacuauaauaauugaaguuacaugucuagaauauuaaaaaaacaaacgaugugacuauuauagacaaguuuaguagaucaaaaagcuccaauucaaaucaguggggaaaugaggaaacaauucgcugaacucccuggaaggagaagagcuacuuccuauucuucacgaggacgauucaguccucucccuuccccuccccucugcauuagagaaggucucaaguagcccaggcuggacuugaacucuagacccuccugccucagucucccaagugcugggaucauaggugugaguuaccacaaccuguuacaaaaaguuuauacacuaacuagaaaagaaauuaaaaaugauaacucauugcacaaacaucucucuacuaaaauguaauuuccacgggguggggacagaaaucacauaaacugaggcaaagaauccuacaugaaaaauaaaauguggcaaacaccaggaaucuaaacugauuaauauuucuguaaagcugaagguguaaguacuugaaccucaauggaaaaaugauuauaguauaaaacagguauucacaaugaugcgaauaaauaaucaaauacagaaguucgguguccucaacuaaaaaaagggaaaagaagucaugauuuuuuuccuuacuaucaaacugauuuaaaauauuaagacuauaguuuuaucaaaucuaagauauuacucauaugauaaaaauuauuuuaaagauguuaaaagguaaaaaaggaaguaugucuuuggcucagugguucuauuagcuuugucaugaggauaauuccucauacacugguggucgguauaaaaacugacagccuuucaaguaaguggccucuaguuagagaauuccucucuacgaauuuaucuucagguguaagggaaacacuugaaguaucuacuguagagaauugguuaauuaaaucaauuaugguucauuuauaccugaggcugcaaaaucaaauaccuucaggaagcaccucgacugcaugugacuaaagcaaauuagaacacgugacaauagggagcagugacagggugacaaaucaaagcaugcaugccccauugagacaacucaagguaaaauugaaaaggaucgugccaacaaagcuuauucauggcccacaagcaggucuggaagcccugcuccguguuauggugcucaacaugacuuguguaaaaucauguuuaggagggcgagcaauggcaugaggaugcuuaccaucuauuauugggaagaggaaaacucaagguuacgcacacauuugcagaacgcucccuugaaaagggcgaguagaagcaagaaccucuugguaacuaacuguuugucccccagccuuuauauuucuuuuauguuuguauucucuauaccuucuacaaugucaauauauacauacuauuaauaaaagggcaagcucauucuuaaauguuuaccauauuauaaacaugagggcagguacauggcugacucacacaaacagagaagagaacuccauauuacaccagauacagagaauucccauguucgugcauuuaaacaucaaccaacagccagacccuggugcuggcuuccuguuuuaguacucugaagucaucacugucaucgugaauuuuauaaauacaaaauucacugccuuuacuggcuaauacagacagggucaugacuccugacaagagaguccucuuccucccaaggucugaauucuuguguuguuccccugaccaaaugacuuuacaauacucuucuauugaagccugcaacaacaugggguggggagcgguaucuccacacuucacaagcagguuagcagguaaggacuuugccuguuugcuucacagugcugggaauuccaccaggccucacacagcuaggcacgugcucuaccacgcaccugcacucccagcucauuuuuaauaugguuggaaaguucaccuuuuggcauucuggaaaguggugggucacagcacuccauauggaauccucuaucacaggaaucacaaaaaagcauguuauccuguaauacaacagauuagagacuaguugagacuaagaccagcugaagaacaucaacacccaaguuaccagguuaacuaagauguaauaaaggagccacaguuucccaguguggugcgccauuaccaauguuuaaacacugcaacauuguguuggaggaagagccccccuccaucaccgcccuggcgcugggaugugaggcgcguacucacugcauuuuugcccuggacucgacaugcgcugcacgucuugcacucgaugcacugccaccucaaggccuucacauuugcgguuaacucaggacaaaacuucagacaggauggguguccugcaauacaaagcaauugcucugucaauaaauagugccuuaguuuauaaaacccucauugccuucauucaauggaugccacugaggccgaccagugagccuuaggaacucgagaacaaaaccagcuguagcugcacgggcuuacuuucucuucuuugucucugacuucuuucccugcguauaugaagugacuguaugagacuuucccugagguaacccugaaccuuaucucaguuucagcuaucagucucauaggacuugaagggagugagagggagugagagauagauagauagauagauagauagauagauagauagauagauagauagauagauagauagauagaaagaaaaagagagaaagaaagagaaagagagaaagaaagagagagaggaagagaggaagaaaggaagaaaggaagaaaggaagaaaggaagagagaaagagagaaagagagaaagagagaaagagagaaagagagaaagagagaaagagagaaagaaagagagagggaugggggaagaagaagaaggauaggaggaggaggagaacgagaaaaagaagaagaagaagaagaagaaguaguaguagcagcagcagcagcagcagcagcagcagcaguagccuggccugucaucgucacuaaccuccacgugcccacagccauugaggaugcugugcuguauagugguaaccauguccaaacaacugaucucuguguggugaaaucauauaaaauuaaaaaagauggcuaaacaaaaaacugguugagcuuaguaugguggaugcacaccuguaauaacaugauucaggggucggucuguacaaagcaagauccugccuuaacaaagagcugagacuguuuggaaugcuacaacuccaaguggcuugaugaauucacucauuacauagcacacaaagaacauuuacuacuaggacagaugaagaacauccacugccauccaguuccugggucacugaguuucaauucuaaaagcaggggaacaagcauggaguuugggagcugaaggagagacucaggcaggacguuaggaagccacccugggcagguucccucggcuugcuugaacaauguguugcuccacacaacccugggcacuuuuuuuuuuuuuuacccagcaacauucugcacguccaguuugcagaaagccccagaggaacaagaccaggauuccaugagugaggggacagugugagcugaggcucuggaaagcagcuccauuucaaaacuaauggcccuuuuucacacaaccccaaggagaucuccaaacuugauuauuauuucuuuuuuuaaaaucuggucuuuaaauagcaagaacauuagaaaaucccaugugagagaacuuauaaccaagcugcaaagggaagcccgagggguaauaaagaaagcagauucuguaauuucaaaacuguuuuauaauuuccugacuuuggcagcuucauuguuuaaauauguauuuuggguuccugccaaaaagguucuccucccuaaagcuuaacaggugcuucauaaaauuccacucaccaggagaguugccuuuuugaaguaagaacauucaauaucaaucaucaauaccauuaauaaaaguacacaauuccuacucuuuaaagaaaaaaaaaaaucaaaacaucuguauugaagauguugaaaaaaaucaaaugcugccaacuggcuccagcuucaggcuuggagagacacccaggcacgugcgguugaccuccagucucuucuaagggagaagaagggucucuauccaaaaagagcaucaauaccccaccccucagaaaccgcaaacaagcacuggucacuuguuagcuagaagaguaugguuggaagggagagguuagaagcuacuuugaucaucucacccccuccccauguugaguggacuaaaaacucaacuuuuaaagaagagcaauuuaaauuccucccuuaaaauggauccuaucagcuuaaaaauacaccauuuacuccucccccuuuauuacucccuguaagucauacaucaccagcacagacgaccucaauuucaugcacugaguauuucucuaccuuagacucucuuuuugugcuuuguagcuuagucuucaguaacuaagguaauucauaucauauuagagcuuacuauuuauuccugcagauauccuacaauagagacuuuuaaaaauaauuuugcauuuucaaaaguaauagacuccggccauuuucaaucaaaagcaaggaacauuuuuccucuuaaugcuuuccuccaccuuaagcaauagcagcugagauuacuacuauguaagcugcccuaccgaauuccaaacucuuuagcccaucuuuuuuaggaagcaaucuucccuuuauuuagcuuuaaggaaacgauuauagauucuuccagcuugacaauucuaugguucuguaaaagaugccaagcaguggaaagacauuuccauuugcuuuccucacauuaacuuuaaaaaauaaaacaaaagauuguaacucagucuugguguauugcuguacaauagauaguaaugagcuacuagaaaucaaugguauugauaauauaaccccuaaccuccuacugagccaccccauaaacuuaagucauuucucuaaaauccucgcucucucugcugagagaauucaugaggauuugucuuucuggagaugguuuuauaacuguggauuuugagaaccacauuaaaucuucuuucacuuauucauuaagcacauaaguaguuauaauuuacaauaguuuuaucuaguaaaaccaaagaagaguggcuuaaaauuagggaaguaccaaaggagccacaaaccaggaaguccuugagaagaaaacccauguauaguaaauacagugaugguccaacaccccaauucucaugccauguagacaaagcaacucuacaagcaugggucugacugagggccugacguccgucaugaggagaaaggcagagacacugggagcaugcaacagucugcacuugucacagcagauucugaagauggaggaaggaaagcuggaagccaaacacugacacucauucccccugggaaggggauucaccugacagcaaggcaagggcucggcaaacaaucgagcaaauccuacuacaaccaauggacaaggauguggauccagacagcaccccaaccugcugacaccuugacuguaauuugcugaguccuacacugcacuucuguccuacagcuguaaaauaaaaaguauggugucuuaaccuacuaaaucuguggcaucaauagaaaaauaacccagggccagggauguaguucccaccuagcaugcucugaauuccaaugaaggugggagagacggcagagaaaagaaucagguguccggcuccucaggcugguuauuuagcuuucaguauauguaaguacuccuucuccaaaugacauuuaauuagcauuagaaauaguagaaagagagaugauuccuaaccuuucaggucacgugauguagcagaaagacaaguacuaaugcacucuagaagcagagacagaagaaacugaauguucaagaagaccagccugggauacacagcaaaaccuuaccugcgacaaugcuuguccaccaugcacaaagccuugagcucaauccucaguaccacaaauuaaaaggcuauggaaaacaccagucauacaucguaacaaagggaucccuuccugcccuuggagcaagugcuauauacuguggcacucaguuacagaaagagaaggcaggcaucccccgcccuagucucccaauaaguagcaugucuaacccaagccugcacacuaacagaucuauguaucuccauucugcauacacagauuugcuguuauaacaaacuaaaguucaucuucaccaaaguucacaucaauuaauccauggcagccuaaguuaccuuucuaaauuuaaaaaucugaucauggaauuuuucuguggcuaccaaauugacauaggaaaaaauguaaauucucccauacugguugcaaaacccaucuaaauuggaccccuguuaacucugccccaaaccauaaucuuuugauucugcacugauaccgacugguuccucucuccaaguccauggaguucuucuccaccucuguguacuccaccuuccucagccugcucuccuggauccauuccauggacccacuuugauuaaggaggcccuucucagccagguggugguggcacacacuuuuaauuccaguccacaggaggcagagacaaguggacuucugaguucaaggccaaccugauccacagagagaaagccuguaaugaacaaacaaauggagaccauucucuguucuccaaguccaggggccacacugugcauuguucuugaucuugacacuaucaccagguaaacaggcuucugauguugugauguucagccuuacuucagggccaauggagcaauggagcuagcugaccacugacuaaaaccuuccaaacuaugguccaaaauagacuugccuuucacugugaugacucagugacacuguggcuucuugagggccggggcuccccuuccucuucugaggugaggcuuucauuccuugucuuucuauguauuccucuuggaauuccuucuggucacggccuccgcuuuccaacccaaugauccaauguguuucuagucacugugaaacuagaugacuaaccaacugcucccugaggcauucauacauagcaacucuaagaaaccagugcuaacugccgccccccacccccaaaaccauacauacggccaaaggcugcaccuuucccucccagcucccccagcacggguagguuccccaggcucgcgagggaggcugaccuucuaccuacagauccugcucauguucugcagagagguucugucccucucccagcugcgccucacagccucucugcugccuccuguuucaaugagcuuccacuuagugcgaugcuguaauuuugaacuguacacuuaucuuagauuugcuaauuugaaaacacacaugcacacaacucaucuguaaguaagauuuaaccacccagcaaucugagcagcagacacaaaauuucauuuggcauaauaucuaauacuuaugugaagcuaauuaaagauaauuuggccuuaaugaggcaaggagaauagaacaguguuaauuucaaaguaggccgacccaugaaagucaaguaaaaucacuccccagucucagcauuuccucagaccugacugaggacugucucaguuuuaugaguggcuaggacaaucuccggaugugucacguggcugaucaugcaagccccguggaucuagaggacagacuuacuauuuuccauuguacagaauaagcaaaugucuguugcagccagcaggaaggggaguggggcaugggguuggagacacuacauucggggcggcuuucuguaccucacuucacauguuuacugcccuugacuugagcaguuuuuuuuuuaaaaugggacuuuuagcaaggaaaaaauggaguucugaucauuuguuauacagucaucuuuaaagcagaggaaguccagugaucucacuucauguggaagcagaaggaaacaguuacacucaugucuguggaagcucagcgcaguacaaucgucaucacagcaauggggcuucagagagaggugacuaagagcgucgagcacauaugggaagcacauugaauaaucaucauccuccugauggcugcaucuggacuuccuucuucugguugucuauuacucauggacauuuuucuuuuuuaacaaaaauaucuuauguucagaauuccuuugauccuuacaaacagucccgauuccauccugcagucgguggguccuucuguggaugggaaggcagcaggcucuacaaggccaccuggaggaccaaccuuuaguuccccuggagcugcaggacuggacugugccagcauggcucccauccugacaaggcacugcagaagcauguggcccaucauggucuuccucaugaaaaccaugguguuagaaaccacauguacuccaacgccuccuaagauuaaccacauuuuacuuugaugcuucauuaaaaaaaaaaaaaaaaaaaaaagauuuauuuuuauuuugugugcauugguguuuugccugaagugacuguaucagauauccugaaacuggaguuacagacacuuacaaacugccauguggguccuaggaauugaacccagguccucuggaagaguagccaaugcccuuaaccccugagccaucucuucagccccugaugcuucuuuuuucuuaaguuuuucgagacaggguuucucuguguagucuuggcuguccuggaacucacucuguagaccaggcuggccucgaacucagaaauccgccugccucugccuccggagugcugggauuaaaggugugcgccaccacgcccagcgaugcuuaauuuuaggaggaaaaaggaauauaguuuuuuuccuaauugaccagagggcguacaugucuacacaguauuccauaauugggaucuucucccagccccugaaguagucaaauccaagcugauacacucacagaugguuaaggaacugccagagcacugcucuacuuuagagcccagagaggcaccuucaggcauccucugugcucuacagaauacacuaugccccaagguuugcauuucugccaguaacagguagauguaugugauccagggacagagaaccugacccuucucuacuugcuagaaaagaaggguacuuuugagggcagaaaggacaagccugggaagcaaggauggagaagugggaagcuucagagaaaagacauuucagccacuuuugugcagagggggccagaccucccucugcugggucuucaaucugggaagacuaggggagcuugaugguauuauaaagucuaagaucaaccuggguagaauuacaccuugauacccuauaaggaaggccuugaaguuaugauaaaaucccagauucgcaacaacucagcagggccgggugugucaucagcaaugaggaauauaugaagagaaucuuucuucccacuugcgaaaucugucugcgugccccaugaauagauauuaaaacaagaugauagagggcauuuuaacauacagcuuaaaauucacagauaaacaccagaugucuggacaccacagaacucaucaggcagugacacaaaaaaauaauucauuugaaaugagccuugugaaaagaccuacaagguaaguagaggcagacugaugagugaggcacugccugcccaggggagcaggggacucauagguugaaauaaauuaaccugaacacacagacaauguuucugugcucuucugucacuaacccaggauaccauggccaagugagagaaugcuaaugcauccauaaagcccaucaccgagacagcagaagacaucuuuuaggcagugcuugacaugucauaucgugaaggcucuuuccagcuagucagguccuggaggcugcugaccacaaauggccuaucaaguugaacuucugaauaaccaacuaagaaccauuccacaacauaaucauuccucaguaugacauauuuccucuauccaaccauuaagcagcuguccuacguggugacaaauuuuaaguuacucacagcaaucaagugggacagcacgagaguguggaaaaccauaagaaugggugccacuuccaguucucaggagagcccacgcagacucuggacugggcuguuuagucccucuaaguguagagguaagcaccagcauuacuaaugaggacagcaccuuguggaaugauuaggugucuggcuggaaggaaaggcagugguguaugagagcaugcuauagguucugcagagcuguuuugcuuccuuccuucugcuugcugggauugaaccuagggucuuagacaagugcuuuaccacagaaauaaaacuccagcuguuagccaggaguuuuaaacuaacauugagggaaaaaauaucucaguaucugagagaaaaagagaagaccaacacagaaagauuaacauuuaaaagccuuacagcuggggcugcaacucagcagcaggguuugcuuagcauggguaaggccuucagguugguacucaaugggaaaauaacaaaacaacaacaacaacagaaguacucauaggggggcccaguauuaccauuucauaugcaggaaacuauguguaugugcauguaaccugaguggcuuuuaugugccgaaucaaaaagaacagccaguaaaagaaaaccuuuaaaaacauaaacacaauuugcauuuauaucucugaauaaaauuggaggcauaaucuuaaaaucaaaugguaagagcagagaagacacacuccucgaaucucauggucugucccuuuucuucaguuaacauggagcuggauugaauuacuacauuucaccaguaggugucguaaccugaaacaauacagacuucacuggagucucucugagacuggggagaacagaagggguauacuguguuuagcuuaaauccuuugcuaugagcuaggcguggcaaugauuggauuugggaaggugaggcaggagacugacugacugaggucaggauuuaagaguuugguccaggcaauauacugagcaucucaaaaggcucagggacaaguaaaaggaguuugaugccagccugggcuacauggagagacaguucaagaaacagucaaacaaacaaaaucucuacugugacuuuacuuacugcaugcacugcagucuaacacugaauuagccacauagaucugaaacuggagcuugguuacaaauacuacugaacagaaucauauaaacauguaacauaggcugguauugguacauucauauuucacccuugaccuguauaauguucuuauauuucaaaccuauucuaucaccaaacgaugucuuugaacauguucugggagguuucgcuacagaucgagagcaugaagcucugacaguggacaccauguagaacgcacacaaaccaaacucaccacuacugccacaaucugcacaagacaggaguucuucugguuucuuuucacgauuugacucuuuaguccccaaacagaagcuacauauuggaaugggaucggcacggggcuaugagaaagagaaacaaaaacaaaaaccaaaacauaguguuagccuuccuuucaaaauuuaaaacaaauuauuaaauucaaagcgucuuacauauuucuuaaggaaacccugauaaauuaaacaaucaaaaagaaaaucaacauuuucuaauaaaaaucaucauaaguuaugugguagcaaagccguaucugaauacauuuaaauguagucauuagauccagaaguaacuuuuaugaauucagugaauccuaagaccuucaacuaucacagagccuucagcaggaacauuaaggauucaucuguguucccaaguguucccauaaucuguauguacaauaaacuguucaucuacucagcaacaaagacuauggaccucaucuaguuaauuagugagauuauuuaacucagcuuuaucaaguguugugauuauucaccuauuaaauaccggacaugaaaugcgugcuucagagagcccaugaacagagaacgagcaggagcuaaaauucugucggacuugagaagaucaaaagacuauuaacaagaccucucuggcaccaagggcuucaaagggaaaccagggcacacagaagagauaaacccuccaucucugacauucacacuuuauaaaagaaacaacaaaacauuugucuacccccuggcacccuuuaacucucuauggcaauugcuuuuaacaauguguaaaucuacauacauucugcgucuccucgguugauuauuacugccagcagggcagacauuuccaaccauaugaaugcaguucacugugccuacagagcuacauuaucuugaacagccaaaacuguauaaaaacuaaaauuuuauugcacauuccaagccuucucacauguugucugcuaguucuucucugaagccuuuauauggaaugucaugaaucaaaaauucagggcaagaaaacucaacauaaucacaaauguuuuuauauguaaaucacaaacaagauuguguuagaucuaauucucuaagucgacagcagcacagaauaaaccucguuugggcaaccauucaaucccaaaugccuaauacguagccugguucacaguaggcucucaaaauauguuuacugguugaauaaauaaagaagcaacugccaguuaaaaagaaaaaucagccacuucuuuaagauaauauuuuggaugguuauaaugauuccacaaaugucuugguucccucuaacaacaugccaugaaagucaagaauucaucuuaugaccuagcauucacaaacaacaauuaauaugacugugacuuucaucuuacaauaugaguguucauuauccugcccuuauuuucagccgaauuuguucuauuaauauaugcacaggcuucacuuucugagggagcuuuacaaauggauuguuguagcucuguuaaaaaggcucaguguggaauauucugcaccagagaaaccaagaggacaagcuacaacaaauuggucagugacuccagccacaguuucugaaaggccagauaaucagcacugcguaauuauggauccauaguuauuacuugcaacugcucggcugcaguaccuugggaacacuuuuguuccuuuaaauagcaauuaaaagaacaaucugguuuuaaagugacaacguuccccugauagauucuggcuaaagcacagucuuuguacuaaugggauccuugcuuucauuugauagaacaauguucaagccacugccaccacccuaacagugauaaauaauuuacaaaaugucacauaucauucacgaaacgaaauaaauccaaaucuguagcuccauguuucuuuccagauggauuuuuagcugaaagagagccauggccaucagccagcauucacgcucauuuuccauuuguaacuaaagguaacacaaaggacaaagguugcuaguaguucauggccagaaagacugaugucccgcacacugcccaauaauagaagcagagaugcuaucacauucaagugaaccccaccaugcugauguaugcucacaaccauuuauuuuaaggauaacuaucucacaauacucuauaaaaccacugcauuauacagaaacgucugcccugcugaauuauugauaauucaaagcacuuuuugcuaaccucaguguagccgagucuaauuaacuuuaaaaaauugucacuuguaugaaaugaaacuuguacaguaaugcauguaaaugggucacagaauuauuuugauucacuaucuucagaugacauauaaacugguuuuguuuguuuguuugucugucuuggcuuuuaaaaaauaaucccuuaaaguaaaauggauucuagucagaaugaggucugguuaaauagcaauuugauuccgcacaaaucuauuaacgacaagugauauuuaagaacuuugaaaacagaagcccaaggugaucauggcggcacacaccuguaauccuacaauuuaagaauuacaggcagagagcugggcgugguggcgcacgccuuuaaucccagcacucgggaggcagaggcaggcggauuucugaguucgaggcuagccuggucuacaaagugaguuucaggacagccagggcuauaccugucucaaaaaacaaaacaaaacaaacaaacaaaaagaaucagagguagaaagacugaaaugacuucaaaguuagcuuuaguuucaaggcuagccugugcuacacaguaaagcacacgcaauaguucccuuaaaagaaaaccaaaaccaaauccaaaccaccuaacuuuuuuuggaaauucuuuuucgagacaggguuucucuguguagucuuggcuguccugggacucacucuguagaccaggcuggccucgaacucagaaauccgccugccucugccuccugagugcugggauuaaaggcgugcgccaccacucccggcuuuaauuccuuucuuugcucucuggggcgggguggaggguugcuggcagcaacauagccaucuugguggguaaaguggcuacacaagcagaacaacucuaguuccguccugggagcccacacaaauagacagaaagggaaagugacucgaguauuauuuucugaccucuagggugcauaaacaauagaguaauaaauauuugaaagaaaaaagcaaaaggaaucucauaauggcaucuaacuuguuggucaaauuuucuaugauguuugguucugcugaacucauguuaagccuaaaacaacauucagggaguggugaugguaaguaaugagcuggcucuguucuguaagccccuuuccugccucggccaagcaguggcacuuaggcagcagggaagccccuccucccaccaccucaguuacucaccaagcggguaugccacauuaucccuacuuuaccuaggaaccugagggugugagugguuagggaaauucuguaaacuugcacgggucccagugcaguucugaaucacuccaagucugugucccuagggccaagugcucaaccucacauuucccuccaugacucucucagaaaaacagaggacugaaauuuaucuuucuaucaggagcaacacauuuauugauguguuuagcaccucuucaauccacuuucuuccaccaccaauaggauguucugaaaguacuuaaaaggaaaucuauaaugcuauauuguuacuagucacaaugggauuacuucuguaaccaauaugggacuaagaccaugugccuccaagugguuccauaaagcgcuuaggacagccaugccauucuuggugaaucuacuaguaagagaacaauuaacgcaacuuuaaauugaagaauucuuuauuaaacaaugucccuggucucuucaaaagauauacauggagacuaaauauaacccaugauccuugguuggauuagugguuuuaaaaagagauugauuuauuuauguguaugaggguuugucugcauguauguauguguaacguguguguuugguguuuuaaggcuggaagagggugcugggugcccugcaacuacagcuacaggaagccgugaggcagcacauuacugcugaguaccagaccugagcccucagcaaguacucuuaacugugaggcauuuaucuagcacccuaauucuugagucacaauaaaggauuuuucugggauaauuagguaacgugcacuaaauacagaguaauacauaagccagaugucaacuuaagugaacauauuaugaucauguugagccauggccaacaagcaccguuuuagagauaugagcaaauacuuaaaaagugucaugguauguccguaacucucaaaugacucugaaaacaccacuacaccuaaauccaguaaggugucuggcuaugcagcaaagugcccggcuggccaucaacaugaaaggcacacacacacauuccacaucacucuguccauuuccugccauuuccaacauuuucaagucuagaaucaucaacaucuucacguauggggguggggaguauuccacucucaaaagaaguccauugcaaaguauuaaccacauggguuauaagcaucagagaauagaguacuauaacaauccagucacugauucacaggaaguguugaggacagacaaccguacucauuuaaagagagagaagauaguaccaaaaucacaguggauaaaugauccacuuucuucaaaauuaaauuaacagggggcagaggaagcaggugagcaagacuuggaacuuagaagacugaaagaaaaaccaggcaacuguaauguguaagcuccauaugucagacuguccuuaaacucuguauauagcucagguuggcaccaaacuaacuauccuccugccuugaccuccagagugcuaaauauguaccacccuuugaccuuaugccuugcucuugaucaugacuuuaacuguaaauauuguuuuuaaaaguuagcuggguaugguggggccugauuuaauccuggcccuaaggaagcauagacaguuggaucucugugaguuccaggccagccuguucaacauaagaaguuucaggacagccagggaaggaacugagguguauacucuaacuuugggagguggcaagcuggguauuuucuugcagguagaagguuagacucaguggcuccugggcacaaagcacagaccccaaagcagaauagaaaaauguuacagcugugcucucuagcaaaaagacucacaauugcucucccugucguuaacacacuucuugagauuauggugcaaaaaaaguaaccuaagguuuagggagauggcucaguggguaagcugcuugcuaugcacuuuugaacaccccaguuuaaaucccuagaagccauguaaaaccgagaugcugacaguccuugcuaagaugggaggcggaaugaagagaauccuuaaaagcuugcaggccacucacaguucauacaucagagagaaccuagggcuagugaacuagcccagcgugucaaagcacucauugccaagcuugcuaaccugaaugcagucccagaaagccacaugguggacagagaaaacugacuguuacaaguuggucucugacuuucacacacccaucauggcacacaacugcacgcacacacaaacacacagacacacacacaccacagaaugauaaugaaugacuaacauccaaggcuguccucugacuaccacaugcagccuguggcaugugcucacugcaugcacaugcauauauacacacaaagauaaauacauacacaaccauaugcauaacauaaauuuuaucaguuuaaccaauuuuaaggugccuucauuggcaacagucauaauuuuguagaaacaucacuacaucuauuuguauaguauuuucuaucuaucaaacugauauucuacacauaucaaacucuguuauauuccucuuuuucuuuucacuacuguauuugucuuuauuucuaacuuuauuaaugcuuuacccaauuuuccuacauucacuuuauauccuuaucucugccacccucccaacccccuccuccacuccccaggagucuccccucccuagcacaucaagucccuauaggacuaggcacauccuuucccacuaaugucagacaaggcagcccagguagaggaacagauuucacagacaggcaacaguuuuagggacagccccuguuccaguuguugggggacccacaugaagaccgagcugccagccacaaguguccaagcuaacugacucugcuggucguccuguggaguucccguccccuucagucgggcccuauggaugaccacggaggccuuucuccacugcaauuuuuuuuuuuuuuugaaacuaucauacucaaggcauuugagcaucuuugggaccucugagcuaaaaaaauaaaauagcucucuuccuaggaaacgcucuuaaaacccaggaccaugauguaagaagugucauuacucuuguuaguuuaagauacuguacaaaaagaaauccaagacuguacacuagagcagaaucagagguacccgugcucacauccucuuccugacaaugucaaauuagggugugugugugagagagagauaagcuauuucuauagccuauguacacaaucaggauauaugucaagggcucucuuucuguaagccguguggaucugagccuucucugauguccuuuaaacuacuagaaaacacucucggugauccgaaucuuacagaugaaaggucccauacucuguguguauuuacucagacuugcaugacuggaaagacuggaaagagauuucaguauguuccuugaagcucugaguuuguaaaagcauacaaugugugcagguuguccaguucuaggauggcucagagguaaacggcgauugaguauggaaaguacuauaaggcugacuuaaauauugccuuauuuauuacccaauucacucugguuauaaagacuuaacagcuucaagccuuuuaucaauauuagcacaaaucaauugcuaugaaauuuuaauaauuauuuuaaauuauucuagaaaagaauuugauucucucagucccugugaugaguauuaauuuuacaggacuucuuuuaaaagaaucgccuuaaccagugaucauaugaacaagguaggaagcaccucaaccaaaaacgcaaguuuuuaaaagcuauuuaauaaaggaaaacucagaagaaaaaaaaauacuagcagaagggaacaaauauacggaauauaugaaccaacuuaaaaaaucuuaaaugaaaaacacuuagcccaagcaccuuuucccggccacuaacuggagaacaguuuguaauuggagagugucuguacuuaagccaggugauucaaccgguucucuaaaucuccccguucauccaagaucccuccacaaugcuuucucuggcccugcuccagccgcgcugaucucuggaguuggguccugcuuuacugcuuaccauaaaguucugcgcaugugcgccucuggccucaaccaugcucagucuguuucccggggaaagucaaugccacgaaaacuaucauccaagaauucuggucagacagcuccgagcccucccugacauggucaguccuguguggcauauggaguuggauuuaggugucacgguaccagacgaccugcacugacugcccacugucucuaaagcuauucacuggccuggcguagaaccuuccucaccuugcuuugcugcacuguugagcacgcaucucuaggcagugccugacugguucugcuucuaucccuaaagcuaaagcuuaagcuucuucacgcggaaggcccacuugaugacagcgcggccacgggguguuuggugaaccacugagcgagcacagcugcgacugggaacuguuccuccuucucagguuccugaccaccagugccugcuuucaaauaucuuuaaugacuacaagcacuuugaguaaggcaagcagcaguggugagguguguucaucauuuauugaagguguuuauuuaccaucacacauauaauaaaugauacuuauguuuaccugggcauauacuucccuaggcauaaucugacaagacaagguuuaaaguuuuaaagccacccgaagaaaauuuacccuccuaucaucaugaauauuaacuuuuaggaaucacccaauuaaaacccugugcuguuuuuauauuaugccaauuuggacaugggggaguacuggggagacccagagagaauggguuaaauaugaucaacauacauugcauucaugcaaugaaaaacauacaaaauaaguacauauauagugcacacacgcuauggagccaggucugauggccagucuacaguggugaagcaucccucuccaacaugagggccaggaaggagaaaagcugagccgcugagagagauggaagcagcagugucagcagcaggcagacccuagaguacaaucccuccaucuuuucuuguuuuuguggccacaugguauaucuuaggcuggccuucaucuccugauccuccugccucuaacugcuagaaucauaucaaucaucaaucaaucaaucaaucaaaucaaucaauuuauuuauuuagcgagacagggucucacuguguagaccagguuacucagagauaggucugccucuaccucccaaguacuuggauuaaagauguacucacuggcucaaucuauuuuaaaaguacuuuauauacauauuuuaaacccacaucgguuuaaauacauacaucggugcuuugugacugauaauguguuacugucaaaacuuuauaccugucagugcagugacaacacagguugacaaugcuccucuugucaacuuaacauuuuucugccacuucaguacugggugugacauuuaucuaauaaagaacuaagcuucauuucuuaucacuuagccacuuacucaacugaugucuguuguaauagauugagcucagcccugcacacuugggacuucccucugaaguaauaugccuaacacagucuuugggaacacacaaacucugaaagacuucuugugaugaccugaagcgucuucuuucuucugagcugcucacacugccaugggucagcagcuguggucagugcagccaugggucagcaagcagguuuggaggccagcacccauuaaagcagcaggggcuacuucaaacccuucugggcagaacagaacuguucauaacaugcauguuguauuuucucccuguucauauacccuuuguuaaaguggaagucuuuccucgagauucaugaauuugaaccugaauagaugcuaaguaauuuuucccgggagguaauuggagacacacucacuacaagauguuccacgggaaacaguuucaucuuaauuuuacucucgcucuauggauuuccacugucucaccucuccugcucauuaugcuucucgguggguaauugguucugugagagagcaguguaucauccccccagcucuguggauuggccuucuucaucacucugagcacaaggauuuaugguugguaauguacagagaucuugaaugugaugguuguauuuuagcuccuugucacagugaugagcauucucaguauuuaaaagcagcagcaacaacaacaaacccuaagccuaguaaaacaagcauuugaaguauuucugcauauaugcauaaaauauuaucccuuucccccuucauuuagaagcaaacucguaucaaugaccacauacuacgggggaugccuuggaucaagggagcuucagaagcaagacacaauaggagcucagccacaaaggagcgagaagugaggggcagucuaagaacaucagcccgcucaccaacugugugcagcuaauugaaaugcucacacuguauccuggagucuagaacuuguucuaauuaggcagguguaccauuuauaagcaugcugauuaaggagagugauucuacuggaagaaaacaaaucuaauccugcacacugagcuuaacaaaaaccucucacuguaagaugaagccgacacauuuugaaaaaaugacaacgaaauaauuaguuuccccggggccuucaauuucuuaucuggacagggccuuggcuuuuaagauugcaucugaacagcucucuuccaccccugccauuagaaacugcagauauugcauuuaucuuccuaagagggaucaaagucugauucaacacagcuggaaauucaacauacgguuacaggaagacuguugaagauuuacaaacuguucucguuggcaggcacaucacaacauuagaacuauaaacuccacauuuauauuauauuagcacuauaauuugagauuuagaaaaacagaaaguucaaauaaacuuacaaugaaguaucacaaguccuuaguuuuugcuaaaaaaaaaaaauuaauuaauuaauuaaacacgucucccaagugacugccagucucagugguuaaagagauuggcaaaagcaaaaucuagacuuugaaaccauuguuucuuuaaaaauaagaaaacugacaggagguggggccuggugacuccugccugccacccccacuuuaagagcacugccaaaagucugagucuagacugggcuaaagagugagggucaaucucaaggcaaaccaaaacaggcaacaaagaagaagaaauccuguccuaaagaggaacuaggggcgucagcaaagcacugugcaagaacacguuugauuugcagccccucauaaaaaugaaguggguucugguggccucagcuuguaaucuuagggcuagggagguggagacaguuguuggagugugcuggucagccagucuagccuaauuuguaagcaccaaacagucaaagacugucucaaaggaaguggacgacauuucugaggaugacaccugagguuauccucuaguacauaugcgugugcgagaacacacgcgugugcgcgcgcacacacacacccauacccacacaggggacacaaaaaaguaaaaacacugcuacuggggcaggggagauaaaaaaguacuaacuuuugaaaacuuuuccuaagcaaggccagugcacaguagcaguggagaaaugaaaagacagccauacugcacaucagaaaaguaugcgauggcuaccauguugucgauggaguugccuaucugccagagaaaaggauggcuucugcaauucccacuucgauauaaguauggcccucaaccuugcauagauguacucugcugcaaagaaaaacgugaaccaacugcuagagguuggcacaggcaauauuauuuauacccaauaaauaauacccaaagcuggaaacagaauccagaggugacauaccgaacauucuccuauagcaacaccacccucaacaguucuucacauucggagacccggaggcagggagacacagugcgguuuacugcggauccacagucaccuggcacaguggaacuaacugacgcucuaaggguuugcccucccagaagaacuaagaguagcauaauucuaucaccacacuuauaucucagccacccucugcgcacacaaaccauccagcagucugcguuucuaagucucugccuauuuugcuuuuguuuuccuuguuuccucugcccuuucaauuccaguauucaucauaagcagggagacuagaguugcuuggauaauuacuacccaaaugucagagcucagaccuuguuugugugugcagcagcuucaccccuagaucauuguuguggugucaaaguuccagauccacuaaugcuuugggccacacauuguucugggaccaaagcaucacugccaggagucagaagagccacacaagcccaucacccuucucuacgaagcuacagcauagcuagcggucauccucagaaauguguccacuucccuugaaacagacuuucauugguuuggcgcucaccaguuagacuagacuggcugaggaauagaugggucacacaggacaagcuucccugccaggucagggauuuuccaagcucaacuuccuggagcauauacaaggccaccaaaacaauaggaagaagaaauaaguaaaauuucugauauucuguaguaagaccaauacuuacuacacuccgccucccccaggauuacagcaggacuacacugcccaccagggcacauaauuacuucuaaguucauaugucacuggaacuugggauguucauacugcugcacacacaaaggugcauuuuauauaugacaauaacauguagaacaaaguuuugcuucaaugaagguucaucacccaucuccccucaggcuuccugcuucucacccacguucgugccccuccucacuaucagccucuacuuucaucucuauuaucaucuguuaauuugguacauuuuauauaauggagccugagaauugcuguguauaggguuccuucccacuucuaugcuuuugagauugagauucucauagacuauuguuauuagcauccacaauuauuccaccucugaguagucuuuauugguaaaggcuacuggaaucuuccuuaauauaaaggcuguguugucagucucacagaggugacuuagucucucuaaaguagauuggcauuucuuucuaguuaacaguuaaaacaaaacuguuaaaauuccucuucccccuccuuuuccauuuuguuauuuuuuuuugagacaggguuucucuguguaacccuggcugucguggaacucacuuuguagaccacgcuggccucaaacugacagaguuccacccgccucugccuccuaaaugcuagggaaaggugugugcuaccacagccuugccaucuuucugagauuauuuuuuauuaucagcagacaaggugacauuacguaguugagacuggccuacaagccauaaucccccugccucggucuccugagugcugggauuacaggcauguguggggagcggguguggcggcagucccaaaggcgccagggacugcagcuaagucauaugacuugcaccugacuuccucauauaagccacaaacaucuugagagcugcgcagguguaccaggauacuggugaauccauuuugauggagauaugccccugcugcccugauuagcugaagcugcgugccuggugaaguggcguggccugcuguguguggaugggaacugagaguauaaaagagugagaggcccaggguucaggggagauauaaaaacaagggagauauaaaaacaagggagauauaaacaagggagagauauaaacaagggagauauaaacaagggaaauauagagaaagaagaaacaggacugaauaaacgugugcagaaggauccuguagcagcgucguucuuccuggccaguugagcgcgugcaacaguuggugccgaaacccgggaaaagaaacaucuucaggcaagagcgaagacccccugcuacagggaggauucagaacugcaucacugggaaggagcgguuaauaaaguguucccguaaaacagacuguugagaaggauccggcguggauucagaacucuucagcuggggaacgguacugaugaagagaaagaagaaagaugaggacggaauaaacugcuguuagaaggacugguggucgcgucguucuugcuggucgagagcaggcgcgacaauugguggcccguacggggaaccgacucccccaccgaguucagaacuuucagcagucagugguugccggcaggguaaguucacggugagugaaacuugugaccccaggaguuugggaaggaccucgauaaaauagaggugagcauaaaguugccaggaaguaggcacaaaguaacccaggaguuugggaaggaccucggauaaaauagaggcaagcauaaaguugccaggaagcaggcacaagguaacgaaagguucccggcuuugggacaaguuaagguucccggcuuugggacaaguuaagguucccuguuuggggacaaguuaaggaacuaugauaaccucaguguagugaucaauagauccucgcugaguaguuaugcuuuuuucucccguugacccuuuguggguaggucugauaguuuuggucuuguuuguucugauauauggacucuguuacuguuugaaacuguguguagaggcagucaagacaggucagaaaauccuuauagagcaacaagaaaguauguuggaagagaagggcuuaaaaagaaaaaggaaaaagaaaggagacgcaguguuaucagguggacagaaaggacaaaauaaaagagcugaggcggaggaggaaggcgaauuagcuucugcguccucucccuaugccuccucagcagccaccuauagguggaccuucuguccagagauuuggcguauugacuccccagauggacacacaggugauugagguuauggucucauuaccacgagguauuguguccaucuccccuggggaucgaccagaucagguguugaugugggcgagagggucuguuuguguguuuccacaggaccagacagaaccucuuuggguacuggagagauuggugagacgcugcaagaaugaggcuccugauccaguugccccuguggaugugguggaugaucccacaagcacaaacgauggagccgagaugagagauccuuucgguguuccagaagccgauaccagcucgacaugacauucaaauuuuuccaugccuuuuugaucccugaauuccccuuaaagagauagccccucuggcuaucuaucccuugcuucagggaagaugagcggggaugagagcccugggauguaugcuuguuauaguguguguguguuuuguguuuggcacauguguuaggugcagagugugcggcccgcacuuucgccaugguagcguaggcuuuugcugcaguggaggcgggacaaucuccucagauucgguuugccgcucuaaaagaaauuaugcugcguuaugccauggggugcaaggcuaagcacugcacagaggauagcuugcuguuggcauccuguggaaggcacgucugauugcaugaagguucaguguccuaguucccuucccccaggaaaaacgacacgggagcuggccaagaccucucugggugaugagccuaagggaugguuuuguguagggccccuaugcuugcacacuggggaucagaccucuaccuucacccaugaggcuugcuugcagcaauuaagaucuggccauagauuaaucaacauccuggccuuuugaugcaccugccacaagcaaaacacaaucuccccaggaguggcuuggcaugauugagagguagucagugauaagacucccugggcaugucaccaaccuaagacagggaucaaaccaaugcuguuugucacccaagaacggguaaggggcaugacuacggggggcuaucuacagacauucucucugccaaaaaagaaaaaagggggaauuguggggagcggguguggcggcagucccaaaggcgccagggacugcagcuaagucauaugacuugcaccugacuuccucauauaagccacaaacaucuugagagcugcgcagguguaccaggauacuggugaauccauuuugauggagauaugccccugcugcccugauuagcugaagcugcgugccuggugaaguggcguggccugcuguguguggaugggaacugagaguauaaaagagugagaggcccaggguucaggggagauauaaaaacaagggagauauaaaaacaagggagauauaaacaagggagagauauaaacaagggagauauaaacaagggaaauauagagaaagaagaaacaggacugaauaaacgugugcagaaggauccuguagcagcgucguucuuccuggccaguugagcgcgcaacaggcaugugcauuuuuauacuaguauuuuuacagucauacaaaaaugcauuuuuauuuuuacagauuauuuaaucugcauaauguagaacugcuaacuuaacaggauaaagguuuaacauaccagaauugccuuacuagauugguugauaaaggggaggaaauggccaauacacagugggcggagauaguuuguacuaggaagcacaguauguuaucucagaaaccuaacaguagagaugccacgagauuaggaauaaugaagggggcguggguucucugcacacucaguucagaaccaauguaggugguugacuagagguauggacacaaagacccaacugcacuguugaaugcccugguuuuugagguugacacccuaggagacaucuuuaaaggcuuucuuggauggcuguuggaaaguccaguaaagcaaacaaauagagcaguguagccguucaguuaaggucaaggucgggacuaggacaugacaguucugacaauccacccuugcaagaccuagaaaggacauagucucugaagcuauuaggaugaucgucaggaugcuucuagccucuuggcuuuauuuguuaacuaaggugugacagaguggaacugauugcuuuugaaguuaugcuaagucugaccuugguuacaauaugaauuccagcacacuuggcuuggaagcaacauuuucugcuuuuucagagaccaagcuaaacauacauuucucagucaaaaggcccgguagguaauccgaucugagcagggauacuuuaacccacggucaaauaaaaagcaugauugccuuuuuccacacacagccuaggcuaggccaauuacucaugaauauaacuuuucagacauuacauaauuucacacagacuugcuucuggugccugccaaagaaaacagccauuugcaucacuaggaauaaaucuacacuugaugagagaugaaaguuacaaacaugagacagcaaaacucugcccuccucuuucaugccacccuccuguaugauguuacuaauaauuuuaauuuuuaaaaaucaacauuagugagacagaaugacaugagcuguaaaaucacaugagccaagggaaaaugagguaaauucaaauguguaugccccaagaaggguggcagccucgaagacaugaccaaugacacaaggaagcagaaaaaccaagccuuacuuaaccacaggacauaggcgcucgcgcucaagugccgccccccccccccaucucuaggcacuggugugcuacaccauaguccuauuuuuuaaaguaucuuuuuaacuugggagauuuuucauauagcucaggcuggucucaaacuugcuacacagccagaacuguuuugaagucuagauccuccugucuccaucuccucccaucuccacccuacaagggcuagauagaauuaggguaugcaccuucauccccagguuauuaguacuguuuuuaaaagauucuguccuccuaaucuaaaacucuaaaacuuauugaggccaaaaacugacuugacagcuaagagcacacauuccccuuacaacagaccugcacuugguucccagcacuccgguuucuuggcuuacaaccacuucagcuccaggaaggaucugcugcccucuucugggcacuguggguacugggaagcauaugugggcauguauucucacacacauuuauauacauaaauaaacaaaaauaaaucuuaauuuaaaaaaugcuuagcugauauaucccugguaaaugagaauuaauuuauuugaaauuaauucaugaauauccacauuuaauauuuuuaaauacaaguaacaacacuagccuguuauacuauuuuaacaaugaacuaguuggcuuagauugucaucagcaagaacaagcaauagaauacuuauaugucauaaaaauaagaaaacaugcaauaagccauuccaacuaauaacugaagcuaugggauuccacaggcauauguauaaacucacaucuuguuugcaggcccauuccacagucauuuuuaggauguccuuuuaauaauagauuuuucuucaacuuacuugaaacuggcuguaugaauggcugcuuuugaaauuuccccaaggaaaauauauuaccaccaccaccacccaaaagcaugcaagugccugugcacuugcauacagcauucuugugcuuuucaaaagaucagaccacggauacuagacuggaauagugggcaaaaacaagugccucacuacuuuugggcaaacacuagucuugaugcuaaguguucaaauuuauuucguguuucauauuugauauagguuuuuuuuuucauuuucuaaaaagagguauauuuuauaauucuggaugauaaccacagaagguuguguaugcauuuauauguaacuuauauacauguauauuaagaauaauguggggggggcuugcuuugcucucuuucucaauaauaaaaauaauaucuaauguuuauugcauguccauccuguggcauuagagguuaaauuauuuuaaaacuacaacagugauagauguuccuauagccuuagucuuucugaagagagccugagcacaggagggcccucgggcauggaggagccagaagagguaaggucuaggggauguguagcaucuaggugaccaacaacaaucauccugaaguggaaagaugcuuaucaggggaagaaacuaaagguguggaggacgucgucaaugcaguagacagggcuuaagaaaaugauguuguguuguuggggaggcucagaaucuagcuacagagaaaagguggagccugcacagguguuggagaugagaggagccagggguggcugcugacaaccucacacaaggugaagcuccugggagagcaagaaagggcguaaggcuuagaguucaugcaggcauucuaggagcuuaaagaaggcaagcagcaggcaaagcagggaggccugcucccugaagcuacagagcuugggaacuucuaggaauccuagagagugauauuauccagaggaagucagccugcucacuuggagagguacucuacaguguucagaaaaaguacccugguaggaagcuugcuugcuucucacucagugcagagaauugcucaguaauugcugcucaugaucaccacagagacuguagacauuuuaacacuguggggaucuaugucuugaaauuuuuauuaguauuuagauaggcucuaagcaaaguucucuacccaugucaucagaauaaagaugauaauuuuccaaagaaauccuguuauuaucuccacuaagccaguuuucuucuauuaggauguacauguaaauaauugauaguuaucuagaaugguuaacacaugaauuguccuaaagacauagcuaguuuucuuaacagugcagaucauaauauuccuaacagcuuuucucauguagaaaaaggaauaaaauaccaagauuuauagauaaguccgacuuuagccguuuauugauuuagcuuuaggagccuuucacaacagaguccuuuuaacugcauacagccagggcaugugucuaaucaauacugaacaucuaccuugcaguugggguucaugaauuaaucaacaacugcucaaacucaaaaccaucaggcaaaacccagcagugaccuacaucucugaacacacugaaaccaaugaaacaauguuaucaccuguaacaacaaguccgaucgcucucaagggcuaaaacugaaacuaacuggaagucucuccacaggaguuauuuaugucaugcuaucucuuucuagaaaggaccauaagcuagcacuaggguccuuccaaauggucuauccuguguggcugaauauagccuuauccuguaaugcuauaaacuaagggauuacagcaaacguggugugcgaggauaacauggcuuuccaaccucuauuccacacucaaaugacuggguccacuaagcauucccacuuccucaagaaaaaaaaaugguggguaaacagaaaucuguccaggagagcugcagacuguauaagaaggcugugguucuaguaauggucauuugauggugauuacagacacuuugagaagagccuccuuguucuccauggugugagcaacucacugacucaggccaugaagccagcagccaaguggcaguggcguggauccaacgguuccuagaggagaacagauggacagccauccuuaaaaaagaguucccugaugucacccagcaaugagaugugagggcucaaaacaugcacccccucccucaggaggcacgugcgagaagaugucccuguguucuucuuucucucucuccagcaaggccugccggccggaggcuccccagccacucuaucgaaagacucuguugaaaauacacuuguguuugguuaaaggaaaguucauauuucuucuuuguaugagaacuuauugaaagacucuagaagaucacugacccacacacagccuggugaaggaaugaaaaggcacaaaaucuggaaccagacucacuggcgggauucaagcaucugaguacuuuaacuuuuugcuucuauaucuauaaaaugugaguuaacaaucaccggaaugagaaaaguguguguaugugugucccccccacaaaccaugcgcuuaauacaacccuacacacuauacauauacuuaauuuaagauaugcauagcuuuugguaacuacucaaaaacaugcauaauaagaaaaagaguggcuuuucuaucugcuaugguacaaaagagucaaagaguaagaacaugugacccaugcuuugcagaauucacaaaugauacagagagaucagacacauauaaagaacuuaagacaauauaauccccauaucauauuucuugcauuuuuuaacacaauauuuugugaaaaguuggcaaguuacgcaggcucuggucaacugcuagagugcuugccuagcaugcacgaggucccaaguucuacucugucagucucagaaccuccuacaaaauugggcauaauccauguugggaccaagcuggcucagauucaccugccuaccuaaggcagggaugaaagcauggaccaugucagucugcaccgcagguuauuaaucacaauugcaaacaauuuccuccacugagaguccccugguuuuguuuugacaugaccacaucacagguaaucagacaguggcaccaacugagacccuguuaagaguguauccuauacauuaugauacauacccuggcagcaucaggaccauguuagaauguauccuacacaugaucauauauaccccggcagcauucagucaauaauacugccacucauguauuuguaaguacuuuauauuaacugaaaauguuuaucauaacauuucacuguauagaaaagcauaugcaagcuaauguggaaacagaauguuuucaaaacagugugugccuggaaacauuagccagauaacaggcagaccagauauauaaaccauacacacauacgcacauacacacacacacacacacacacacacacacacacacacacacacgccagaacacaggcagaccagauauauaaauauguucuuugcagauacauaaaguagaucagauauuuugguuagaaaacuaaagccccagcauaaguagaagaaacuaauuucauucaagauaaaugacuacuuucuuacucugaauaggaaaauaaucucugguaaaucgaggcauacuggcaugaaagauauaagugcugaggcccaagccacucccucugaguaucugcaacauuuccuaggcuagagcccagaaagcucugcaaaucuuuaugugacuaaugauccacuaaacaacuccagacaagagagacucagcucuaaguucuaccucuuacagcagugagaaauacucaacucaggaaaacaaaaguuccuggcuacaagcucacucaccaucuuguacuuaucaaagucaucccacagacauuaauccgggguuauuuuacuauugucuaaaggcugaagaaugcacaugucauaaauauuuacuggcuugauaucuuaauuuugcaggaaacaguuauaaaacuuuuaauguuuuaccagccguguaaaacaaaaucccuuuucucaaaaaguuacagacauacagcaaaugauuuaagugagcaaagaauuuuaaggugcagaacugggcagguagcacauaccuuuaauucugcaaguuggaagacagagacaguaggauauaugugaguuccagaccagccuggucuacagcuagugaucuagugagcuccagggacagccagggauacauagagauacuaucucuaaaaacaacaaaacaaaacaaaacaaaacagcuguaaaaauaauuuuuagggacaacaacaacaaauaaacaaacaaucagagccaggugugacccaccacaccauaccuguaauuccaauauuugggaggcuacagcaagguugcccugggcuccauguuauguuuuaggacagccuaaacuacagggaagaacacauauuuggagaucaaccgaccaaagccuuccauuaccaucuaaaauaacccugggcagcaagaugcacuugacugccacaccuggugacugcagguugauuccugggacccauaugguagaaggaaaaaacacacuaccccaaguucuauucuagacuuuacacucagggccggcaaacacacacacacacacacacacacacacacacacacacacacacacacacaccaaaucaacauaagaaagaaacuauacaaagguaaagugcuuggccaacagccugaggcuucucucccugcccccaucaacagcucacccacugcugguuugcuacuugcugagacauagucagaaaagauuuuauaaauuauuugagguuuucuccuaucuucuccaccaccccccacuccuccuucuccccaacuccucucuuuuccuuagaaauuucugauuuucccggucugugagggguggguuuuauagagaggccuccagcugaguuguggcauucccuagcuggguugucugaauugcucuucccgggagagguuuccuacagccacacagaaaggccaguuuacuccacagggaucugcuugagcugguccuccaccaguugacagcuaagaguccuaauuuauuggcagccuuuacuauggagugggagaguaaguuugucaagcaccuguucuugggucaacaaguuaauuaccagagaacuuccauuugggggaagguauucacaacaguagcauagagcugccugucacgacacugcugccuugcacugaaugaauauacuucagucuuaccuuagcugauccugagauaaguauugcaaaauaaagaaacuggacacagaacuaacuugacuaaaagucacuggcuccuaggaaugccccuggugucuacugagcaagaagcuaaacaaugauucauuccgugaagaaagagugucccauuccacaagcucuauguauguagccuguucugugccccacugagaauaguaauaauacaauggcacacugggcgggucuuaaaagguggacacacauuacucagaaagcauaugaauagugaaacagaacuaagaaagaguuuagguaaguuauuaaaaucagccaugggcuggagagauagcucagcaguuaaaagcauuuguugcucuuggagaggacuuggguucaguucccauuaccaacaugguggauaauaacaaucugaaacccuaguuccagggagucugagcagcucuucuggacuccauggacacugcaugcacauauaugcacacacacacacauaugcagaaagaacagugauacacauaaaaugaaaagaaauaaaucuuuaagagccagucaguccaacaggcguguuuacacaugccaguaauuccggcacuugagagguagaggaaagauugcuuuccuggcacguguaaggcugcaggucugcucccuacacugacaggauaggauaauuaaaauaagcaucuugcauuuucugcuguaggcaauguaaguacaauaguugguuuuuacuagucuaaaccuaaugccuaccugguuucaaagcucaauucaacaauuauucauugacuauucuaacauacacauuaauacaaacaguguagauccuuauuugugucuacccaggaugcacucagaaugcccccacuugucuacagugugaaugugauuauuugcuuauauuugcuuccugguucccuuacccuccacuagcucugaguacagccacacagacggaaccuguuugccugcugcucuggcuccugcccccucuaccugccagauacagagccucugauuaauccuuccacggcgcugugcccagcagaaugacgccuaaaguuaacauucggaccucagaaagagucugauuucuuuaaaaagcuuagaaaauacaggaaaaggaaauaaucuuguccacauaucuucuaacacaucagccuguaguagacaguuucuaucucuuacuagcuugcuuuuaaaauaaacaccccuccaaacagaaccucuaucugugaggaaaacccaaacagaagugacuccauuuccaggucuguccaccacguguccuuuagugacucuggauggaaauguuacuauaaagaaagguuagaagaccagacuucuugaaucaagcugggcagagauugggggguacagcagagggaggagaaagcugcuccuacaguaaaaaagccuucauuuuaguuuggccaugaaaucucuucaaccauuccauaaauuccaauauuagaccuuugagcuuucagauguuaagaaauaguuuauucucuaaagggcaauuagaaugaaguuggaaaaaagaaaaaaauccaauagagcaaacuggcugguuccaccaucugagcucaucacagagccccaggcagccuuuaacuggcccauggggagauaaaagggcuuuucuuggcuagaagucacaaaaccaagcuuuccuuuuguugaacagaagaaugcccagucaacaaucaggaagcaagccacaaacuuucaagucuuaaaagcuuaagaaaugcuguuuuaggagcugagauccaucucauuuggcagagggcuugccuagcaugcacaaggcacccccaacacugcacugcccauccgucaaaacgucggagagacucagaaguuaaaggucauuguugaauauacagcauccccaaggccagccagggcuaccuaagacucuguccaaaacaccauacacagggugagaaagcugguucaucagguaaaggcgcuuggccccaagccugacaagcugcguuuaaucuccagagcgcccccuacaggagagaacuaacuuucauuagugucuacaaccuccacuugcaaaugcucccacacucuccccccauauauaagcacaacagaaacaauaaaauaauucucaaagaauaaaaauacuuguuaaguaguucacuaugaaaagagauaaacuauuuuuuuuucaaaugaauaauguuuugagcugugccuaaugauaaaggccuaaaauucaaacauuuaugaggcugaagccagacugcagaauaaggccagucugggaaguuuaguagucccuguuugaaaguaaaaaguuaaacugguagcucaguggugaaacacucaccuagcagcauauccacgccuacacaauagccugaggaugacaaaacaacaacaugcuuuggugacaaaguuuauacuuuaaacccaacagugaauaugaaagaagcacucaaccaaaacaguucuuugcgaggguggcaauguccccuccucccaggucaggcucuuuaguagccacgugucuuguaauaucauggcuuuuagcuaucucauucuuugaaucuuugccuaauacagcucuuaucuggguauaccacucgcacggguguuuauaaguuugcuuugcuuauaacccaacuauaaacuuauaacccaacuagucaaacuggcagccagccucuacugcuaucucgaagccaaugguucaugaaagaaguuaaaaacaaagcaaaauagacaaacaaaaaaaccugaaccaaaugagcuauauuaugaccauuuuauuuaaaaacauaucuacaguaaaaauucaaaguaaauucagguaccaggucuuggguacauggagccugaguggaauuuauucuuacuaacaagguugcaguuuuaggaagcaguaucuuuccuaucacguguuccacccucuuuacucacauacuaauuuuuguccauuucaauaaauaacugcacucuccuaguuaucaaagccaacaacccugaaagcuuuaggcuuccuaacacuuucaccaagucuguauaauuacugcucaucucaacuuccaaaaccuuaugucuuuguaucgccugucugauuugcagcaauaccucccuggcugcuuccuagcugccaccuuguagcuuguagcauggcagcugaaacauguuauuaaaaugucuaaguguuucucccuaagaugaaugaggcacucaauccccagaacagggguaggggguguaagacucaaccagacucugcucagaagguucccacccagagucagcaggggccuuaugauggcuggaaaccacaaugcuugugccagggucucugcgauccuaucuuccucccuguucucacuccaagccagaugcccagccuccuacguccuacguccagacucagcgcacaugacgucagggccuugcaugugcuauuccuagcauccagaaugacacacucauguccuuuacaaguuggaguaauugucauuuaaucaaacuacuuaaaauagaaaugcugcauuccugcccuugccacuccauaccucucuuccacugcuuuuuucccaccgcaguuauugccagcugauauaugauauaauuacuuguuauuaucugucucgucucauuugaauguaaaugaauuucaugagggcacagauuuguguguucugcucuuugaucaaucccccagugucugagacugccugacauugaagacagagacccugucuccaaccccccccccccgcagccccccaaaaagaccaugcuucaacuggaggauggcucagcacuucuuccugaggacuggguucgauuccuacaacccaccugguagguaacucacaagaaccauccuuaacuccuguuccgagggaaugacaggcuuuucuggccuccaugggcacuucacacauguagugcacaaaaacgcacacagacaaaauacucauacauauaaaaugaaguaagucuuuuuaaaauaguaaauaguaaaaaaaaaaaaaaaacccaaaaaacaaaaccuauuauaguugaaaucaaaagcuuaagacaguaauauuucucuucuagcacacaugaagugaaagcagaacuauguaaagaacggguccacccccagcacauacagcauccugggcuucacuauuggucuagaaagauuccccagaggacacaaggacaugucuuuaagagugcucgcucucgcucccuuccucccucccacccccucuuuuuuagccauguaaauuaacaaugcaagucacaucagaugagagcucauaccuguacucucaacauuugagaagcaggacugcuaugaguccuaccuagaaugucuggguaaagacuaagacucauacccucuccccccccccccgccaugucccccuaaaaucccugcaagugacaauagaaccagaauauuuacuagcuugaaagucaucauaagagaucauuugaucaacacugaaaugggaaauaauucaaaucuguugaauuguuuguaaauuauuacaaauaaugcuuucauaaauaacugccuagaaaaucacguacacacccuucuuaaaaggagguucgcuuggacugguuggaaaagaggggcuggaagggauuuccuaaacuuggcaggcuucuucauaguaugcacucugcaggagucccacccuccacuuaggcuuucucaauuuuaacuucuaagagcuaggagauggcucuggaguggcuaagguacuucuccuucagaugacaugaguuugcuucccagcacacauauggggaagcacagaacugucaguccagauccauguccggcaugcacauacauacauacauacauacauacauacauacauacauaaaauaagaaacaaauuaauauaaaaauauggacugauaugaaacaauguuuuaguuacaaacuaaaagccaucuuuacauugaaacaugcuuuaagacgugagcuguauucuaaacuucccucagacaacccaugcaaucaugagucaaggaagacucaguccaacacagcuauauacacuuauguucuguucuuccaaugaagagguuacugaccuacaguaggaguagucuuuguuguucuuaucuuugcuugccugcucagaccccauaaugagccacagcacacgugcaggacagcuggcaggggaaaucaggcucuguggccaugggccagaggaaagcuuaagcagagguccgaccuaugacccacaccucauuagcaccucacucuaaggaacagagcugccacaaaaaucaacacuggcuuaagcauuuuguuuauaagugaaacaaauccggucaguuggacaaccaacuguucaaagcacuccuagaaaauugccaaagcaccaauagugugcaagaguucugaggaacuagcuggacagguugcuggcuuguccacucgaacaaagcagagcucaguugaacagaugagaauguaggagacacacccaccucuagcacaucagggauucaaugcauauucacugaaggaaaaagaaauguuaggggggcacagccagccacuugagugacagcauuguuacuccaggauuagacuugccuccaaagugcaaaaaaggaggaagggacaauuuuucuuagaaaucguaaggcuagaaacccuauacuccaaaaauauuuauuccagcaaucuauguauauuagaaauccauuugguaccaaggcauaaugaagggaauuaaaaaucuaagggaaauuaagccacaaauuuuuuauaucaaucuuucucucagcaaauaggaggucugagcccccuccccccccccagaaugcaccagagaucggggaagugagagacucucaggacucaaagugagggaccuuaagugaaaagcccaacaguagggagagggaacuuacagagcacaccuccagcaggaagacaggacaucaagugaggggugggguuaccaugccacagucauaccucuaaccccauaauuguuccugucugaaagaauuacagggauggaaguggagaugagccugagaaaaagaagguccagugacaggcccaaagugggauccagcucaaggggaggucccauugccugagacuauugcugaggcuauggggugcucacaaaaagggaccuagcaugacugccuuccaaaagacccaacaagcaacugaaagagucagaugcagauauuugcacccaaccaauggacagaagcagcugaccccuguuguugaguugaggagaagggcgauccuguaggaacagcagucucaauuacucuggacccccaagauuuaucaaacacuagaccaccaaacagacagcauaucacuggaccagcugguaugaagccccccaacagacacaguagauagaggaguucugggucuguguucauucagagaugaugcaccuaacccucaagagacuggaggcuucagggaguuuagagguggggguugggggugcgggcauccauaaagagacggggugggguaaggaagaggugugggacguggagcagucagaugguggauggggguuggagaauggaauaugguguguaaaaaaaugaauuaaaaauuaaaaaaaaaaacauuucggcugggcagugguggcacacgccuuuaaucccagcacuugggagguagaggcaggcagauuucugaguuugaggcaauucaaagcacacucagcaacaaagucuuccauauuccuacuaugauggaccaguaagccccacuuaaagcauuccacugccuucaaaauccaaagucccaaaauacacauucuuccaggcaaaaccauggucaagcccuauuacagcaauacaguuggucccugguaccaacuucugucuuacuuaggguucuacugcuguuaacagacacuauagccaggcauauaaucccacauuugggaggcagaggcaggcggauuucugaguuugaggccagccuggucuacagagugaguuccaggacagccagggcuacacagagaaacccugucuugaaaaacaaacaaacaaaaagcagacacuaugacuaauguaagucuuauaaaggacaacguuucauuggggcuggcuuacagguucaguucauuaucaucaaggcaggagcauggagcauggcagugucuaggcaggcacaguaccgaaggaucugagaguucuacaucuucaucugaaggcugcuagcagaauacucacuuccaggcagcuagaacuagggucuuaaagccacgccuagugacauaccuacuccaacaauaguguccuucucuaccuucuaauaguguccacucccuagccgaagcauauacaauccaucacacucacuagagaguuaacagaaaacagguacugcagcaggcaaacagaaauaacacuacauucaaaaagauaaaacugagugugaccacgugcucugugcugaggaugcagcucaguuauugacgagcaugcucaaguccuugggugugaugccaagcaacaccaaaggaaacaaagcagcagcaagcugacaaagcugaaaaucccacauucugaucaaauacacaacagauuaagucaggaaccccuuacugaguugaauggaagauaacaaagcugcagagaggauuaauaaaguacaacugagaacuuaucugaaggacuguuuggagaagagcugcuacaaggcauaccaaauuuuauuuauuuauuuauuugagacaggguaucuuuguaaagcccuggcuauccuccacugccuuguagaccagccuggccuuucuguguagacuaggcugaaagggaacuugggaggccugccucugccucccaaggacuggguuaaagacaugcgccaccauaccuagcucucuacuaacuuuuuaacuagauaccccucccccaaaaaaaguuaagcaaagaguaauaaaggaaaaaauagcugaagaaacaaaucagucccccucccccagaucccuagcagaauaaacuaaaaccuauauuaagggcauauuguagaaaauuuuccccccaaaaaagggaagggugcugggagguuuaaaguauuuagaaaacaggcaguucccuuuguccccauuguuucuccaagaggacaauaaagaucuaaauguacauccuaaaacuagaggcagugauuacaaauaaaugcuuauauguacagcuaacugggauaugaaaacuuucccaaaauauacuccacaggaaugaagacacauuuauuguuauacuaauggggguaaagaggguagcuuguaucuuuguaucucuggaagacuccuauacgcucugcucugcugccagcaaacacugcaguuuacaaaugcaccagucuucaugcucauaacaugcagucacuucuacccuaaugcccucucuuccaggcggagaggggcucggugguuaagagcacucccugcucuucuggggaccuggguucgauucccagcucagaacugccuguuaacuccaguuccaggaaauccgacacucuugcacagauccacaggcaggcaaaacauuaaugcauauaaaaauaaauaaaucuuuuuuuaaaaauuuuaaagcccuucucauuuuucccaguuccccacagcaguccuucccugcucuuuaaggcccagaucaccccaugcuaucucuucugaaagcucucaacacuauuacccgauccaaaauuguuugcuaagauugggaaaaauaaauaaauaaagaggaacuauaccaaauaggaggagacagaaaagaaaucgaacuaaagagaugguaaggauccuggauuggaccuugaagugacagaugcaaagacaaauaggagggccuugagacauuguucagcaguaaagggguuugcugucugaugucuagaucacucucugaaacccacauggggagaagagaacuaacucccacaagguacacucugaauaccacguguguguguguguguguguguguguguguguguguguguucauauauaaacaaaaaucgcuaaauaacaaaacaaacaaacaacccaagaguuguaguuuaguuaauaguaucgcaucaaaaacuuucccaguaauguuuuggaauuucuacugcaguuuauauguaagaguuaacuucagaggaaagcucuaaaaggacaucauaaacacaacgcucaauguggaggcaggugaucaggaggcucaaacccauccuuagauacagacaguucaggucugccugugccaaaaaccaaaagaacaaaaaucacaaugcuauuuuugcaacuuuccaauaauuuaaaauuauuucaaaaugcuuucuuuuacaagauuuauuugaaggcuuaaguuaaauccuuacagacaucacaacaaauguccauuuucaauacuaaguuuccaaguaacaugacaagucggcucagaagagguuuagugaaucaccgccacaucuauacuuugagauuugaccagggcuaaauucauguacacacaugucaaguauaauuaagaaaaagccaaguaacgaacugugagaaauagaaagcaaauggacuaagccugcaaacaguucuguagcggguacagucaauaaaaugagcugacgucugccagcacuggaaguguucucuggguaucacggacucagugaaaccacacucuauaaaguccugcagaauaccacagaccaagaaaaacaaacgaggggagucagcaucaacuagaaacacuguggcaagaaagaugguucaacagcuacgagcauuugcugcucuugcacaggaucugggugccaugcccagcgcucucaagucagaucccaacuaucuguaauccaggcaaggggauucaaagcccucggcuggccucugcuggcguuagguauacacaugaaacauauacguacuuacaggcaaaauacacacacacacacacacacacacacacacacacacacacaccaaacaaaaggugaaucaucacaagacaucacuucaaacauuuggacuaugauauacucgaaagcaccaagguugugugcauguuaucaguaaauaaggcaccacaguaucucagggucacaucagugguaacauucaugaaaaaauauaggcucuaauuacuucacaggcagggugacuuuuauagcacuuucaggacagugacagugagcagcaauauuagaucaauaauccaaauagauccaccaguguagguaaccuuucgaaaauguuucaauuuaagacaaagcagaaaauuacuuaucuaaauacuaauuuugaaggaaggacauaggcuuuaaucuacagauauuccugucuugcuggggauuacaaagacagacagacagacagacagacagacagacacugaagcugaucugaguuacacucacacaaauggaagaguggcuuugcuggcuguggcugggggaguaaucuucacaaugccacaccuucaagaacacauucaaggcaguaaagaacucagcgccagacugugcaguacaggaggaagcacaaugccuccaagcacuccucagaggccagcaugguggggaaauacaggcccauggaugcguggaaccacuacuucucuugagcuacauacauugauacuuugucauuaggaugacuguggaaauaaacuuacauguucaccaaagagcaugugguaauaagaaccggaguucuuaaaaaguuggggauuuguuuguuuguuuguuuguuuuaagaaagcauaaaagucaucuuugagccgaguggugauggcacguuaccuuuaaucccagugcucaggaggcagaggcagaggcagguggaucucuaggaguucagggccagccuggucuacagagcaaguuccaggacagccagggcuacacagagaaacaaagcagagugugccaaaacaaaaccccaucuguauagcagguauucuagaaccacaucccaacuacacaguuucaaaacugugaauuaagaggaagugaagaugcucauuaauacaaaagccccuaaauucuucaacugcuucagaaagucaccaauuuuggcuuaagucuccaauccauaagucccuaaaauuuuccaagagaaauaaauugcuuuuaaccccuacaauaaauaaucuaacgugauaaauacugagcuaacuaaacuuaaauuaguucuaagcaucucauauugaaaaauuauguugaaaacuacccacauaauuuuucaauuuaaaaacaauucauuuauauaauaaauaagguuaaucuuuauuuuucauuccauuagaauagcaucugcuuaugucauaggacuuuuaauuucaggauuaacuaacuucauuuugaaacagcaauaaaacacuaucacgcuguguggacaaauaaccaugguucuaggcuuaagcacagacaaguacagugcuguguuacaaaugggcuacacaguugaugcgacacucugcagagagcuaucuagcacuaguuucuuguacgucagcuugcuuccuauuucuagaggcccaguguaauuuggaugugguuuuaaagaaugucccucaagcuccuguguuauaagauugcccacccccacccccagcuuagcgauguuacaaagucacaggcuuuaggagguaggucauccuggaggugcuggcuuuggaauagacuuguguuggucuaccauacccuaguuucucucuggcgcuccuccucacguguggcagcucccucuugcacaagcuccgguugugauaucauccacuauuagagagaggcucuuaccagagacuaaacaaaucacugugugauccaagcugugagcuagcuaacuuuucuuuacaagcuucuauguaauagcauuucauuacucaacacaaaacacccucagacaugggccucaaacuuacaagcuuucuccaagucgugugcacucucuucacagaaagcagcaacacuuguugcuggagagucaaaucaaggugcuucuaccacaagagccaagcuuaacuccaugcuuauaaaaaaacaauuaacacagaauagauuuuuaacucauuccaaaguuuaccaggaaaauuuguaacuccaaauaucucuaaggaaagacauauacaacuaccuaacuacacauuagcuauauugaauaucuggcuauauauuaaaccucucccacuuuuuaauucccaaauucaauacuugacacuuauuugucuauaggauuuucauagcucucacuuaauguuagauucacuuuuuauccacaagugacugcacaaucuaaucuauagcagcaaggacacucuacuuucagauaucaacaaauuuucuaagcuccuggcuucccuggggcugcugcugggcgaacugggucagagaaugcuuaccaggccagugccaucaguucgcuccaucacaggggcagugaauauaagacaaaaucuacaugggccauuagcugagcuuguaaugaaauaguuccacagaauaagaaauggacagccgggcaugguggcgcacgccuuuaaucccagcacucgggaggcagaggcagguggauuucugaguucgaggccagccuggucuacagagugaguuccaggacagccagggcuauacagagaaacccugucucgaaaaaccaaaauuaaaaaagaaaaagaaauggaggaaagugucaguaaagaacaccaguccacguaccaucucaaaacagauguggugccucuauuacugacugcauucuccacuguuccaagugauguuaacggaaaaggggaaacaagaaacaaaauacucacauaauaaagaacucuuucgacacaaacuaaagaaauagcacuaaaccauagacucugcuuuauaauucagccacagucacugcacucucucugaucugaacuaugagcaaugcccagucauucuagaaaaauauuucaaaacauuacuuuaaaagaaguaagcagaaauggagacaugaauugaaaccuuacaacauuuucaaguaauaauucaaaauuaugaugagaggagaggcagugaagguguaggagaacuuuccagcaucaugccugcuagcaaggagcuggaaaaacaacauugugauaagagcaggagcccuuguagacuuagaacuguguuggcgauaugauucaaugauagaugaagcccaccaaagcccuggguuugauguccacagucacaagaaaugauaaauuaguaaguugguuaauuuaaaaguugggcaugguggugcaugccuauaugcgcaguacucagguggcugagauaggaugggccaaaguucuaggucuacuugggcuacagaguaagacccugucuuaauacacaacaagcaauaauguuuguuagaggugucagcucagugguggcauggcuaccuuacacauaugaaaccugggguuugauuccccagcauaggagccauaaacacacacacacacacagauuuuaggaggaaaaucccaugugacauccucaugagucaaugagagggaucuugaaauggcaccagugcccuagaugagacaaacauguccagcucgggaucaaggagggagcaugagagcacacagcuccugcgugugcgccccacgacgucacaggggcagugguccuaguucuguggcugcucaaguuugcaagccuagaccuccucccaaucccgagcagacucaagggaggccagugagaagggaagagaggccagggagggaauauagguaagacccucuauuaaaacaaaaggaggcaaagaacuagcaagauggcucaguggguuaaaaaaaggaagaaaaaaaaaaguaaagcaaaaaaaaaucuuaaaaauuaauauuaaaaaaauacuaugcuuguuucagcagaacuuuaaauagcuccuauuacuugaguacacagaggugguaagagaacuucaaaaaccagaaugcuguuacuaagcccccccaaauuaagcucauuucuucugauaaaaucaucugcauggacaggcuggagggggcagagguaacaaaguccucaugucgugccauacacuugauaucucagcauucagcaggcacuuaacaugaccacagguuaaaggucagccaggccuacacagggagaaccugugucaaaacaccaaugaugaccgauggcagggacagacagauggucugacagaugauggacagacaggguuaauugacugacugauugacugauugccuaccucuuuucaugcuauaauuacagaaacaaauaacuuaguuuaaagauagcugggugcggccuaucagagcagacuaguaacagcaaugacagcaagauccuuccugugccacauccuauccagugcaugcuuggccucaaugcaauggaagagacugcaaaugcuuggagagagcccuucgagagcucuaggagcuaaaaaaggagagcucagaagcugggcacugaaggcccuagaaacacuacaacucuacgaaauguccucugagacaaagguucaaaaucagagugugcuauuuauucacaagaugccuagggcaggaaaggaaggcuugcuguagaaagcauuagucaccaugucaccggauucuaauccagaaggccaauacccagacagaaggaggagugaagggaaagcccugcacagauuggggcagaggagauagguagggagcaccaaccaggaagacuauccaaguucccacagagcuacccaaaucugaguccucccacuguccucucacugugcgugagaagcugggucgggagcaguucugugugacugaggaguguggacgagaacucgugucuacaaagacugacugauaagaacugcaggacuguggagugguucagagacuauuacuuuaucuuaggcuaggucuucagaacaggcagccagggcuggagagauggcucagugguuaagagcacugacugcucuucugaaggucacaaguucaaaucccagcaacaacaugguggcucacaaccaucuguaaugggaucugaugcccucuucugcugugucugaagacagcuacaauguacuuacauauaauaauaaauaaaucuuuaaaaaaaaaaagaaagaaaagaaaaucagcuuuaaaaaaaaaauuaaaaaacaggcagccauaccuuguucaccccugcgucugaacuaacaucuugugauuaauauauaaaggccuuuuagaaucuauuaacuuaacaaacgacaagauuccaccaacacauaaacuaagaaugccaucagauagccucuuagccccccauccuguauaacugcuucucugauguacccaccaguuuauucuaaacuuguuuugauuuaugccuucuuuguucuguagaacuauggaacuccgugaaacugcuuccauguugaaauauagaaucugggguaccuaacuccuguucccaggcuaugucacucaaaauuguuccagaaaaaucuaucucuucuucccuuugagaugaaagcugcuaauaaggccagggugccaccuccugccucuguuucucagauauccugucuccauuacucuccuuucagacucuucacauaaagacauauauguugugauuaagcaacuuuuagagccuggcaauuguggugcacaccuuuaaucccagcacuggguaggcagaggcagguggaucuuugaguucugggccagccugaucuacauaaugacuuccaucacagccagggcuacacagagaaacccugucuacacagagaaacccugucuugcuuuggaguuggggaugauucacaguacuuauauacuuauguauaggauaaaaaaaaccucagauaaaccacaagaguauuuaggcuagaaaaggagaggaucaggaaagauauaugaggucugucugcaugaagcugccauuuuuauggucaaaaauagucaaauaucaauaaguuuacaaagugcaaaugagugacuaagggagcauauuuuauauuuggaaagccguccugaagcagaugacucugcggcugcacuggaaagcgccagaagaaacaagguucagaaucaaggcaaggaugcccugugccaagcagggcagucacagugggaggcagagaugugcaaaugccucgccccuccaaagacggucccuuuccagaauguucuauaagcucuuguccacugaaucaaagcacguacuggugagguggguugguuuugucugucacaauagaaaagacaggguagaugugaauggggucuguucugaaagaggacagggccagacaaauucuggauggcaaagaaauaucuccagcccacccucuguagaacccagaugugccuuggccauagccaaagccaacaaacaucugcaagcaggaaucgggagcucugcaagcaacuguucagucccaugugcugcaggauggaagcacuuacugcaccacugacaggcugcacgggugaccauggguaggcaguuuagggcagcagugagugaggaauagggggcucugaagacggaagcaccauggccacugagcuuggcucaucugggauuguucacaggagaguuaagggauagaggaagguggaaggagacugaaugauaaucgagggguggcaggaaggcagggcgcucacuuuccugacucucaauuucuccucucuuccuucuuccuaccuugcugccugucuucuccgcucuccacugaggcgguaccaaccagaacuaccauuuggcuuagacuaaaugggaaggcauugugaacaugucugaaauaccauacccagacccccucaaaaacauauacauauauugucacuucuucuuuuuuacuucuuagacaagguaauggauuauaacccacauuaaaaaaaaugucucguuaguuuuauuaaaacucagcuuucaccaugguccucucccucaacacuguuagaaaacaucaauguggcuuuguucucucuauaaagaaaacccccuuggcuccuaugugcgcagggcaacaggaggguguguguaaaaagagcugaggugugggacuguggcauuucaaugaguggggaggaaugauccacccagggugccagcaaugcgaugugauggcgcgaugugauacagcaaggaccggccggagaggauuuuaaaauagugacaaugaagugucugcuuuuucuuauuacccuacaccugcaguucuaaacaauuaugacuccugcuacugaggcugacggcuggaacaugagauaggguccguggcccaccacuaaugcuuagcugccauauuaaacacuuuuaacccucacuacaaccaaaagcagaagcuuggggagauuaaguugaacgaggaaaugggggucuauucuggguaccugauucccaagucuguauguuuaccccgcaaguaacacccucucaaggaaaguaagcagaaggcaggagaggcccugggaugcugagcugggaugucaucuuccauuagccuacuuucuucccuucuccaucagucaaucagcaccugacugacuacagcucugagaacauucuuuuacauuacuaauuuaaggccuauuucuugacaguuucccuagagcgcaggcagguuaacucugucacacagacagucacuguggccugaggcgaucaucucucaccguagacaggaacugugaaaacgcagcucgggaaaacaguuuggaguccuggguguucauuuuaaugggcaaggacaucuuugucuucauguaccgucaaaauucccacgauggaacauuuauuuuucuuaauugcuuuaauuuuaggcuagcuaugcuuuuuacuggaagccaccauacugagaaaaugcagaauguagcugagaaagaauacauuccuucauuugcuaauauuuuacaacuguguaaaucuuauuuccucuccccagugucuccauguaggaaguagaauuuuaagucagaaccuucaaacucuggugaggacugaauuccucuaauaauauacaauucucagacuacaaaagucucaacagaaagcuuggcuaugaggcacuuggggacuagaauaaagucucugccuaccucugaaaagagaagagauuagcacaauaaaauuaacuucgcagaguuaccaucugaagcaaacaugccauggaggaggaggacaggugcagaggugcacagcucuguucccuuccacaugugaaacuugucuaggccugagcuuuccaaaacuggacauccuggcagauacacuggcgaaacgcaagaaucagacagcgagguaggcaggcaguaagcaagggauucccagaggaagcccggaagccaggagucuuguccguggcagggagaccuuggucaaccccuguccccuccagcaagagcagggucaggcuuuugaagucagaaggcuguggcuggggcaguaaagguauccugccaacaaaccugaugaccugagaccucaggaauccacacggaagacggagagagaaccugggcaggugugguggaaggcgacaagggcagguggaucuccgugaguacuaggccagccuuagcuacaucggaagacucugucuuuaaagagagggugaaagaauguugacaagcuguucccugaacuaugaauugucacauacaaaauaaugaaauguaauuucaaaaaauauuuuaaggggaaggugguuagaaacugaugccuuuauuacaacucauaaagguuauaaguucuugaaaguuacaguucuugaggaggcgaaaugaccucauaagaggcccccuaggagcaaagacccacaguucuuuaguaauacgccagagaauugugccaauugucaaugagcuuggaccuugaacuuccaaugagacugcagugcuagcuuauauucugacuuacaaaaggaacacaguaaaccagugcuuagacucacauaaauaaccacauuuugcaucgugguuauuuccuaugcaccaacugaaagcuaacacugugaacucuagaugagcugguagcggggcacuuucacucucuaguacugcagcguacugaauaugcuuggcccaucagaaguggaauuauuaggaaauguggccauguuggaauagguguggcuuuguuggaggaaguaugccacuguauaggcaggcucugagugcuccuuguccuuaagcuccaguguggaaaugagucucuucuggcugccugcaggaagacaguccccaucugcugccaguggaucaagauauaggacucuuggcuccuguaguaucaugucugccugcacgcugcccuacuucccaccaugacgauaauggacuaaaccucuguaacuguaagccagacccaauuacaacugucuuggugauggugucucuucacagcaauggaaacucuaagacacggugcaagauuaaaagcuguucuucucacuccuuuuggaugccaggaucacuaauaggccugacuuccacacaguucugccgugucuggguacaugcuaacugaguaucccagugccgagaacaaagauguccccgguauuaaaccaaaaugcacuuaacuccugacccaaacgccagguucucuagcucagcuagcaugagccuguggcuuagcaagaacucugcccuucacauccagacaauauuagacugagauuggacaaagcuacaaauuagccaguccuuauucuuuuuuuuuuuuuuuuuuuuuuuuuuuuuuuuuuuuuuuuuuugguuuuuuucaagacaggguuucucuguguagacuaggcuguccuggcacucacuucguagaccaggcuggccuugaacucagaaauccaccugccucugccucccaagugcugggauuaaaggcgugcuccaccacugccuggcucuuucuuuuuuugggguuuuugguuuuuuuuuuuuuuuuuuuuuuuugguuuuucgagacaggguuuucucuguggaacccuggcuauccuggaacucacuuuguagaucaggcuggccuugaacucagaaauccaccugccucugccugggauuaaaggcgugcgccaccacacccagcgccaguccuuauucuguguugcuuuucuacugacacugucaguaaggaaaacaaacaaacacacaaacaauaaaacaacaacaaaaaauuuacuuggggcugaagagaugguucagcuguuaagaauccuagggcucgucaggaggacccagguucaaucccuagcccccacauggugacucaaccaccuguaacuccaguaccagggauucggaugcucucuucaguccccuguaagcacugcauguaugaagcauaugauacgcauacaugcaugcaagcaacacacuaguacacauaaaauuaagaaguuacaaaaauaaaaacuccauucaucagcuugcaguuccacauaucaaaaaucuaggcagcuccuugggucucugccugaugugucagccaccacagugaaugucuggaagcuccugagaagaaugcacgcuuuuggguucauuaaguugcuagcgguuucaguuccuagcaguugcaggacugggggcuucacuucuucacuggcugucaguuggaggccaugugcaguuuuuggaagcuccaucugcuccaucuucagacacuaacccuuuacugagcugcacuguaugugugcaguucuacugcuuccaguucaaagccagucugggcuccagaccaugucauaaaagcaaaauggacugggggccuggggagggacuacaauguaccccuagaaaaaucucccauuugccaaaugggauaauauaaucacgggguggugacacgucuguagcucacccacacucaagaaagagauauuacacaaacagaagagcuuuaggacucagucggaauucugccaaguacacugaaccacgggaaauucaacacuggcaugacuggagaacuccggaagccuucacacgccacaugcacaucgcuguagcugcuuugcagcaagugagguuugcagcaagugagguagucucuuagcuccuuuuccuucaacugaacuugaaccuuaucaaugcauuccucacaguuccaaaaacugaguuucuucaaagccaguaaaauuacauuuaaaauuuuaacuagccgggcaugguggcacacaccuuuaauccuagcauuugggaggcagaagcaggugaauuucugaguuugaggccagccuggucuacagaaugaguuccaggacagccagggcuacacagagaaacccuguuugggugaguggguaagcaaagaaaauauaaaauuacagagaagaaagaaagaaagaaagaaagaaagaaagaaagaaagaaagaaagaaagaaagaaagaaagaaagaaagaaagaaagaaagaaagagagagagagagggggaggggaaggaaggguuuauuucaucuuacaccacuaggaaacuucugagggaagucagggcaggaaccuggaggcaggaacugaagcggaggccauggaggagcagugcuuucuggcuugcucagccugcugucuuuauucaacccaagaaugacagcccugggaagguacuaugcaaaauagcuugcccccccccuccccccgccccaaucaacauuaaucaagacaguacccuacagacuagcuagccuaaggcuuaucgcacagaggcuuuuuuucaacuaagagucccucuucccagacaggucuucaccugugucaaacugaugacaacaacaacaaaacaaacaaacaacaacaacaaccaguauaucauuuuuaccaaauaaauuugggcaacucacgauaccugacccaaccaauuuuccuuuuaaguucaaacuuccuguuagguuucauacucuagaaaacacaaauuguuuuaaagcacagaggguuuggauaugauaggaggagggaaagaggaagaggaggagaggaggggggagggggaaggacagggggagggggaggggaggggagggggagggagagagggagagggagaaggaaugggggagaggagaggagaggagagggaagagagaagggggggagggagagagggagagggagagccccuuucgaagaaucugaacaaagaggcaaacuugcuaauagcagugacuacagcuggaagauaccagaauucaaacuaauaaaggcgugugggagagauggcagggcaagcuguucacagagguggcaaaagcagagaccagagggaaggaggugggcaggcagguggaaggacagacagaaggacaugguaaccaaagcaauugacccuccaccucuuccuuugguauuuugauauccaagaacauuccauucuccuuuuaaaaaccaguaauuuucuacucuuuucaaccaaaaugagcccaacugagguuucauuuaaagauuaaacauuaaacuuccaacaaaauaaaaacaaguuuuuaaaagaucuucuaaaauacaauuucuuacuauauauagucacacacacacacacacaacuucuacaaacccuagugcccagcuaaagcugugcgcuuccccaccccagcgcccacauagaacaaucccaggcagaaaggauuugcccauuagcuacacuaucuccaccaagacagcagccuuauuaaauuacaacuguuugaacaaggucaagcccucagaguuuaauucaaaguguuuccagguauaaugcugucaggucaacuuaaacaagccaacagaggcuuugagccugauuaaauauuaaaacagaaucuuucacaucuguuuuuacccaaggaugaaauuacuguacaucacuucagccagcucauuaauacaccacacacacacaucuugcucaaagguuacaggaauaucaacacuucagaggccugccgugagacugcccacacagccagagugaggucacugaauacuuuauuggacaucaauauuucuuuacaaaaugugagauaaucaguuagacagacacauuuuaaauuaaaggaugaaaaaacggccaugaagauaagccaguugcuuuugaucugaaccuucuaaucacccagucaguuggcaucgguagguaacuugauagcucgcauugaguaaacauuuugauucaacaguaauuacuuuauaaaauggaggguuguugcauucagaaaucucauucuucaauuuggaaaagagcaaauuaggcaugauggaggguagggaauacaugccuuuaaucuggcacccagggggcagacaggcagaacucuugugaguucaagaccagccuacuccacgccgagugaguccuagagcuacaaagugaagcucugucuuuaaaaaagaaaaaagccaaacaaggagaaaaguauaaauauaaaauacaagagguccauauaaacauuucaaaccauuugaaaguacuuacaacacugaacauauauccugcaauuagacuaggggaaaacaggucaggauccggugccgucuagacggccuaucagaaccuugccuaacaaacauuccaagacuccucccauuucauguucaacacucacuaccagcccuuccacugcaggggugauggugugcccaugacuaggauaacagccagucggggcuccucugcaugucuccuaucccuucccgcuucugguacauggagcccacuuucagcuggggaacccaaggguuguugacagcugucaagccuuugcacccuagucaccugggugaacgcauccuucaaaccacagucccccugccucugcugaugguggacagugccagaggcaggaccugccugagcaagcuguuuuccuccaggccuggugcucccuuggaaggacaaauggcagucaucuucccauucucaagggcaaaacuaaaaugcaaacgaugcugcugugcugugcagaggaagcaaagcacgagagggaggcagagccgcagccagcgcggcuaacaccuccacagugguaggaauguuaucugucuuuagauaucugccauuagguggugugcaaauugucuauguuuaaauauuagcaauaaagcaauuaaaagaacacuuacucuaucaaaguagaacauuauucacauuuuucucuagagaauucuauuggcuccugugccaugguggggcacgccuuuaauccuagcacuuagggaggcagaggcagguggaucucuauguucgaggccagccuggucuacagagugaguuccagaacagccaggcugcauggagaaacccugucuugaaaaaccaagccaggcaugguggcgcaggccuuuaaucccagcacuugggaggcagagacaggcggauuucugaguucgaggccagccuggucuacagagugagcugaggacagccaaggcuauacagagaaaccuugucucgaaaaaccagaaaggaaaggaaaggaaaggaaaggaaaggaaaggaaaggaaaggaaaggaaaggaaaggaaaggaaaggaaaggaaaggaaaggaaaggaaaggaaaaccaaagaauacuaccagucucucucuuuuccuaaguucuucaaaacuugaaugcuacacaccgcaacucagagauuuacauccacacuguuuucuuacuguuucauaugccugaaucucauaaucuguuugcuacauauuaaggaaaaacaagcuacggaaggguaaaacauuuuaauuacuucaauauugacuaagaugacaaauccuagcucugacaugcaacugaagacagcaaugcuaguacugauacucacugagacucacucacucacugagacucacucacucacugagacucacucacucacucacugagacucacucacugagacuuuuacuuacugauacuugcuucccuguaauacugcuuuuuuauuaauuuuuuuaaggcguucacuauguaguuguggcuagccuugaacuuccauguugaccaggcuggcuucaaacucacaaagauuugccucucaagugcuagguuuaaagaacucuguggccgucaugacuagauguuuuccuuuaucuuaucugugugugugcacagcuguaugcagcauguccugaagcuggagucacaggcaguucuaagcagucggccacgaggacugagaacugaacugggguucucugcaagaacagugcgugcucucaacuacgagauggucacgagauggucacuuauuuagaauuguaggucaaacacccaaaaaaaaaagggugauuacuguccccaaaccaaaagugguaaaucuucacacuucaacuuaagcucucacagacuaaggaaaaaacauccaagacucauuuguuauagaaagaacaauucuuucuucagauuuaccaacuacauauuggacuugggaggugaaaaaccaaagguucaacuuguuucaaacuuugagaagcaacuauacuugaaaaucugacuaggagcagagaaccaacugcuuuaugauuucuuuuucucuuccugccucaacacagcacucaacgacauugcuguggggacauggauccaggagagccaggcuggcguucuuacgcuaucugacccugugacgacaagagagacaaagcgccugcuuucucgguugcccacuggaacacugcauaccacuccaccacagaagagggcuguaaggcucacugaggugauguuaaagggagagaggccauguuuacaaaaaaaaaaaaaaaaaaaaaacccaggcguggugacucaugacuuuaacccuggcaaaucucugaguuccauacuagucugguuuacaaagguaauuccaggccagccaaggcuacauaguaagaacuuaucuccagaaauuaauagagguugggaagccuggagagauggcucagcagauaagagcuucacuucucuuuuggaggaucugaguuuaugcccaagcacccuugucaggcgaggcauagccaccugcauuucuggcuccggaggaccuaagagccuccuucagaacucuguuggcaccugcacucacgcaugcacagacccauacacagaaacauaagugcuccaagagguuagaucuaacguguacaaaaucagcccagagaggcagaccagacauuucugaucuguuaauaagacaaaauuucagggguugggaagauaacuuagcuagcaaagugucuguccuccggucccacacacacauaaaaagcugggcaguaguuugaugucuguaaugccaacacuuacagggagaggggaaggaagggaagaagaacagcauagucaaagagcaugcuagccaccgagguggcaagauggcucaggggauaguggcacuucuuauaguggcacuuguuaccaggccugaaggcaagaggacucuccgauacccacaugcugguggagagaacccacuccugaauacuuacuauucuccaaacuccacacacgcacacacacauacacaaccuccacacacagacacaugcgcacacacacauacacgcacacacacauacacaaccuccacacacacgcacacauacacauacacacuguuuuuuaaaagugaagaacaagaccauggcuggcauaaaccucuaaccccagcaacucccccaaucuauagguacuuuguuauucuuuauuuacuaaacauagacucagugcccacaaagaaaaggcacagccuauagaguuuuguugucugcuaucucugcuauguuuuuuuuuuaaaucucuaaauuaacauguaagaaacaaguaaaaaugaauuucuguuaauuucuaggugggaaauuaauuaaaugaauuuucauguucucagaaacaaaacugucucuauacuuugaauuguuagagcaaaaaucaacaggucuguauguacagguucccaggaccuauguucugauggcuggcuacacuuuuacuaacuagaaacugaaaucaaguccagguuggaugaaguccacugauuacuuaagauacaacuuagaagccgggccgugguccaggcgcacaccuuuaaucccagcgcccgggagguggggcaaguggaccucugagcucagacgcugacuugaguuucugugguuuguagaacacagccacaugaguguuucuaggaggcagaggaaggaaugggggagggucuaggcccuggaccacuguccuagauacaugggugagucuuccgcagucagugaacagcacuucccuggguucugccuacgcuugucugggcagaaaacaauuuggggaagcugguuuaggcucaagauuauaagaaucgcuuuuaaguacacuuaaaaaugagacacuacaaaauuuuuaagcauuacaucuaaacaccaauaguuaauaaaacagcaguguuuuuaacagaaaacagaauuccaacauagcaguccucuaccgcacacacaaacgcacaguugaaugauauaaucaaguagaguaaaccaugcuaaauguaaagucaauaaaucccuuuuagauguugacccacacgcaccaaagcaaagacugaaaggggaaacagaggagauuaaucaucgugaugcucugguucaauacugagccacagugagacagugugcagcagcacaguuuacuugaaguaagaguggacgcggcacggucagaaguggcauucauuaaacagccucucaaaagaucauuuccucuaauuauugcuuuuguaacacaagacaaagacagcccaauguaagucuggaaaaucuacaguuagcugccaaggucuugccagauaagauuagaugagaugcaauuuuagaaacacaacugggggaaaaaaaaaaaccacagcccuguuaccucuuccaaaauggcaccgcucugucucugcccacagucacuggaagugacaggcggguaacaugggcuggaucuuagggcauggcggugagcugggaaaagaaagaggagacacugagcuggggauuccaggagcucacagugcugggguguggugagggaggguuauaaaacgccuugcaauacuuccagacaaggguucuggccaggcuguacauacgacacugcagaagaaagcagcuggcuggucgacuggaaaaucuucaugucugagcugucucuggaggaagagaaguauuuuaaaaaaauaaaaaggcaagagggaaaggauagcauuccaucuuucaagcacagccucaugaaagggacaacuggcucagcagguacacuuucacaaagcaaagccuuccacaggagagggaggaaggaccacgagggaaaugauauuggaggacaucaaagcuagcagguuggugaguucaagucuauggaaggaaaggaaagaggcuuagaagaaugacugcacuguugcaaguuuucugcguucugcagaugcugggaggacagcuacagccuguagaacucagcauucaaaacugaauuaauauuucaacuacaaaaauauaauuacagcgaaaagguaaccuacagagcuacaugugacacuaaccugcaauccuggugguggggaggaagaaguaagaaaagagugaaccugagccauccaagcuacagacagaaccugugcgugagcaacacacacacacacacacacgagcaacacacacacacacacacacacacacacacacacacacacacacacacacacacacacacacagagggugggcagggaagaagagaaaauuacuauccaggauacagaacuacaauguaaugucaaaacaauccaauuuagauguaaaaagcaaacagggagauagaggcuguucuagagaagacuuggacugaguucccagcacccauguggcagcucacaaccaacuacaugguuccuaugcccucuaacggccuccacaggcacugaauguguguaguguacuuacauacaggcaaaacacucacacacauaaaauaagaaugaauacaacugggcacagcgauacaccccuggaauccaagugcuagagaagccaaggcaagagggcuaagaguucaaggccagccuggacuaaaguccuaucucuacauguguguguguguguguggugugugaaaagaaaaaaaaaaaaaaaaauauauauauauauauaaaaucagaaaguaguacaaggggacaacugugcacagaaauugcaaagccugugcaguacugguagacugaaacguguaggacuaugaaauguagcuauagugcuagagacuaaaacccaggacucucacaagcauucuaccaguagguuauguuuccaacacaguagauuuuauuuuacaauucuaucaugauaaacaaaccaauaaacccaaaacuaacaaugucaaaagaaauacaauuaaagacagugaguuuucagcuaaucccuaagggguccccuaaugccuacaugaggucacaaaguuuauuauuaguugucuacuaaguuaguauacuuacagugcucggguuauuaugaaauucaaaauuuuacuaacacagaaauugcuaguaagcuagaagcuugaaacugcaggguacaaagcaggugggagugcaguaaauuacgaaagccagcucccaugugcagcgcugagacugacugccuucauuucaggguucaguaacguagcagaucuaccaacuucuagucauccuuuuaaaaagaaaauagucuucucuguaaauaaagccaaacuucggguauuaaaaaguccaaucuagucuauaaugaaacuaauuuugauguuauccaauguagaguuccuucucucaaacuagcagugaggaaaaggacaucgguccacugccuuauggcccagcccccuaaagaucuugcuaaauaaaccuacaugcuaaugcuagcucuucuaucuagugggagcacguuggcuggaccuccaggcugucugguacaggcaacuauauucuucuagcucagcucucagccuccauucuacuucuauacccauaaucuucuuccuuggggagagggggaguccuaccucuggcagacagccaacugcccucugggcagaccaccuggucugucaggcauuaccgcugcccucuuuacacuuggucccagucacacugccacuuucagaugggaggaagacaccagccuugguauucacauccccaggccaaccucccucuccuaaaaacacucuggaaauuccauucuaagcucagagcaucaacuaccugauacuuaacccuacagcugguaaaacuuaucuacccuagugucuaaacucuaaaggcccucugaauggagggagggcagagagaguggaaaguuccaaagaauaauaauaacacccuacuccuagaguuaaaugcacagacuccaccucuaggguucucuuacaagggcuggguuaugggugauggagguauagcuugaaugugguacugcaaacaagugcuuuaggaugucuuuucagaugguguggcuauuuaccuccuacuaucugcagcuuuagaaccuggguccuaaauuugagacagugggaaaaugcacuuuaacauccugccacauauaaaaaacauuuagugacaaggcagacaaauaaaauaauuagacaguagccugcuaaagcccaagcugagauaguggacuacagacaccaaaggaaccuccagcaagucgaagacuccacagaggcucagucugaaagaaacgcaaugccauuaaauguucaaguccccgugcaauccagcauugcugcacagggugggauggcgcucagaguucucauuagaagcacgcaugguagcucaggcuaucaguauucucaaacucauaaaugaaaaccgccuguaccugcggucacacuugugugugcuaucagaaaagaaaccuugaguaugucaguaaccuauugacacuguccugagacuguccagguucaagcuccaggcuagcccucaccagcacucaggaggccagaacagcaaaugcugccacagcucaccagugagcacuuagguaaacuauccauaggcaguccuuagguucccucuuaaagaacucaaugcacaugcaugcacgcacacgcacguacacacgcacgugcacacacacacacacacacacacacacacacccaaaugccacuggugaugauaaacaaggcuguuucugucaguucacauuauaugccaauaacaguguggacuuucagucacagucagcagaaauuaaagccccagaggcuggaaucuuccaugcaaggcugauggcaaagauggcaggaaauucucuaauuuuuuaaugucaaaucauguugucuauguuugaauuugcaaauugcugccuauuaaaauauccauuuacuaaaaugacaaauacaugcugugacacuuaugaaaguguuauuuuuaaaacaucgcagacauaaaugaguaaccccuuguacuacuuaggguggaaaaacaacaaaccaagaucuaagaacuuacaguaauggcaaaacaagcacaagauugccacauuucugucugacuccccaagguucagaugccuaaggucagcucagcuuagcacggcaccugcagagcccaaacccaaaugcaggaaggagcuagaggcuucuuaccacgguagcacuaaacaguaagaccagcaagaaccagggacaagaggaccagggaaugcuauuaaauguucaagucaccauacaauccagccccacugcacaagaacagcaucgauccuguuccaaacugcacuacaugggguguauguguguguguguguggcucauggcucagagcucgccuauguucgugucaacauucaauuucaccuccucauaaaacguucaguucugccgggugguggcgcacgccuuuaaucccagcacucgggaggcagagggaggcggauuucugaguucgagaccagccuggucuacagagugaguuccaggacagccaaaguacacagagaaacccugucucgaaaaaacaaaaaacaaaacaaaaaaaaaaaacaaaccacacacaaacaaacaaacaaacaauguucaguucugugcuuuuuuagugaauggaauaacaaagauggccucugaaagugagguggcuguuugcagggacuguuagacagagagacugaaaacaaaguuugugucacacacauaauuuugaaauccaaccauuuauacauggaaguacaaaacaagcacgccucguacuuuuaacacugggcuuagccacauauucuaaagcucuuauaaggugagcuagagugacauuuuuaacuggugguaccaaaaucuauauuagccuagagauuagagggaacaaaugagccagcaccuccauccucagcucuuggccaucuggcccggccggucuaaccucccugucagcugccagcccugcuuccuugcuuguacacuucuucucuacaucagccagucuccucaccgcuccccaucgccuccuucgugccuaugagcagcacugaguccuugcuccucugaguccuuccuuggaaaucagucucugccuuccaccagugacggcacaaauaaccucuugucagguuuccccggaucccccuggcagacaaaguccuuccuccgccucccaagcccugggugucucaccagagccuuucuaaguagucaucucugacucaagaccucugggaguuacaacgccacuaagucagauggcucucucccauuagggcugugcucuagcuagaaaauggcacuggauaacuaaggauccuugauuccaccugucuccugccucaccauacaauucccuaucccaacaauggaagcccacaugacuaguuacgccugcaugcagucagcggcccuggcucuagagucuacuccuccggagucuuggaagucaguguucaguucucuuaccaccugaaucuucaguuacuuaacuuaauggagcugaaaauucucuuggcuaagagcagcaucuaggcaugaaaaguucuccaggguagcuaaguaucaggucuaacugucacagcacacaacuggcucggaagacacaggcauccaggcaagaguuaucuucuaacagacauauacucucacauuuuucauuauguaauuauugaauauauuugcacuguaagaagaauuuaaauauagauaaaaugcaaaugacgccaagccucuguggacaccuccucagccucauccugucccuuccuucgccaguuaucaguguauuuccauauaaccuuucaucaagccaagcucuucauuucucaugugcauuaugcuccacucacuacaugccagcaauugucagggaugugcugggauuucacucauucuaaaaagccuguauuagaauccaugaaaucugaucgugagaaacgaucucuuuuuucagcaauggcuaaggcagcaauuccauaaaucucuuccuccuugugaaacucucgcaucugcuguuuacccaacucucccuacuucccuaccagacauuccugagacgucugucacaugacuggagagcuccugccaaugaggugaggcacagucuccaccugcaucggcacuuguggcccacugcgcuugcucagcaggcuccuccugcucccucugcagaauauugcugugcccgggguccuuucccuucaugcacgucucugugcagcauugagaaaauucuuuccuaacauaacagaaucugaaugaauuuaucuuauauauacauuuacaaugccauccaugauacauuuauaacuagaucuaguuuuaagaaauuuacuuugcauaaaugugacccuuuuagaauuuugccccacuaaaaauuuaugaguuuccacaaaaaguucucucacaaagaucuacacuacaguuuuuaggagcuacguaagguuccaugugauggcuguaccauuguauggugaccauuccaggacuuaaccauucauuuaugcuaaaaugagcaaaauuaccagaucgagguaugugacguuauugauacagcugcuccagcacugucuaaaaggucugaacaauuuacaugcucacacuauacaaguguauucauuucucaaucacuguugccaauaaagaauuaauauuccuuuuaacguuugucaaccucauggcaaaaaaacaucugauugcuuuaauguaugauccccaucacuaauaagugauuacuaauaaugauaaacaucucuugguaauuacuggcugcucuuauuuuuuucuacaaaaugcauuuuuaucgguuuuaccaauuuaaauaguuacuccuauuugcaaaagguucuuuacaucuuucauauuuacccugucuccuauacauaaccaacugcucuucuagguuauuguuggucuuuaucuggggauguccuuggugacagacacuucaaaccuucaagcagauguacucaauucuuaucuaugccgagauugcuuccacagagguaggauuauucuucuaauauaaagccuauucuuuacaaacuugugauuucuggccaggcaaugcuuugugccaacuauccugaucccaucucucaaaagaacaaguacuggacagcacugugccagccaggcuugugugucauuucaggaggguguagccagguucaguucccuucuaaauaucuugggcagaagcaacuuacuuaaaugugccaaccuagucagccugacacuaguucagaccaaagacuaaaagaugggacuuuaccaaccauggcuaaauucccgaaccagcaucaccccauucucuguuggaagccugcuaacucugccucuauucccucacauucagaugugaugugugcccuucagaacugcauaccggacugggggagggggggugcgcgugcucaugaucaugugcgggagggaggggcuagcuaucagucucagaugccauguuuuguugaaauagucucuuaacuguauuucaacuuaacauuauggaacuccuaacuguggaacauuggcugugcuggcaucagacggcccggggaucagccucuccaguguugggguuacacguguguacaccagacugagcuuuuuaaauggguuuuggagaucaaacucaaguccucaugcuugccaggcaagcacuuuaccaacagaacuaucuccccagcucaaccugcaucaucuuuuuaaaaaguuuuuguaucucacaauacuguucauuguuuacucuuaaccagcccaaacuuucaacacgcccccucaaaaacaaaacaaaaaacaaaaccugagagccucaggaugucauuauucuuuauuuguucugucuguugaccaugagacuaauagauauuuuaacaaaaacuaaaacauuagucucuugguuucacaagucguuacacuugguggcuacuaaauugagggaugcaaaaacucagagagaacaauugcuuugucagaauuccuuugaauagcaccguucuggaugcaucauaaauccugagaaaauauccuuacucccagccaguaucagaucaucaaaaugucauaauuaauuuuuaaaccguucguuuaauuaaaacaacagaaagaaacacucuugcagaugagaagagcuuuuauaauaauguaugucuccucgcaaugaaaaauuggagcacagcucaaguucauuuaucucugagcugccaaaauuaauauaguaugcagagggcaaugcauucuuggaguugcaugaauccucucuccugacagauaaaaugucuagcuaauggucauuuagaaaacuaaucuuuauuuaauucuuaaugucuuggauuaagcauaauaugcaaacuccuagggaaaaaagucuauuucuggguuuuagugugcauaaaagccaaaauaugcagcucuucaaagauuagagaauuugaugcuaagcaaaaaguagccaagaaaauguuauguaagaaugcaggggcgggaaagacggauggcucggugguuaggagugcaugcugcucuuccaaacggcccgcauuugauucccagugccuaaacagcgguucacaacuaucuguuaacucuaacuguacggguucuggugccuucuucugacuucaucuuaaggauaugacaccaggcauacauaugguacacagacauauauuuaggcaaaacacucacagauaaaauaaaaauauaguaacuuuuaaaaagagaaagaauguaaaauagaacagagcaaacccaaaaucucuguaggauguugucucugucucuucuauccacuaacaacauucuuuaacauauaaaauacauaaguaagaacugaagagaguagugcuggcaaggcggcucagcagguaaaggugccugccaagccugauaccaucugagucccacaccugaacuaacaugguagaagggaagaacugcuccuugagugauucuccagccugugucuauccacacacauacacacaaaauaaacaaauggauucaaaauuuuuguuaaaagaaaaaagaucggccgggugugauaguauacgccuuuaauuccagcacucagcaggcagauggaggccaccccagacucuguguguguguguguguguguguguguguguguguuuucauuccaggccagccaggaguagagucaauaaaaaccugggaucucagagauguccacuuuacuuaucacuuugccuuucccccuucaaaccaaacaaacacacaagagaaaccauguacucuuuguauggacauguagaaacaccaugacucauucaacaagggcaaaaaaguuccggacggugacaccucaacaccucaauguaagaacuuuccuauuuacagugacgcaaugagagaaacaguaaacaguggacaacuguagcaaugaauuaguuaagccuuuggcuccuggcaggucuuaugcaugcuacgcaugcgcccaagagcucucuagauucucgaaugaaagauaccacacucacacacacacacacacacacacacacacacacaccagcuaauuuugauaugccuugaguagcucauuggcugggcacuucuaaauuucccuguggcuagcaaacaacccccaccucugaaauuccugugguaacaucuuuuaaaaucuguauuucaucucugcuaccccagacccaacaggggaagcagcaucuuucuccuucccugucaaggaaauucuuccucuuuucuggccccucgcccuugaaaucugaaagucuuaucucuguccuucugcccagccauuggcuguauggcaauucuuuauuaucagucaaauccagcuggggccagggaccucaggucuggaaacuuggcuuuuuuggaaucgaaauaagauaaaacauuagaaccaauccucaacaugcagacaauuuuuaacaaaacagcauuggaugacaggcauaugaguaguagaagaaacaauaaauaauugaauagucucaagauauaaaauacagucucauucuacaguucucugagguguuugugauggucccacugggcuggccacagcaucacaccauaacagaguugaaaucugagaucaugcccagcuucuuaaugggguaugcucuaucugaaggauucacgagggccuaccccgucuguccuucugcaagauucuuagacugcugacuugcguuaagaagcggucaaaggaaauacaucccuaaaauacugccaggagggcagggagaucuugggcagccaagacuuggcaucauuuugcccuuucccccuccuucaaaucucucaguccuaaggcugauaauccuuuguacuugacacuauuugucuuugaacauccuaaaaacaaacuacuuuuuccuuugggaggaucuaugcucuaugacaaagcaaaaaauaauauaagggggcuuagggcuggcuacuuugccccucaaccucaggguccugggguccuaaacccugaggacauggcacaagccguuccagggaguucagguguugaccuuggucugaggagaacaaauggaggagcagcaagcacuagcuucaucucacacaugcauccuuaucccacugccuucaucucgcacaugcauccuuaucccacugcaauuucucuguaaacucucaggagcucaagaggaaaaaaaaaaaaaaaagcacuaucucacaugugugcuaucauucauguacauauucuuuagcuggucuuaauaaagaaaacccauauggucaccaagaguguacuauaggcacauuacuaaaucugaucugaauuucuuaaaauuuagaaaaauuaugugaaccaagcaagcccuuagaaaagaugccuagaaggcaaaacaaaauguuuuaguuaguauuuucaggucucuuaaauacuaaagaauuuuuuuacucuggcauuagggacaaaauuaacuuuuaaacaaagauaauuuuuuuaaaaguaagcaaucucacauguuuauuuauuuaacaggaucugggugugcuggcuggagcaucuccacugacauaccucaaaaaccacaaaugacuaacuaugaaauaggccuggaaauaugcggccuguggaggaaaagucuuuaacaaagaaaggcuucuucuaaguugcauuaguauucagagaguaacaacucauuacagaugcacaguucuagucgaauaccgaguaauaccuuugcuaauaagagaauauaucugaaugucacacuucuuuuucacaaaacuuaauuacaagaggugagaauugagaagcacagaccugaguuccagaguuaucggauaagagaagaaugaaauuaaugucaaacauuagccaaaaaggcaaauacguaucagacacuuaggaugguguuaaggaagaggcggugggacagacuaaaaagagaaaaaagaaauuuaaaaagggggacucugggcagaaagggugggaggcaggggucauccugaagaagggcaaagggguuaaaaagauggaaucccugcagccugggcagacacagccccuauaggccucagcuucagguaaagacuaggagggagacauuuccucugagacccuaucucuccauccugugucacccaccagagacuugguguauggcuguucucaagcccaaucagaagucagccggaugugaaagaaaagcccuggagucugaaaugccacagacgcacguguguugccuugcaacagaguuuaacgugucauguuacaauacacaacuguuuucaguguaaugaaaacuugagugaaaugagcccauagcgguggcucuagcacucagaagcaaagacaggaagaucuggucugaagccaguggacuacguagcgaaaccaccuuuaaaaaguccaaacaaaggagaaaguaucugugaguaagagauuagauccuuguauuuugacagggugaggauuaaaugguggugcagaggaggcaugggguguugacagcaggcaaaagcaagaggcuugaggccauagcaucaacucacuacauaaucaucucaguugggucccacagaaucccagcagcagaggaucaacuagagacagcucugauguuuauaagccucacaucuuggagaaaugauucacucaagugagauucaaacuuuaaagcuaauagggacuaucaaagcuaccccuccagguuagggauaucccuagacuccccaaccuagaaaagggaggcacagugugaugugaccgaagauccagcuauuucacucgugguucacaugcaggggaaagaaaagugugcgcucacagagaagcuugcagaagaugaggaacagugggacacaucugcaauccuaacguucaggcaucuaagcuggaagggucacaaguuuugagacucacugggcuacagugagucccuaguugugcacaaugauuacagcagcacuguucauaaauagcuaaaaccuuucaagcagcgaauggauaaacaaaaugugggauugauguacaguaaagaggaaugaaguacugaucugugcuaugauccagaugaacuugaaaacgguaugcuuagugaaagaugccagccacaaaaggccagucacuacaugacucuuuauguuaaaugucuauaauaagcaaauccauagagacacaaaguagauuagugguugccaggggcugagggaagcagggaaugggcagugacugcuaaugagugugagguuucacucugggguaaucaaaguguucuggaauuagaaaacggugaugguuacaugacucuguggguauacgaaaccacugaguugaacacuaaaggcauaaauucaugaugugaauuauaccucaguaacaacaauaaaaacauaugguacaaauccacaagaguguagacagcauggggggggggggugagggggaggcaaagaauguccagaggacauuacuucuuuguuggcaaaagacuaggaaagcaaguuugaucccauuagaaaggcuccugugagcaagcaugaaacucaggcugcugccagaaagagucccugaauuuggggacaagauagcccucagaucucuuaugaguaucuccuaagcacuaagcaauucccacagaguccugccucgggcuuucucccuuuccacuuacuucucacagcaaaugauuuaccuacucuucagucucucuugguuguuccugccuuaaaagauaacucccuuccauauuuuaaggacauggaggaucaagggacagaccaaacaccaaaccaugcugguuuccuuacaacuaacuaacuguucagcuacagaaauaccguggcccuaggcaaacagggugccccuggauacgacuaugaacuuguaacuacaucauaaugcuguaguuucaacuaaggugcauuuugaaugacacaaaccauccccagcaccugugcccuuuaguuuuuaaccagagacugagaagccagaucccugacacagagauacuggccaagccccaccucaugccagggaugccacaugaugcagcucuagccaacgaaacacagacgaggcagccucuggggacagcaucaguucuggagaacacagcucaugcuguugcccuuggaccuuuccccuuucuccuaugggacagaaaggcagagccugugcaugaagaagcuacccugggcgaagugugguaugagggaaacuucucugcaaaagacagugaagcaggaagcugcagagaugcugggucucgaaggcauaaagccacugugggcagcuggcucuaacagcagugggccacugccuacaacugcugccuccaagggacaaagaagcccuacuugucuaauaucccacuuaaaaagcugaguugaacacaugccuaacuaaagcaucugagaugcuuccuaagaaagagccagcagucacucaggcuuaaaagucgucacggaaaacagcuggaaugguacauuagucucauacuuuuaaccauagcagguucagcuugguucaggcuuuuuuuuuuuuuuuuuuuuaauaaaugaaaaaauucaaaggccucauuaaaaugccacauaccuuucugagagauauuguauuuuaaaacaacaaaaaguuuuuccucaacguucccaugaacauuagaguuugcacaacaggucugaggaaacugaggcacagggaugauguggaagaaccagauacacagaguuggaaacaaagcaccagaauccaaaccacggccaagcccacgggcacacucugccucuaccucagggaugugaagaagccacaagcaguuuaacacaauugucccucuccagaacuagguaagagcaagggcacggauaugacauagagaaacacaagccaggcaugaugacacacaugcagucucagcaccgggguaaaggucccuacugccaagccugaugaucagaguugcuguuugacuccacaccuguacugugguacucagaauguacacacauauguacaugaugauaaauaaauacaugugaagaaaauuaagccaaaccaaacaaacaaaccaacaaaaaaccaaagauuucuuuuuaaguucgagauagcaagguaguauauacauuuguauauaaaaauauuuuuaaguuauuugcuaagaaucuccucuccuuugcagccaucauccuucaacccacacaacuuagugcuuauacuuuaguauaucaucaauuuauccacuguacucuucccucaaucagcagacugccucucucucucccccaaggucaacaccccagugaugaaacucacacucagaccuucgcuuuccugccucaagccugcacaaacucuuuacacuuuuuacuuuugaaacacacaguucaguacaacacagacuaaucucaaguucuccauuccccugccucaggcuccugaggacugagaccauguaccaucccuggguaaccacucaauauggcucacagcuucauucccuagcacacagaaucacacacgcgcuggucaaguacugcuuaccaucgcccaaaccuauauccacggcaggacucccagucuuucaucuuccuauuuccucuaccuagaaccuuauccauaaguuaccuuucucuguaaagcuuuccauagacaacaaauucgccucguuccuuugcacuccaagguguucuguacagcaccaacaucaguuguguacacuggcugaguguaagcugagucuuccuggcugaccacuguguacgacaguguaucaguaaaucguuacaugugaucaagcccuagccucacacgugagacaaauauuccaccucuccucugagcuacaucuuuauccuaaucccaacugaauacacauucgcuucuugaagggguacagagugaaucggauaaccccauuacucucugagguucuuaaacagggaugccugccguauauaccuacuacagacaaucugaggcgcccagugcucgcuaagcucaguagcacuacagcuccugacagaaauguuucuacugagcugugguuugaaagggaugaagcaugagaggcaucuacucggggguuauauuauauauauuagcauucaagacuugauuucaauacaugcuucccuaccuuguuuacaguuuuccuuuuucaguagcaccauauuuuauuauauauuuauauauaauuauuauauaugauuggugugucccuuuaauuggaagcagaaagcagcaugggagaaaaaaaaggcugcaacgcuaccacucaguguugccuauacaggaucagaauccaaaauagacccuauauucagagagaaaaagaaaaaggaaacaauuuucucugcuucaccuucucugcguccugaccuaacaacaggaauuguauaagccaccaucuuccuuccuccucagcaucuagaauguuuacaaauuaauuauucauucuagacauugggcuuaucuguucuugcaucuuaauuauuuuugagguuuugaaaaagcuuagcuuauuaaacauauuuuaauaacccaagcaacccagccuuaaaguccuuguggagcugcauacagggcacaaucaccauucacgguaaaugaaugaaaacaaacaaaagugccucccgcagccccagcaaguacaggaagcugcacaaucacacagcuucccucucccccccacccucaccacacccccgccccccacccccgcuucaguuaucccaauauauuuaagcaaacuuuuucuggaaccaguugggacuuuucguucaccauuuuucccccuugguaaguaaggaaggguauuaaaacgacgcuucacacaagucaggcagccucaagcucuuuacauagaugaaaugaggcugucaacgccugauccucuugacuccaaucuucuaagucucacgaugacagccauguaccaccacacccagauuuguguuuuguuuuacuaggacaggguuuaguuuugaauauucacagguggccuggaacuggcuauguagaccagguuggccuuaaacucacagaaauccuuuuaugugucucauguauaugaauacaguaugagugcuguguccauauggguguacacacgucuucauacauacacauacacauacacauacacacauacacacacacacacacacuguauaccuguagguguacauacauuuucauacacacucuguccacgaggguguguguucacgugggugugugcaccucuucacacacacagaagccagagaaggaugugagaugaccucuucuuucacucugccucauuucuuugaggcagggucucucccagaucacauuuuuccugccaggcuggcagucagcaagauccccaccucugagguuauaggcacacuuacaggcccagggcagcuuguuacaaaggggcuagaauccaaagacaaaugcucacacacauuccaaguguucuuacccacugagccacuucauagcucccaagcucacacauuuugucuuuaaagucaucuuuugucacauuguccucacagacacaaaaauuucaucacuuaaucaaaauuaagugcuugacuuaauuuugccuuggaacaaaagaucugucagaacaaaaaaauuauucuuuaugauaacuacuauagcagcuaaccccuaaaaacaaacauguucuagagcuuaagaaacagaucagugagccgggcaugguggcacacaccuuuaaucccagcacucgggaagcagaggcagguggauuucugaguucgaggacagccuggucuacaaagugaguucgaagacagccaggucuauacagagaaacccugucucgaaaaaccaaaaaaaaaaaaaaaaaagagagagagaucagugauuaagaccauauacuguuauuguucagaucccaaccuaacuaaugguugcuaggagaagagaaauauuuuuucagaaguauaacaacuaguacguuccuguaacuacuaacucuaaucaaaaccacugguucacaaaaaauacauacauacaucauauauacauacaucaaaguagaagaauguuuaggaguggagagagagggaaucaaugggaaugggaagaguauaagaaaggacuuggugugggggugaggggacauacacacacacacgcacauacauacucgcauguguacacacauacacucuuccagaggucccaggguugguucccagcacccacauggugaucuauaguuccaguuucagggaauccagcaccaucuucuggccucuacaggcaccaaccaugcacagggugcacagacaauacacccauacacacacacauuuaaaaaacaaauuuuaauuaauaagaaaaggaaacuuaguaguuuggaaacaagucuaugugacaaguguauccacccacagagaaagaagcugcaugucccuucccauucccuaugggaaucucacaagagagaugacccaaggacuaggagguuggagccugauuaacuccuaccagauuuaaggagggagguggguucauugacaguuucucagcguuucuaauaguggguaaugcugacaugaaacuaccaggguaaauauuuguuccauuuuuggcuuauaaauuucaugaugauaaaauucuguauauagagccguuaauuaaaaaggagucuauuugccuuguaagaaguuugaggcuguguguuuauucuacaugaauaaaacgguacacacuaggaaggaauaggaauuagagaucugaacgugguugcuuugguaugacaaguuccucuugggaaugaaaagguuucauuuguuaagucuaaguguggccuuuccgggaagcaucugcaugaagaugcagcaguacaguacaguacaguacaguacaguacaguacgaguugccaugaccccaccucaaaaggaaaggccaagaaacagcaagucaaauguccaaggagauuuauuuuagagucacuuugcaaugccaugguaaauuacuuaagagguggucucacuggcccaggcuauuuugauaaguccucccaggacuagccaaacaaagcugacgagcagccagcugugcuaucuacuucuguaugacugggaauccacagccuggggcugacuggugccuugccucggcaccaccaaacucuugcugugcauaagggauguucacaaagcagaggucuccuugguggugcuguauuguauacaaggucacauuguguaggccucgaugaccucaaccucucagucuuacuaccucagccccuugagagaucagauuacagaugugugucaccauauccagcuuguguuauauuugcuuauccaacauuuaucucugugaaauacauacuggcauuuacaauuuaacauacaaaauuuuaaguaacugaaacaauuuuaacuccuaucuacagaacauacagcaccaaacugaagacuaagggcaacucugaacuucagguguuacugaugucuccaguuuggcuccccaguaacaaaccaaucacucugguacaagugcuguaauaggggaggcaguacacucgacagguaggagguaugugugggaaaaaucuguccuuucuaauaaauucuaaugagccugaauacuauucuaaacaagacugauguaaaauaaugcacaaacaauauauauuuugcacagagaagugaccucuccauucgcuauuugcugauuacaaaaccgacacagaguaauugagaaaaaucacugaaagacaacacagucaacagcagucacccaccccagcuaucuugucauuuacuuccuuagggcugcaggauaugacaacagagauuucuucuaugauaaaccuguauguggcuuuccaauuuuagaaggcaacuuaaagaggacguaacucacuugggagagugcuuacuuagcacacaugaugucuuggguuuguuugauaccuaguaucccacaaacaagguuugguaguacauggcuguaauucaugauuauggaagcuaagaaagaccaaaacagaggacccuaaguuugcagucaagcccuaccucaaaaauagcaaaaagcuuuauuuaggaaaaaguugaaacguaaaaaguugcaagucuacugugauaauuaucuaugcuccuggcuuguccccucuaccucucucccauccugcccuaccuuccauuugagauuaaguugcagauacucuuuuuuuuuuccuguuuuuuuuguuuuguuuuguuuuuuuuguuuuuuuuuugagacaggguuucucuguauagcucuggcuguccuggaacucacuuuguagaccaggcuggccucagaaauccgccugccucugccauccgagugcugggauuaaaggcaagcacuaccacgcccggcaaguugcaaauacucuugucuuaauuaacaccucuuaaaaauaagaucagauaccacuuaguuguccagugcuaaauaacccuggaaauauacauacaaguaacauuauauggauuuaacagguuauauuugggaauauauguauacacaaauacauauauccaugcaauaucaaccaaugaaaagaggccaugaauuuaaaaaagagagggaaaagggugugggaagguucagaggaaggaaaaggauaaauguuguaauuaaaauauaaucucaaaaaaacaaaaaaaagacaaaacaaacaaacaaacaaaaaaccaaauaaguuuuuaaaaaaaugggucaucaagcuuggggcaucaaauauccauuccauaaauggaauacauuaugaaucuuccaaaaauucacaauuucccccacuacagagugaauacuugcugcagaggaaaugcauggucccaggaguuuucaaacuuacuagcuguuguuuguuuucuuguuuggggaaaggguuggaauauuuguauaaauccuaccaguuuacuuuuagauuuugaagcauuuccaauuuugagucuucagauuagggaaacucaaccuguacuacuguuuauacacagccuacccgaccccaucaccaauucuauuuagcugccaugccucucugugauuuuaaaaauacaaagccacucaucuugugccugaucuuaaucaacuugccacuguacugcucugguccacucuggcauggccacaucagcucaaacgcuaaccaggcccuuuccaccucgacccugcaaaccucucaagucuuccuccagaaggguuccccugggugggacuuuccagcacauacaacaaagccucauucuugccaccauugauuuccuucaugcuaccaccuaucauauccugaaugugaauucugugaaaucacaugguucagaguagaagcucaucaugccuaaaugaggaaggauaaaaugaaggggcagggaguggggagggccacugaaggacuucguucuagagauuccacacuggcagauguagucggugaucucccuuuuccacaggacaggacaguaugggcacacaucaagucucacacucacucucaaguaagugcuaugggagaugccaagauuaauaagagcauuucuuagcaugcuguaauaaagaacuucagaaugcugggaaccccaaagagaaagccuagaguuaaacagaaaggcuagaucuggugucagacacaauuugacucugaccuguauguguguauggccuugacugccuccaggacucaauuuccccuuagcucaguggggauaaugccaacccacccaguaccuuggcucauuugagaggacaggaugucuuaacagucaguggguggcaguucuuuuagcaagaaaggacaacaaauucuugaaucgauguggcuguaaggaggagguaaagcaggugcucagauaagcauuaggaaauaguccucuguaacaccaaccacgugacaagugcagauggugccccucgccauucuccaucagcuaguguggacucaaaccaacaccccagucaucucuaaacacagcaugugcugcuuugggggcacaggagcuccacccuggcucuuggacacaggcuacauggccaguugugggaauuccucacaaagcacagauagacaucacaugaccuugggggccuuucuuuucaacccugcaaguuacuuuuaaaaacccgaaugcguuccaggacagccagggcuacacagagaaacccugucucaaaaaagaaaaaagaaagaaagaaagaaagaaagaaagaaagaaagaaaggaaggaaggaaggaaggaaggaaggaagaaagaaagaaagcaagcuggagagaugacucagcaguuaagagcacuuacugcucuuuauucaagaaggccagcguucggguuaccagcaccuaucuuaaagguuaaggacugccuauaacagcagcuucaagacaucagaugcuuggauaccuucuucugacauccuugggcaccaggcacauaugugguguguguauauguguguauauauuuauauguauaugcauauauguaugugggcaaaacacucauacagaagauaaaaugaaacuuuuuuuuaaaaauugaauuaaauauguuucauguacccacagaacauauugguaggcaauucggauaacaguuuuucuagugccauggaaaaaccaugccuagaaagccaaggcccacuaaacuggacuaaugagcaaguauagaccaauaaagaacacgaugcucagagaagcuggaauucugggaggcuuggagacuuccaaaaauaacauccaaaguuuugcuaggacaugaaggucaugugcugcauggccugaggacugcagcccucgcuaacuuuagugucagcuucucuacaacagugugcuuggugcagaccauuuauuggcaacugcagcauggcuugcuuacuugcagcacagguuccagaacauggaguuacuugcaaacacuuugcuguauggagcauuacauggguuaguacacgcgagggaagaauaaagaggcucuaugggagaagagaacgguggggcccugagaaggaacaacgagaggacugcgcacagagcaagucugaacaagcaaacaggagcaggagugggagacgaucaaaaugaucuccauaagaaaaggacaaauaaaccugguggugguggcgcacaccuuuaaucccagcacugggaggcggauuucugaguuugaagccagccuaaucuacaaagugaguuccaagacauccagggcuacacagagaaacccugucuugaaaaaaaccaaggggaaaaaaaaaaaaaaagaaagaaaagaaauagcagcugaaaugaucucuuucaacaaacaauugaucuucaacaaaacuaucaaauggaucaauuuacaaguggcuguuaucagauggggagacagcacugagcauccaaagacucugccacucacccuaauuaagacguggagaagacaaauugaaacaucaccaauucuaacacgcaaaccaaauucugcccuugggaauuucaauuucaggccugugcuuaaaaucuaugugcauuaacucugacagcauaucagaaaacaugacacaugucuccugaucacccuaaauacaaccuccaaaaaccauucaaguuugaaaaauaugugucaagcuguuucuaaauaaaccagcaacuaacacaacaacuugcauucaugcaaguucuuuucuucaugggggaagggguuugaguggcaaaauaaucagagacaugguauguaagggcagacuauauauaguauguugcuagccuuauuaacagaaccugaugccuuuuggagagcuccuccuuauucucagaugcggcuaaaagaacuaagaguuucaaaaauucaaggucagaaugggcuacacgagaaccuacauccaaagacaagaaaaagacuuuaaaaauuuuuuuauuguaugugaauagaugguuugccagcauguauaucugugcaccacauguauguuuggugccagugggggcuacaagagggcaucagagacccuggaacuauaauuauaggugcuuaugagccuccgcaugggugcuuggaauuggacucagguccccuggaaaagcauccaguacucuuaaccacggagucauuucuccagcccaaaaaauaauuaaaauagaaaauaauuauaaagugccauaguaacuuauuuauuuuauuuacaugaguauacuguagcugucuucagacacacuggaagagggcaucagaucccauuacagauagcugugagccaccaugugguugcuggaauugaacucaggaccucuggaagaggaguaagugcucuuaaccucuaagccaucucuccaguucaccaugguaauuucugcacaaaacacauaaugcucauuagcucauguauucuuugacuauaaguaguuaugcaaagaacauguguguagaaaaauauguaaaaggauagguaacaauaaaaauauuugcgcuauaaaaaaauucaucagggcuuuggagauggcucaguagauaaaagauuugugguacaagcaagaagauuugcauuuggaucccccaaaacccacggaaagcgggcaugguaaugcuuacuuagcauguggcuagcaccuccaggcuccuacaaugaagugagauggaaggaagagauucaagacuacccagggcuugucagcuagggauccuggcauacaaagcaauuaacacaagagagugucuccaacaaaucagaagguauagaccaacaccugagaccgccucugaccuccguaugcccaccaugcaugcaugcacacacauucaugugcauacguauaugcuauauuguuuucaccaucaucaauaagauuagcauggacacagauucugaagcccugaaggagagcuuaguuugauuccaagaguauggucugguaacggggcugaugcuaacacagcagcagggcagugcgacauauaagccuugcacucugagagcccggaacuccauaugcccagcccuaauuagcaugugauacccggcagcuucugaaccacccuagggagauguuuucuugucuuuaacacagagcuaauaagaccuaccucauaugcaaaugaggccaaguccacggcccagaagaguguaugcuuaguaacuaugugcagacaggaucauuaguagcacauacaucugaaggaaaaaguacacuuacaagucaaaggacgauccuaaggcacaagaaauggccacacuguaauagauggauguucgucuuccaccaccacagaaugauuccucucugacaacaagcaggccaucccauucucuguguggucaccuauacugugcuauaaagaaccaaaaggauccaucccaaaaacauucuccuagaaggggaaaaagccauacaguuucagcaacagcaagaccuuguuucaaaaaggaagaggaggaacggcagcggcagcaauagcaggcuccugcagugguuucagacugagcagacuccagauagaagugacagacuaaaaccaaaacaagccaagcccagaguuauacagcuaggaucugcagacagauggcaacaguaaggcaagcuuugaguuucuagaaugguugauaauaaacucaaaauaaaaacaauccuguuauuccaccaugaucuucagacacagacugccauaaaaucaggaugcuucuggcaucaaauauuaugaaagcauauuguuuucagcuuccuauguuagguaaaaaguaguuuucuacgaguugucaaaauaauaaaucaguuuuaaucauucuguauaauugagcaaaaguuuaaaaaaaauguuguucacucccuucuaugggaacauaaacagugucagaagaagaaaacucucggcgcugcuuucuuagauaccuggauuagaaugaucacccuuugagaugucuuuguguuccucaaauccccaaaccaagccaccccgagcagcugcucacuggccaacuggucugcagauuucaguggacaacaaaagguuaccuuaauucaauaagauaaucagcacacaguuccccaccacccagagucuuaccaucugcaaggcggcagagccaaaugccuauaaaacaacuggcagcaugcagacagguccuugugucucuugugucagugaaacuucucuuagcaacagcuaaaaagaaacugaacuuaagagagaaagagggggaaaaagaaagagggggagagggagagagagagagagagagagaacggacggaaaaccuuaagccaucacgauccaaaaaguuguuauucuaaggccacuaagguucaccagccagauggguaauauguuuuauucaauuacaucuuguaugaggauaacaaagcucaaggcagacaugaucuggaucuugucuuuguucaagaaccuuccaaguuacaacaggcauucaguguguacauauaaguuuguaugugugacuguuugugagugugugucuguauguaaguauauguguguguauguuagaaagauaaucgaagaccuaaucacaagagcaacuucaaagccagagacuaguaucaauuuaggcugcaacaugacaucucuacaccaaccagguacuaaacuccucuccaagcuugguaacaagugccuuuuuaccugcagccacguauucuaguuacaucugcuucccagugugcaggaaaacugucaacccuacagaacuuagcuguaguauacauaggaaacacuauuauaccccucacuaugaucacugguuuuucacauuucugccucuuuucuaucuuaugcucacacccaucacuuauucguguugugauguuugcugaaccacccgacagugcgcucagacacccuggcacgucagcaugaaacccuuuaggaggacucuccuaacucacagggauaaagacucacaugacaaacaucauuaccacacugaagagcacacaccauugaugccauuaaccucuggcccaaccucccauacacacauuuaucaccuaaacguuguuuauacguuguauauacauggcucagugguuaaggguacauguguaagguaccccagcucagccaccagugcccaaguaacaaugccuggaacccuagcucuaugagauccugugcuucuguucuuugcaggcacuguuacucaaaauaugcgcacacuauacacacucacauacacuuaauuaaaaccaaauaaauuuagccaugcacgcuacacgugccuuuaaucccagcauuuggaaggcaggcaggaggcucucugugagcaaggccagucuggucuacauuaagaguuccaggucuuccagggcuacauaguaagaccuuaucuaaaaacuuaaauaauuaaaauaaaauaaacauuuuaaagccccuaggaaaaugagagugggguggaaaggaaauagaagaucugacuuaucuaagaucuuuuggaacaauggggaaaauaaacaaguauaauuauucaugaagacugaaaaaccuaauaaaggagccuggccuacuuagcagguaauaaaacacauucugaagcuacaguagcuaaaacccuguggugaaggugcaugcacugacaguucagggcgcuaaaccacagagccucaaaagaaacucaaacacacagguuuaguuuaggagaaagauggaauuucauauacagaagaauaaagagauuacucaacgaaugguaacgggacagcugggcugccaucugaaaagauaauaaaguaaaauuggauuccuaccucauuccuuagaguaaaauaaacuccagauggaucaaaagcucaauaauaaaaagugaaaacagaaaaacauuggaagaaaacacauggauuuuguuuuucucgucaucuugcggaagaacaggccuaugcacaaaaugaaccucagaggccauaaaagagaugggauugcuuuucagccgauaaacaagacuacaguuaaacuguguacgcccucuaaccuggcuacugacaucaggguaugugaaggauucaucaauauucacaaaaggacagaaggaggcuucagaucuccagagucuaucacugacuaaaaagaacauacauugcuuuaugaucuagucuggccucuaauagcacaugcuccauuacgcacacaugaaaagcuaucuuuuauuuuuuuaaagaaaaaagccacagguguauggaguaucuuuggaaaaugaugacaggcugucuaugaggcuaaggugcuugcuucucaguauccaucuauccaucagucacuaacaguuaguggagguuuuguuuccaccagacucucucuguguaacccugcuuguccugcaauguguucuuuagaccaggcuggccucaaacucagagauuuugccugccucagcuuccugagugcugggauuagagacaccaccaucuggcuuccauugaugguucuuaaaaugcacccagugaugggaagguauaugccaugcagggaaggaauaaauccuaaggugacaugauaaggaggcucucuaagcuauuuauacucaggugccucagaagaaaaacuggaagcaucaauuuauuuuaaagaaugaaaaaaagagcuggguaugguguuuuacaccuguuaucccagaacuuaggagguagacaggaccgggaauucaaggucagccucagcuauaugaagucagccugggcaacauuagacccuuucucaaaauaacugaaaaacuacuaaaaauaacaauagaaagaaaaaaacuaaugaaaguauuaaacuuugcuaaacuuuccaauuguaacauuuuuuuugaauuaugagcaaguaauuauuaacuuucuaaacucauauuccuuuccuuugucuaggguguggggggcaauagcacaccaugauugagguguggguggguggguaagggugagagagggugagagagggugagagggagagaaagagaaaccccaaaucuugacaaaaaucucaggcuagagaaaugguuuacugucuaaaagcacuuccugcucuuucaaaguucaauucucaggcuucccaggcacuggcucauaaucaccuccauuauauaccuccauaaggauccaacuccucuagcuccuguggguagcuacacacacacacacacacacacacacaaauaauuaaaauaaauauuuuggagaaaggguucucaauaaguuucccaggcuggacuugaauuugauauccccugccucagcccccuuaaguagcuaagacuucaggccuauaacacauagcacaacuauaacucagauuuuuguuuacaaauucauuuuuauguaugaauauuuugccugcauauguauauguguguauauguauauauauacauauacacacauacacacauauacauacauacauacaccacaccccaugcacuugccuggugccggcagaagucagaagagagugucggauccccgggaacuggaauuacugaugucugucagccaucuguagccaaauaggugcuaggagccaaacccagguuaucuacaagagcaauacuguaacucagauuuuuuuguuuguuuguuuguuuguuugucuguuuuuuugguuuugguuuuuucgagacaggguuucucuguauaacccuggcuguccuggaacucacuuuguaaacuaggcuggccucgaacucagaaauccgccugccucugccuccugagugcugggauuaaaggcaugugccacuaagcccagcuuguaacucagauuuuuaaaacaggauuuugaagcaaauaaggcccaguuuauugggucuuuuauuuuuauuuuaacaagguuucauuuagcccaugcuaguauaaaccuacuguauaagagauacuggccuuaucacccuuaucauccugccucuaccucccucuacaugguauuaaagccacaaaaauuuagaaccagcagacagacagucuuauccaucaccuccuuaaaauacagugagaguggcauuuagccuccaucauccugggccucagcucucuucacuguuguuuacagugugcccaccaauccacagaugcccuguugcaggacgccuauauugauuuuaaacaacaccuaacccuaauuaauaacagccuaaacauggacuagagagaagacccagcuugcugcucuuucagaaaacccaaauucaacucccagcagccugcuaucaggagguucacaacugcuuguagcuccagcucaagagcuccaauagggggacagcucaagcguuaagaacacacgcugcccuuguagagguccuggaaucaguuccuagcacaaggcagauuacaaacaucuguaauucgaguuccauggaucugaugcucucuuucagccucuaugggcacgcaggcgguacacuuacauaugcaagcaaaacauuaauaaacuuaaaauaaaaauaaaauaaauguaaaaaaaaguaaggcuaaugagauugcccagcagauaagaaguauuugccaugcaagccuaaugaccugaguuugagccccagaaccuacaggagagcacuaaccccuaaaaguuauacucugaccucuauguaugcacuguagcaugcauguaccagcacauacgucaucuucacacauaacacuaauagauaaaaauugaaaauaaaaaaauuucaaucacucugaaaaugaaggggucccagcugugaucuugacagguuucuacuagcuguuuaaauuaccauuccaacauggcuucucuuugaaauucccacagggcccggcacagguuuugcacauuaugagaacagacuuguguugauuugacccaaaugaagagauuggggcagaaugugggcaaacgcaccccaggcagccugaaucccaagaguccugugcccgcuccagcaccgcccauggaggucccccucuucuuuggcccauguguuuuccuguaagauuuaccugcuuagcagcucucacagacacucaggauucauguaaaauuauuuuguaagcuagcuagcuugcuuccuuccuuccuuguuuguuuguuuuucaugacaggguauuuucuguguagcccuggcugucccagguacuagcaugcacuaccacagccagcucuacuuucaaucauaagaacauuacaauguguuuaaaugaguauccucguauauaguuuucuaugaucuucaaacacaacguaaacuaccaagcauauacauguuauaggcacaaacacauuuguuuucaaucaugccuguuugcuuucauugaaugccacagacuugauaggaaaauuaaaaaugguccccaaaacaaacuaugaacuucgggaggacugagaauuuucucacaggauauacacaagaguacuuuaaaaaaaaaaaaaaaguggugcucucagucauaacuauuuauuucauuuugcucugaauuucugaaaugcuugcaaaauacauacaauuugcaccugaucaguguucuccaagcugccugcaggcuuguguucauacauuagcaagauuuauugcuaaccaacauaccaugcuaaauugaaaucaagauacuacacaauuuuccaauacagaggugauuuuauaaguuggcacaaacgcuuugggggggauguaauuguugguaucguguuauacucaguagcuguggaaaaugagauaaacuggaagguuucagaaggucagagcucaucagauggaaagaucgcagcuuuuaucagcucuggaaagcacacugaugauaggcuaauaacuaaauaguuguuauucuucaccaacuggcaacauucgguauuuccaaagcacuucaguuaagggcaacacccggggagaugcagccucacugugaaggggaaggaaucuauagcccccuccccaaggccagccugugauugcugcuugcuucucugaauuuuucucaaaacaacaacaucaucaaaagacaccugugugauuucucuuccaacuguccaggguccuuaacugaggcuugagguugaagcagacauaaaaugcuuccaagauugcugagucucugaagcaccgaacaggaccggugacacacacaccuuugaucccagcacucugaagacaguggcagguggaucucugggaguuccaggccagccugaugaacauaccuggucuacacagggaguuccaggccagucagagccaacagugagacacuaccucaaaaaugaagcucugggacucugagacugcucaugugaaaaccugaguuugaucccuggauuucaccaugcagagaaccaagcuauucuucgauuuaugugcaugccacacuuacacgugcacaauaauuaaaaucuuuuguuucuaaaauucauuuuuuauauguaaguguuuacuguggaaugugagggucacacuggggcguguguggaggugagaggacagcaggcagcaaucagccccuuccuacccugugagcucccgggauugaacuccagucaugaggcucggaggcaagugccuucacauacugagacacgucacuggacugugaucuguuuuuuuuuuuaauguacucugugggcauuuagcuuaaaaaaaaucuuucucuacaacuuuaaacguguuucucaaaaaauauuuuuuaaagauuuauuuuauguauauggguacacuguagcugucuucagacacaccagaagaagccuuuagauuccauuacaggugguugugagccaccaugugcuugcugggaauugaacucaggaucucugaaagagcagucagugcucuuaacccgcugagccauuucuccagcccucagaaaauauuguaaaucacaaucuaagucaugccuuuaacaugaauacaaccuaucucaaaaaaaaaaaaaaaaaaaaaaucuaaacaugaggaccugaguuuccagaaccagagguaaaaacccagaagcaggaucuagcacaaguguacucuccggaugccaaaagcuaagauaggaaagagugugaguucgaggccagccuaggcugcuacagguuccuggccagccuaaauuugcagaguaagacacugucucaaacccuacuccagccccacaaacuuucuaaacuauccugguaaauucauuuguuaguaaagggacaccgucaagcagagacaaaaggcaggcccugcuccccacccuuagaaauaaucagguccuagaacucagacaagcagacucuaaccuguggccagcaucacauccacagaaugacccauucucccauaagcauacacugacuuauuauaaaaucugaguuggguaaagcacugugcaccaaggcaacacacgauggccacuccccccccaacccccccagcauccuuacuuaaggcccagggccuguuucaucuuuguccauguaguaaccuggcaaauaggaaaaaggacuuacguacuuuguuuugguuuuuaauuuuuaaaggaguagguuuuaucucuucauuguuuugcuuugcuuuuugagacagggucucaaguauagagcccaagcuggcccugaauuugaauaaaucaggcuuuggccuccugacagcugggauuauaguuaugccccgccacucccagguaaggaggcugguuugaaaaguuaacuaauauugaccaucuacaccaaaaguaaucuaugcauccuuugaagccaggcaccuauagaggaaugaucagagaugccgcauugcugguauuaaagacaggacaggaaccaagggcaaaccaagcaaacagccuaggagcugggaacagaagcgaggaaacgaggcucagcuagaaagucaugcugcugucauccucuaccgugguaagaacuguguuagacuuccuaaccacagaaccaaagaaugacugcaaggcuuuaaaugcuaaguggaugugaacaaagcagcaauggaaaauucaaacacacugaaccaaagguuagucacauggccucaagccugcacugagcacuuacuagucacaaaggggagaagggcuucgucuacaaaggaagaucuggaagcugaaaauguaccucugugguguaaggcuuguauagcauucaggaagcccuguguccaaaucuccagggaaaguaucagcuccagauauccuacaggacaacucuucaaaacuggcaaugucuccagaaauagcaaaaagguuguucucugcuaagagucauuaugaccaaaugccacuugugaacuuugcugaguccuaaaucaaguuauaaauaacauuaagacucguuugagaaaauacaacucuugguaaacccucuggcuucacuuuugaaguguuuacgugagugauggugcugaucuauacaggaggucguuuucuuuuucuuuuuuuuuuaaagauuuauuuauuuaauauauauaaguacacuguagcugucuucagacacuccagaagagggagucagaucuuguuacagaugguugugagccaccaugugguugcugggauuugaacucaggaccucuggaagagcagucggugcucuuaaccacugagccaucucuccagcccaggaggucguuuucauuccucgcuaaauauuuaagaauguaacauaaugaugucugccauuuauauuccaauaauucauccaaacuuaucuucuguuugacuucuuuguuauuguuuugucuuaaaacagagucuuucucuauaaaacucugcaguccugaacucaugucuguaaaucaggcuggccuugaaggcagauccacccuccucugccucccaaguaccagaaauuaaggguuugagcuaccaaacuaagcucaaaaauuauacauauacacauucauuuauucauuuucucuuucuuucuagaagagaaagaaaagguauaguacuaacaguuguugaaagaauguggcauguaucauucagacaguacaacuuuuuaaauuacaaagguaaggaagaaggcgugcccuggaucccuccacuacccaccuuucuucccaggucccuuacauacugcccagggugcaaugaacagcugguguucuucagcuggccuccacacuuccacaagcacauacuauuugcugcggguuuacucacaauucaagcucaauagcuaaaaucugauuuuguuauaagagagaaacacaugacuaaaauuccagaaaaacaggucaaccaugaggacagagucaucuuugacgaccuuauuacagggauuaguuugugccuucuucucuucugccauuucucuuguuccauauaaucuuuacauucuuauuuugagcuucauccuuucuauuuaugccuggagagagagucacaagcacggcaggaaacuggacaaaaaacaggacugguggcaucaggagcuacuacagaaaccacaccgccuuuggcucccagcccuaguacugggaagaucacaggcagccuggacccaggcucuccuccuucucccugcacuccauauggcagcugucugacaucaaagaaggugggagagauucucuacauucuccagacuguucccacuccuucccuugaauuguggaagaauccaugaugucucaaucagcccuuccgcaaucccuccuuuccugaaugcuaagaaugcuuaaccccaagugaagggcugcagagcagaggagcagcagcaaggaggacuaacagcaggccuccccgaggagggagaacaccagcuaaaugucacaugccuuccagaauagcaccaaggaauaaaaacugaacuuguaaaugaaauuagguugcucuuuugaacugccagucuagcuagacaggaaaaggcccagcaugguuucuaugagugccuaugcuguucuuaauagggaggacacaaucaagccaaagcaaacaucuguuaaccagucaagucuguuaaugaaacaauacugcagcugguuuaucaaagaucaaaaguggagcaaauuaggaaagggauguuugaacaaagaugguuucugaagaauagcagcucaagaauuuuaaacccacuugucaaauuaacacaguucccuccuggauccccucggagcacugaucaggguuugcccugaccucuguagagaccagcuucgguuuaauccaacguuguuucaucuaauacuucuuucugucucauuccacacucucaaaaacauaaccuuucauaaacaaaauacaauguacgcugugcacuacaucacagccuacuaauuacgauguuuacuuuuauaaagaucaacaacaauaggcaguuucccaguccuggcaacuucgcagcaaaguguuuccuacccacgcagaagcaucagugcacggcaaggccaccccuuccucugaggcacauggaccaacuuccugccacugccuggaagcagcaagagcacccacaugcaaacacgcacgcacuuuccucccggucuugcagacagagugccaucagcagauuacauggcuggcucauuugcuaacucuuaucugguaagcuaauugcuguuuaugugaaauauuaauggauaggagagaugaaaggcccgagaagauuucagauuccuauuuuaaaucuuggugugacuggaaaacaauuuuaccaaaucuacucuaguuuaauguucaagacuuaaaaaaugaagcauagaaacacaacaaaaucauggauuuuuacaagcaaaauugucaucucaaugauaaaaacaauuauaucucccauguguuagugauaacauacaaagauaaaauagauuuaaaaaaaaaacacaacaacucagacuuccauuuugagaacauuuaaaguguaucaucugcugaagucuggaggaaaaaaauaaaaauaaaaucuuugccauucaagauaaaaucagaauaaaucagcaaacaacacauaacuguuaaaauaaccucaaagcuaaaaauacugacuuucuugguacuaaaaguaucacagcguaggaacaaggcuccguaggaguuuuugccuaaugagcauaaggucuucuauucuauucccagcaacacacacgcgcgcaguuauaaagucauguagguacagagaguacaaguaucaauuccucaaaguuggugcuccucaggacaggauuaguguugugggaaaggcaucaaaaacaucaagcacaccuaagaucuaaagaguuacaggaauguccaccacgcccucuacaaucaaaccuuccgacacgacgcuguugcucuccagaagcuacuucaagaagccuagacaaguucuaucuugauaacaguucaaaaguagaacaagcugccaugcuucaagugcaauagaaagacccagucacucacuucaucuuccgcuugaccuggcugccuagcuggagaaguccaagagcuccgcggugacuggaccgguacugcccaacggcaaaggcugcccuggcgcacugcacccuucuaaagaacuucucgagcuuaauuacaggaacaacaggauccacaagcuugcuucccugaccuuggaacugugagcauugauccaccugaucuuuuacacuguaauagguuucaccauucuaaaaccgacuuuuuauccaugucaaugccaaaauucagagaauuuugaaaagcauauuucauaauauuuaaggcuguauauucaacuuccaguuggauacauauagcuaaauauucuuugagaacaacgagucuuugauacaaagcacaugaacugaagucaacauaaaaagacacugacugggacucuaauugagacccuucacaaaguaccaacuaaaaaauucccagaggcaagaugagggauaagggguuagagaaaagaaagcagcaaaaacaauguaaaauguaaaaucuguggucuggugacugaaucugacauaggaugggacugugucucuuuucuuuucucuuucuuucuuucuuucuuucuuucuuucuuucuuucuuucuuucuuucuuucuuuuuuugagacaaguuuucucuguguagcccuggcuguccuggaacucacucuguagaccaggcuggccucaaauucagaaauccaccugccucugccuucccagugcugggauuaaaggcguggccaccaugcccggugggacugucucucugcacaggaauccuucacaaggucacaccgcccugcccacagugcccaaacacauuucggggggggggggggggggggcaugacagugucacaugaucuuagcacuugggaggcugaggcagaagaauuaggccagccugggcuacauaauauaucuggaguuccccuacuuuacagugcacuggaaauacacaaagauuugaccuucaauaaauuuuaggaugauacucucaacaaagugaaauacuaaggaaucugcuuaaaauugaacuaaacugacuuuauaaaaaugcuaaagcccagaugugcaaauggaaucuuacugcuacaaagugugauaacugaagucucucagaauauuugacuuuccaaaguccucauaaucugaccuaauugagcuuuaccacuuuuaaugagaaacauuaauacuauccuuuaggaguucccgugcccagucaaagauaaaguuuuaucuucagugguuuaauucauuuuccuaucaucucagcagagaaagguuucuuaaauaaauaucaagacuuucaugcuaagaagggagaauagugaucccugauuagaauuccagagucucagaagagcugacguacaugccaggaagccgaggccuccuauguuagcuuccacugugccccuccugcacaggagugaggaugcuguuaaaucuaaugaggcacagacuucccugcugcauuuccaguuugaugauauuauaaaccgcacuugcuuggggaaaaaaaaaaaaaguaagaagcccaucccaacuaccagauuucaaaugcuggcagucuauuugcuggaggaaaacuguuucugaccuacugaagaacugcaagagagaccuccaccauucaugaauagccccggggcugacuaagauaccgcccagaacaaaugagcccuggacucaggacuaucuggguggacucucagccugacuguucaccaguucuacugaccuugaacaaaaagcguccgcuuugcucugcaguuuuuccaucugcaaaaaguagggcaccgaucuaccucucuuccaguaacuaugagucaggagcuaagugcgaacuacuuggaagacaccagcauuuacgcuuacaauacauuagcugcuauuuuuauuuucucuuuuacaaugacauucaacuucucaaagguaaucacaauaacagcuucuuuaaaagacuauuuuaucaaacuauaguuaagacugcaccauccuggaacagucuccauucacauccuaaauucugccaagcacgcagacauaccugaaauuccagcucuauugaggcuaagguaaaaggaccaaaauucaaagccagccugggaaacuaagugaaaccuugucccaauauuuuuuuuuuuuuaaaugaaaucggggauggagcgauggugcaguggguauaguacucaccucacaagcacgagaaucugaguucagauccccagcacucaagaaaacaaggcuggcuacagugggugcccgucuggaauccuaucucugagaagguggguauauuacuuggcagcccauauagccagugacaaauccuaucucaaaaauuacaguggagagcaauagaggaagacauccaacauuuaaaaagaaagccagggaugguggugcacaccuuuaaugccagcacucaggaggcagaagcaggaagauuucuguaaguugaggccagcaugaucugcauaaagcauucagggccagccaucacuacuguagagugagauccugucucaaaaagggggagggggcucucugcuaacuacagaguuccaagacagucugcgcuacacacauaaugagauuuuaucuaaaaaauaacauguuuguauguaugugugcaugcauauuaauauuagguugaggcuagauugcucacuaauaaaauaccaucaaaaucuuauuaugauuacuugauacaauuaauccccaaauuuuaucaacuaaauauucuggagcauguuuucucaauuuuccuuguuaaauaacgaugcuaacuggacagcuaaaagaucuacauccuagaaaaagcaacugcaauugcaugcuaagcaauaaaugucucaguucucucuccuagacucuuucaaacaugaauuuugccuuuagacuaaaaauaguucuguacagaugcugccugaagagaaaagauaaggcuagcaagaaaugaugagcaagguugcagagaaggaggggagcuuuggagaaccuguccugcccgcuccagacccagaaaaugccucccuccagagucuacaauuauucauaaagacacaaaacuggccacagugccugaauggagaccaugucccugauaauuaugcaacuuugccauggccgaggauaaaaaauaaagauaaucaagcuuaugaaggaauggcucuggauucccuuaaagaauuccaccucagcacucagaagcaaaagcaggagagucuguguuugaggccagccugggcuaaauucagagcuccagaacagccagguaucucuaaagaauucaguaaagauuuaaacuguuuuuaauuuuaaaaaaaagauucaaggagaaacagguaucuaaauggcuguguucaggaauucaaauaagucauuuucuguaauuuuuuaaaaguauagaauaguuuaucuagggcauggggacgggaguuaagaggguagcagaggcagagaaaggcagagagaaggagagagggggaggggaauggggagcaaggggggggggcaagaguaagagagaggcaagagcuaagagccugucguuuuuuaaaggacaguuaugaagaaaauuucauaguuuacuucauuuuugauacauccacaaucaaugaauaaauaaauguugugggagaccaagaagguaugaacacagcuaagaaauccauucuagacuucagauaccugugugaagggucuuccuuaguucagagguaggccccuacuagguaagcaaaaaagggaaacggcccauuucaugaguucuuuguaccagaagaacagaagcaaaccaguuuugcuaauacuugggucucauaggagcugagacaaaaugaaggccucgucaugggaacaggcagacacccuucccacagagccugacaccuggcuuucaauacuucucagcaagcagcuuacaggcacagucgcuuccuauucacgaugcucaaugucauccuaucgaugagugcacuugaccaaaaguugggaaaggaauacaaaaccuggaggaccugacuugcaaucugcuguucuacuucagcaugacuuugggaaauuaauucaguaaguuuaaaauaaaacaaagaaaaucacacccaacugaagacuuaaaaaucucagcagaaacaaaacucugucacacacuuacaaugcuauaaaacuaacauaaagccuugggccaucaaucaacacagcucagugguaaaguugcugccuaucaaccugaguuugaucuccaggaccuaccgaguggaaggaaagaacaccugcaacuguccccagaccuccucaugugcacuagggcucgcagguaugugugcacacaaacacaaaaauagacaaauacaccaaacacacacugaccacugacaauaaauggcuuuaaacagaagggauuuaggucacacauuaugcaaagauucucaguauuaaaauaaguauggagguuuuucucucuacaauuaagggaagaaaaacucccacacuuuccuuucuugggcuugaagaagguagauucaaguuuaccugguaguuacaacauaaagcaagucaggugaguauuauguuaacuauuagccacugaagaaacccucaaugugucauaaaaugauguuuaaacaaucaugcuaugaaacauccuaauauaaauuauaaaaaccagcuucaaggcacaaacaacugaucuuuucaaacuccauucagaucuuccguccacaucgguaguucucagccuccuaaugcugggaccguuuaauacagccaacuauaaaauuauucuuuauauacuauaauuuugcuacuguuaugaauuguaauguaacuauuuggggagauagauguuugccgaaaggguugggacccacaggcugagcacgccuaaguggaagcgaaagguaaaacaguaauaucuccagggcgucgauaccgccgggcucacucaccuggucuuucucaugggguagaaggcugacgggcgggagugaggacggaaaagcacugggguacuggggcgccccuuugccaucugagcucccacuauugacccuguacugugguccuuccuucaguaaccucccauuguucacagcacgcuuggccccuagccgcaaccucugcugaaaggcuggaugguugguggugccuguaagaucacucuggcuucucagauacuucucaauguucuucaaggaggagccguuuggcuccucaaggccuucgauugcucucuuuaaaaguuuauuccaauccacauugcguagaucauuacacggcgguccuuuggaccccuugguuggcuuggggaaagugcccgguuuaaccgaugaaaaacgcccaggauugucuggguccuuauaugaagcaaggccuuuguuggugacuuugagaacggagccauccugaacacuaaguuccagcuguuccgagacuguuuucuuguccaacccaugggacgugcugaccgcauggcagauccucucuucugagggccgcugcuucugcuucuugauuuucugcacugcuucaagaauccacucuguguaaaguggguuugcaaguuuuaccaugguugacaaauggcuucuccaacacagacguuacccauagagauucgccuuguacuuaacacaaccugcacauuccaaagucacaauucaacacaagggcagaggaucccagcccaugugaagcaacagcauagggacaaccauccuuaaagagaggacugacugccaggcaacguggagaguugucuuaguucaccaaugggaaggacugcacucuucaagugaaagacaucuuuaggaaaccaagaccuuaaaggauaaaaagagagagagagagaaaagacucuuaauaaugaaacuuguaaaaauaaagauuucucagcauuauucuuuaucagguacaaaacuaacacacugaaaggcagguacugugcaauccagccacaggacaacucugugcaaccaggcacuaggugcacucugugcacgacuuuguuuuuaggauuuuauuuacacauaauaacuuaagagaccacaucugucaaacaggcuugagaugacucagugguaaaggcaccugcuccaccugaguucaaccccuagaacccacacagugaaaggaaagaccucuccccccaaacucgucugcccucuaugcacacacugugggauaugcugccccaaaccucucaaaguacaaaacaaguuaaaacauggaaaaucugaguccuguuaucaaaauuauaaucaugugaaagcagucuaagguacaugucuaccagagauauaaaauaaauauaaaaaaggaacaauagugcacgccuuuaauuccagcacccagaaggcugagacaggaacaucuuuguuugaagaagaccguggucuacaagggagucuaaagccaguggagagcuacacagugaaacuguauccaaacaaaaagaacuuaagacaagacacaguaaagcugagcugagcuaggucacagagggaaauuuccaaccucgccaucuguaugggaucagggcacucuggugcucugcucugcguagcaucuguguauggcacaggcuggcaaacugaaaugaauacaaguaaauaccccuucaccuuuuaauaacgcaguauucuacuuaucuuaacaccuguuccagcucaucccacagcucaacagaaagacaaucccuacaaaccugacuccagcuggccagggcagcagugcgcucagacuucugcucuccaaucugguacugauacaauaccggcccaggaacugggccagaccuacugcucuccaguaaugucuccaucucagcccacucuauccagaugacagcguguucauacauagcaccauuuugcuagguguaauauaauagcauaagcaugggaucuuagcauuuaagagguugcaggaagacugagaguuugaggccagucucagcuacauaaaacugucuuuuuauccaaauaaacaaccaccacccaaaaacaucauguaaucgccagcauaacuauaaauguaaguggcuugagaggauguagcaaugaacagcucaagggacaucauuuuggaaucugagcccaauccaguucucaccugugccuuagccgccugcuucagcuaguucugccucugcagagacacugauaaggcucugguccccagcccuauuacuaccucguggagaaguacaagaccuaagcuugagucgcuuucccuacaggcagcauacagacaguauuccuacuuaccaauggggaaaguuccaagaccaccagcagaggccuagaucagagauacuguaccugauacauauuguacuaccuugcuuuaguuuuuucuuguacacacacaauaacgauacuuuaauuuacaaaucagguacaacagaaaugaacaacaauaaaauaaaaaaugcuaacaauauaccauaauaaagguaauuuaaaaauuacaaagaaaaaaauauuguucacuucccaaguuuuguggggucagcugaugguaacuaaaagcauaguuaagaauggcacuuacuauuuaaaacacaguuccaacuauuaucauagaugucuacuaaguucagugucuacagaucuugaagggggucucacaaaacacaaaaccaaagucuuaugguugcuaauuuagggauuuacccaaagauagaaauuucaaauucugccaggcgugguggcgcacaccuuuacucccagcacucaggaggcagaggcaggcggauuucugaguucgaggccagucuggucuacagagugaguuccaggacagccagggcuacauagaaaaacccuguaaaaaacaaacaaacaaaaaaaacaaacaaaaaagaaaagaaauuucaaauucuuuagauagacacuaaagaacaacauuaguacucagagcccggagcuccugcaagaguggcccacgcagcuccugagcacggccugaaagggccuucucagcacaucaccagucagcucgccacguuucccugagauucagaaaugggaagcugaugagacuuagcagucauccaguccacuucucagcugcccaguacaagaucuuuggccaaucucccuaacagcccaccaaaucuuuggaggcagcucaaugcaccacugaaaggaagcuggagacauaauuaauuugcucacagaagcaagccuccaccuuccuaugauucugacacacaaguugaguuccccaggaauaaucccaagauuucuucaauaugacaggcccucaaauacuugaaaauaauuaucuuuuaaaaaccacuaucaaucucccccaccucuaccccucccuaaauaaacacugcuauccuagcuccuucaaccuuuuacauccuagaucucuaaccacagccaucugucugcugcacauuacugcuaacauccacuuuaaccacacacccccaggaguuacucaggucaaaguguaacucaaagucacaggaaccccacacacacagacagacacacacacacacacacacacacacacacauagccaugcugaccaugcugagcacaugcccagaucuuucuccaaaaauguuguccaacuaaaccuuuccagcccuuccuuaaaaaauuaaaaugcuggauuuuuguuguuauucuuguggcuuauuuccuuuugcuguuuguuuuuuaacacaaggucuugcuagccugguacucauuacauagcucaugcuaaccuugaacucagggcaaaccuucuggcucagcuucccaaaugcugaguucacaggcaaguaccaccacccuuggcuuuuuaaaucgugguauucaaagcugauuuggacuaucuucuaaccugccaaagacugucugaaucuugacugucaucugcagaucuauuaaguucuccaucuugugccaugacauaaaucacugacagaccuuagagcuggagcaccgugcuugggauaaaacugcugaagcaucucccccugucagagcgugcacaacagcaaacguaucuuuucaaagugaaaucacuuacagcaaaauuucauuaggagcuauuucauuggagccaaguauuaucucauccuucaucauuuauucaggaggacccacaacuaccuugaucugacuguacaaagcauaccugagggaagcaggugagaagaugucacaacaaagugcccauaauaaauaccaaguugcuuuuaggcaucuuagauacauaagcaaaagagcaucaggaagaaaacuguguaagucugugauugcauaaagacggcccagaggccacacucaucuccaagucucucuagcucugguagauaugagcuaugcaauugagcacaaucucuaaauuuaaaacuagguuugugacagccucuuaaaaagaauccccucacagggugugguggcgcacaccuuuaaucccagcacucaggaggcagaggcaggcggauuucugaguucgaggccagccuggucuacaaagugaguuccaggacagccagggcuacacagagaaacccugucucggaaaaaaaaaaaaaaaaaagaauuccucucaugaaaacaccaccaacugacuaguccugaacacuaacuuucccaggcagcaaucacuauuuguucccaaauccgucuagcauugauugacauacugguaaggaagagaaaggcacaauaucaacacaagccucaauuuagggcacggugaucauuuucacuucaaagaccaaaaaaaaaaaaaaaaaaaaaaaagaaagaagucauaaauacccguaucuuaaauccuucuucuccacccgccaccagcccccagcacaagccccucuccucaauuuaaucucaaaaugagaucccauccaacaaaccauccaacaagaguuaauuaggcagaagccgauguaauuucagcagcucucugcuacaagcugaaucgaauguuuaaaaaacauauacaguuaggaaaggagggaaaucagaagucucuuaccuguaagccaauccucggauaaauacaugcacaguaucuacuuuguacauuauccacugcaauuuuguuuuuaaucuggggcugauuugucugacaccccacggucccaccuuaaauugguacaagcuaagagaauacacugaaaagcaguuucauuucaguccaagcaguaucuagacagacagaucuacagggggaaaaaugcauaauucauucgaaagucacauaaaaaugauuuucccccugacucaaaauuaccugccccccaccacuucucuuuugcagaguccacuugcuguguuuguggacagggccacuagucacgacuaaaacucaaaucauuauucucuugccuuuuuuucccuuuuaaaaacuuaacagcuagccgggugugguggcacacuccuuuaaucccagcacuugggaggcagaggcaggcggauuucugaguuugaggccagccuggucuacagagugaguuccaggacagccagggguauucagagaaacccugucucagaaaaaccaaaaaaaaaacaaaaaaaacaaaaaaccuuaacaguuaaaggcuaccaaaaggaguaagucaacccaaauuaauucagaagauucaugcugcaucaaaugaucccuuucuauugccuaugguugugaaacguuuuaacuuuggcuaaaaaaacaugggcaaauuacauuguuguaccuugcagccuuagaaccccauuugcagcacucguuacaagcuauucuacacauccaggaaaacgcuugguccaacgcugagcuuuaagccucacuggcauuacauaaauaucaacacuccagaaauauucagggcagcauaaggagaaucgaaauaucccacucagaagaggccuccuuacgcuugcaggaaagccugugucaucucaaaauuagugucacaacauuggagccaugagauuacagaugugccaaaaacacugguagaaaaacaaaagguuaauaauagaguauauuaucuuaccauccuagguuuggcuugcuauuuucagcucucuuacuuuuauaagcuccaggacuuuuguuuucaaagaugguuguauaaacugagugggcaucaacaaaugcuaacaagaucuuccacaauacagcauacacugacaauaucuuccacaauacagcacacacuggaagaaaccaugacuucuuuccuccauuacugcccaccacacccaaauggcacaauggcuuaaaauagcauccuugguucacaaccaucuacugucugacaucaaauaucacuuacuuggugaugcuugguaccauacaagcccuaaauccaucuacuucccugaaaaacaugcuugcacccaauauguguaaacugggaguugagguucugaauacuagucaaagaaaaugaauacucaguggcacuaagucccugcccuacacacggucuuauggcacauggcaugggaaaggcaaagcagagccagagccagagccaggacacgcaggaaucaacuaagaagugacaaaggacugcuuggugagauuaccaugaucccacaggccuauuucacaccauacacuugaaaacacugagcauagcuucuccaacagauacagacaaaacauggucacaacagcaguguucacaauacucaaagguacaaacagcccaaauauccacuuacaguagaacagauaaaaugugguaaaacagcugggcgugguggcgcacgccuguaaucccagcacuugggaggcagaggcagggggauuucugaguucgaggccagccuggucuacagagugacuuccaggacagccagggauacacagagaaacccugucucgagaaaacaaaaaacaaaaaaagugauaaaauagaucagacacacacacacacacacacacacagagagagagagagagagagagagggagagagagagagagagagagaggaugagaauaaaggacuaauauauacuauuacaguauggaugaacacugaaacauauuauacuguaaaagaaacuagacacaaaggucagauauccuauaacugcauuucuauaaaacauccauauauaacuuauaaacaaagcaugcauugcuaggaccucaguguggagagaaacuguuuuauaaguaugagacuuuauuugaaaacaaugagaggugagaaagaggugaggucaaacaacaaugugaauguacugaaaugcaacugaguuaaccacuuuaaaauaauucaucagcaggguagugguucacacccaaaagccuaacauuuggucaagaguucaagaccagccuggacuauacagugcauuucaggguagccugagcuacacagaucuuaccucaaaaacaauaugaauuacauggauuuuaaauccguaaauuauuaaacaauauuuuuagaaacuaaaacaaagccaggcauagugacacacaccuuuaauuucaguacuccaaguuugaggccaacguggucuacacacugaguuccagggcagcuagagcuauauaaugggacccugucacuaaauacaacaaagcacaacaccacagccaaagaaacuaaaaagaacuagggacuagagaauguagcaucguugguagagcauuugcuuggcaugcacaaagccccaaguuaaauccccaaacacugcauaaagccaagcuugcuaacacaaaccuguaauccuagcacucaagagacagaagagccaaaaguucaaggucauccuuggauacacaggaaguuuaaagucaaccucgguuacaugagaucuugccucagaucaaacaaaccaggcaugauggcacaugccuuaauaauuucaguggcgugaagacuccagcaacccuggaguccccacaaaggcuucuucaagcaauauguuccucugauuagagaccagucugcagcaacugagccuugcugaaacccaggguaggacacccauugugcaggguacuucauuugaaccugggaaaacaguguugaucuucugacauccccuauaaucacaccuagaucccaggcagccagaaagauugaaaguuccaagccaguaugggcuacauagcaagagucugucuugaaagaaaaauaaguaaguagaaaccuagauagcugccaagucaaauuuuccaugggucagugcagccaacacccacccaucugacaaaugcuacacaccucugcuuagcuggacaugucuagcuuucuuacugcuuuccaaccauuuugaaauucauguccuuuuuauauuuugcucauuuggaacugaccaauuauauaauucuuaggaacugucuuaauuacuuuuuaauuguugugacuaaaacaccaugaccuaagcaauuuauaaaagaaggcauuuauguuggguauuguggcacacaccuuuaaucacugcacaugggagacagagcagacagaucucuguaaguuugaggccagccucaacaaauaguuacaggauagccagaaauacacacugagaaccuaucucggaaugaaugaaugaaaaaaagcuggguggcagaaaaguacgccuuuaaucccaacacucaagaggcagaggcaggcaaauuucuaauuaugaggcuagccuggucuacagaauaaguaccaggacaaccagugcuacacagagaaacccugucucaaaacccacuccuauaaccccaccccguaaaaaaaggaaagaaagaaaauaggaacaaaaaaaaaaaaaaaaagaaagaaagaaagcauuuaauguggggcucgugguucaucguguuaaggaguauggcacuggagcaguagcugagcgcuuacauccuuaccagcaagcaggaggcagagagaaaugccugguaaugagguggguuucagaaacugaaagacugcccccagugacacaccuccuccaacaagaccaugccuccuaguccuucccaacugguuccaccaaccauaccgcucauucaaacacaggagccuaugggggccauucuuacaaccacaggaccagaucucacauuugauucauuucuaugugcuccacuuucuggggcuacaacuggaucaaaagagggaaacaaugccuguuuggggguuucuuuauuugguuuggguugggguuuuuuuuuuuguuuuuuguuuguuuguuuguuuguuuuuuacaguauccgacacuaaagucuagaguguagaggaacucacuauauaggcuggucuugaacucaugguguaguggcugacaccuauaagcauucagugggcuaagacaagaggagcaucucaacuucaacucaagccuagacuacacaaggaacugggaggcagagacaggaagaucucagguugaguccuguugaguuacacagcaaagacaacacaaaucaaaggguggaggggggaugagagugagaaaaagagaaagaagaugagaagaggaaaagcugugacuaacuaugggaguggcauguaaaugugacauaucaaauaaguaagucaagaacacaugacaccaaaagcaaaguacacauauacagugcuggcgugcacucacacacucacacacaaucauguuaaauauuugaagcauuuuggcaacaucuagucacuacaauggaggagcaacaaaggaaccagagcaagcaguauuucauccuuccaaacaucaaucuaguuuagauuaaauuuaugaggguaacgcagucgaugcaugcuagcuggacugaaugucuaauuuccagucuuuuuagaggaauacuaaauucuuucccacuacucauuaacauagaguuuucaauucauaagcuaauaauguuuucuaaggguuucuaagaggcuaaaucaccaugaaaaugaucauuucaacuaauacauauuauaugaauuguaaguuuaaguuuucaugucaugcucuccuaguugacaauacccuuguuaugucauuaaacuauaauuguguaaaucugcuucaacaaacaauaacugaaccaucaauaaacuauuacggcuuccauaaucccuagcaaagauuaguuucaacaucaucaucauaaauuaguagggacaggucccaagccuccugguugaagccaugaauuagguuugcacagucauuccugcaucugagugcucaauaguuuccgucucuaaaguuuaaucacacuguuagaaacaucacaggaaaucugaucccuuguaauagggaggaugugacgaaacaugaagaagucagcucgggucggugggccuuugaagccagcacugauuaguaauuacaaccacuaagcauuuccacuuaaaaaauaaucaacuacauuuagaguguuucuagcauuaacauuuuucuauucaaaccuaaguuucucucuaauugcaaguuagcuuuauuuggcuuuuguuuugggguuuuugggggguuuuuguuuuuguuuuuuuucaagacaggguuucuccguauagcccuggcuguccuggaacucacucuguagaccaggcuggccucgaacucagaaaucggccugucucugccucccacguguugagauuaaaggcgugcaccaccaccgcccagccuuauuugguuuuuaaugacagagaacgauguauuaagaaauaauuugcugggcguuuugcaagccuguaaucccagcauuugagaaguggaaggcacaagcaucacuucaaggccaaguuacaugacagccugucucuaaaaauuaagccaucugaauuuuaaagaugauucugaaggcugagaucagauagagcacuugucccaugccccagaguccacacaaaaagcaugugggcauagcggcccauagccuuaucaagugagcucucuuuguucaguuaagagacccuaccucaauauauaagguagagagugaugcaggagaccaccacaccgucaacaccaagccucccgcaaugauaaacacaugugcacacacacacaugcacacacucuccaagagaaagagguucuucuuaucagccaggcaguggugauguacuugggaggcagaggcagguggaucucugaaauucauggccagccugaucuacagagugauuuucaggacagccaggacuacaaugaaacccugucucgaaaacaaacaaacagggcuggagagauggcucagcagguaagagcacccgacugcucuuccaaagguccugaguucaaaucccagcaaccacaugguggcucacaaccauccacaacaagaucugacgcccucuucuggugugucugaagacagcuacaguguacucacacauaaucaauaaguaaaucuuuaaaaaacaaacaaacaagucuccuuuugaaaaggaacacaugucacggugguacagaaacaacugaaccaugccuggcccuccugccucaggcucucaagcuggaaucagugugccagccucuaacucauccuuaagccacaugaagcuggaaucagugugccagccucuaacucauccuuaagccacaugaagccugcuggucuacugacauaaagaugcacucuauccacgcucacaauauacagcucuauguaccuuagcuagacagguuacaauaagaauacagaaguuaggggacaggcaugauggucacuccuguaagcugguuaggaaugaggguguaacucuguaaucaaauauuuaccuggcauguaaaagaaaggcccugagacacucaccaccaccaaaaacaaaauuaaaaguacauaaaaagguaaagaaggaagucucucugguuauaaaguuuuuaaaauaggcuucagaaaucuuauucaacaaguugggcauagugucuuuaacucucagcacgugggagcagaagcagguggaucugugaacucaaaaccagccuggucuacagagugagcuccaggacagccagggcuacacagagaaacccugucucaaaacaaaacaaaaaaguuuuuuuaaaaagaaaguuuauaggaaguuggguccgguuuccacuuugcuaccuaccuaaacugugggacacugggcauauuaguaaaucaauuuaagucucaaguucucguguguaaaaaugagaauacaagcuuguuuuacagaacuauuaagaggaaugacugagauaagagagagagaugaaggaagcaaggacaguggcaggcgcacaauaaaaugcuagcucguaaaagugagaggguaauagagucagcuggaggccuguaaagucuaaucuggcugagcuuccgucuacaugaccacuucuccucagagacuagggaagcagcaccuggccuuagcuguagcuuuagacaaguauaaauucaagacagagaacagaaaaaaaccugaagguuugcaguggcaaggcugggggcuggggggggaggugggggagggggcaggaagagugugggguacucaguuacacaacuuacaaagucaggaaagcuuucaggagauaauacuccauacucaacuuuuugaccacaggguagggaaauagucuuuaaaauaaaacacacaaaaggcacugcccauaaagaaaagaccaauaaaucagacuccauuaaaauuaagaacuucaguucacugaaagacaucauaaagagaaugaaaaggaaagccggaggguagaaaauguauuuguaacauacacacaggacagagagcuuguagucacaguagcuuccaggucaacaugguggcaaagcauuaaagguacuugccaucaaaccugcuaaacuugaguuccaucccagggaccuauacuguggagggaaaaguuguccucugacuuucacccaagucuuggugcaugagcccacacacaugcauacacacacacacacacacacacacacacacacgguguaaacaaaugguuaaagaacagcauuuuuaaaaaaagaacuucuagccggacgugguggcgcacgccuuuaaucccagcgcuugggaagcagaggcaguuggauuucugaguucgaggccagccugaucuacaaaauaaguuccaggacagccagggcuacacagagaaacccugucucgaaaacaaacaaacaaacaaacuucuaaguaguaauaaaagacucaguuccaaaugaaaagaugggacagagggggaacuuuaccaucgagaaaagcugaaugacaaauacaugaagagcuucucaaccugcuuacuacucaaaauuuagacaggcuaaaauuuuaaguuaacaagucugagaguuggaaaggaaagagaagcaauaggagcgaguguucuugggaaaguuuaaccagugagcaguacgacaaauacacacucuagugcucuagcaaggguaaccacacagcucuucauucaaagccaaaaagguugauuaugcugagacaacagauauagagcagagcaugaggcggcccugccuauaaaccaacaaugcaacucuacguucaagaaauguguacacaugugcaucacgauauguauguugagaugcuucaagcaaaccaaaaacaacuaaaauacucagcaacaacagaagagaccaugaaaauuaugucccucugcccuaaaucuucuaucgaaaguuuacuauucuuacuacaacccaccuuccuacgucuccccaaaccaacugacuuuucuagauacaaauguagcuauugcucuguauguggaaaucaaaggccaauuacucacaaaacuagcuuagaaacuacaagccagacacuugguuaaaacuuuucuaacagggaaaugaaaugucuaagaaaggugcagugacagggcucacauaaguaaaugcacuuagugauaaaucugaguuugauaccuuggaacccacguggugaagaaaucagaacuccaaaguugcaccagugcacaugugugugggcauucauacaagcacacacaugaacauauacacacacgagcauaugcacgcacacacacucaauaacuguuaaaaaagaaaaaaguaauguuauaaucauuuguuagagcccagcggugguggcacacaccuuuaaucccagcauugaggaggaagaggcaaucaaucucugugaguuggucagacuguucaggacuguaaagcuacugagaaagaagcccugucuauaaauaaauagauaaauaagugucauaucugcuucacccauccuguuuacuuucuauucacaggucuuaccucugauagcguccaccuguuuccacaaguaguucauuaguccuuaacacaacacaaucaucagcauccacccagaggcccagguacagccgaaaggucaaaguucagcugacccugucaccuaaauucuuccuuuaaguuaaaacuuuccuuccucaguuuuucuucgcuuacuuaaacacaggguuuuaacuacuaccuaggcugaccucaaaagccaaagaugaccaaggauuacaggcuccuuacccauuacuccuuaaaaacaacagcucacauucacucugcuacauguauaauaaauuucuaauaagcaagcagucaaguguauuuuagaguugcaucaggaaaugaaggguauacuaguaugaggaagaauguacuuucuacaaacacccacuucgcuggggcuggagagauagagggcuuggcgggcacagcauggaaagcaggagguccugcguuuggaucuccagcacccaggugaacgcugagcgugguuuagacugccuggagucccagcaagagcaggugaagacaggcagccuccaggagcucgacagcagaccggccagccuagcaaaaauggccaacuaccacuucguaagagacuuuaugucaaggcaauauggcagggagagauagaggaagacauucuaugucgugcccuggccucuggaugugcacacuuguaugcaucaaaugcacaaaauguguuugcauacaucugcauguaugugugugcacaagcacacacuacuggaguacaaagaacuaacacaacuaaagucccaugcgcuacuucuaccucuugcccauacaaaucugugcauacucuuucccuugaauuuccugguaucuccaccccaaguucacugggucucuagcuauugcugacaacuguaauuccuuaucacugcuccuucauaacuuccacuacucucacaugaacauucuuucucccaacugcaauuguucaaacuccuccauggugcaggucacuaauuugcccuucuucugccuuuacccugccaggucccauuacucccugcacugugcccaaaccaaaguccuaccaaacucaaaaauaccaaauguucuugcccaagguagcaagcauccaugucucuuccuagggacacucuaugcucucccuguuccugccacaccuucaagacuaggcuugaaguuuacuccaaacaaccccagccaucaaaauuaaagucuccauaaccuuucuuggcucaaugaagacugggggcacaguccaucaaauuauagcacccagaccuauugcucagugcugcccucguucacagccacagccuuccccuaacuuugaaucaccuguccugaugagauguucuaauauacugcugcaaauuacaagcagccucucuccauucccugcucauuaaagucucuucugcuaccuuagaaaaucucccaaacuuaacuaauccauccuuccuucuguuuucuuaauguuucauuuaccaugggccagcaaaccacuauccuaugccaacaugaggauucagccugauucuuccaccaaagaaacuguacccgccucaugaacccauccccaagacgaaccaacaccaacucagcaauacucucucauuuaccacacccaaauucauccuuaguguguccccaguuaacggcaaucucgccagucugcagcacuucaccagcccucacacaguccuagguacccuucccacuuccaccaaaauuucgccccucccuacacccccuucuacaccuguuucuacaccucccguuucccaucucaucucccguucuuuuaaucuugcccacgcccucguccgaccccuccauccauccuaccaguucacucuugcacagaaauccccucccagcccaagccuuagaaucccucugccccgccccucccgacuuugccccgcccuuccauuccugagccccgccccuugccccguaggcucggccaggggcggagcuuauuccuccucccuccucucccccgcccccuaccgucacgcucaggggcagccugaccccgagcggccccgcggugacccucgcgcaggggccugugggaggggcgucgagggucccaggccacccccccgucggucccccgcccgccuagucuccucccccugggaacgcgcggggugggugacagaccuggccgcgcgccaccaccaccgcgccugccgggggcgcugaaucugccugagaaagaagcuacggcugccgccuggaggaggugccguagcgcccgccaccgcugccgccgccgccagggguaggagcuaagccgccgccauuuugugucccccuguuguugucguugacaugaauccgacaugacacugauuacagcccaauggagucucauuaaacccaagacgcggccccgccccggcgccguuccauuggacgagagcacgaacacuuagggccaaccguuggccuacgggucuguccgucacccgcucgcuaaacacucugccccccauuggggcaaguuccugccggucaucucgccuccacauagacacaccucucgacccaucauuuccccccccccaccuccggcaccaccccgagggagggucgacugccaguaccaaucaacagaccgcggggcccgccuuuuccgggcaccuauugguccagcccuuuuucucucucacagacaccgcgccaccucuacuuccaccuacccgcccccucuaccucuagaaauggauuggaucuaggcgcaggagaggcgcuuggccuuauuggcuguacacgacgccaaucagaagccuuuuuuccucuccccucccccacucaaccccaaagccccuagcccgcagcuaaaguuugugugagagcugaucgcuggcggcggccgcaggauuuaggggugggcgcaggcgggcgcgcgcgggcgggcacgcgaaguuaaaauucgagguucucagucgccugcucccgccgaggagcgcgcggacgggcgcgccgcccggagcguuccauccagcccccuccuccacccucucuccuguccugucccgggcgacuacucgcccgcccccuggcuugcacccuacccccuucacauacccccuacccugccagccucaggccgggugcaggcggaacgaucucacugcagccucuucgccaucccauacggagggggagcaagcccccuacccaccgggugugcacccccggcuccgcacucgcccgugucugcaagcacgugcacuauucgccgcugccuccggccaccccgguccccggcuaaccucgccuccagcccggccaaucgcuugcugcccuuuguugcugcagaccgggucuccccgcugccuuccucagccuccgccucguccuuugccagccgcccggguccgcagcgccgcgcuccccccgcccgggacccaccgccgccgccuccuucuccuccuccgccuccuccuccucggcuccgggcugcagcgcacagagcccgaggcagcgccgcccagccccgcuccccccgcgccgcccgcuagcccgccuggcccggccgggggcgcagcccggaccccgcccgccccagucuccgccccggggguaccugccuccgccccggggggcuccgcucaccgcccucaggggagggcggggaugccgguguccgaaaggauggggacgccugggcuguuuugggguggggaguguguccgccaggucugggacugaggugcggucuucuuaaacgcgcccccccucccgccgccgugggccccaaacuucguccuucucccgggucuuguacccucgggcgaccgcggcaguuuuggggugggggaugccucaggagcugucucuacccugaucaggaggaagagggagcagugacauucagcgacugcggacaggcauccucgggugggaguggggaugucagacgcaggcuggagagggaagcugccccucaggaugcccucucccggccugcgggagaggcuggcgagcucggagcugcguucugggugcuuccuggacugugcagcuggauaacauugggguugggcggggggcgaccgcuggggggcccuucccucgucuccaaccagcgcuguaaggaaagcugauggcgaaguucgguuuuccaggcuuccccugggcccccggaguuccugaggcccauacgagggaggcugggggauccucuggccgcccaggcaaggcuacucuaaaggugcccacaugccuugcagcgcccuccggacucuggagaaaacguccugcucuucccagaguugggugggaugcugguaagagauacuugagaguaugagaaagguagacuugagaaaaggcuccuccuaacagaguuugaacaguuucucuucccagaccuuugggaagaagggaaacaaaccuaugucccugggaaagccaaguuuccccgugugguggccggggugaaaaaccaccuguugccugaaguucuguccuugaaucaggacguucuuggggccccugaugaggagauguaggaugucaaagagcaggaauuucagucucccugcccugaaugacucauuuucaugccacugccacuccugcagcagaguucaacuccccguuagaaacuacuguucaacuauguagguacuuuguuagacccaauaaucucaguucuuaucuuagcagcagcagcagcccugucacaugcagacagaaaugcacaaaggcuacucuggugugcgagcuuccucugcuucugagcuuggcagcaaggugaggaagaagccaggacaaaaggcagaggugaaugaaagauuaaaaaaaaaagaggggagagcagauuaaaaaaaaaaaaagaggggagagcagaagacuuguaacacuacacucagaacugucaccaguuccauuauaaaccucuuuuauagguguuuuauuacuugguuguuaguuuuuaaaacacaaaccucuuuagguuaaauccggacacucucagacucagcccaaggaaacgaaacaagguaaacucagccacugaucggcuuggcaacuuuugaauuacauuacugaugaagcaaaugccgcccccaaccccacccucguuggguuuucuaagucucuuccugucuguuucaguuaggaucuucaauaacuugcucaaggagaguuuucacaagccauuaguccauaacucaguccuguucauuuagauuguuuccaagaagggcauuuauaaggugugcuuuuccccccauaauacacaugcuagguaggaauuuucuccaagaaguuacaaaguaaauuuaaggauacuggcugacucauuagcccuucuguuuugcuuuguugcauuucugauagucugcccagaugcacuuuauuuuuuaaguuacauuuuggucccuuggggugacauuuauuuucuugagacaaggucuugcucuguagaccauuuggccucaaacucacagcaguccuccuacccagucucccaauugauagaauuucagauaguaaaccaccacgcccaacccucagacugcauuuuaucuggagcaauaaaauaaaccaugucuuaaaaacaagguuuaaaacucuagaucucuauauucgaaccaaguauguuaaagaugcaacuaaaaccaguaagucaagucuacgauggccagccuucacucaucccuuuugccacuaaaaggaaggccugacacuuagagcugucacagugcuaaggaugaaacccaggcccuugggcucacugugcacaagaauuuccagagcaucacaguaaucagacucuuuaaagaacuugcuuaaugcucaugguucaagccccagccacccugagagcaagggagacagcaaaaaaauagauugacauuugucuaaaucuuuguugauguagaaaacucggaaagcagaaauauaguguaaugucuuuuccuaacaaaauuauccaacggguguggcaagaaaggggaacaguuuucccacugcuauuccccuggaggguuacuuguccuuugauaaaucugccucuucagauaaguaggacugagaggauaacagagacgcagccagauagauacucacugcucccucuuaaaccucuuucuuaucugugguaucucaagucucugcugagugaaauagcucaauuaaguuaaccuaggaauagcgagaauugaaaaccaagcauagcacacauucugcaccaucauaaaccagcaucuuaucucaccuguucaccaccaccggaaaacagcuagccucugccagaacuauugacagcuauuugugcuguuuagugcaguccacagaucacuggaaucggaaugaucugggaugcuucccagauagcauccuuggcccaacccaccuucugauucaguagcucuggaauggguugccagaucuacaacuguuagcucaagacuuguauugaaauucucaguuuuuugaauuugagaacuguuagccuaggcugaauucuucccccucaacagaaauaauuccaugauuuucuuagccagaauuaggacuggaaugauuccgaggugugacccauguguccuugagcuuuaacaacaacaaaacaaaaaaagggcagaguagguggggaaggagccaaagggaacuacaggaguuuugaucuuuggggcuuguuuacuugcucuaagacaagucagauaagaagaggccagccuggucuacaaagugaguuccaugacagccagggcuacacagagaaacccugucucaaaaaacaaaaaaaaaguuccagguacacucacacugauuugggggaaaguggguaaggaagcagcagacauaaagaccuugaacuuucuuauccaggaccgaggcugugaggaauucuauguaccuuuaguuauuaggcccuuagaaagcauuagcucaggacuacagagaguacuaucugcucuuuagaggacccaaguucagucccuagcacacacauagcagcuuacaacuaucuaacaacaguuccaggggagccaacacccucacaugagcauaagagcaugcaaaugaccaaugcacaagaaaaacaaucauuuaaaaaaaaaaaguauuagccuaugcaaaccuucaaacugccaaggcuaauuaggaauggguagccacagaguucuaacaucugauuucaauagucaugaacagacaagguuaucggucaaucguuaaaugauuuaauaaccucaagcucuguaaaggaacaccccaaguuaaccucagaugguaucaccccacaccucauaugugccuuccugcuuugugauugauugguugcuugcuucuguuuuguugaagcgggcuagcauggaacucauugcaucucucucuggcugaccuccaauucugaaagcuuccugccucagccuccagaagcugagcuguaagcuucaccucuauaacuucaaauccuuuaaaugcauucuggaucaaaucugaaaccagugagccaaugcaggacuacacccaacacuauucuuucucuccgacuuguggccagcucccucguucucucugugcagugcccucccucccuacuguaucugacagagaccuugaagggcucuuggacuucuaggcucugcugcugcuuccugucaaguuuuccuggccugugcaggggcccacagcauucuggucccuacuguagcccuggucuguauaaaguuuagaguuuguugaaggaccaaauaaauaaaagcauuuauccaauccuaugaucacaggcuuuccuaauuaaucuuucuauuguacagaccaccagccugcucauuggaauaacugcccuuuaucuaugaagcaauucauaugugacucuugcuuuagccauauuuagaaucaucuguguuagccuaaccuuucuuugcccuaggucucacaugagacuaauuaaauuagaauauuuggagguagggucugcuauuauuuguuugggguuuuucauuuucucuuguuuuguuuuguuuuuuaguauagaauggaguuuauucagggcauggggaagagaguuaagaggcagagaaaggcggagagagagaaagagagagagaaaagagagagaaguagagaccagccaugaguacauggaagggggcugggagaaaggaauggggagagggcgggagcaagaagggaagagcaagagcaagagaggagcaagcucucuuguuuuuaauaagggagaacuggagcuggaaagauggcucagaaguuaaaagaauuuguucuugcagaacccagguucaguuccuagcauccacauugggcacagccaccuuuaacuccagucccagacaauccagcucucucuucuggccuuuguggguaccugugggcaugugauauacuuacauauacauacauucacacuagaaacuuuaauuuuuguguaaauaagacugagccuuacauaacccaggcuggccuaaaacuugcugcccuucagucuaauuugugagccuucugcucucaccuccuaagugcagaagacaggugcauccccagcccaaguuuauuuacuuagugcuggaggaagaaacccggguuucagacuugcuagguaaguacucuaccauauuauacuaaguccccaguccucaucagcaucuuuucaaaacacccugugcaaacuuacauacuuacauaagacucuguauaggaaaucuucaggcuuaugaaguuugcugucuaauauguauuuaagagauagcauuuagauuaauagaucuauauuuaaccaaccaagcugaccaguuguaguggcucuccuauaauuccagcacucacaagucugggauucuaucaggcaaaacugaggacaguuguaggcagucuaggugaauccaggcccgcugcacuaaagaagagccuugaaggcauuuguaauucuuuuacccuuauuuuuuggugugguguuggggauugaagcuagaagcuaggaccuguuguaugcuaggugaauacucuaucggcugagccauaccuccacucccuguggaauucuguaucugagcuuguuauaugaaagcuuaaguaugucuuucacaagagaguuucugaguuagcaggauggcucaacagucucauccauuggccuuccuugggaugggacugaaaagaugaacuugcaacaugaaguucgguguagaaguugucaguuuaaauuaugugaugcuuggcuacacgaguaucauauggcugagaaggaaaacuuagagccugugucaucaacucuguugagaaaaugggacauuuccagauauagagugcuuaggauacaugagcacugucugagaagauuggccucuaaugcaacaguuguauagacaacagaauauuaguaucuagauuauaugugaaaagaacuuauaaaagucaacuuuguguuguuucuugguuuuuuagauugguguuuauacuauagcccagacugaucuccaacacaaggcacucuucuugccuuaaauuugagaauuauaaacaugaacuaccaauaccaauuuuaaaaacucuugccaggcauggugguguacaccuuuaaucccagcacucgggaggcagaggcagguggauuucucaguucgaggccagccuggucuacaaagugaguuccaggacagccagggcuauacagagaaacccugucucgaacccccccccucccaaaauauaaacaaacaaacaaaaaaccucucuugguuaaaugcauucauuuauuuagcaaauacuuaucaagcaucuaucauaugcuaggaccugugccaaucugagaguauguugcugcccacauaagacuuacugccucacagaaaacaaggguugauugucuuauuucuaagauuuauuuuuauuuuauauguaugaguguuuugucuaaauuuaugucauguacugaauucaugccuggugucugaaaagccagaagagggcacugaacucccugaaacuggagcuacagauaguugugagccuccauaugggugccaggaacuaaacucagaccucugcgaaaagcugcaagugcauuuaaccacgguuccucuuucuagcccucaguuauugccauuguuuuuuaaacauguguuuucccuuuacguugucugugguauugaguacugcauaagaguacaggcgcuuggaggccagaaggcaucugauccucuggagcuggaugugaggugcugugagccacucacuuugaugcugggaauucugcuccuccauaagagcaauacacaacacacacuuaaccccugagccauuucuccaacccauagggguuuuaauuuucauuuuuacugguacugaaaauugaaaguaugcccucaucuaugcuagcaaauguggcacugcuccaagcgcuuuguuuucauuaucaguguccuuuuugagacaaggucuagguuggccuuagaauugugguucuucugcuucagugccccaugugacugggauuacagccuugucccagcaguguuagcugagacucaugccugucaucucagcacuugguaggcuacagaucucuguaaaugugagacuagucugcuguacauauugaauuccuggccagccagagcuacucagcaagaccuugucucaaguaaaaaaaaaaaaaaaaaaaauuacacacaggcacacacacacacauaaccaaaagggcacuaauaucuaaacauuauauacaguguauauaugauuauugcuauuuuucuucuaugguaugagugaguauauacagcagccaucucagcuuuucccuuugaaagauacaagggauacgucuugaguagcuccuguccacuacaguuauuccagcugccccuuuuggaguuugcugccuauuagucugcuucacgugccuggccuuggugguugauaggacuuggugaacgaguaacugggacuaguaacugggacuaguaacugggacuaguaacugggacugagcucuuguuccuucccauucuugugcuauauccagugauugcccuaguaaagaguccauaauaagcccuagagcuugcuuccugaacuaacaacaucaaaccuagauuaccuggaguccacaguauccauccuugugacaacuagacuacuguuccccaguucuucuccauguucccucauggaucaaugcuuuccuuuccauuagggcaggccauggguucaauccucacuggggaugaaaaugagaagcaaugcaucuuauuuuuggagucuuguuuguauguuuguuuuauuacauauaaguacacuguagcugucuucagacacaccagaagagggcauuagaucccauuacagaugguugugagccaccaugugguugcagggaauugaacucaggaccucuggaagagcaaucagugcucuuaaucacugggccaucucuccagcccuggucaagaguuuaaaaacaagggcacgguaacacauaucuauaaucccagcacuuaaaggcugaaacaggaggguuguaaauuggaggccaggcugguuacauaguaagaaaauguggaacuggggagauggcucaguggauaagagugcguccuguacaagaaagagaauccaccuuuucaccccugugaaaauaaagcagcaugacauggcauuaggcacccgagccacagcacugcuuggggggacacagggggauaccugggacuugcuggccaccagccuagcucccaguccagugagagaccuuguuuccaaggauuaagguugaaaguagugauagagcaagacauucaguguccuccccuggccuccgaggguacacacugcacacacauauacuccacauugauugaucgaucacagaggcucacacagaagagaaagaauuagagugacccauucuccaucucuucucuuccuuaucgucaguaacaucucagaagacaugggcuccacaggaugagcaacagguuggccuaacucuguuuagauuagacucccgaguaacuuaauacaggugauuccuuccacgguucuaacuuguuacaaggagaacaaacuucgcuguguuaagcugcacagaaaaugaaguuuaucuaauacagcaagcaggugguguuguucacacaaacuccugaaugcaaccccucacaaguacaucucuagcccugaccuuaaccaaaacacugagaagcaauacacauacuuuuuugcuuguuuguuuuugguaguuuuugagacaagauuucucuguauagcccuggauguccuggaacuggcucuauaaaccaggcuggccucaaacuagagauuugccugccucucccucccaaaugcugaaauuaaaggugugugccaccaacuugagguuuccaaaccauuuuuaaagaaaccuuugugcccuucaguaccuaaaauguuugguccuuacagaucacaguuucuauuuuuguuuugacacguagaacaugugucccaggcuagucucaaaacagccucugccucuuagguauaccacucagcuuagucccagauaucugccacagcacugcaaaaugaacuaucacagaaacuggcuuccugacuucaaaguaacuguuuucucauugcugugaauggagcuuuuggagauacggauguugcuuggggauaggccugcaucucaagggagagagaaauaaauucugccuugaaucuguucaaaacucucuuggcagcgucuaggucuagucuuagagcucuaagacauggcuaaugaccuaggagcugcuuuacacgacagcuaagagaagcacgauuuauucucaucaauuaaaggaguuggggaaugacgcugacaugguguugugcaauucuguggcuccacucaaaaccuuggaggauaaacagugugagaacuugggcugcugaaguggacuccaggagcacauuugcugaacauggcuuuaaaagugucugguguaacaauguuguuaauaauagcuaacacucauggaguacuuacaaagcuaagugauuucccugaauuggcucauuugguccucacaacaaucuaguuuaaauacugcuauuauccccuguucuacagacaaggaaacugugacccugaggugcagaguacuuggugggaggucaguauuccuagccaggcuuuuuaccauuacauucugcuugccccuccgggaggcugaacuacagaaccuggcuggcugaagccauuccuccagaagaguggccuucucuagguauucaggaguucaggacugcacuuuuuuuuuucuuuuuuugguuuuuugagacaggguuucuauguguagcccuggcuguccuggaacucacuucguagaccaggcuggccuugaacucagaaaucugccugccucugccucccgagugcugggauuaaaggcauguacaaccacgcccagcuuaggacugcacuuuugagagcagcagauuauugacagaugcagaucugaggagcccaugaucuuacuacacuauaggccaucagugggagaggaaacuggcaccaggaaaucagauaucagagcccagggagggugaacugauacuagggauagaaggaaggaguccugaaacacaaugcauaaaaaagaagguguuacugguagucaccaagacaacagucauaggucagguauggauaggucuggagacauggacagacaggcagacaggcacacaaccaacugaaaggauaugggaauuaccacuuucuuuggacgacaaaagccuuacacuuaauugaugcgaggauuguuuuacaaagaggguggagugaacggccagaacugcugugccuugggcagcagcagcugccuaaguaggggcucauaggaggccuaggcaaaaccagccauguacccgcccccaccauccagugccauccccaacuaccaagcugccuguucuuuguaccuuuaucauucuccagcccacagugccagcuaagucacucagcugucacaaugaggccuugagcugcaggauacaauauaacuccugggagaccucccucaggcugaggccugaaggcugaggccagccuuucuggugcccagggagcagcagcugcaucucccaaguugcuaaauuagcaggacucuuguuuugcuuuuaauuuuuuugugugaacucaagaauagguggcggaugucuuggcagaaugugaaugagagccuuacugaaagaauucaccuugcuaaaggguggcugucaggcacacaaaacccaagugaagcaggcuuuugcuccagccucuugcucacccucccaggcaguaaucagccucccuucccaggaucccucgacaagccugccuccuggccaggcagaccccagagcaaaggccugcaggaagaggcagacaaggccaaaguuucuacaaacuaauagacuugcuucugacaaggauccuagcuggcaggccagcauuauugccauacuggcuuaagaauggcccguguagcugaagcaucacuccaagaauggugacccuagaccaucggugcucgugcagaaauugcagaagugcugcuuuugucuaagcaucccuuucagcccucuuugaugcagugcacagugcccccagagcucucuacugcagagugccagaugacgcugaggcccugggagcccagcacccuucagugcugcacccaccgacgccuugguucacagcaaucuguaucuuugugagacaaacgauaaacagaagaacugacuuuuuguuuguuuguuugugagacaggguuucauauagcccagguaagccuugaacuugguauguugcuuauguuaacccugaacuacugauucuccugccucaaucagauuauaggcauaugccacuuuaaaauauacauuugugucuuauuugauauuugucuguaugcaggcagaccccagagcaaaggccugcaggaagaggcagacaaggccaaaguuucuacaaacuaauagacuugcuucugacaaggauccuagcuggcaggccagcauuauugccauacuggcuuaagaauggcccguguagcugaagcaucacuccaagaauggugacccuagaccaucggugcucgugcagaaauugcagaagugcugcuuuugucuaagcaucccuuucagcccucuuugaugcauacuuggccauggaugccacaguggcaaguguaggucaggggacaauucaggguuugauuuuugccuaccauguaggucccaaggacccaacagggaucaucaggcuugggggagugguaagcacccuuacucccugagccgucuggcuaggcauauguuacauuuuaacaguauuuuaguuuuugauuuuucauauguaguucagguaugguugagcccuugaaagacccacaacgugaggacucccccacauucugacucaggagaggcgacaucccaaaaucaccaacaagaaacagucuugcugcaaauugcaagaggauuuuuauucaagagcgcucucuggcccacggucauacaccacgcagggguagaggacuguggcaugccgaguagcugaguaaggggguauuuaaaggaaggaaccacaacucaaggaggugggaagggcguuguuggaaaauaccaaaaauaccaguuaagagucacaaggaaguacaaaguuacaagugucagguuaucucucaagacaguuucuaagagccccuaacaaucuaagagccccuagcaauagcaccuuugcauaguggguuccagcaauggucagggugggucagggugacuuucuuugaaugaacacucuuugaacccaggaagcggguggguggaggaaggaaucugguuuaugaugagcauaccuuggagcacugaguuuacuacucuuucacccucauagucccagcagcuggaaggccaaggaggaagaucacuugagucacaaguucaagcccagccuggguaacauauaacauagugaggcccugccccucucaaaauaaauauuuaaaugcagcugaacacacaauucaacaugagcaacucacaaaaguaguacuagccaauacacauacagaguguuuggaaugacuaggcacuaaguccacgguggucaugagacuucuuccuuucuagauuaauaaacauuaaaaauauugucaaugcuuuuuuuagaaauacauuuaucuucagcgaugaguaucauucauugaauuacaaacacccuacuaucagaaugucuuuuuaaaauguauuuuggggcuggagagaugguccagcaguuaagagcacugacugcuuugccagagguccugaguucaaaucccagcaaccauacagugccucacaaccaucuguaaugagaucugaugcccucuucuggggugucugaaaacagcaacaguauauauauauauauauauauauauauauauauauauauauauauauauaaacacacaaauauaauaaauaauguauuuugauggcuaaagugaugauuccgcaguugagaugccccgaguacaauccccagcacccacacggcaguucacaccuuucugugacucacuuccagggcuucugacacccucacaugcacacgugcagcaaaacaccaaugaaauaaaaauaaaugacacguuuuuaaaaauguaggggccagcuauaaaagcccauauguacuugaacucucgacccaucugccucaacccgcugaaggcugauaccagaaaucuguagcacccacucagcuuacaguuuugaauuuuaaaguaaaagucagcaggugggucuagacuugccucagagggaguuuugagaacagcaccagcuaucagccaaagguucuguaccacccaacaggagauaucccaucaaaauucaauuugcauuucuuugacuagaacuuggguguuccuuuucaugcguuuaaaaggcauuuguauuuccuuuucuuugaacccccauacuggguuccuggcagccauuagaguuuuuuuaauaaaaaaaaaauguuaggucagguauaguggcucaugucuauaacugcauuuaggaagcaggaaagucaagaugacaaggucaaggaaccagacagauggcuuaguaaagaucaguauugcuugcucccgcagaggaccaacaguacaguucccagcacccaucgcagggggcucagaaccaccuggaacuccagcuccaggcuaucugaaaccacugaccuccucaggagcuaccuacaccugugcaccuacacacacacacacacacacacacacacacacacacacacacacguaauuaauuuuaaaauaaaaauaugccgggcggcggcggcacacgccuuuaaucccagcacuugggaggcagaggcaggcggauuucugaguucgaggcuagcauggucuacaaagugagcuccaggacagccagggcuauacagagaaacccugucucgaaaaaaccaaauaaauaaauaaauucaaggucagauuaagguuagcuagcaaguuugaaaccagccugggcaacacaaugucuugccucaaaaaaaaaaaaaaacaaaaaaacaaaaaacaaaaaaaacccuacaaucugccuaggugcucugcaauugcuuuuucuguugcuaugagacacugcacuguugaaauccacuaauucauauuuuccugggcuucuggaaggccagggccauggcuguccaguucaccaucugaagcccacgugggcagccaagagacagauaccuuucagggcugugacucugcuuaaguggcaaguagacaggugacuccuucuaaggagucuaaaaggagaaagcuagcuggagcucuaccagccuucuucaauugugacaaaaugagauuucuaaaacauuaccccagcucagacagcagccuccacagucuagaacagauaaauacagacagguucaucccagccucugcccauaaguccccaugccagccccagccagggucccugcagaguuccacacucacugacucccagcauccccugggccagagcagcuccagaagccuguagucuuccaagaccaaggguggccuagacuggguuaugaaagugauuaacucuaauccaaggacccuugaagagacccugucuauaccuggaagaaccaaguaaugagaagguggagaagaaccaacacuggagcgggcccucuuggcaccugugcucucucccagaacugacacccagcaccuaugcuacccccagguugcccgcucccaugcccucugcccugaauacuguugccccaccuccuaugcuauccgaccuuacccaaccccacccagcuguacagugccuauccccacccucccgcacaugcugucccgggugcgcgcgcguguguguguguguguguguguguguguggcucauuguccaugggcagaaguacaaagugaacuuuguuaccucagacugauuucauuuuggcucuuagccaucggugccauaaugcaagagacacauucuauaagcuaagaacaucaaugucacucaggacuuccaagagcaaggggacacgauacauggcaaggaggacuguaguugcuuuccuugcaugacugacccucuccccagagccugaggcacccacucuaaccaucacucacuccaucaagaucaucuucagccauaucaugaguuuuugacugcaugagacccugacucaaaaacaucauaaaacaaaagaccuuuucaaucuugcaucagaagaacucaugugauaugauggucaaagagcagcugcaaaaucacuuaaacaaacuccuaugcgcucaaccagacuccguggacagagguuugcccauucucuuuauaacccccuacuguguauacuauuaucucugcaaugcucugugauugagaguagacuuaagacuuuuaccccuuaaauagguccagcuuucacuaacaucaaggacacccuuuuaaaugaucacauaauuaucaaauucagaaaauguggcuuuguuaaauugcuguuaucaaaccuggaauucauauucaaauaucacuaagugucccaauaaaggcuuuuauagcuuuuucuuucuuagaccaggagccaaaccuagaucugauguuucauuuaacugucucuccggugcagaucagugccuccacuuuuguaacaauuuuaguggcccgguuccuuuggaucugcccaguguugccugaguuaaaguuuaggguguuagcuaaguuuuguuucugugaccucaggagcaccccuccuucugcucccucccagggccccuacacuccaguugcccucacuugcuuugguucugucuccuuuuaauaacuuacauuuguugcugguuuugggguugguuugaaugggguugauuuggguauaacagacaggguuuguguacccugaccuagaacucacccuguagaccaggcuagccuccaauucagagaucuaucugccucugccuccugaguacugggauuuaaauaugggauuuuaaugugcccagcaguuuuguugauguuaauuaggaaaaaaauacauguuucuuaaaauuuaccauuuucauuuuuguuuguuucaagaaagggucucauuacauuauucugacuggcugggacucacuguguagaccagaucugagagaucuccaagugcuggaugaauggugugcgccacuucacauggcaugggugaguuuuaauauguaacauucuuuuugguuuuucaagacaggguuucucuguauagcccuggcuguccuggaacucacucuguagaccaagcuggccucgaacucagaaaucugccugccucugccucccaagugcugggaauaaaugugugcgccaccagacccccacaauacauaacauuauuuacugcuuuuauuuacaacugguauugcuuaaggauauauaauuucuaauucaaaaauaugugugucuguauuucuguguguguuuugagacaaggucucaagaagcuuagccuagguucauacaauaugcagcugaggauagccuuaaacucuucuuucaagugcuugagauuacaaguaugucccaccauuccagugugguuuagagauugaagccauggcuuccuacaugcuagggcaagaauuuuacuagcuucguuacaucccuauagccuuacaguguuaaugguggaguguggggguguacauguuuaugugugugggugcgcuuguggaauccagaggucaaccuccaguguccuuccucaggugccauccaccuggauuuuguuugagacagggccccucauuagagugcacccaauagauucugcuggguccuccuauguccugggcacgcucuuguuacaagcuuaagucacuaagucagguugaguucuaggcaccaaacccaggccguuaugcucacaaagcaaguaccuugcagacuaagcucuugucucagcccccauaacauuaauuacuuagaacagaaaaggugcuugccucaaaagacuggugacccaugcucaauuccccaaacauacuuaaagguggaagaagagagccaacuccauaaaacuguccucugaccuccacaugugcacucuggcauaugugucaccaaucaucaucaucaucaucauaacagaaagaggaggcagagaagggaaggaagguuugccuacugagaguucguuggaaguauucacagcacaggagaaacagcuuauagaagcuucgcugaaagccuggcucacuuuagggaggggacuuaggagguggcccgggcugccccuggggcuaaggcucccuagggaaaacuuucgaauaacaaguuuccuucuucagaacugagaaaguacagcagcuucucugauacaggcccugcagccaccucaccugagcacugggcagcucuuucccccacuugcccccacacaggguuucucuguguagcccuagcuauccuuaaacucacucuguggaccaggcuggccucgaacucccaagugcugggauuaaagguguguaccaucacugcccggugcacugggcauuucuauggggaaaauaugguggggaaaauggucagagaaaaauacagccuuugcaagucaacgaaaauccaccauuuacucccaagggccgagauuaaaguguaucggcacugccccacugugcucuguuaauuuagaguugggauagacccaggucgcuaaacaugcuaagcacauguuuuaugauuuggucacaccaggucacauuggcauaggugauuguucaauuuucaguacuggugcuugagccuagagccuugagcauaagcaagcaggcaaggguucucucacugagcuaugcgcuguauuguaucuccagccccuuuuauuuuuguugauuuuguuuguuuguuuuuugaaaauggucucacacugcccuguaacucauuaaguacccauggcuggacucuauucuuguuuaccuggguuuuaaaaaaaagcggggcguuauggaguaugcuuaagacagucccaaaguccacauucuucccaacaaaagcauggucaggccuagcaauaccucagucccugcuaucaauuucugucucaguuuggguuucuuuugcggugaagagacaccaugaccaugccaacucuuaaaaaggaaacauuuaauuggggcuagcuuacaguuucagaggcuuaguccaugauccucauagugggaagcacgucggcaugcaggcagacauggugcuggagaaagagcugagagucacaucuggauccgcaggcggccggaagugaacug

SEQ ID NO: 7300 - RNA, 11332 nt, Mus musculus
aggaccaggcagcgagaacugauacuuuaggccguccucaauggaggccagguggccuguaugcucugcuuggaaaugcuuuuuucccugcaagaggaucaucucugagucaagcaugagagacuuccgcugccccuucgaccucaccuuuccccugguaugcaguuccagugacgcagaggaggaaguggaucaugcuaguuuggggugguuaaugcaggggauggugugugggcuacuccguuuccauuacgagguucucacucaugacugagugcucguugccugaaucuuuggcucaccgacaaguucaagggaauauucgcaccagcaguuaauuauccugaagcuccugggacuugucuuccacacgucacuuuucgucugaaacaguagguuuccccagggguaguugaaguuuucugauugaaaguguccugcguuaaggagaggugugagcacgccguggggaucuauucaccagggguguauuguacuuguuucagaugcuucaggacaauacaccggcuuccaagauaagugcuuuuuauuucccugcaucuuagaucaauuauuuggaaucuuuuugguaaguuaaacuuaagagcuuaaaccaucacaucucuguaauuaauaagucaaauguucuuaccaaaauuuacugugucugcuuuauauuguaacugugcuuugaggagcugagagaaaguaggaagggacagaagguggcaagaagccccucacuuaacacccaugucgcgaaggacagcauaggucagcaucagcagcucagcuccuuccaggcaagcgccugccgcagaugacauuuauagccagccgcucuucugucgucagugcacaaccaggaggcacagcaccuuuccaaacagcacagauugucauucugcaugccauuucagucaacuaguaagaaauaagacauguguucauggucauuuuuacuguuccugguggauucuguuuaacaucagagcauccuccgucauggggagauuccaaauaguucucggcaaaagugccauuuucuuccuggcugcaacuucuuugagggucucuggauucccagaggaggaggagacacacuacaagcagggccaggcaccucagggcauuggcuuugggugguguuuggugcucaucaucccugggaugugugcaggagguucugacuaaacauuggguuuccagucauauucucggcacccugaaaaguaucccucccaacaagugcuugcagagucccugccucuucacagccucugagugcacacacaacaggagggugcuuugcugggagagaccagugggcucaauguccaugacacauagagcguguuaccuuccaccuauggggcagcaguccugcgcugcagucaaaaggccaaggaauugucaggagucagccuuuugacacugcaggaguggaggguacugaaagguuuguacuccagugcuccccaggggcucagcuugcuggcucgccuaaauuaccgcaugcuuuuuagacucgggguacaagaacagcuagguaaaauugaaagggagggugggaaugcuucccucuuaggucaaagugugggaacauagagacauaauaaaaaccgugccuccaggguaagguaguucuguguaguggugagcguaggugggagggggaacugcuuguaggccaaauuucugccuucaacagugggauucacaugaaucagugagggccuggggacuuccauaguuagucacugcagggaacuuuuaauugugggaucuuguggacaaagggaacaguuaucauccaugguucuauaccugcgccucacccccccacccccggcagaaguacagagcuggggcucccagcugacuaaguaaauuucucaggcuaugccaagcacuuagggagcaggugacgggauacgccaguuuucugugcugagguuugggcuuccuccacugcucuggcaacgcagcacucuccauguugacaggacacgauaugggcuggcugcagcacagcagcuguccacguuagcauuccugacaccgcuguugaaaaccucaguguggcagagcggcacgcgccgacaguggcuuggcuguuaaagucugguguuuguuugcauucaauacuuaaacaggacgagaggaguuaaaccaaaaaucuuaggcaaaacacgaugcuuauuuuauuucuauucuguaugaugacauucaaauaaaagcugucaagaugcagcaugcuguugagguagagugucuuuuucuagauuucugcauuauuugcaagugguuuugagaaacaggaagaaaauggauccaaggcauugauuucucuuuguaacaacaacagaaaaacuaaaacagaaaauucuugcaagugcagccauuuuggaacuguagaugaaggggaggaacgcugaugucuggguugguguagaguggccugguuuggugagugcugccaccuacugucugugcugauguuuguuuacacgcaggagguucacggaggugaaccucagggaggugaggcuguugaaacaauuagagcaaagaagccaucacuacuugacagucaauucuucucuccuccauuacugccucuuaauuaccgagacagccaccagcuuccguucauuuccucuaagugggcuuaaagucuucucauuucagaguuucuuugccagaaaagcugugcgguucgagcuucaugugcucguguauuuuauuuguaauuguaggagccacauucucagguuggcuuaguuuuuaugagaaggguaaaaauagagcuagcaucguagauuugcguuugccaccauaggcgugaaagccaguguuuuauuaauacuaaaacagcuucaaaucagccgcugguuaaacggaacaggcagugcaggcugugucagccgaagccccuucacuaagccccagcugucaaagggucaucggguccucuguggaaaacaaccugcccauuaaugucgggguggucccuccccaggauccgagagauccugacauugaguauccgagagaauuucaggcuugcaggggauuuauguguggagauuccccagaagucucuuuagucuuagcuuucaaccuccgugacacacaacaccauguauguuagcugccaccagcugugugaauucgcuuacagugucaccacaaaaguugacaagcagaaauuugacgaggugacaucacuguaauugagagaggugacgagcuugacaggacacacuugaccugugugaugcuuuuaccuuguggcugaugacauuguuccuaguccuggcccuagcucugacaaccaagcugagugcaguuuugcuuuuccugccuaggcuauuugcuuucucgaagagaaggccaagcagggucucccgaaaagccgcucucugaccugggccggcucuccuaccuggccuacuggaaaagugucaucuuggaauaccucuaccgccaccacgagaggcacaucagcaucaaggccauuagcagagccacaggcaugugcccacaugacaucgccaccacucugcagcaccuccacaugauugacaggagggauggcaggugagugcccugcuuucugcuuucuugauccacagcaggaucaagccuguuguuguugcuuuugcugguuuuccauuuucauaaccugggucaaaggaaucuggauuggccagggacuuuguucuuuuaaaacaguagcccagguaaccuucaaacucaugcgauccuccugccucaguucuggauuacagguaugcaccagcauguccaccauuuaaucuugaguugguuugguuugguuugguuugguuugguuugguuuucuagacagggccucacuguauagcccuggcaucccuccaucucaguuuguuagaccaggcuggccuugaacucacagagagucuccugccucugccucccccaagugcuaagguuaaagguguaugcaaccacaccccacuagcucucaguuuuuuuaaucucacuuugucuugucucccuauauuacagguuugucaucauuagaagggaaaaguugauauugggccacauggaaaagcugaagaacuguucccgacccaaugaacuugauccggagagucuaagauggaccccaauguuaauuucuaaugcugugguuucugaggaagagcgagaagcugagaaggaggugaugacgagucauccugaguggugacuuuugucuuguaguugcuuaagcuaagagagucauuugcgucauugugaaagcucaguuauaacgcuuaugaaacgauacagcgcuaauuuauccuaaccgauuaagacaugauaauuuuauugaauuaaguaugaaaaaugagacauuuaucauugaucacaccgaggcacucagcacugacaguauguaaucagaucagacuuggugcugggcugcagugcugccauguuaaucgauucuuuguguuuauaaacuugcguagagugcuccaugccagugagcauguaauguagugauaaagagcuugaaucaauucacugcaucguuaacaccacuuacuaucccaugaaacccagccguaacaccacuuacuaucccaugaaacccagccgucuuaggucugcucuccuaacugauacagcuggaaugugcuugaccagcuggucagaacucacuuagagagagauccuuuuucauugauccuggaggcuccagccguguaacugaccucaccgaugaccauuuugcuccccaccccaggcugaacgacuaauggaacaagccagcugcugggagaaggaggagcaagagauccugucguccagaguuagcaguaggcaaucgucugcaaaaguacaaucaaagaauaaguaccugcacuccccagagaggcggccaguggccggggagcgaggacaguuguuagagcuguccaaagagagcagugaggaagaggaggaggaggaggaggaagaugaugaggaagaggaggaggaggaagaggaggagagcauucagacaucucccccucgguugacuaagccacagucaguuuccauuaaaagaaagguguguaugcagauaagcuguuuucuggucugucuggcuucucuucacaguuuuuguuucacucucuguaguuucccuguaguuuacaucucagugguccagugucacaaucguuuaucuuacacuugugguucugcuuacugcuaacgugugcagcaugcuaaccacccuagucugguguucacugccaccugcuggucugcaggacaccucagaggccugggggggucagaccagaccaggucacaugacucacuagagggccagccacaccucagagcuccaaguccagcguuccugcauuagugucccuuauucucacauaggguucuuagguauuccgcacccuuuaguuugcugcugguguucugcuuguguggccagugacacggaaguaaaacucuucauauccuggguaccagguagucuccucagacagcgccaguuccugcccagugggauagaaagcgcaacauugguuuguguggggguggggguaaauguucuuccacaucugcuaucuuugucugcaguuucuaucugugacauacagcagggcagauauuauuaauacagccuugacaaggagggauaacacgguagaaaugaaagcucuucccaggggcuguccuaagaaguauuuuccaggcaguuugcuagucuaacucccaacuagguucuuucuucugaccucacaguuggaguuagcagagggagcaccccgugaagugcacuuguggcuacucagcauuuuaacuucuuauacagagaagucagucuuguguuauggguagaaugagaggaaggagaucuauaaacagagucauuccagucauggugugggccacagcucuccguauggauucaccugaaggaaaccagcucuuuauauuggcugcacuugcguuugggggaaaggugugggggcuuagggagcagauaacagcaaguguuaaaugacuaauacgguuagauuuuagaauguuaauaggccuguaugugcucuuuaagaacauugaaagcauuaaaaguguaagaugcaggaauucuucaguacuguuuaucuggaaauagugccccccccacccccaccaugcugggaggggagcccagugccuuuugcaugagagguaagugcucugcuagugagcuacacccuggcccuggcccgaagcugacauucacguagacauacugagcccucacagagcagcauucugccaauuucaugguucauugacacauaucuuaacauugaaucuaccuguuccuuuauuuaaauuuuguauauuagaugggugucccccccccuugggaaaauagcuuauuguugcaaccacgggaagucauuugugccauuaucuuauucagagacugcguuacuuuuuaagguaucuuccauaucaaaauagucuauaaaauuuuuaacugcccacaucccaguagccaagacucucuaacucugcaguuuucuagccaguaauuauucaagcaccuuuucauuuuggggacaaggaaguucaccuucagccccaccauguuucucauagugccuaucaugccgugggcaucuccagagcaguuacaagguaauaaaugacugaccugauagccgauuguugcaacauuuauaaaagcguuucuagaaucaucugugauaugccagauacugaagcuggugagugccacuuaaaaaauaggugcuggaaaagcaaugcucagcuuuuaaaaucugcaguugaguugcuaggauguucucucucaaagcaucugcuugaguaaacaaguguuuuauuuggaaaacauaugccuguguucuuggcacccaagagggauguucaacaucaaauggaagguuaaguacaaaggcauugaagaaguccugacauguaagagucucgggcgcacgucaguacacguuuacugcguaucaccucagcuguuuaauuccucaggagcacuuauguauuauguuuugaauuaauuucagaggccuuuuguaguaaagaagaaaaggggucguaaacgcaggaggaucaacagcagugucaccaccgagaccauuuccgagacgacagaagugcucaaugagcccuucgacaacucggaugaggagaggccaaugccgcagcuggagccuaccugugagaucccaguggaggagggcggcaggaagccaguucugaggaaagcauucccacaucagccagggaagaaaaggcagacagaggaagaggaaggggaagacaaucauuucuucaagaccgcugcccuuuguagaaguaaguggaggguuaguucgccgcagggugugccagugcaccugagacacaugccagcccauccuuucucauucccagcgucucgccccuuuuuccuugcaaugggguacuuuguuucuaaaucagaauaauccuguaggugguuucuucuuacucuguagaaauugccucacccuaaacucugaaggcuaguaagaaacacagcacacguucccugauacugcucugugaucuaccuaguuagcauuuuuggacaucaggguauuuguuaccagugugcacuucuguuuuccuugaaaacaacuucucagugcaucaggguguauccuaauauuccucugugugauccagaagcaccugaacuucaaacacccucaauaucagcguugguaauaugggaugauacagaaaucccaaagacagacuuucuuuugaaguugacagggauacccucuucuacaaacauaccagacucaagugaauugucucugaugcccuguuuuaaagcacguaucccuuacucugcuagcacagguacuccaagauggacggugaggagcuguaggacagcuccugguagcuggaaggcugaaaugacucugucuaaaacuugcugcagccuagggaacaacucgccuccuuucucugggaaccacaggaauugcugucuaugucucuuuuucaaagcauaagccagcacuucccugacuccuuagugaauauuugcuaucuccuguuucauuuuuuaaaauuuuauccuuuccuuuuuuaaagacaggcucucacuauguagccccagcuggccuggaacucacuauauagacacacuggccucaagcucugaggucagccuuucccugcccuucaggugcugggauugaccagcauaccugacccauucucccucuccuucucuccucuuuucaucucacucucuaucccucucuucuugucugucucugucucugucucucucugucucugucucucucugucucugugugucucucucugucucuaucucucucucucucucucucucucucucucccucucccccucccccucccucccucccucuccaguuuuacuuagaauucaaccuguuugugccggucuuguaccuggugagcccccaagaccugucaguuuuccucugcccccucaguacugguuccgggcauaagacagcccacauugcccguauguguguaugaggaaucugaaugcaagccuucagcacuguguggcaagcucuuacacugcacccacugcgccuucuccccagacuccuguguacaugugaggcucauggagagcucccucugcagauguggacgcugagccugacucucacuuggaggugucggcucggaagccugcagaugagcugcugcugcugccucucaccuuggcuuuguucucuuuaccuuugauggucacauuccaccauauuucuuucacgauccucuccuuaaaggagauuauuagaaaacucaucuucucaucuagggauguauuccuauagaaacuguauggccagugacucauagaauaaacguggguaaaggcacuugcuaccaagccugacagccugauuuugaucccaaaaacucacaugguagcaagaggaaaccaguuccuucaaguuggugaugcucgucuucaaucccaauacucaggcagagacagaggcaagcagaucucugaguucaaggccagccuggucuacagugcuguuucuaggacagccacagcuacacaaagaaacugucaccaaaaggggugaggaggggcgcuaagagacauugagauggcugauuccugccauugugaaugaaaggaaguggugugaguauccuuggggaaguggccaagcucuggagcuuguacagaguccucucuaaaucaaguacaugcugucagcuaguggugagcucgaugucuguagggaaguuuaugugcccucacuuuauuauauaaaugagcugaucuugcuggacuccagccauucuggcaucaacuuugugacuuugcuuuuauuauccucuaaaauacuguuuguuuguuuguuuguuuguuuguuugcuugcuugcuugcuugcuugcuugcuugcuugcuugcuugcuugcuugcuugcagacagaagcuguccuagaacucacuguauagaccaggcaccaccacccagcaaaaauaguguuuuaauaagaaaugucuuaaggccccaguguuuuaugucuacauacuuauucaugaauaugucuauuuguuugcuguauuuuuaguagcaaacauucguuuuguuuuguuuuguuuuguuuuguuuauuccucucagaauuuuauaagguggaguuugggugagagaaaacccugaagcaguugucugccuguacagggcaacugguauagagagccuuugaaacaaacauucuuauuucuguguacauagagguccagaagaauagguuuuagacuuguaagaaaauguucacuuccaucugguugcugauugucauucuaaaucagaucuuauauuugaacagcagacugaucccuaauauaccaugaacagaaucccugauuuaaaacaacaaugggggcuggagagcuagcucagcggguaagaguacugacugcucuuccagagguccugaguucauguccuggcaaccacaugguggcucacaaccaucuguaauggguucugaugcccuuuucuggugugucugaagacagcgaugguauacucacaugcaucaaauaaauauuuaaaaacaacaacaacaaaaaccccuguguuuuaaauauucaguaauauuaugguaauuguauuuuagcuugugucauugauaaauugugaugcuaacaaugacagugauuacaacugcgcuguucuguguagucacucaugcaguucagagguacacaguaaguaaugucugggcuggagagaugcuuuggugguaagagcaguggcugcucuuccagaggacccaagcuccauccccagcacgcacauagugguagacagccaucuauaacuccaguuccaggggaucugaugcccucuucuggccuucauaucaggcauguguaugguacauagacaugcauacaugcaagcaaaacacccacacacauaaaauaaaaugaacaauaaauaauaagaacaaaguuaugucagcugggaucaucuaaaucuagcaaauguucacagagaggagguccuuuccuccggaugguaccagauuaacccuuugagugcagugaugguuuggguaugaccuaacauuaauccuguccugugguauuuucagauuuguugauguugaaauugauuguuuuacuuuuuuaguauuguggagcucccaguuuuugcaucuuagaaugucuuugacuuccuaggccuagguuacucggguuggcuuauuccacaauauuccuaguuaccucucucaucaacucuuaaagugcuaaaguaaagcagugcuugcuuauuuaaaaggguguguuaaguugucucugguuuuccuuccuaaaauguguguuuuucugucuuuuugucuccucauuaagaagauguagaugaugaugcagaacacuugaaagaaggcagcaaagacaauccugagccucuaaagugcagacaaguguggccaaaaggagcgaagcgagggcucuccaaguggaagcaaagcaaggagaggaagacgggcuucaagcugaaccuguacaccccaccagagacacccauggagccagaggaccaggugacgaucgaagagcagaaggagcuuucagaggacaagggcagccccguggggauggaacgggaggugacagagaccguggaugccuugcugccucaggaggggagcagaagggaagagacaggcauacccgugaguccacauaaaucaccagguggaaagguagaugaggaggaccu

SEQ ID NO: 7301 - RNA, 17789 nt, Mus musculus
cuuuauuaugaugaaccuuuuauuauagagacagucugaaauuucuucuguauaaagaguuucuguacugugucaggggacuccacuugcugaggggugccacccagcccacccugccucugccucagcggagcccugacuugcuggugccaucucaggaucucuggaaacagcagaggcuaccauucccagggccagguaggucagguuaggccacgcuggauggaggggucagggccucaggugcucccuaauucagagucuuccuguuucccgccucagccuguuguccagaaccuggagcugucggaggaagccugaguugggacagauaucucggugggccugcaccgucuggauggcaucuaccagugucauguucucgaagaucaugaggaaggccaagacaauuguggcagagcgacucacccccauagcgcaguggaccagcacucggccuguaggaagacccaagcuagcguuggccacuuguacccaucucaccuuugggaagaagggacaucucuggucaucccuuccauccaccuaucucaacacuggaaaacugauacugucuucacugucagauagggcaauggaagcucaaggucacacgacaacuuaguauaaggguaaagugagcagcuggaccccuucucugcuccagaggggcuuucucugauagccauugcaacucuaggugagggucaccaaacuucugaaaccccuuggauuuacaucacagggaauauccucuuucuuuccccuggguccugcuugcucccucuugcccauaaagccuuucacuuaugucuccucuccggggugcuuacccaagagucuuugcaaggucuugugauuucugcauagugucuggcuucuuucuaaaggguaugguuaucccagugaucacaguggauggugugagcauguggugugugugugugugugugugugugugugugugugugugugguggugguggugguggugguguggugguacacaugagaguacaggugugcaugcgugugugcacaugcauauaugaaggccagaagucagcucuggguguuucuccucaggcucuguccacuuuucauuuuuugagcuggggucucucacuggccuggacauacugugagucacugcccugacagugagccucagauucccuauuugcaucaguuucagucacucauuacuaugccugccuuuuccauguggguuccagggauugaacccagauccucaugccugcacaugccauccucaugccuaacugagccaucucgccaacccccaugcugaaucuuaguuauaucugaaaucacugguuuccauaauguaccaaucauugacugguaauagccaucugguccuuaaagugggagggccucugauggaguuggugccgugggcucccuacccaucaagacuccuggagaaauaguuccucaucccgcccugaccccaacccaaccccuuccgcagcagcuuacuucggggaauauugagggcaucucugauguaacgagcaacaggcagaaaguggacgcugaggucaaagaagggguugucaucagccucaaugccauaguacuccagagguguuccacgguagaacuuggcaccuguguccaccuggaacuugcccgcagccacauucacaacauggguaaugcccagcuggauuagacgacccuugucucuggcagcauaccugagggaagggcacguggcaaguuaggguaguguguguggggggguggaucucacugcauuggaacuuaccccucacccucuguucuccugcaagugucaagacgaaacagugaacugcccuggugauaaaagcgauccuccagagcagugcuucucagccuuccagacaccacgacccuuuaauacaguuccucauauuauggugacccuccccaaccauagaauuauuuucacugcgacuucauaacuguaauuuuucuacugcugugaacugcaaugugaauguuuuuggagauugagguuugucaaacgggucgugauccacaguuggagagccacugcucugaaccucccccccccugguggggggggggacuuccuggauagaaguuuagcuacaugcaucaaaaaccuuagaaaagcgucuaugcuuuauauaaacacuuuuuucuaggaacagauuaaagggaagaauuuuaaaugugcugacagacauuauauaagccaaauuuaauaauauugaaaaccaaaauauuagagaaagaaacauuuuucuuuuuuucuuuuuugguuuguuugguuguuuguuuuugagacaggguuucucuguguagcucuggcuguccuggagcucacucuguagaccaggcuggccuugaacucagaaaucuaccugcuucugccucccaagugcugggaauaaaggcaugcaccaccacugccuggcagaaaaaaacauuuuuugacagaaaaaaacccuuaaguauaguacaguaauccuuuuuuaucuaugguuuuacuuuuuacaguuucauuuacucccaacuaugacuucaauuaaaaaaaaaaaucuaaguucuauagguaaacuaauagaauuuaaauuuuguacuguccugcuaugauguacccaaggcugucuuagcuagcaguaauaaucaacuuuacaggucuauguagaugaaaccuuaacugagaaguugcuaccacugggcuggcuauggacauguuuccgggguauuuuuuaguugacguaggaggaugcagcccagggugguuagugucauuccuagcaggugggccugcacuguaugagaacaguagcuacgcaagccggcggaggcaaguuaggagggugcauucccucaugguuccugcuucaagcuccugccuuggcuucuccugaugaucaacucuaacuguaauccaauaaaaucuuccacccaaguugguuuuguugucgauguuuuucacagugacagaaagcacacuagaacaaggacaagccuuuuggccaguggauacacacaccauaugcuacuuuaccuguuaauuacuggcuaucgcaguuaugagacuaacaugguaucacgggaaggccuguguucaauuagcccucacuuaauauaguaauuacuccauuuuguuauuauuaguguuacuuaaucuaacuuacaaauuaaacuuuucaaagguauacauuaguaggggaagccgcagcauauauuaugagcuuuuggcaccgguuucaguuugauauccacaggggaacacggaacaaaccccucaggcaaaacaaguuccugugcaucuaaauuaugaaaugccacaaaucacuacaaugugguaaaugcagguaaacaggggaggauguuuauguuuuaucgagaaccugugaagauacaggauauaaaacagaauguuauaggacuuuuuaaauauguagugugauuaauuuuaaaagcuuucuauauaaagcacgucucaaaagcaguauugcaaagcgauggcaguuuuaccaaaaauagcauugugaaaaagcacacgugcacuuuuuaaaagucuacaaggauuuuuaucucugugaaaaaagagaacuacuguuagcuagauauuaaucuaugcuuuaauuuaauucugauuaaguucauucauguauauagauggguguuuugucugcguguauaucugcacaccagaagauggcuuuggaccccaugggagcaguuauagaugguugugaguggcuaugugagugcugggaauugaacuuuggaccucuggaggagcagccagggcucucaguuguugagccaucucccuagcccaaugaauuuuaaauacaaagaaaaaaauuaguuuuuucuauauauuuagucuauauuuucuuuaaaaaauuagaauauguuuauguucagugguauuuuguuugcauguaugucuguguaaguguacaggauccucuagaauuggaguuacagacaguugugagcugcugugugggugcugggaauggaauccagguccucugaaagaacagccagugcucuaaaucuccgagccaucucuccugccccuaucagagaaaccuuggaaacuuuauauauuuucccagcauaccuguacuaaccacuccuaggaucgugauaguaguuaaaaaugggauccgugcuaauggacuauucaugauaccaucacacaguagauuauacaauacuaaaauugagcugcagcuacauaguacauuguguugcacaauuuuaagcaacugaugcuguccacgaaguacacacagauaggcuauuugccacacaaguguggagaccugagcucagauucuuagcauccacauaaacaccagaugcaguagugagcaccuguaaucugccacugcuccugcaaugagauugguggcagagacaggaacauucccgguagcugaugggccaucuagucuggcauguccagcuguggacagugaggcagcggaugugcuccgugcccgccacacgugcccuguggcacauauucaccuguguucacacacaaaaacauaugcguuuauuuuacacacacaaagaaaaaguuuugguuuugguuuuguuuugaggcaggaucucauggagcaugugcuggccuagaacucccaaugcagcugcggacaccacgcccagauccgccuuugacagcuguguaccaucauccucaguccuuaugccaugcuggggacugaacacguggaucugugcuugcuaggcaaaugcuuuacaagcuuagccacauccccagccccaaaagauuuuuuaaaaaaaaucuaucuaucuaucuaucuaucuaucuaucuaucuaucuaucuaucuaucuaucuaucuaucuaucaucuaucuaucuaucuaucuaucaucuaucuaucuaucuaucuaucaucuaucuaucuaucuaucuaucuaucuagauaucuaaugugaguacacuguagcugucuucagacacaccagaaaagggcaucuaaucucauuacagauaguugugagccaccaugugguggcugggauuugaacucaggaccuuuggaagagcccuuacucgcugagccaucucgacagcuggcacccagugcucuuaaccacugagccaucuuuccaggguccaaaauauuuuuuuaaauguauguguauauguguccaccaugugcaugcaggagccuguggaagccagaaggcaucagauucccuggaacugcaguugcaggcaguugugagcugccgugcaggugcugggacccaaacccagacccuuugcgagagcagucagugcucuuaacugcugagccauugccuuaaccacaagguaaauuuuaaauauuuuuugcucuaacuuuagaaggcuggcaaaaggcauaucugaaguauuuaaggcaaaacuagaaagaaaaauaaaugcugcuuuugaauugggugcaaaugguggucauaucaaaugaaauagcacagacccagaacauagcaugcauuugcuaaucugaguagcuccuagguuuuauauagcuauauagcuacauaaaaucacauauguacuacauacauaugacacuaaagcugaagcaagauuaucugguggaaggaaccaaacuagugagugagaaagagaaaaaaggagggcaugugggggggugggggugggcacagcaguacacgacuugaauucuagcucugcaggcagaggaaggugggucucuguaaggucaaggcuaaccuagucuuccuagacaauuacaaguuagcugcagugagacccagucucaaauuuaaaagaaauugggggggggggcgcuggagagauggcucagcauuuaagagcacugacugcucuuccaaagguccugaguucaaagcccagcaaccacaugguggcucacaaccaucuguaaugagaucugaugcccucuucugaggugucugaagacagcuacaguguacuuacauauaauaaacaaauaaaucuuaaaaaaaaaagaaagaaagaaaaugggggagagaauagggaggugaauaagaucaaauacacaguaaagcuugaaaaaucugcuaaacccaucccaauauacaaugaauauacaccaauagaaaugagagaugcaugguagcauacacuuagaaggcagaagcaggaggaucuuuaugaguuugaggccagccuauucuaccuagugaguuccaggacauccagugggacugagucaaugaggacgaugaugguuucagguaggcuagguucacagcucaauuugcagagcgccugccuaguacgugcaaagcccugggugugaucaccagcauaaaacaggcaugguggcaaugcacacuuguaaaaccagcucuuuggaggugaaggcuggaggaucagaaacucaagguauccucagcuacauagggaauucgagccaaccagggguacaaaagaaaagaagagaagagagagagcuuugucucuugaagugugguuuauccacuaaaacaggucacuucuaggauacaaggaauucucuauuccauggccugaaagaugaaacuguauguuuccaaacaaacaugagaaaggcaaaugcaggcagcggugagaagcacugugggccaucuggaggaggcuuauccugguacucccacccaucagccacccuaaaccccuacaugggucuuacuuacgcaucucccaagaaaagguugggccagaccucauugaugugggucaguguggcaguccgacggacccacagcaaucgcugcagagaggccaguguggguggcugguagggggacaccuggacugccccaugaaucuuuggccuccgaaguuccugcuucuguagcgaguccauucugggaacagaguaaacaggacaguagcuggaacaggcuccccaagcguggguccaguggacagggagaccuguguugcaguaccaggagccagugggaugcugugggggccagccucagcuaugcugaaugaggcuauuacccggcucagcuggccuggaaccuagaaccuuuucccugggaacaaggagaacuagaacucucuugucaauuccauggcgcuaagcguaccuuuccugaggcaacggauguuagaaauguuggucuuagggaccguggggaaucucuguagggcuaaucugugcagaccguaccccuuuagucacuggaaaccccagcuggcggaggcucuuggagaggaccuaggaugucccuccaaagccaggcagcucaucuguagcucccacccuggcuguuucuaaggcugaugcuagaggaggucaaagcacuguccaggguuacaguccagccacaagugggcauuagucagcuuguucacaccaagugagcuggugucgcucauaagcaggcuguaucccuugugcuguguuccauguuucacacugacaccaaugacaaaugacaaauggcuaaagacuacccugagcuugauauccagugugugccuucaguucauuccccaagccuuccaguugccagaggguggucaccaacugaugugucuccucuagggagcugucagggaugagcuacacauccacuuacaggccccgggcuuuuuuccuccuuacccuugugguucaggccaguacaccuguacaggccucacccggaaggaguggguuaugucuggagucaucuggcuuaguccaucugggcccuugcagagcugaggugucagaggcaccagaaccugagccugguaccuuagagggaaggggaaccuaccuuggucaacuaccccugguccccucaaagaguaacucgaguagguacagacuggguagaaugccuuuucccucuggcaggcacugccaaaaccagaaaaagagaugggcacccaggaggccacuggcuuggccacacucacccagccaguggaugaugagcuggguggaagagagggccggccuuucucccucaucccccucugugaccucucuggcaggcugaguggccugccaccuaccuagggcauggucuggggccaggaaugggggacuaggugcaggggcaggcugaguggaacaguccuaaagcagguuccauccagaacacaaaugcuguuaugcgccuagaauuccagguccaugcaugugagccaauggggauguggggcaagaugaagacagaccugagcugcggggacaggagcaguggccuaacaucucucccuggugucucugcuauugaaaacacuuguccugaagauggggaccaccugaagagaugccuagggaacagacuccccuuaaaauuugacaaggauauauccugggaccuaggcaaguuuucauuccuaucugggccuuaguuucuuuucucugcucucugguauucugcuggcugcaagagaagggaaugacgcuauaugaaguaacaccagggaaaggaauauuaggguggaggaucucugaauccagggaaguccaauagccacucuggccugaggccaccagcuagacuccuccagcuaugaguggaacuagacagggauuucgggaaaccguaggccccucacaggccugcucaauuuggcaugggguaagucugcccucuaguggccaguggcugcuaggcagcccaacugugucccaggagcucggugguggggauuaggggauguccuuaacuucccuggucuaacucagaccuguaggaaagauuuuucuuagacuuaggguuuccuggucagguccuacuuagggcuauauguagcccagcuaucugcucugguccacugaggguuccuuucaccuaucagagccaggcccagcagcucacucagugagccauuccuuaagcuuuaggcaccccccccaaaagaaagcccagggauucugcuacccccugguguagggagggcccagcuaugucagaaggagccauggcugaaugucuuguaggaucaggccccuguucacauucaugauaguccucccguggcucucuagugcuaccuggcuucuacuucccugaaacuucagcagagaaguugcuucugucaacaguggcuuucuugcccacacugccucuguauacagagcuacacauacuuaccuuuuguuggcacuaguagcaucucuagcuugcucucuguugucugucuuucaguuugucccaggauagccuucuagaauaccacccugcauaccucgggccuugcucagcagccugggacguggcagcuguuugccaccuaccucuuuagcuguaaccucagaacacauuucuccuggucuccucugcuguucccucucugucuccccucuucucuuagggagcacagaccaaguggggcuagcguucucacagaaggacaucgaggugucugggaaagagacuuuggcagguaaaugccaagggcagacugcaguggucucugcccagccugcaucccuggagggagacagaccugugugggagucugugagccugagucuucaccaggagcugcugggagacucucaugacaucauaagugagaugcaccucccagaggcccugcaucagggcaggugccacauaaaugaggcaucacguuauggacauugcuccaaucagucucauccuuucggggcucagccaagaccuauagaggguagauugcuauggccuguggaguuuucaccuggaucucuguguuucguaauuauauucccagcuugaggaaguacguuacagaccagacagagcccaggacucgugucuucacgcugaguccacccuguucucucacgaagcaggcaguaucaacauccccacuuuccagaugagaaaaaucaagccucagagagauaaaagcaguuugcccaaggucacacgguggcgagaggcaggguucugugccucuaccucugacccauuuggagucccccaacccaguccucacaguugcccacacaagcaggcauagaugcccugggccccaguacccaguauucucaggggucucugcuuagggucguucacccaccuguggggagauccugaccgggcuguagucuucuccgacccacagcuugugccgcuggauucuagccgccuggcuccgcacaccugaugcuguuucuauuuuuuuauuugaguuuaauuauaaagcaugcugucgucucccuuuugccuuuccuugccacucccaacuuguccauuggucccauggccuggucagcccuaggcucagccagguacuuccuccuuaaacccaggcugugcaacuguacccagcaaccccauggcugaggcccaaaccuauccucacccuuucuccuuguacauguauccuuaauguucaggauacaggaagcucagaggguugccugcggugugugggaugaguguauuuggguagcuggguggggaaaaggaaaagcaagcaaaccaccuuaaaaauuccccuuagagccugaaugguggcguacaccuuuaaucucaucacucaggaggcagaggcaggggcagagacaggcagaccucugaguucaaggccagccuggucuacauagugaguucuaggccagccagauguuuuagacagucacaguaagacuuugucuaaaacacaauacaacaaaacagaaaaccaccucucuaggacuggguggugguguucaaugguagugcacuuaucuagugugguugagacccugaguaccauuccagcuugccccaaauaccucccaacccccaaaucccuuggcuuucagagguuacucaaaacuagggcagagauaaagagcugaugggaucuaugcuggaagacacagaugagacuaugucaaagcacauacuagaaggacaucagagcauaggucuaggagccucuauuucagggugagaagugcaagcucaccaucuggcagguuccggucaggcacagacagacagacagacagacagagcauagacagacacagcugucaagggacuauggagcaggucugugcacucaguggcuuuuauccaggagcagcucucccuccacugcccucugucucucccucaaagacaggugccccaggggucugccuagugagaggccacuggauuugagauuaaaaaguauccuuuuuaauccagaugcucuaaucauauacccauacaauaaugcucucuagcacuaccagauacacacacacacacacccucagccuuauguccacugaacuccuugagccucagggagagccggggagaacacugagaaccauucucccugacccuaucagaggacuuggggacccugucacaagagccucaaagacuaguugacagacagcccacucccaccuguggaaacugaagacaguggcugagagggcacguggaaugcuggaggaggcuguuggaguggcggguucgacggugagcgccacgcugggcccuuuucaucuucugggcguccacuugggcuaaggcugccaucagggccagggcaagaguagcaaacuggcagagccuggcggcagagcggaaggacuggcucuggaggagagagaaccuucacacuacaggcagguaaaugaaggccuaggcuggcuggcacuuuaggacaggagcaagggcuguuaccuaacccuguaucugucaccucuccguucucugccaggcugaauggguacacguacaaggagaaacugugaggguuggcuugcuaucccuggcuuauggagagagauaaccccacuucacagcccccucacuucagggccucagccaugggguugcuggguacaguugcacagccuguguacugcaaaucucugagggcccucaugacacggacgauucuguggauaucaugacaaauugugcaauguugcagcccugcucaacccacuucccccaaagcagcugucugaugggcaagacacugaggucagaagucagggugucugauaucccaggcuaagggagcagcaugacagggcaugcuguaaaaucugcugcucugucacgugucucauuccugucugggggcgggggagagcaggcugugaaugugccaucuacauggggaacacauccuuggucacuaacaccagcacauuucauaggaagugugcgacaaugcagccugguucugugcucucugggaauuugguaaguccuauaggcucucaggagauacugggcagcacucaaaagcaaguauacauauacauauacauauacauauacauauacauauacacacuauauauauaauuauauaucauauaucacauauaauauauauaucaacauauacauaccaucuaucuaucuaucuaguauaugguauacaugauauauuagauaucauauauaguauaucauauacauacauauauauauauauauauaaaaugugcauauaucacauaagacuuccacuaacuuuuccuuccucgucuuucucuuuuauccacccuacccccacaucuguguguguguaugucuuugccuuauaccauguuugaaauagguuaucuuguuuuuuugucuuccauuucauaugucagguccacuaacucccagggacucuucugugucucccucucaucccacuacagguccagcuguauucgagcuuggagauucagacucaggcucccauacuuguguggcaagcgccguaucugcugagcucuucuaucucucucgauucucuggagaucuaaugaauccaggugggaagcuugccugccuggcucgggugaaaucuuggauggacaaggggagaccagcaccuugcuacuucaggcacacacagcccugcuaaucaguuucaucucagguccccuguccaggcccucaacugacaucuugcucccaaccacacucagcuuugcuuccuugaccugccuuaccuggcuccuuagcucugaccugcaccccgaaguugcugguccagcuggcagagcugucggaggaagccacgauuggggaagauccaucggcgcucccucacagugauuauggccugcugcaaggacagcugcugguggagcaugagguaagccaggaccaguguggcagaucggcucacacccaccacgcagugcaccagcaccuuagcugaggaagacacucagaugaaggacuccucucuacuagccagcccacccaagguccauucccgaaccuguguuggguguaucaugguguaucaugccuggggcaaguuccucaaucucuuaugggccucaguguccugaucuuucaaauggguacucacaucuguuuugcuaaagucuucaguccaaacccucagcaugacuuacagaacccuuugagaccuagccauucaucguccugcaccuuaccucagccagagccuaccucagcccucagcccuaggaacacaggcugacuugcaguuccuuggcauugccaugaccucugacccuucccccugaucuuggccugacuagccuuuacucauccagccagucucaucucagacauggcuuccucuaccagcucuccccacuacugagggugucacuggaaucacaaagccauuggcccuuucugcgugugucccaaggaaauuguuguggagggaaauccccaacaccacgguccucuggcuugaguguuuguggagcucuucaugucugcucucucauagcaguaacauucagaauacaucacuguuugauuagcaagcccuacaagaguagaugcccuggcuuagucaaggcuggcuucuuagaacugaguucuuuccuugacauggggugaauaaugaccaggugacagaugaauggaugaaggaaaaaaaaaaacugucaaagugcuuuggcuauuacaaagcaacgugagccuuaccaaauuccucaucauaaaaacaucagaggaaacagaaacccagagaaagacacacuggcuuguccagggucacagagccaaggggcacggcuguuucccaagacaagggcuccagccucuccagaccuauugcaucuuggguccuaccuccagguacggugagggcucgguggaugaagucagcugcugaggagaaguaggggcugauauugaaaucagggaggucgugggcugggauccccagguagcacacacugcugccguagaagucaggaccccccugacaguagaguccuccgugggcggcauucagcacaugggugauccccaacuuccacagcucaaaucgguuauuugccguggcccugagaagggcagaaagggggcuggauuugggcugagucucuggguccugaaggaggcuuguuugacucugcuuugggaagggugaaaccauaaggguaaaggcggagcuagaaaccaucauuacugagcggagucugcaaagcucuccgucccagccucagggaguucuguugguauaguuggugcugcaagggacauuuuugaccucuuuuguugucucaggcagccugcccccagcaaaggaaagaaggaagagauugcuucaguccugagaacuagcugccccucccuucgugccucguguccuacuacucauaaauaucaucuagaucacuuagucaccacgucuaccaaucuacaaauauuuagcagugacaccuuuucugagucauccuaagucaggcuucaccacccauucaguguccacugguggcaagcugggaccagaaaguaugaucuaugucuacaccauuuuauauuccaaacguuguugguuuacagacugucugguuaguugucuuaagaugugccugaagaccccagccaggaagucucucagacccgcccccgacaccccuccaaaaaaaaaaaaaaccaaaaaccaaaaaccaaaaacgcucgggcucccccuaguguuagaaacucgucaccaaaucgcuccuggaacuuaggagucaggagaaaauuccuggccuggggcagguuagaagcaacuaguucuguugcucuagccaccuccucagguaaagauuucaaggauugccacgucuugcccgacuccuacaacccugucagcagccacucacgcaucuccgaugaaaagguugggccagacuucauccacucuacuacaagaggcucucccggcccucaggagcuccucuagcugcaggauacuggggcaagguguggcuucuuuuucuuccccagguuuugggauggaggcaucagccaugggccagccugccuaccccucugccugcggucaggucugcucuccugugcuauuucuccuugccagagauuggcauugacaggugggacaaagugacucagcaagucccaagggccucugaacgcugcaagaccuauuucccuugagcugacucccaucccuaaagucuccgagaacauggaguuggacuccuacaagucacgaucucucuccaccucugucaguuccuucuguaaaguuaaggguuugccuguccuggggaguuguugcaaggguuaaacuaaagguucacugcgucuaacauagggcaagugcuuugaaauagguucauucguagguuuagagccugcauagacggguuccaaugacaagaguuaaagcagagaaaagcacugaggcuugaaugucagaaaagacucuugcaggucuaagugggccacaaacagggggggacaccgauaucggcugcauuggagccuuuggauuguggaacacaggggaccuugucagaguuguggagucacagaaacuuaggcacacagggaggaaagcaucugacgugugcuguaggguucacacagaacggugguucuauaaugaagauagcagauuuuuuuuuuuuuuaagagaaagcugauggauccuuuuaugucagagaggugaucauugcccaaggcucugagaauaaggcucugagaaucuuuggacacuagaaccacuuuuuaaacauuauuuuuauaauuaaaaauauuuuauugguacuggagagauggcucagugguuaagaacacagauaauacaugcaggcaaacauuuauacauauaaaauaaguuuuaaaauuauguuugagugccuacaaauauguaugugggccacaugcaucccaugccugcuguauccagaaaguggggguggggggugggucuccuggaauuagaguucuagaugguugugagguggcauguggcauugaacuugaggcauugaggugaaaggguauuaaaccugagucuccagcaagagcagcaagugcucuaaccacugagcaacaccucuaccccuauagaagcacggggacaagagaguucucugccuacaagggcugcaggagaugagauguuuugcagugucauggagcccuugaagguucugagcauacuaggcagauuccuggcugccccuguucuccuccuguccaucuuagaaucugcccccuucucccucagaacuaccaaagccgguccugcauuguucaagaaaguagagucaaagagggcugagauuucaagcugcagauggcuucagacguggauucugccaauguuaggcuugcuuuagaaggggauauuccguuaaggugggguaugguaguagcaggaaagaacccagguucugucugagguuagcuugggcuuggguaccagcuuggauuaacugugcuacgucaggcuacaauguuucuugaccuuucuaugagaucuacagaguugaaacaaugauuugaaguauagucucuagcacaguacaaaaucaaggggcaauaaacggggcugggcagugguggcacucgccuuuaaucucagcacuugggaggaagaggcagguggaucucugugaguuugaggccagccuggucuacagagugauguccaggacagcugaagcuacacacagaggaaccuugucucgaaaacaccaaagguggaaaaacaaauaaaugaugcaacuugaggacugacugagaagggguuugccccuucaaagggcucaggauaauagccucuuccuaggcuccaaccccagucaacaacccacaagccuucuccuaucuucauuaaaacccuuugaugaauuaugcuugggcaugacgcaagcgcucucccccucccccuuggguuuccccuccucuuccgguuuuggacccgcccccuccccguagcgccccgccucccgaagcaguuccgguucggcuggccgcugcuggcggcacggcuccaaaggggccggagcgaugcccgcugguagccgagccggcucccgccugcgcuccggcucccucccccggccuucgcgucugacucucaaggcgcugcgccccgccuacgcgccgaggacccccgacuccaacggcgacuuagacaccggcuccgagcugggucccggcagcccggcucccaccgcggaggugagcgggcgccgaggcugaugagaggggagauuggggggcgccugcaaccaagggugaguggagagucgggggcgccaagggccgcggggagacgguuggggaagccaggggaggccgcucuggaauggaauccggagaaaaucaggggguugagcugacccgcgggcaacaagggacgaggcgcaggggcuggguccuugcuacccggcuaggggagaaggaacgugcaagagggguccccggaauccagaccuggaggaggaggugcccuggguuguagccauagagaugagggauagggagagcuggccccgggccuccuguaacccguaacccgcaugagggcgaggcagccggguggggacugacagccaccugacucggugggaaugguggcug

SEQ ID NO: 7302 - RNA, 48198 nt, Mus musculus
cguagcgccccgccucccgaagcaguuccgguucggcuggccgcugcuggcggcacggcuccaaaggggccggagcgaugcccgcugguagccgagccggcucccgccugcgcuccggcucccucccccggccuucgcgucugacucucaaggcgcugcgccccgccuacgcgccgaggacccccgacuccaacggcgacuuagacaccggcuccgagcugggucccggcagcccggcucccaccgcggaggugagcgggcgccgaggcugaugagaggggagauuggggggcgccugcaaccaagggugaguggagagucgggggcgccaagggccgcggggagacgguuggggaagccaggggaggccgcucuggaauggaauccggagaaaaucaggggguugagcugacccgcgggcaacaagggacgaggcgcaggggcuggguccuugcuacccggcuaggggagaaggaacgugcaagagggguccccggaauccagaccuggaggaggaggugcccuggguuguagccauagagaugagggauagggagagcuggccccgggccuccuguaacccguaacccgcaugagggcgaggcagccggguggggacugacagccaccugacucggugggaaugguggcugguuucgcagggcgggaguuaggguugccuggaaagagggaggugcugucgggugggaaggagcuuggccuaaagguuagagaggaaaaguccaggggaaaaaaaggagcccuuggggaucuaauuuagggccuuggcuuuuuuacagguaagugucuuucaaggugucaaaaaucucuggguaguggaugacggcuuuggggcuugccuguuugugaucccuuuaagaagcuagauugcgaggggcggguaugcaucgcugauucucguacagggacugggggaggcgaucggagagaggaagugauguucguagaggguagugauuugugaaaauaaagaugucacucagauuucuucugacgcgagugguuucuucuccucugugcuucguuuuuaagaagguucagaugucaggcaaguguaagucuuuaguacauuaccuuuaaauuaaaaaaauuaaaucugcaaggggaauuuggacguuuggauuuuacagauaauucagugcgaauuguuaacacuugaauacagcuugaguuggcccgcauauuggccacaggguggaaauaugguccguggaaauucuuggguuuaagaggucauuuacgacaagaagugaagccacccauaguccagaauccuacaagaucguccccauugguaacucgaggauuggaguuaccucguacaaaauuugaaaggugauuuuaacagcuuuuucaggaucaguauucucuugcuauuuagcagauuuuuuccacaugaauggaauuuuuuuucuaucgugaucaagaaaccuaaagguagcaaagggagguuauaguuggcagcugacaaaagaaauguguaagcacacaggugcuuuuucuggaagauguaguaccaaagcuguaacucugccagaaaaauauugaucccaaaacuuuuugaguucauauaaauaagaaaugguaucgugacuccuuugacuucuaacugaggcucauuaaggcuccuugcagcuuaucagauagguuuggcuauguuguugggcauuucaaaaccaacuuuuaauuauuuucuacuuucaacaagccucuacugcuccauccucacaagaugaccaucuacuguggcugcaacaagcuuuuaaauugcuuucugugaaugggaccuuaauaucagacuggcaaaagcucaguggauaauaauuuccucaaagaauaggaaauucuuuugcucuucugaggcugucagaagguaggguucuuuaguaaagaugaucuuucgaugaagaauuuuuauguagcguugcuguuuguuuucccugacauacugggaaccuucaaaagaacuuguuuuuguauuagcgcucauuuuuuuuuuuuuuugaagcagucuugauguguaacacaggcuaaccuuuaacucaggguuuuccugaguuagcuuccugagaguuuggacuacagacaugaccuaccucacccagccaaauuuagcugaguaaaaauuuugauggaugaaaguuuacugaacuggaauacaaaaauucugccuaauauuaugagauuaaggagagaaacuguuggaguuacaaaauuaauggguaaugguaauaaaauuauaccuaaugauggcuguguuuucauuuccguuugucaguucucacagccaccuaacuguaaagaaaaugaguuuuacuguaaagcagauacuguaaggcagaaagugccuucccagcugcagcugcagaauuggcaggugcaauuagagaaacacuucaguagcaugcuccucauucugcagggcugcugguccugcuacacugcugccuguaaaugccuugguuuuggugucaagucuucaguauuuuaaaacuuugcuagcugaccuagacauuguccugacucuucucagaucuaagguugaacaguuuuugggaaacuuguuaaaucuagauguuuuaauggauguuguuauuauuuugucuuagaaaaaaugccguauuaggcuguaacuaaguguagaguguuuacauagcauucaggagguucuggguucaaucccaaguaguuggaggaggagaaccauauucauuagcuuguuaaaaaaucuucuuagaagccugauguaauauuugccauuuauuaguaguugugacuagcguggcuguuuacuuaaaagaugucuuuucugucuucuaauuuaauuuuaaagguuaacuauuacguuuucaugguauguacuagauuaugaaguuuugguucagaauauucuguuacauugacuagcuuuggggagagagcuuacaaaaauaaagauuuuaaucugggcacuaugguuuauuacacuuaauccuggcacucaggacaaacugagaggaucaggagucaaggccagccaaacucaucccuaucucaaaaagagggggagggaagucaguugauaguuuuuuucuagugugcucgaacucugaguucaauugacaguaaaaaauaaaaauaaaagacgugucaauaugucaaacuaccagcccgacuaagaaucaagguuuuguagauucagcuuacuuaccugugugcuguuaccaguguguuuuaggucaggaauauugcacuaaguuucccacgagcuuuugauugcuaucaaacuuuucguguagccaaggcucuaaauuugccacuguugucugucacauuuucuccuucucuauguggauagaacuagguacaacucaguaguaguagcucugauuuaaaggucugaugaagccagacaagacuuauguuucuuuaauauacacgagaacucuugaguaugcuagugcaugcuuaggacagcaaacaacagucucagaauugagguucagccaagagggugcugacgaaaggcagggagcaggugcagguccccgcugucgccuggucggaggugguauucagguacgcuaaggccggagugcuggagguaggaauugcuucggacucucugcagcuguuuuacacugcugaguuccuuccuaugaaguaguucagaaaaagacauccucggcucgcuaagaaaaguaagauuucuuuggauaaauuuagaaaguuuuuauuugcucaccgaaaauguuauuauuuagaguuuuacauauuucaaauggaauagagaaaagcuggagaaccaaauuacuguuacagaguuguuaaucaugaaauuuagauagaaaugcccaaagugugguaugguuuaugguuuuugcuuuuguuuaugaaucuaauaauuguuauaauuuguguuuguugugugcauauuacauaggcuauauuagguuaaauuggaguugggcuuaguuuguccugagugugguuuuuaaaaauacuauuuauuuccuuauauuuacuuacuuauugauuuauuuugggagggagugccaggcgagccauggcccggguguggaggucaaaaggcaauuugaaugauccguucucuccguccacuguguggguccuaaacacgguugucagauuugccaccuuugcccauugaaccucgccaguucacauugauuuuguuuguuuguuuugguuaauaaauauuaugaauuuuucuugaauaauuuacaaucauucaaagauuaaauaaacauuuuauuuuuacagaaauaaaaguaaauuuucuagcagucauuucugguguucauuuuagcacucucagguuguuugucguagcuggagaaugaccaccuuacaaguggcaucucagucccuauaagaagccacucucugugagagaacccagcccuacaagaaaauaguacucucauuauuuuguuguuccaaagaaagcuugccaugcuaaugaccaacuccagcuuucugucuuuuagauguaucucuaccauacauguacacaguuaagaaagguuuaaagagugaaucgcauguaagagggcagccacaagacagugugaauuaugcaaguuuucccaaggaauguauguagagccaaagccguagccuaccaauguauggauugaaaagcuguguguggcagcugguauguuggcucacaccauguuagucccagcacucgguggcagaggcugguggaucuucgugaguuugagcccugcuuuagaaauugaguuccaggacaaccagggcugguacacagaugaauguugucucaaacaacccaaagaagaagaaagaaagauaaaaagaaaacaaguaaagcuauguggccguucucuuuucuaaacuuucauuguuacuguuucccuaaggaaaguuuucuuuaguguuagggauccaguucaggccuucuucaagucagucaagcauccuaccaggaaaguaggacuuuuacagcccuagaaguguauuagccuuauuauuuacucagcuuccuccccuucaguccccccccccccgccccaaaaaggucucaucccauagaucagaaucucucagaauuaagggcauguucugccacacccagcccaguccugaucauaauuuugaagacuguuguccugccuugagauaugguuuuuacuuuuuagcuuuuuggguuuuuuuucuacuuguuuuguuuugagacaagauuucauuuuucuguguagcccuagcuguccuggaacuugcuuuguagaccaggcuggcuucagagagucaccugccucugcuucccuagugccgggaucaaaggcaugcagugugcaugacugcuuggcguuuuuuauucaacaccacuuaaaaacaauaaaaauuuuaaaacuugaguugauuaucaaaacuugaguugauuauacagcuccucaggcuguggggaccuccuaccauaaauuauuuuuguugcgacuuuguaauuuugcuucuguuaugaaucauaauguaaauagcugguaugcagauggucauugacccccuuccgagggucaccccccaccccacuggugagaacugcugauuuagggccauuugauuguacggcugucacagaaucuaaagguaaaggaugagugcuucaugcagcuguaauucaguguuuuaggggauucuuguacacauuuacacagacacacuugagaaucuuacaagaaaaauccaucagggcugaaauacauagcucaguggcagagcccuugucuagggugcugcuugaggucccagguucaauccccaguacugcaaaacaaucaaagaccgagcacauuuagaucgccguagcuaccaucugagcagagaaauugacuuuuguaaaacugagcagaucaagaguaagaguuugauuuuauugacgugccuucucuauucuaaagauugucuaaugauaaauuagaacccauguggucucuuguguauugauauaguaagccugguggaguuuuguaucuuuuuaguuaggagugccugucauuuuucagaaauuccuguuucuucccaaaguguacuuuuagauaucaacaacaaucaauugucuaaaauuuguauuuuuauuuuaauuaaaaaaugcuucaguuauguguuugugagguauagagugguaauucaauguauauucauaauuuaugaacucaaaucagcagguuaguuagcacuuaguacuuguguuuaaacuguaugaguguguauguguguguguguguaugugugugugugugugugugagugagagagagagagagagagagagagaaggcuaagguuggcgguggaugucuuuaggcacuucuuuaaguuauaguuugagacuagauagcucacuaagcacauagacaggcuggcuagagagcuuaaggaauucugcugucccucccagcccacgcugggauuacaggcaaacacugcugucuguauguggcuuucuuaugugggugauuggaucucaacuucccucauguucauguggcaacuguuuuauugccugagcuaucuuuccaguuccccaugacuuuaaacauuaaaaauggauauaacuuaaaauugcacauuuuuacgggaugcugugucuguguguugugugugugugugugugugugugagagagagagagagagagagagagagagagagagagagagagaaggcuaagguuggugcuggaugucuuuaggcacuucuuuaaguuauaguuugagacuagauagcucacuaagcacauaaauaggcuggcuagagagcuuaaggaauucugcugucccucccagcccacgcugggauuacaggcaaacacugcugucuguauguggcuuucuuaugugggugauuggaucucaacuucccucauguucauguggcaacuguuuuauugccugagcuaucuuuccaguuccccaugucuuuaaacauuaaaaauggauauaacuuaaaauugcacauuuuuacaggaugcuguguguguguguguuguguguguguguguguguguguguguguauguguguguguguguguguguaagcagaaucuuuuuuaaaagagaaagcuguuuuggggggguguuuguacacuccugcauuugcgacaugugcucaugaagccagaggaagagucuugugcccuguuucaucacacucugcugugcugggcuuuuuuuuuuuuuuuuuuuuuuuccugugagaguuucaaaacaggguuucuuugugugccuaucuuggcuguccaggaacucacucuguagaccaggcuggcaucagacucagagaucugccugccucugccucugccucugccuccggagugcugggcuuaaggugugcugccaccugguucaguauugggguuuuaggugaguguuggacucagguccugacguuugcacagcaagcauucuuaacccacugagccagcuccccagcucccagugugauuuguuuuaaaaaucagaucaagguaacuaacauuucugucuccuuucuauuguuaguugcuuuuguuuguuuguuguuuguuuuucgagacaggguuucucugugcagcccuggcuguccuggaacucacucuguagaccaggcuggccucaaacucagaaaucggccugucccugccucccaagugcugggauuaaaggcgugcgccaccaccgcccggcucugucuccuuacuauuacaaguauuauuuggugguguggaacaccucucuuaugauuguuaauaaaauacauaauagguuaauaugaacuguaguaaucccauucugcuaacaaacaaacacuucuccuuccucccccuccuucccuuccuuucuuccuuccuuaaucuuauuuuauuuuauuugauauaauuacauuccuuccuuccuuuuccgucuuccaaaccaucccauauacucuuacuugcucuuuuugaauuucauggccucuuuuuuccuuaguugauacugcaugcauaagucuggauguauguacacguuucuaaauauaacuugcucagucuguauaauguuacuuguaucuucuucccuuuuauuggucugguagagacugaauucaggcccuccaacaagaagcacucuaucucucugagcaacacucccagccccagaacugcuacuucugucuaucugguuuuggugaacauauuagccagccucccuuuaucuuccucuccucccuuuuccagacucuagcggucacuggacuccaucaguuuggcuucuuuuugauuggggggaugggggugggugggaggagggagggaggcaggaauugacugccuuuaugccugacuugcuguacuuaauguaauauccucuuguccacucauuuuagugaaaaugauugaaacguuuuauuuuuuaaaauaccauuuuaauucuucgagaguuuaauauauacauacaauguauuuugaucauauucaccccucauuucuuuccaugaacccucccagauccacccccaccaccccacccuccucccaguuuaaauucuuuuuguuguuguuuuugaaaaaaauaaccagucuuguaguccaauuugugcugcccauauacucuuggguauaggagcauccccuggagcuuuggccuauggggccacacccuuaaccucacacacacacacacacacacacacacacacacacacacugaaacacuccuucccuagaagccaucagccuucaauggcuucucagcgugggauggugcuuucaagccucucccggcuggaguggucaagcuugccuuugugaagggaaggcacgaugacucuaugaguccuuaaguguagcaguucugucauauccaaaaggcaguuuugcacuuguccuuugagaccucugguucuuaaucuuuccaccucuuccaagauaguuccugggccuguagggagcaggcuggcuauguggcuaagugcuccacagacucuuugcacuuugacuaauugugaggugguugguugguuuguuuuaauuaacugcuauccacugcgcaaaaaaguucucugaugaagcaugagaacuauguauuugauuugagaaucccucuuauggcaucuggacuaacuagagacuccugagcuccuccaaccucagcgucuuagugauugguuucuguuuguuguuuggcugaauuacacgccuuugugauucucuucaucuuuugauguguuugauggccaucuagguugauuuuguuuuuaagcuuucauaauaaacuuaaguguaaaggucuuucuuugauaugcugauaucauuuccaaugguuguaguguuaaucagauuuccauuucuuuaacaauaucacuuauagagaugguuuaugugacuugugguaucagauaguugauagauuguuggcccuguugcuuuuuuauuuuuauuagguauuuucuucauuuacauuuccaaugcuaucccaaaagucccccauagcccccccccccacuccccuauccacccacucccauuucuuggcccugucauuccccuguacugaggcauagaaaguuuguaagaccaaggggccucucuucccaaugauggccgacuaggccaucuucugcuacauaugcagcuagagacacgagcucugggggguacugguuaguucauauuguuguuccaccuauaggguugcagaccccuucagcuccuuggguacuuucucuagcuccuccauugggggccccguguuccauccaauagcugacugugagcauccacuucuguguuugcuaggcccuggcauagucucacaagagacagcuauaucaagguccuuucagcaaaaucuugcugguguaugcaauggugucagcguuuggaggcugauuaugggauggaucuccggguauggcagucauuagaugauccauccuuucaucucagcuccaaacuuugucucuguaacuccuuccauggguguuuuguucccaauucuaagaaggagcaaaguguccacacuuuggucuucguucuucuugaguuucauguguuuugcaaauuguaucuuguaucuuggguauucuaaguuucuggauuaauauccacuuaucagugaguacauaucaugugaguucuuuugugauuggguuaucucacucaggaugaugcccuccagguccauccauuugccuaggaauuucauaaauucauucuuuuuaauagcugaguaguacuccauuguguaaauguaccacauuuucuguauccauuccucuguugaggggcaucuggguucuuucccauuucuggcuauuauaaauaaggcugcuaugaacuuaguggaacauguauccuucuuaccaguuggaacaucuucuggauauaugcccaggagaguuauugcggaauccucugguaguacuauguccaauuuucugaggaaccgccagacugauuuccagagugguuguauaagcuugcagucccaccagcaauggaggaguguuccucuuucuccacauccuccccagcaucagcugucaccugaauggcccuguugcuuucuaagguguauagagaaaguauaucauaacaaggaggguggcccagcaagcuguuacaugugccuggagagaaggccuggguaaggaggagguggacuccacaggcagccccucccccagcuuaaaggcagauacaaaguauaacagaaaacuacuuaaaaguggagguuuuagggguuuuuguuuuuugagacaagguguuagauaaccugagcugaccuugaauuuauucugucacugaggagggccuugaacuccuguccuucugucucuaccuccagagcgcugggacucugccacaacacauggcuugcuuuuggauuuuuaaggcaccuucauagacauuuuuguccuggaacucauucuguagaccaggcuggccuggaacucugagacccacaugccucugccucccaggugcuaggauuaaagguccagccaccuuuauauaguucuugauacuauauuauuuauguccccauccuccccgguguuuguuuguuugggguuuuugauacuaaaucauuacagauggaguagauuuauauuuucucgguuccuuugauuucccauggucggguuugagccugggcccucuugcacacggcuaauccuguguuauugcccuagcccagugcagcguuauuuugagaccagcucucgcugauuugcccaagcugucugugaagccacucugaagcucaagguccuugaaacucaaggcagacacugagcuuuccauccucccaguucagucuccagccaggcacgugggaguuacagccgugcaccgugagcugaguuccuaggcaggugcugagguaacaagcuugguacucuuggguucauuuguuacuaaguuuuuugaggcauuuauaauauucuggauaugacuccuuuguuggcuaaguuacuguuguguaaauugucucagcacuaugguggugguuuccuuugcugugggaagcuuauuagaugcuaccaucucauugccuuuugcuuuuguuaccuguguauaccuuuaaaaauguuagugauuuauucucguaauuccagcacucuggaggcagaggcauauagaacucugaauuggaggccagccuaguuuuccuaguaaguuccaggacagccaguguuaugagacaccucaccccccaccccaccacacacacuguugguaagugcuaggaguauagcuuggagauagagcauuugccaguaugucugaggcccuggguuuaagcuguagcacugaaaagaauuuguaaguaauacuacuacuguugaaauacuuacuuacauuucauauuaaauguuguuguguauaaucuacugguuuacuuauuugucuguguaccuauaugccccacacugugacauauaccacagccuccuuuuggagaucagaugacagcuuucagcuuuuguucucuccuggcaugugguuccugggugucaaacucauauuugugccaucuggcuagcuuggaggcagcacucuugguuuuuuugagacaggguuucucuguguagcccucgcugucuuggaacucacucuguagaccaggcuggucucaaacucagaggucugucugccucugccuccagaguccuuggauuaaaggcgugcaggcuagucucaaacugagagcuggacuugccucugcuucccaagugcugggauugaaggugugcacugccacugcugcugccaccgcccuagccaccaccucugccaccaccuggcuaaggagacagcacucuuaaccauuguucuuucuaucuaaguuuuauaucagauucuguuggcaugcucucucaaauuuagcucccuacccuuaguuuauucuacugggcauugaacaguuauacuagaucuuaggucacugccaguguuaacauuguaaguauucuguccugcugauuaccaaagugauguguucagagccucagauaacuguuuacgaucucuugguucucccuggaauaaagcugaaagcauuuugaguugcagguacaguuaauaggggacagaguuggucuguaguuaugguuugcugguugacucagcuuucuguaucuucuauuaguguuuguagacauacacgaauuaucugauuuucuguuuauaucuauuuaagugaaguauacuucacugaaacuaguauuuugauuuucuaaaauucuuuuucuuucuaaucaucaagcauuacauacuaaacauacaaaacaaacuuuaaaaaguuagagugaagagcccacccuaggaauaacuauuaauaguuuuuaauuauuuauuuuuguuauuuuuaauugugugugcaugcgugcacaugugcaugugagugcgggagccuguggaggcuagaaugucagaucuccuggagcuagaguuccaggugguuagaagccaccugauuggguaaugggaaccgaaucuggguccuggaagaacagugcaugcugugacuccagcuucucguacuuuuuucaaacuagaaaaggcaugccauuuucaguuuguaguucuuuaaagaaaaaaagaacuuuuaaacuucuuccuuugaaauauugacuuacagggaguagcaaacccuuguuuuguuuugugugugguuuguuuuuuuaaagauuuauuuauuuauuauauguaaguacacuguagcugucuucagacacuccagaagagggugccagaucuuguuacagaugguugugagcugggaaucgaacucacgaacuucagaagagcagucagugcucuuaaccgcugagccaucucuccagccccuguuuugguuuuaaaaaguacagaaaacccaucuacuuuucugcuguagucauaucuuacauaacuguagaacaguaucaaacaggaaacugucauuuuaucaagaauagauucuuauaaccauuguuccaaucccagugaaggguuguuccuucucuuccaucucucuaauucuuggcaacaacuaaucaauuccauuuauauaauccugucagguuaaaaguguuccaucaguagaaccacacaguaugugaucuuuugagacuggcuuucccucaagucuaaugcccuugaaacgcacacaaaguauugaauauacaauaacucacucauuuuuauugcuggguugucgacauggaaucuuuugguuucuuggacaucucaacuacuacaaauagugcugcagucauuugcauguaggaguuugugucagcauauguucucauuucuuuggaggaaauacucaggagucuaauugauggguuauaugguuauaugauagauguagguauaguagucuucacuguggcuuaaacuuucugauguguuccauacugaccuauaugagaccuugccuuaaaaaagaaagaaagaagaaggcagcuauuguuaagauguauuuuauuauuuucaguuguguaugugacugcaugcaugcauacaaguguaugugguaauucuagagccaguguggguacugggaacaggacuuggguccuuuggaagaaaaggugcucuaaacuacugagcuguaucuccagucccaaagccaacuguuuuaauaagcacuccaucuggguaguuauacuaaucaccuuaucguccaggguuuguguuugugaccaacuguuagcaucaggaaccggccuuauaguugcaggucgccucugaauccggugaugaaggugacaucacccacaggcaacaggaacucuugcaucuguugccauggcaaucgccaugcauucccacauucccagcaucuuccuggcuuaccucccacccuuaccuucgagcaguuacaucacaaccuaaauaaaaggcagacccuccuaaccucuguucuuuuucccccuucaucuuugccaccaccuuuugcccccuucccccacaauaaaccucucucacauggaacuguauuggccugguguggucugucugaacacgagccucccucgauucuaacacaacagcaaccacugaccagaaauccgccugccucugccucugccucugccucugccucccaagugcuggaauuaaaggcgugugccaccauugcucggccagaacagcggauuuaaaguugguguuuauucuaagcuguucucauuucauuaaggagguaacuagaauaucauagaaaauaagaugaacucaagcucagggugguggcuugucuguacuagcacaaguuaggccggagaagcacagaucagaggccaccuuuucucaccuaugauucuagcauuuggguggcuaagagucaggaauucaaggcuauccuugguuauauaguggguuaaaggagauccuguuucaaaaacaaauuauaucucuuuugaguuauaugaauaauuuagauaaugauguuuacaaaacccuacccucaguuuagaauuaaauuaucuuuaaaaaaauaaaacagacuucaaguuagauuuauuuuaaccuuuuuuuuuuuucauuucacaaagauagauagauagacagacauagaaacauaucaucccagagguuggagaaaugcucuuacagguagggugcuugcugcacaagucuggaggaccugugguggagggcaccuguaaccucagcguuacacuguugcgaguggaggcaggauggguuacuggggcuuacugaccaccaucucaguuuagugagaacaagaugggaagugauagagcaggcuaucuaccucugugauggagcaggacaucucugcacacacaguugcauguaccuccccuccccccaacaaguaaauaaaugcauucuagaaaauauaucggacucaagcugagcaugguggugcucacuaguacuccucaauguggagcucaucuugggcuccuagugaggccugauucaaacaaccgaggguggcagggauugaacucugaacucuuagucagcaggauuuaaacuaaucugaucaguagagaaacaaauuuaauuaagacagccgaugugcucaguaagucuuaacuguguauccagaguacguacaaaagauaguguuuuucguugcaugcuauacagaacagucagcuacuuucauuuuaucuauuaucuauaacuuagaaugaacuaagacugccugauaguccaaggcugagugcaggaguggacuuugugucuugauaagacaguuuuaaccuuaguugcaggauuucuuaguugcucaugacuucagaaugugcguuuaguuuuuaucucaaauugcaaugcuucacuuauacaugccaguuaacacuucagccccggggaucuuggggauagagcccuuggagagaguacaggaggcugggguucaguccccaguaguaccaaaacaaaauacuuuugggagaggaacuugcuuugugugcagugcucuuaaauguggauccagaugccaaugguguacaugcaugggauuacaguuagugugcaucggaacgccgagccaggcagggucacucagugaggcucagcagcacagccaaccacagugaaucaagauggaaugaugucauugugcuaguguuuagauaacuucuugggagucuuugauauauguauucuguuuauagaaaugcaaccuguggugaugugguaauagugauaacuucgugaacagcuguuaacagugaggaauuggacaugccaguguggugacugguacaguguagcgucuccauguuucagaacacucaucagcacuugugccaggguaaagucuccuuuagagaaauuuuauaugugagagaaauauaacuauuaguuuuauagguugugauuuuuauaguuuuaaaaugcuccuugaauauguaucacuuacguauauacaaauacauacauacauacauacauacauaugcauauuuguuuuugagaugagaucgcucacugaaugugggaacuuggagccuacaaauuuggguggcugacuggccugugcgcuguagggauggauccaccugucucugccuccccaaugcuggggcuauaaacacggugcucugcucccuuuucuacccaccucccucagucuuuuuaagugguucuuaugugggugcugggaauccagugaguguucaagcaguuuaccaacugagccaggccuguaguugauuguguauauugcacuuauauguaaugcucuugcuaaacuucauauuaauucuuuagacacuuuugugguuguaguuguuguugauguuuguuugauuguuuuguuuuguuuuguuuuguuuuuuugaggcaggguuucacuguguagccuuggcuggccuggaacuuguuauguaaguuagacuagccuggaagucacagagauuucccugccucugccuuccaggugcuaggacucuaggcaugugcuaccacaucuggccaauaugcaugcauguaugcauuguauguaugcauguacguauguguuggggauggguuuuuaguaggucuuccuccuaugagcaugcacuccaccacugagcuauguccccuaacuguggaacgcuuacugacugugugucauccuuguuuuccaguuuugguguauuuccuaccacagcaccuuuggggcgucuguaugagcgagcggucagguuaccuacacaccuuuugcuucacuuggccuuguugccuuuguuagagccuuuaauguuuccuaggggcaucaagaaucaucuuuaucccaggcuuuccucaugaaaucugauacuagugggcuccucaaagaugcuuuuaucacguugugcuauuucuuuguauuuuuaguuugauggguuuuuacaaucagaaaugacggaugaauuuugucaaauguuuuucuucauaguuugaugauuuugugguuuugcucucuuguuaauauggggaguuggcuauuuuuauuuucagauacuaaauuagcuuggcauuguugagauaaaugccacuugguuuuaauuuuaugucauuaaauuuguuuuuguuuauuguagcucugugcaugagggcuaacaguucauuguauuggguuuuuuguuaucugauucuguuuucaggacuuaauucagaaauagccuuuccuugaagcgcuuguagagaacuguauuuauuugguuuucaagacaguuucucuauguagcucugguuguccuggaacucacucuggcuggccuugaauuuagagacccccuuaccucuaccucccaagugcugggauuaaaggccugagccagcacaccaccagugaagcccucugggccugaaauuuucuugguaagaguguauuacauacucaauuucuuuaaagauuugaguguuuuguuugcauuuauuuuugcaggaagucaggauuaggucagcagacaacuugacagagccuauucucucuuuccacauguguguuccaggcaucaaacucagguugucuggcuuggcagcaaaugccuuuacccacagagccaucuugcagcccagccccacccccaccccguuaaugaugucuguccucaucucuuuuauugccauuauugugugugggcuuaauauucucucuuucccucccccucccuuccccuacccccuccuuagagcagaguuggggguuucauagauguuaagcuggguugggaggagcugcucgggaagaaagcagggcuguggugcaaccucucugagagccacuucauuguccuuacaacacuuagggaugcgauuuugguaaauuugaagcaguuaucaaagggggguugcaaaaaacuaaaagagauccugaagggcacuggacaggacugauacgguaaaagucuagaucgugaggugccuuugcuguaagcuaaguuaacagucuuguuugagauuuucagaaaaauauuuagggaaaagaaugaggcuccacaguaggucagacacauuuaggcuuuaugccuggucauuuauaacuuuaacauagaacaucuaugugugaaaggaguaucucuauuguuuguugguagcuuuuacagaaguuguuaauugugcuggauuucugcuucucaguaaacaggaggcuucagucagacuucagagugaggaauuucucuucccauauaauuuuuccuguguuucuuucugcccugccuccuuucucucucucugucucucucugucucucugucucugucucucucucucucucucacacacacacacacacacaccucuaccuguagacaugguugcauuauguagcucugccuguccuggaacucacuguguagaucaggcagaacuugaggucacagcaaucuaccugcagcugucuccugagcugugggauuaaacucaugcccagcugaucccuuugaaguuguuuguaauuucuuccaugcuaaauaggagcauggacccuacuuaccaaguuuuaaccugucugcuccuggggagacacaaggacauagaugggagggaguugucauuugaagggaaucagccguccuuuaaggggaacauguguaagaaagucauaucaagagggucagagaaggaggcugaguuccacccugucacuacagcaacccaaggaauuccccaaaucuuuuagggacuucaacuuagaccaaacugggauuagugguguuugugcagaaaaggaucucagggugagccccuuugaagcagagcuggggcuuuuacgguccauuucauuucaugugugcacacauggguaucugucugcggguaugugcacaugauuuuagguguugguaaagagaaccuagagauggagcuacagggagcugugagccacccgacuuguagucucagguccuuuacaagagcauuaugucccuuaaccacugagcccucucuccagccuccauaguugggaauuacauuuuuaaaaucauuuuauguuuauuuauggguguugugccugcaugaugugugucuguacaccaugugugugccuggugcccaugaaagccagaagagaaugcuagauuccccugcaccuaggauuauagauauaugugaguugccaucugaaugccaaccugaguccucuggaggagcugcaauuguuccuaacuguggagucaucucucuagucucagaguuggagguugguuuguugauuuguuuguuuguuuucgagacaggguuucucuguguagcccuggcuguccuggaacuuacucuguagaccaggcuggccucgaacucagaaauccgccugcaucugccucccaaguacugggacuaaaggcgugcgccaccacugccugacagagauuuuuauuaagagauguuuucaacauagauuuaaaacaagauggcuaagagaaagaaggaaggaggggcucagagagaaagaaggacauaucugagaacacagguucgaguugccuaauuuucucucuuucuaguuccugagggaagaagaccuggccucauugcccagcggggcuuugccccacacucacuguguagccuagacuagccccaaauucuagauguuacugacucguccucuucagugcuggauguaggcgugucccagcaugccugcuuucuauuuaacauacuuaaauguauaguacaguugucaucauuacauaaauuucuuuugggggggggugguuuuucgagacaggguuucucuguguagcccuggcuguccuggaacucacucuguagaccagcuggccuugaacucagaaauccaccugccuuugccucccaagugcugggauuaaagucgggcgccgucaugcccggcuaaauucuguuaucucugucuguucuggucaguuucuaugggaucguuuucaugaauuucaaugucuuguuuauggauucuagauaccuuuauauucuuauauauguuauaaauauuccugaagucacaagaugcagagaaaagucugcccuaggguaauuuuucucauuagcagcaaaauaacauuuagggaccaaacaguucuuuguuuucagagagaugauucuaguaccccacaguuuucuucuguuuuuuguuuugaggcagggucucucuauguagaucuggcugguauggaacuugcuauauaaccagccuggccuugaacucauagagaucuacuugccucuguucuccugaaugcuggcauuaaaaacaugaaaggguuuauuuuggcuuuuacuucuacaucuucguucaucacugaaggucaggauaagaaccuagaggcaagagcugaugcaguggccagggaggggugcuguuuacuggcuugcucuaauagcuugcucugccugcuuucuuauagaacccagaaccaccaaccuagggauggccccacccacaaugggcuggguucuccuccaucaaucaccaauuaagaaaaugcucuccaggcaugccuacagcccagucuuuuguggaggcauuucucagcugggguucccuccucucaaauuacucuaaccuguugucaaguuagaucaauuuaggcagcacagagccucucacuauguaguccuccuaaauucucucucugugguucacucuguccuugaaaucucucuguccucuugacguggccuccagagugcugagguuaugguauguaccaccacagcuggcaacauuauaagauuuuaccagcaucucuagugucuaccuucuccaugcuagucacccucuccacaaguagugaccauaaagauugcauccaccugcugccagauaccccuggaaagugaggagaauuagccuuaguugagaacaaugguuuagauuuuauguuguccuucugguauuauuguguguucuuccuaaagccccauggguugugaauuauuguucagccugguugagauaggcuuuuucuuguccaugugugaaguuaggaaaccuuuuagaugguuucuuuuccaucucgacgcaugcauguucugaugagucuucaagggagaccuuuuauggaucucugcauagccccaucugagcccacaggaaccugugucucucaccuuauccugugucucucaccuuauggcucuccuggcuuaaacacuuucaaggcauuaaacugaaguaacaugagcucaccucaguuguuuacugucagggguggggguggcugaugguccagcauuuugaauuguuuuuucauauauuuuauugauuguuugauuauuuuaaaucagaguaaaauuuguucugcucuuauaucuuggccagaagcagcgguccugcugauaauugauaugaaucaguuauuaguuaaaauggaaagcauccuugaacauuuauugacuaaaauucauuugguuuguacagaacuaguaaucugacauguucuuuauucgaagucuucuguucccugcaauucuugugguucaacaugacuguuauuaaauggaccuuaaagcuuacuaucauuuuuuauauucuucuuuaaugcuugcucucagaguuggagcuaacuauugguuaguguggcccuguaacuauucuguaguagcgcacaauuaaaggacaugcacuaaccugaugaggcagagcaguggaaugugucaugcuuuuagggcauucucacagcaggcucaaaggcuggcuucuguguuacaacuccaauuaucuaguggcuaaagcguggccaucaaagccagcuugauugaaguugaaagaacuggugaguuagugugggggagaaacaugaaagaagagaaaauuauuuugcuccgagaugagaugaaauuguccuaagagccgugcuccaaggaugggagugacuuggaacccgcuggcggugagcccuuggcuaagggaaaaggagcagaauagagauagagcggggaauguugguuguuguagaugagguuugcuacuugguagcugcugcugaguuuauagcacaucucguuggguauccaaguaugaugcuuuaaucagcauccgggggaaggaggacacagaugaagcaggggggaugaaaccauccagcaaugaguguaaacucaaacguuguagaaccauaguuaauggaauccuacguaugcuuuauguaacuuuucagcagugcucccuguagaugggugguggauguucauuuucuaagauugggaaagaaaaaugugaguugaugauguaaugcuggacauuuuugucuuuggguaaauuuucucaugucuguuucuuauuuccugaauguuuuugaugguaggagugagcuuacuaguuaaaauguccacuuuuguucagugaugacaggccuuagacaagcauuuauguggguaaagaagaguaacaucaccugccuuuuacuuccuuaaccuagagaagccaagaagguuuucugacuccagaaugugugcuauaaggccacagugaagguuaaaucaggagaccagaggaucaucugauugggaggagaggaaaaugaugcuguccuggguguuguagaaaaccuuuguccugggggauacucauuuguauuguuuuguuucacuuuuuaaagcaagcccuuucccaaacacuauagucuaaugaacguucacaaaagaaauguauaacucauaucuauccagaauauuuuacuacaacuggguuuuuguuuuuuuguuuuuuguuuuuaaaaaagcuagacagucacuguaucauuauggauuaaauaaauaaaaccuauccuuuuuuaaacaacucagaaggaaauauagugaguuauuuuaaaucuagaaaacccacuggcuuuaauaguuaagaaguagacacaugagaagaaguuuuuuguuacccuuuucuuucucauauaggccuuugccucccauguaucugauagauuuuaaaaauugaaauagacccagguuuuacaaaauaaaaagaguacaaauagcugaguaagaucaaagcagcaaaaaccaugaguacuuuaaaaagcuguauuaaguagucuuuuauaacuauaaucugaguuuugcuucauuggcaugugaguuuucuuuucagacuuugaccacuaauucuaagaagggccuuuucaguucuccagugggacucucggggaggagccagcagugucaguguaggcuuuaaucugagcacucaggagucagagaggcagguggaucuuugugaguuugaggcaauccuggucuacagaucuaguuccaggacagccugggcugcacagaggaauccucucugaaaaacaacaaaacuauuaggaacugagcucacggcuguuuuuaaaccuuuaaucuguuagauaaaucauuucauaacuaguagauagaaauguucaaaucuaaaguuuccuggaauaauaccaucuauaauuuguguucuuuuccuccucaaguggagaauuuuuuucuauggcaagacaauuucagaaauuaauuuuuucuaacauaucucuuauagauuacauuuuauaaaaaguauuaaaaugccccccuccccccauuauaugcagugcaucauuguucucaguaguaauuaaucauuugaagcgaucauggcugacaugcuguggaaaugccauuuguaaaauaccuuucuauaaagugcuaaagcugugguuguggaucaggguagaucacugaucuuaucucugugaggccuggguucagcaacagcccuccauaacaccagaaccguugccaucagccucauaaaauuauuagagugcuaaucuauuggaaucacucauugcuaaauaacuuguuucucugacuagagaugccagugggggcaguauagauacuuuauuggguuuugguauguguacuugcauccagaaacaaaacuuaccugucuaggaauauaucuggguuuuaaugaagauguugaacuauauucaagguuuuguuuuguuucccuguuuucccuugacaggaaguagagaaagaaauggcagguccuagucaacucugcauucgccgcuggacuaccaagcauguggcuguguggcugaaggacgaagguuucuuugaguauguggacauuuuaugcaacaagcaccgccuugauggaaucacauugcucacgcugacugaauaugaucuccgcucuccuccucuggaaaucaaaguccuaggagacauuaaacgguuaaugcucucaguccgaaaauugcagaaaauacauacugauguuuuggaagagaugggcuacaacagugacaguccuaugagucccaugacuccauuccuuagugcucuucagagugcagacuggcucuguaacggagagcccacacacagcugugaugggcccaucccugacuugaguucugaucaguaccaguacaugaauggcaaaaacaaacauucugcucgaagacuggacccagaguacuggaagaccauccugaguuguguauauguuuuuauaguauuuggguuuacgucuuucauuaugguuauuguucaugagcgugugccugacaugcagaccuacccaccacucccagauauauuccuagacagguaaguuuuguuucuggaugcugaguuuauagaaguuucuagacucacacagugguaguaaguaggguaauugcauugugauuauagcuggcauguguguuccauuugcugugucuggugccaucaaaggauaugcuuugccaagcaugguggcucauaccuguacucuggaaacugagauaggugggccacagauucaaauccugggcaguguguaagagauacuuuguuaggaagcuguuuguaauaggcuauuuuauaugaauuaaauuuauuuguaauaguacaaauuaauuaagggauugauucuguucuuauuauauacugaauaaaacuaaguauauauuaaauaaaaauaaauaguuugauuaugaaaaacaaacaaacaaacaaaaagaacaguaagguuuucacaucagugaucuuuagaaauaagcaguaccaccuugcuuuccauugcuguugauugagcccagggcugagugcacauugagcuacguuugcagcuaucuuguggggacaucaaaaagaguaaugagaccaccuguuccaaggaauaguauucuaguugguacucagccugcucaccucuuauuguauucucaauaaacuauucuuccuguuguuuuuuuaaaaagauaguaguggauuuuaaaggaaaacacucuaugccuggaacagaugagaaaugagacugugccugcauccgucagggugcaguugauucuggcaagcucuuagugggugcugauauccauuugauggacaaccgcaaagcagcagcauauucacaugauugaagggccaauuuccacauuacuccauugcagaggaaaccgugcuggaaccugacaaaggucaucuuuaaccacguggucagauccaccagcacaguggagcaaacugaaccuaggcacuggauggaauguucaaagcaucaccuagaugauauucugauaaucuuaccccucagaaaauuuuaaccuaaauuugaucauuaggaaauagauauacaaaaaggaacauugugcauaguagcugaucuagauucuccagaaaugucauaauaaaacccagggggaaucaugagggagauugaagggacauguuaauugaauccuaaucaagaaaauguaguugcaaaggacauguugaggauaauuaaaaagugugaccguggcugcauauuagccgaugaugcagagucagggagcagaugccugcagguccaucccuguccucagagauaugugcaguuagagggagguguaucugcgacuuacucuggaggaaucuaaaugugugaaaugaaguaauauggcaaaaauauuaaauacaaauaauuggaugacuuaagaguaguaaguacuuauucuuguaaauuuuucagaaggaccaggauuuuuuuuuccauauaaauugaugauaguaagagggcacaggaguuggaaacaaucagaucauugcuguaaggucagugaaggaguacaagacguaggcuuggagcuugaucacagggccuuugcuuguuuggacgaggcuguauuguaagaugguggacgaggcuguauuguaagaugguggacgaggcuguauuguaagaugguggacgaggcuguauuguaagaugguggacgaggcuguauuguaagaugguggacgaggcuguauuguaagaugguggacggcuuguagggaugagcugggguuuguuugcuuuugguuuuuaucuauuuuuauauauuaugccuaaacucuuauauuuuaugcuuauaaauauauuuauaauauauaugccauaauuauauauuaugcuugaaguugaaguuaugagaagaaauauuaauaaugucaagguuugguuuauagucaugaguguagguugcuaugaugaggcaaagggaagaccauaggaagagaaauacaauagaagggaggaagaacgccauuauaugccguugugccaggaggaguaaugggagagagugaggaagaggcagggagagcaucaggaagacagagaaaucgagccuuucauuacaucuagaaaguuacaagaaguuuuacaggaaagaauuucaguauaauuuuuguaugaauauuagcuuauauugaguaaaagcuuaagaacagcuguucuuaagcaaaauuauuaaauaguggaugagagacacaaaggaagcaggguguagaguguguguguguguguuaggugaguggguguuaugaagauuuaaugugggaugaaaugaguaaacucccucuggggagcaguaauuagcauuaguuuugagaaggaaauagauuuacuuuuuuccuaaguuuguaaaauuacuuguguguguguguguguguguguguguguguguguguguaauuuugugggggcagagucucaccguguagcccugguuguccuugaacucuucuuaauuuuuuuuuauacacauugguuuuuugccugcauguacguuugugugaggguuccagaucuccuggaacuggaauuacagacaguugugagcugcccugugggugcuggggauuguacucagguccuuuggugcucuuaaccucugagccauuucuccaagcuauuuauuucuccaggccccugcccuugaacucuuccuguagaccaggcuggccuccaacucagagauuucugccuccuaagugcugaaaacaaagguguuugcuaccaugccuggcuuauauauauuaguaauacauuuuaaggguaucguggcacaugcccuugguucuagcuaaucaaacguuugcugauaauauaucauaaauuuaucuccagauaauucuuuuggcaugcauauaauuuugcuauuaaguugagaagacaaguguacauaauaauccguuggcugaauauuugauacuugaggacagaggguaucuucuuuguuuuucagaguuaaucaguguuuguuuguuuguuuuuuauaguccucaauucuaagacuacccccacauaaauucauaauacaaaaugcugaguuuaguaucaguuagaaauuguuaaaucuauucuaacccagagccaaaauucauguaacaauucuuuguuuuuuguuuuuuguuuuuguuuuuuaagacaaaguuucucuguguaucccagcugccuaggaacuuauuuuguaguccuugcuugcuuacucgagaucgccugccucugccucuugaguucuagauuuaaaggugagugacacuacuuuuuuuuuuuaaaugacacucaacagcaguuuuuuuuaacuguuguuuguuuguuuguuauuguuuguuuuuuguuuuccaaggcaggguuucucuguguagcccugguuguccuggaacucuuuguagagcaagcuggucuugaacucagauucaccuaccugugccccccaagugcugagaugaaaggcauguaccagugccacccagcaauaacaauccaagagugugguagcguguugcuuccaugcuaaggaguagcaaauagaaaaaugggugauuaacgugucuguccucuccgagcagaagacuugguaaagccacugauuucuaacauacagcagucuuugaaucugaccugagguguuaugacagcauucauuaguguuguaugcagcagugacaugcaguuggaagaauauguuuguguucagaaccaagacugcaguaaaguugugcagugcacuguuggcgaggugggcaccuccagaaacaccucagacccauuacuuguuagacgaggaguuguuuuuuggucguucucaguucagaaaacuuugacuguaagccauuuuuccuuauuuguuuccuucuuguguauucacuuguaggcucccucacucauucaguccuaaacccgcaguuucagaaguugagugcugggcuggagagauggcucagaggggucagagugucuugcaaaggaccuaugcccacuccaggcagcuugcaguugcuguaacucaaacuccaagggcucugaggcucuuuucuaguuuccucaaucuccuguauucacaugcacacagauacauauauauaccuagacauaguuaaaaacaaagucuggucggcgugguggcgcacgccuuuaaucccagcgcuugggaggcagaggcaggaggauuucugaguucgaggccagccuggucuacaggcugaguuccaggacagccagggauacacagagaaacccugucucgaaaaaaaacaaaaacaaacaaacaaaaacaaagucugcuguuuuuuuuuuuuuuuuaaagcaauugugugcaauagagugggagggaaggguuguuucuuuauagaggacuacuccaggaagucugcgacagcgaguagguucugaugagugcaauaccuuuugaagcagauuuucuacucccuaggcuuuacagauaucuccuaagagaagugacguucuacagagcaguucugagguugcuguuagaaaaguguugaguugaagggugcaucuguacguguucaguuccagaaagaacuguuuuucuguugcaguguuccuaggaucccgugggccuucuccaugaccgaaguguguggcgugauucugugcuacauuuggauccugguucuucuucuucacaagcacagguacucacugacuccucgagacugagaguggccgacucucauggaggauugucaagcucgguccuucacucugcauuucccuggaagaucuccuucuauucagugacauaggaaaauuggguuuaguuuaaaaaggucauaagaccaauaaguuuaguaauauuguacauguauuuuauaagcaaaaggauaucggccuuagucaaucaguccuugcuagucuaccuccaccucuugcuccuuguccuccuuucuucagacaugagcuaggaaugccacuucuauagaaagacagaaauacuuccgaggacaguguuugcuuaaguguuugaauggaggagggaaagcccauuaaacaagacugucuucugugcucugcauauuugagaugguagagaaguugcuagauggagagagggcuucucagcaauuucaucaagaaguaaccaagggaaggcauuuuaaacaauuagaaagacagcaaggaaggcauaaggguaagaaggugccuuuugcuaaaaggacccugauauaguggucucuugugaggcuaugcagugccuggcaaauacagaaguggaugcucacaguaaucuauaggauggaacacagggcccccaauggagaagcuagagaaagcacucaaggagcugaagggguccgcaacccuauagguggaacaacaauaugaacuaaccaguuacccccagagcucaugucucuagcugcauauguagcagaagauggccuaguuggccaucacuggaaagagaggccccuugguauuacaaacuuuauaugccccaguacaggggaaugccagggucaagaagugggaguguguggguaggggagcagggcaggggggaugguauaggggacuuucgggauagcauuugaaauguaaaugaagaaaauaucuaacaaaaaauugaaaaaaaauagggaagaaaacaaggcuuaguagugaagaacacuaagcacuguccuguggcuagccgcucgcugccccguugcuuuuaggauccugaaaaggagugagguguugucuugcaacuugagggccucucuucucaggaaguucugugauagccacauacauccuagccgcagcuauuuuaguacgaugaaggugaaaauaaagguugaugacugcuauuuuugucucauuuugaggccauaaugaauccauuucucauugcacauuguguccugugggugcucauauuuuaaaaaugaaaugauuuaaaaguguguauaucacugcuuucugguuaacuuugccuuacaagacccuguggauuuuaaucuacccacuccugaaaauaaaagcaaauuuaacccuguaagaaauucagggaagcucagagcagaugcuagacaaaaguguccagguaagaaaaaaaauucaggcaaaauccaugggcacaaaagcugugaucaaaggcugugaucaaagacuagaugaaaaggccagucuccaaaaccugguaaaaaaaaaaaaaaaaauuaaccucucagaaacuuugguagacucaguaaagcauacuagugaccagguaaauccaaguagugguguguguuuguuuguuuccuuccuuccuuccuuccuuccuuccuuccuuccuuccuuccuuccuuccuuccuuccuuccuuccucccucccucccucccucccucccucccucccucccucccucucccucccuuccuuccucccuacacccccccccauguuuugcuugcaugucuguuugaggguaucaguuccccuggaacucgaguggcaggcaguuguggggugcugugugggugccgggaauugagccaggguccucuggaagagcagcaaguacucuuaacaucugagccaucucuccagccucaaacauauuucucaggugucaucuuuguaucacuuugauugugaaccucugaaacguuguugaaauaaaugcaaguuccuaaacuccauccagauguguacacuaaagaucaaaacacaccuugucuuauguucagugcuacuuuugagggaaagucucccaaaugcuuagucuguuuaaauuuagggcauuuaaagaaauaauggcauaaaugaugucaccguuuaugauuacucaaaguuuucguuuuagaugcacuuaacauaaaacuuaguauuuaagagcuuaguuucauagcuuaaguuuaaguuaggaacaacuuagaaugacugucauauagccacucuugugguagaucuucugacuaacuguacccugcuauaaacaguuuaagggucuagcaacauaacucucaaguaaaaugcacuugauacucuuccuagcaccagaguugaguucccagugcccaugcugauucucucagauccugcaccucuggcccccaaggcucccugcccuuccaugcacacccagaggcaaacauacauaccuccacguuguaauuaaaaacaauaaaaguaaaucuuaacuuuuuuuugaguaaagccauuggugguugugggucacaccuuuaaucccagugcucagaaggcagagauagguggugggucucugaguucaaaacuagccuggucgacagaguaagucccaggacagcagguuacacagagaaacucaauuuuuaaaaauaaaaauucaaaccaggucccagaaacccuggguggcuacauugggccaucuuuauaucucauagcaaguacugaguaauuuuuuuauuuuuaguaaauuauaauaguucugauacuaaacuucacaauuuuacuuuugucuugaaaauuuccacuuucguauggccauauuucaccacuggaaggaugcucuuucagaucugcacuaccugcauguggcuguugugauuuuaauuagaugauguuaaauccggaucuuuguuacaugagggucauuucagucgcuccagccacaucguaucuagcuggcugcauggucguaggccauccccaucacuguagaauucuauuggaugaugauguuuuacaugguuuucuaagaguccucuccugaguuagaauaagauaugacacauuuauaacuaaacccauuacuuugaguacaagcuuaauaauaaaauuauauacauacauacauacauacauacauacauacauacacacacacacacacaucccaaauacuuuauagagguguaauuuaaauguaaugaauuuuucucccucuaaguuaacaggucuacauuuaguaaacaacuugggagcaaaugucuagauuuuagcauaccaucugaguguuccuuuaguccuuucauuauuaacuccagucacagcccggccagaggcaaacacugucacauuugucuuuaugguuuccccuuuaguacagaacauauaaguggggagaaagauuucugccuuaaaggcuaauguuuuuuuauugcuuucucucuagaaacguauuugaugccucagcguuuggagugucucugauuucugcuuuggucgcucuguucacaggucaauccuucugcgaaggcucuguagucugaugggcacuguauucuugcuucgcugcuuuaccauguuugugaccucccucuccgugccaggacagcaccugcaguguacuggaaagguagccugcuaccuccucucuguucucucuuguucuuguuggauuaaugacacaguauaugcaggaggguaaagagcuugcuuuuuguguuaaaauguggguuuugguuuuguuguuguuguuuuguuuuguuuuguuuuuguauuugcaauaucgguaguaaacuucuggaaauaacuggguuaaauaaccuuaagcuagacuccccucccugugauuucaucuguggauauuaguuccgugcugugggacaaugggaaauuauccuuuucugcugcauuuucccuuucucaccacacucagcaucuuuuuuuacaauguuuuuuuuagcauuuauuauauacuauaguggguuucauuaucauacccucaugcguggucacaucguucuccauacacucagcaucuuuaguucuucaugugauucuguggccccuucauggcucugagccuuccuuuuccuuaaacauuuucugguucaaaugaguucaacacucuguaaacuuuuccuuugcuuuugguauaugcuuuauacauuuuguuuuauuguauuguagauauauucuucuaauuaaacagacagggcaaauuaugcccauaggaaacaaaagaggggguuguaaauuuuguuguuuuuacuuuuagaucucggguaagaucugcuuuguaaauguaagcucagugguagagugcuugccugaugugcagggguacugagguucaguacccaggaccuacccccaccccacuacuuaaagaacaaaucuguaaaauaacuuuaaaaguugagccucucagccggauguaguaccacaccuuuaauccccucauuugggaaggcagagaggcaggugcaucucugaauuugaggccaaccugcuuuacauacugaguuccaggacaauagagaaagacccagucuaaaaaaacgggaacaaaagucaaagaccaauccuguccuugauagacaaaauuguugcaaaugguuaaauuuggccaaaaaaauauuaaccuacguaagcagacaaaggacuugauggcuacauuaauaucuuuguuguuauuuuaacguuuguaaaacaaaauuaggugucauugccuuugcuaccacaguagaaauagcugacaugccaguuaggggaggaagauuaagcacgcaaaggagaugaagagcuaaaacuacugcccauaggaacagcucuccagguguucacccaggagacugggcagugagggaggggccaugaaaggucagacuuacuggaagcaaaucuguuuaagguuagaaacuauuggggcauuuuguguuuuucaauauagaaaagccuuuuuuguuuguuuguuuuuucaagacaggguuucacuguguauuccuggcuguccuggaacucacucuguagaccacgcuggcuggccuugaacucagaaauccaccugccccuguuuguugaauccugggacuaaaggcaugugccacugccacuuggcagaaaaagauucuuuuauuauggaguuguacaaguuucuuguaagaacucaaaugauauauaaauguauguuaaaaaagcaaaaaacucacauagaacccuuuucaugccauccuacaaguaaaacuuaaguuacacaggccugguuugaaguuucuucuuucuuuccuuccugccuccagcccuuccuuucuuggagacauacucuaugcagcucuagauggccuagaacucacuauguagaucaggcuggccugaaacuccucacagaaauccuccugccucugccucacaacugcuaggauuaaagaugcuagguaccacgcuaagcaacacaaaucauuuuucaguagaguuuuuauuauuucauaaauugauauugauggacaccuuuugaaugauggaugaauugcagagguuguucuguagcugacauuuaaggugcuagcauguuauuuuuuccucuuuuguauaugugugaggccugauguagggguguguguguguguguguguguguguguguguguguguguguguguugacacaggacucagggucucugacuuaaccuggagcuacuaguucugcuagcccuggggauuuccagucuucaucucuugcugcugugauuuccaguauaucaggccagucuuuuucaucuuucuuggcauggguuuucgggcucugaauuuaaggcauuuuugcuuggaagcaucucccuagccuuauuaauuacuuuuuaaaaaugaguacacaguuauugucaucuguuuaaaaaggucaucacuuuaauagcugugggauaguccauuguaagcuucccccccaccccaccccccggcuugcagaugauguaaaaugugguuguuuccaagguguuuuucugcuucugucuuucagagggaccuugaucucaaggccuuauacaugcuaggcaagcacuauguuuaccucuaaguuuuuggaaauagaauuauuauuaaugauaggcgcauuggaaauugugauacauaguucuaaaauguguacuugaaaaaagcuaauuuugguuggggggaauggaauauagaguguaaaaaauaaauuaaaaauuaaaauaaaaaauaaggcaaaagaacaaagguaguuuucagaggugcaguuguaaccuugugcuuuuucuguagcuuguuguuucugaagaacagugaugagcaucguccgaguuugcuuuuuacagccuccagacacuacucaaaaaaacgccugucaaaacaucuuaaaguuaggggguguguauguguguacucacaucacaugcaagugugggcgcacacaugccaaagcaagaacggaucaggggauagcucuugagagccaguucucucuccuuguuuugugaaaccaggguuugaaguccagucaucaggucugcucacaagugucucugcccacugaaccaucuugccagauccauucaugcauuuccuuagcaaaacaaaacaaugaaaaacagucaccaggaacuaggcaugccaacuccugccuguaaucccagcacaaaggaggcuguggcaagagauuggcagguuugaggccagccggagcacauagugaggcccagucagccugagauaggagacccugcugaaaacacaucaucagagugacguuccuucccuauauuacuuggcuuuguacgcagacagaucuguaagcuucuccaaacauuccugguuacugcucucuguaaucuccuuuuaagcaauugagaaaaucgacuuuguuuuagaaauuacauuaacaaaaaagauauaacuuuaauuuaguuguauuaauaacuuuacccccccccccggcuacuuuaaauacauuccuuuaaaguagacuguagggcacuaccaugagugucuccuguauuacugacccaauuuauuagcuguguucauggcuaucuuugucuuuaaaacaauuauuucuuugauuuauagccuuaaaugauuaucaaagguuuuuuuuuuuguuuuuuuguuuuuuuuuuuuuuugguugguugaguuuuguuguuguuguguuucauuuuugguuuuguuuguuuguuuuguuuuguuuuguuuuguuuuuuaagacagaguuucucaaugucuaccccuggcuguucuaaaacuuugguuuuuagauuaaacugcccuugagaaagccuccugccucuugccucugccuccugagugcugagaguaaagcugugcacugucaugccugguuuaaguuuuaaagacuaauuuuuaacauuguguguaugugucucugucuggauaugcacacguguuugagugcccacaaagaccagaggugaugcauuccuuggagcuagagucagacgcaguugugagccauccuugaugagggcuaggcacucacugggguccuggaaaagaacaauauauauucuuaaccuccgagguuugguacugaccaaccucccaguccagcaggcuaagcugagccacccacccauucaguguaccacuuaaagggacagggguacuugcugcaagacagucuuugcagccacuuugggaagaggaacagacaccgggauccagugacaaacccaccaccaucaccaacugccgucuuaggguaccaauugaacuuuagguuuaaauagagaaaaauuugagguaaucaugagaaguacacauaguaaggcugccuuggucuaaguguggucugguuggugauuaccucaguccuuguuauugcuugaggagauaagccagcucucauaacaugauugcucuugcuugugauuucacgaugggguaaccugccugugaggcuccagcaucacuucaaguuuaggacaauaaguuuggaagggacacugggacagcugacaauaggugccucaguuuucauccuuguguuucauuguaccuucaucucagccuugaagagagcugaauugcguugaguagaagccgugguuaauaugccuuugagaaguuaggcaugugacucgcccacaguaaaugagaugaauaugcagagaaggcaggcaugccaggcuuuucuucugcuuugggccuccuugugacagcuaaggaguccuugacucaccaagaguccucugacuguuuuagaacaaguacgugauccagaguccacugcacugacugucacagcacuuggaaccucgauggcaguggagauggggaugacugaggauggagagcuccccugcauccuuagcagcagccacuugguucccuuuugcacccacacugcuuagugucuauccgucguacucauugccagcuaggaaagaguagcuaacgguuuauggucuucauuuuuuuuuuuuuaagauuuauuuauuuauuauauguaaguacacuguagcugucuucagacgcaccagaagagggcaucagaucucuguuacaggugguugugagccaccaugugguugcugggauuugaacuucggaccuuuggaagagcagucgggugcucuuacccccugagccaucucaccagcccauggucuucauuuuuauauagacucuaaucucccccaauuguuucuguacauggucugaagugaggguaaaaacauuuucccccaauaguaugcuaacugauuaggaaauucaaacgaaacuguaaacaaacuguaaugaaguuguguuuccccucugaaaguuugacaguuuuagucucgaugacuaacaaaagaaagggcacauaaauuuaauaauacuccagagcuauguacaaaguuaggagccucugccaacauguugacauaaacuucaugucuuuccuauguaaaggaacaaugcguggggcuuuugaagugguaauaccaaccuuggcaagaucaggaaaggaacugcuuggucacuagugacaguguuauuguccugacaagauuuuccagguagcagcauguggacacaugggccgucugugccuggacuggaaggugucagacccacaaugucugccuucugcacaaggucuuuccuaggcagaucuggagguuccccacacuuuuguguuugcaucugcugcuuaaacuaauauagauagauacugcuuuuuauucaaggagaauuguuuuguuuuguuuuuguuuguuuguuuuguuugagacaggguuucucuguguagcccuggcuguccuggaacucgcucuguagaccaggcuggccuucaacucagaaaucugccugccucugccucccaagugcugggauuaaaggcgugcgccaccacugcccggcuucaaggagagauuuuuaaaccuauuacccagugcaguuuuaugaauaaccagauccagaucugaaaggaauguauuugagguggaacauuuugcuuuccuguuauauggauaagaauuuccugauaaaccuaaggagguuuaucagaauagccacuuaagagaaagcuggaucuuugugcaaagaaacuuaucuuaugcuauuagaacaaauuagaugucacgcuucuguuuggacagcuuucuuucagucuccagugacuuuuuauuaauuaguuaacguauggauauuuccaucuaaaucugcccuaaaugcugcuaauuguuuuaaaguauaauguaaccugccuauugaccuacauuauuuauagcaaucauaaaaaguagagcauuaugggauaaaagccagaugucaaaucccuuacauugagaccauccagaggcauuucauugugauaaauuaauggcuuaaaaucauggaaccaagacagaacuaagaacaugccuauuuuuaaaacuuagcaacacaaagcuaauuugcauauuguaucuagacagcuuccuauucauucuuuucuauuucaguucuguuucuagaaggauguaugagaaaugcagagugggaaaaaaugaaaaggcuugaauuacugagugguaauuauuugggacuagcauuacuuguuuguccccuguuaagauacuauccagcccaguggugguggugcacaccuuuaaucccagaacucagaggcagaggcaaacauaucucuuguguuugaggucagccuggucuacagagcaaguuccaggacagcuagagcuacacagagaaacccugucucaaaauaucucuccuuuuuaaccgcucccccaccccccccucacccccccucaccccucaccccccccacacacacaaauguucugguaugauugacuuaugaaacaucuguaacccucuggucuuccucuucuauccuaccugagacuugcaucucaaagccagauugugguccuccauggcugcuggagcgucaguugcuauguuuggguagucaguagaaggcaaauggggugguagaaaagagcuccucuaguagccauccuauagagcuuucacauuuuugcguacaacuuauuguacagaacauggcucccuguagcuauagggaaggccuggagggcuaagaucugguugaguucauggccucgccagugucugaguuucugugacagugaggacagggagaauaguuaauaaaugacagccuggaaguuacagcauaguucauuuccuugcugcuucuuuuuaauauuuuucuuuuuuuaaagaacguuagagcuuauuaaaauauuuuaauagagauuuaaacacggacauuaugggagaaaaguaaguaaauaaagcaaaauguaguuguuagggacuggaaguuguugcacaaacuacucagacacggacgucugucaaacagggcugguuuauugaacacacacccuaagacugaaccaucagggacacaguacagacucagaagcugaacuguggugcccagcuagacuccuauagagcuuuuaagccugagauacgaacaucugugcuaaguuauucugccagucaggauugagggauagggacuuccauaggaacaacgucuuuguaguacacuuauccuguccucauugguugggguguccacuguggcaggggacuugccuugucuaggauucauucaaccuccuacucaaaauggaaguuuuacuccaaaugguuucuuguauuggugcaggugucguucuuauguugggguccaucccaggguuagcuuauaaaggcaagaaacaaaacaguucauaccuagaugcaguaaguguugccggguuguugguucggguccaagcuuauugugacuaaguaaacaagggaguucuaacuggucucuauugugauuagguuccaggagcaucaaagcgcagaagguaacagaauauguagucaguucaggaaugagaaaggguccuaguaacagcacaugacaaaguuuccuuacaacaguaacagcacaaaauggcugcuauacagacaaccuaggccuuaacauuuuaccuaggucuuaacacuggggauguucuuaauuuacagugacuaugugaggcaggguuuuucugaguagcugugacuguuuuggaacuugcucuauauaucugauuggcuuugaacucagagaucugugacugccucugccgcccaagugcuuggauuaaagggguacaccaccacugccuggcugcuuguugguuuaagauaaaauuucacauaaccugggcuguccucugugaccaagacuagccuuggacuccugcuccucugcaucugacucugaacaugugaagccuugagauucugaacaugugccgucauucuuggcauugacuuugcacuuuuugcuuuuguuauuaucuugagaugcggucucucugugcaacccugguugcccugguugucgauauguagaccaggcugaccucaagcucacaaagauagauauacuggccucugccucugagguguugguauaugaacauacgcuguacgccugccuugaccuuuuuacuuuaaaggaacuacuguaaaggaguuugaauuaggaugauuucauuuaauuagcauuuucuaaguacagucaagcucugguaauucucugggcccaccuugaauuagcugaguuagaccaguugccuuuaccuggaugcucuuauuucugaaucaugaauugccugaaauggauuugggcaagcucugagccucaguaagcauuugaagaacuaacucacagcguucuuuguagauauauggaagugugugggagaaacuacgacgggcauuugccaucuggagcggcuuuggaaugacucugacuggcguccacacuuguggagacuacauguucaguggccacacaguuguucuaaccaugcugaauuucuuugucacagaguguaaguauaucuuuaaugcuccuaugcauauuagauagcuuguugcagagaaggaacuagggaggaagugagaaagaauaggcggcugggguggaaugcaacucagucuggagugcuugccugccacaugugaagccccagguuugauccccagcaccacauaaagcuaggugugacggcagaugccuguagauccuaguucaaguucauccucagcuacacauccaggucagcagccugggccacaugagacagagcugaaauaaaggguguggggcagagguuaggggagcagaagcuuagagccuacccugagaaacguggcuaagaagcuuggcaggaauguguuauuaaauaaaugguccuucuguccuuuuccuagauacaccaagaagcuggaauuucuugcacacucuauccuggguucucaaccucuuuggaaucuucuucaucuuggcugcccaugaacauuauuccauugauguguuuauugccuuuuauaucacaacaagacucuuuuuguacuaccauacucuggcuaacaccagagcguaucaucagaguaggagagcgaggauuugguucccuauguuuucuuucuuugaaugcaauguuaauggcacaguaccuaaugaauauuguuggccauuuucuaaaccagcaauaaugaaaagacuaauuggaugaagacucucucucuguaaugaguuuguuguuaaauauacaguaguuauggaaugaaaaugaauacuuugucccaggcuccuggauacguugcauuuggcuucuguguugacagguuucccguucugagaaaggccgugacuguaaaacucaagaaagaacacacaagacuccuuauuagcuguuugaauggagaggucauggaaagaguuuccgccccucacuguaggaagacccagcguggggugaugucaggccgauaccugugcaugcugaguguuugcuuacggaacucaagcacaucagcuugggcugguugaagaauuguuacugauucccaguaggacucaagucaagaauauuucugaagcuggcuuuccuuaccuagugagccguucucauguguucauugaacuaaucugugucugucugcaaagugagugucuuacugguaaauauguuuuaccuuuugagccauuugaaagaaaaacacauugaacacagcagaaacaaaagaaugcggggggcaccgugugaggugacacgcucgcugaucaggugucgccggccucccacuaaugcaggggucagcauuucagagcaggugcagcgucaguugcugucccuuucuguucggaagcuucagugugaacaacagaaagggcuccugaggggagguggcuguguuccuguagugcuguaaguccccggacuaaauacuuguuguaacuguuaguuaggcagaugacagcccaauauacugcuuuuuaauaaugugacuuaagugaacacaugaguguuuuaccagauguuagaguucuuacaucagugagugaguaaaugugcaugcagagaauucuuuucuucuggaaaaaaacaaaacagaacagaacaagcuguaggcgcagugcuaauucucggggugggggugggggugggguccucuuuuuguuguuguuuuucccugaaaguucucauucccgaccauggaaaguacacagucugagacauggguggauagaaaaaggcuucuuacuuuuuauuuuaaaaaaauuauauacauauguucuuucuagagucuuaauuuggcaguuaagaacuaaauacuuuagcugcuguuuaccuucaguaauuacugucaccucuccgauaccauuugucacuuuauuuucuauugguuguacauaacaguuuuaaccugguuguagaauuggaauacuaauuguauagucuuuacguuccauuuucaaacaaggacucaagagcugcaggcaggcgcacugcagucucacgcaggccacagccggcguuuauuccucugucucggcggcugaauggucauuuuugcaguuggagucauagucccaccucuuggaagccacugaguggauuaggcaggaaggggguuugucuaauagacaaacgggccucccccgugcugagaaccccugcucugaggaggcuggagacagcgcucauuucucaccugagagaugagguaaagcaaucaaaaucaaguucaauuauguuuuuaaaucuuguacuucaaaauccuugcaguauuuuaaauuauugauucuauuacaagccaggaucaaaaacgccaauaucuuaucuaaagaaacguccuaauccuggagaaaagguuugcuaugcuuguuugaguagcuugacuuagggccaagggauauauuacugccacccccucuuauuacuccccugccccccacagagcaggauccaauuuaccuggggggagggggagagacaguguuggcuuuugggaaaauguuccaaaaaugcgugucuacauuaguuuuaagaugcuaacuauauuaaugguaaauaucuuaacaucaggcuucucuccuccauauggguucuaucauagaacacaauaggaaacaggugcagcuggcguugcccuugccaagcuauugauggugagagugccugacagcagccugcuguacggauugaguggccuugggucacuccuguuuguuuggaggaaaaagauaagcuagauguauagccuaguagcuacuauaagacaguguuuacagagcuaauccucuucaagucucaaaacugagacaacauuaguuuucagguuuuguccucacaucuuuuuccuuacuaaaaccuaaccauaaugaagauagaauuuauguuuacauuuugggcaugauguggcugcgugcagucuccacgcuuuugaaccccguauuugauucugcagucgugugagacuuuucuccuugacagcuuaguacagaagcaaggaaagguuuugaguucuugggggugcaaaggaagaauugccuacauucuaaucccagugucgcugcccucccugugguguuaagcccagggcugugugugcgaggcaagugcucucggcuuuuacagugcaaacaggaucuacugaaagguagacaugcuggguggaaaggaacgagcuccuauggaacauaagcuugcucucaccaccacauaguuuuggcagaaaccuuuguguuacacuucccaacgaggccagaguugcuguggcaaaaauaaccuuucuaaagcaaugggcuucaucuuagaaccagucaauuuaaauaacgugagcuguaaccaagaaaacccacacuuccaauagcguaacauugacacuguaaguggugaccagccccauucuaccugccuguuaggacugagaauuccaaaacucuguaaguuauaaguggggaacaggggugcuggauccuucuauagcagagagcaaguagucuuucaggaacauuugugcaaaaguguuugguuguuuguugggggggggggguucuuuguuuuuguuuuuguuuuauuuuguuuuguuuuuucagagacaggguuucucuaauucagggaucaccugucuuugccucccaugcugggauuaaagguguacaccaccacacacaucuuuuuguaaaacuuaauucguauaaauucagauuuguggcaaaaauguaucuucuuuauauucagcaaaaagaaauuuuaucauugaaagauucuagauccaaaaugcuuaacaauguuuacaauauucuugacuuaaacucucugauuuaguacacucaauuauuugauggucuuguggauagaaaucccauagcaaaagcagacaguauagucgcccucucagcugacagacuuaggagacaagaacggucuuuagaauaguccacuugcuuuccuucagacagcgugaaagcagaaagcaugucagggguuuuuguuguuguuuuuuuguuuucuuuuuuuuuuuuuuuuuuuugguuugguuugguuuggguuuuuuguuauuguugguuguggguuuuguuuuuguuuucauuuuaaacaagcuuauguaaauaagaugcuugacuugaagggaaaacuaucuaagaucauuuuguucaagaguaauuuauucccuaaagacauguaacagcuucaaaaaaaauauaaaaauuguccuugaagcugggcaugguggagcacgccuuuaaucccagcacuugguaggcagaggcaggcggauuucugaguucaaggccagccuggucuacagagugaguuccaggacagccaaggcuacacagagaaacccugucucaaaaaaccaaaaaaaaaaaaaaauuguccuugguuuugcaaugauaaaugaaaaucauuaaaauucuccaauugaacaaggcaugcaaggauuuggugguguuguguucuuuuguuaaaacaaugagagcaaaauaacuuacugaaauauaaagaugagagcugaaugagcaugccaccaauggagaagggguauuuucacagacccaguacuuucccccagaccaucuccaucugaugccaaccagaacagaacauuggccauuucguuuaaaaaaaggaaaagaaagagagagcacuaugcgugugcacauacaccaguuacuuuuuguacaauaaagaaauggggacagggaaaugaaagaagagaaaacuauacuguguagucaggauguggcgggaccaaacuguggcuuuuuaauugagaauguauucuuggucuauaacaaauucuggaguaaaguagcaggcucccuuuuuaaguagacaccuccagucugcugcuggaacacauacaucgaucuuuauucuccacugauugguugcccaucgaaccggaaucugaucugccucauugacaaacccugccguucacaauaggcuuucauuaguuuacuaagugguauaugccucuuaaccuuacacugcaccacagaaccauccugucccgccaccuucaaauuaauaugaucauuguucucagucuugacuccuuccuuggguuucucgucagccauggcaagugcaggagucuccuuguggccuucgcuguccuggaacucagacauuuuucugccucugucuuugccucugccucugccucccaaguugcugggauuaaaggcaagcaucaccacuuacugccuagcaagcaugucaggguuuuuuuuuguuuuguuuuuguuuguuuuuuugagacaggguuucucuguauagcccugacuguccugaaacucacaagcauaucagguuuaauggcaacuuuacauaacaguuuguguuuauuaaaaagugagauuagucccagucaccccuauuaccucugcagcugaggauuaaaguaccaucagagaugcuucaggcuacuggauggaaagagaaaggguuuuguuuguuuguucuccuuaugaauagcuuuaaaugacuaaaauuacuguaaaaguagguguugguuugccuguagauucaguggcacugauuuuacauaacuaauaugaugaauuacuguaucaaguucaguacaaaggucugugaacucuaagcuauuucuccagcuacacuaaguuguuuuugaggauacauucuacacuguguuaaucaaaggacucuuuauucugugaauuucccaucuuggcauaaggaagcuuugugcuuugaugggagaaggaauauucuauuguuuguuuucuuuuuuccauuguuacuucacaucucuuuuaaucugaacuaguggauugucugaagaaccaaaccgagccuauuguuauuaacaucuuuaaaauguuuaauuuuaauaauuuuucauugaauucauggauuguugggauaaugaaguauuugugauguggaacaaaggaaaugaaauugguacucaguggggaagcagguugcuuggacuaagccaggcauguucaguuuugagaauucuaccuaaaggucucccugcccacagagaaacuaguguuacuugaagacaugaaaaucccugugguagccagaccuugaagcacaguguuguaauaaguaaauaccugauucuaaauuaaauucagauuuaacuaauauauauuauuuuauaacuuuguuguauuaaaauguuuuaaacacuaaaaaauaaagcauuugaaaguugguau

SEQ ID NO: 7303 - RNA, 20644 nt, Mus musculus
aagcaagacauuaagaaaaaccccuccauggccccugcgucagccuccagguucuugccgugcuuggguuccuguccugacuucuuucaguaaugaacagugauguggaaguguaagccaaacaaauccuuuccuccuguuguaguuaggguuucuacugcugugauaaccuugacacuauuuuguagaggaaaacauuuaauuugggccuggcuugcaauuucagagacuuagcucauuaucauugugguggcaugcagcccaacauggugcuggagaaggagcugaggguucuaccucuugaccuaaaggcagcagcaggagacugugugccacacugaauguagcuugagcauaggagaccucaaauuccacucccagagugacacacuuucuccaacaaggucaccuuuacuccaacaaggccacacuucuuaauagugccacucucucugggccaagcauucaaagacaugagccuaugggggccauuccuauucaaaccaccacaucuccccaacuugcuuuuugguccugguguuuugucccagcagcagaaacccuaccuaagacacuagcuucccacgcugucugugcuuccuccuccuugguuugaacuccuacuauggccucccugccaaaguaugcucuaugcucucugugcuuucuaaaaccuacacuguggcuggaaacaaacgacccgagucuucagccgcuccacugaacgcuuuucuuguccccucucccagucucuacucaauuugucaucgugccaacccccagccuggccuguggauggaagagcacuugauuuccucacacacaguccuaccagacugaguuuaugccgucagcuagagcaucuucaaccuguucaccuacuuuuguuuuugcauguggugcugggagaggaugaaguccaggucuugcacauaccaggcaauauccuacagcuggaccacacccugaauucaauuuuuuuaugacccauuugccgaucacuccuauuuagucacugaggacuuuggcaccugacucaggguuguccucgccacuaucuaucuuauaacucccagguuacuccagugucucugccaacagcuugugccagucccacuacugugugagauguggagaugcagcucacuccaaaguccuggccuuacucagccagugagcuucauagguuagacucuccccaguaacuaaaguagcucacuguaauccuaguagcccucucccuuguucucuuucucacucccucuaaguucucaacuucuauauuuuccccaacacccaucccacuuugaaaacuacugaccccauuugaauccuucucagcaugcccaucccuaagaaaaaugguaucucaggccacagucuccauauuuagacccucuucuaugcagaagcuuucagacgggagcuuccguugagccuucccgagccugcugcuaggucucaguuuguuuguccugaggaugauugcguugccagugucacauccauaagcccaugaaauagccaagggucauguaaaugugagaggacagagcuugagugugggcugggcuggcccucuuccacugugucagagccaguggcaggaagagaaagagaguguguagggccagcucuucugacagaaccuuucugagcccaugcaggaguaagacugacuuuacagggcuggauuucagaauugcuguggaccaaggacucucguuucccaucguuuugagcaagaauguccuuaaaacacuccugugcauauuucacuguuacaugcuggaugggggaagggcagagauacauuuacaggaacuguagucagggaauuaacagccucaguagcccuucuccgguaugaagauuagauggcuggggcugugugucuuugaagggaguaaacacacuugcauacaagaguguaaaugacucuaugagcaaaucaggacuguggagauuuaaaauauccacauauuuacugacacuucuuuuguaagauguagucuaacccuccacccccuaucccugccccuugguauaauucggucugagcaauuaacuagcuuuuaagaaaaaaagagucuaaagucaggugguaugccuuuaaucucagcacucaggagacaaagacaggugggaucucuguagauucaaggccagccuggucuacagagcgagucccaggacagccagggcuacacagagaaacccugcauaaacaaacaaacaaacaaacaaacaaacaaacagagccuaaguuaccuaggauggucuucagacuuuugguccuucugcuucugccucccaaaugccaggguuauagguguguucugccuugcucaguuuagucacuugggucuagcagaauaaggcacacacacuacaaagcguuuucuaagacuagauaagucacugcagcuucaguagucuugucagacguuuuuguuguuguuuucaauauccuggauucaauaucaugcuuguuggaacagguucuucuguagcccaggcuggcaucaaaucccuguguggcugaggaugacgccucacugagucuccugccuucacuuuucaagugccggguuuuggggagugugccaucacucuaaaggaguuugaauauggauacucagguggauucacuaaauccugcucaaaaugaaggccuugaaacagaguuucucuuugaacugauccugcccugucuuuguucuccacccaaggaaagccaagaaauuagauuuuuuuuuaaucagaagcaagucauagaaaaguaaaacccacuccuccugcccccaaagccucaaagcuaaaaacacucacuuuacccugccauaaagacauucucugaccugccuugauuaacagaucaucagaccucuauucuaucaguuaauuguguguguaugcauauuguaugcauaugcauuaucugugguauauguagagggggccaaaggaagcccugggugaaugaaguucugagagaaugccuauuuugacauggguaccacuaugucaagaaucccaaggccuccaacccauggggcaguuggcaaagcuguuacccauguggaucaggcucaagagcagugguggcgcuucucuugggagguaugaauguuuguagaagauugauuguugcaaaccuagcaacugcagcuucuuccuccuggauguucacagucugaggcugcugccuacagacacuuucuaccaagcuggcaaccccccuaccuuucuguuguacuuaauaaacaccuugagauucuggguugcugugguagcaauuagagaacccuacccgaucucccuucucuguaugggugacugucuuuucuucauuccuucauugucuguagccaggguuccuggaucacagcuaugcuggacaaggaaauaacauauuuuugcaugugggcacguguacacaugugggcauaugcaugugucuucauugauggcucucuaauucacugaggcagaaucucucacugaauccagagcuugccaauuucaccuaauuaagcuagccaucuugccccaggaauaccaugucugucuccugagugcugggcugccugaguccugcuugggcugccacaccuugcccagcuuuuauguggguucuggagauccgaacuccugauuuacacagcaaggacuuuauugagccaucuucccaguucaagaccuccauguuagugggguuugguggugcaggccuauaauaucagcuacuuggggcaggaugguggugguggcugaaagaggaagaugaaaaguucaaggcuuuccugggcaauuuagugagagaccugguuuuguagaguuaaaaaggggaucggaguuauagcucagugguguaaugcuggucuuacauuaguucaauucccagcauuacaccaagaagaccacccccuucuuuuuagaaggaguucuuauccauagcugggaggaugggcuaccuggacagacccugugggauccuuacucauucuguuauaaagauuauacucuuuuuguucauuuauauuccuaucuggcuguccaugcuucagucaaccuaagcacaaaaaucaauaauucaaaaauaaaaaucaauaauucaccuuggauguuugggcucuucaguuugguggcuuguauaucauauaaaaucaugaucaaauaaaugaauuauacauuucucuugcuaaccugccuuuuacauaggagugucagcugugucuuuaugaugggaaggagucaccaucuuucccaccccuguaauucuuugcuuaggcuggaguuuguccccaguggccauuaagcaccacccacauacuuuacagaguaaagcuuccgacuuuugugucagaaaaugaugucucuggagaucaaaacuugugacagguaauacagaauaggaauaagcccugcuauaggcaauugagguaacuaauuuagcaggcugaguuuuucuggaaggcagugcugaggaggccaaacucuaccacaagcaucacacagcuggggcagacugucucccgugggccagguccauggcagaccaaccugccugagcuuggaugaagggaugagucaggugcuggagcccgaucucauacacacaaagacucuucccauuucacuuuuuacaacacaauuccagcugugagcaggugagguugcuggcuagccuugcuccugggagagaaacauaccagaguguaacuuuaaacuuggguguuggauuggggggagcccaccuagccaucuuuccuccggcuuaggaggagagugaugacuuaacaguacuugaguagaggaagaguucagagacgauugagucaugagugcauaugugugggugucuuugcucucaguccaacuguaugucuauugaagauuauuaaacagcaucuuagagaugagggaauugagguccacaggcuaaauuauuugaguuuauugagcugaagugucaguugucuccauuuuaaaucuucuguauggcugacguguguguguguguguguuuugaacagugucuacugcucuucaccuuuuacagaauuuagagaacacgguuugcaggccagguugacagagcccccgugacccucuuguuucuauuucuggaacuacuacuggcuuuuaauguggguguugggugcuggggauccgagcucagguccccuugcaugcacagcaagauaaggguucuuacucacugagccuccgauucuaucuuuauuauccuguuugccucacccuguaguuuagccucaaacuggucucuauuauuauuauuucaagacaggguuuuucuguauugcccuugcuguccuggaacucucucuguagaccaggcuggccucgaauucagaaauccaccugccucugccucccaagugcugggauuaaaggugugcaccaccacuauccagcggucucuuaucuuuauuaaccuuuugccucacucuguaguuuagccucaaucugguguaauuucucugccgcccagaucugggacuacagguauaggcaucaggacuggcugcucccucccucuucuggcauaucuaaagaacuugagagcagcauucuaaugacuggucagcaugaauccuacaguuauucccuugucucuccaggccucucaaccaggggaagcuucucuuccuagagcaggaugugcuucugcgcgugugugaacccauaccauauaugggugagacggaggcugcaggagcgcaacccugaggcuccgagagaaaugcccagagacuggcucaaguuuguuccuuuggagcccagccuagucccagcaggggaggacauggcggugggcggugaaccgagaugggaagagcauggaggcugcacuuggggagaguguuucaucccccucaacccggaccuuaaguucagaccuccaggcugggacucagggaggaggcugagagggugcacgugacccugcggggcacaucgccccgccccgucgcgacucgcguggccacucccauccugaccgcgcgggugccguugcgccgccuccgccguucccagguccucgccucuggggcuguccuggacauugccuaacccgaggccccgcagcuccugcucgccccguccccgccggacgguccgagaccgcucacccaaggagaccgccgugcucucgacccacguggucacuccggagcaggugggagugggcagcgggcggagcggcaaggacaggcgcgguagacagcccgggcggccgcggcggggaccuggcugggggaggccaggcuugcggcggggcgcaacggugucuccuucacuucgcccuccagccgcgguggcugcagcgcaacuuucagauagcggaguggccucagcugcgagccgagcgguggcggcagcgccccucaggacacccgcagguacuauggugcccgccucuugccgacucuggggccuuagggcgggccggcagccugagugaacucagggcggcccugguccccuaagauggccgcagcggccccggccccuuucucuaauguccgagcuccccaggggacccuuugacuguccccugaccgcacuucuugucccuuucacagaucaccuuuuccccgcgacuucgccauggcugagugcuguguaccgguaugcccacggcguaaguagcacaagagguguuugcgcgauggggccaugggggcugugcuguuccucuuuagagaaccauaccuuguuccgccguggcccacaugaugccugcaaagacuuggaaaguuugcuucuuugcgcgcccccuaagucuuacacugccacucuguugacggacguggugcugggcuguuggguugcagauaggggggcucgcgccuggggcguugguccuuggccgcacccacccuuggcuuuuggauauguuacuuacaaauccgaaagcaaaacacuuaguuguugaauuccaucuugggguucggggggggggggcggagaguuagagcagucacuuugcaagaggaaguaguucgcugucugccugcacaggucgagugcacuacaaggucauuacacguguuccuaagggcguggaugugcacuggagaaugaaugagcugcuccuggagcucggauuccuugcccuuaagccucacguugucggaggacuugggggaccguaguaauguguuuaaagugccauuugauauuuaguugcuguagacauagaugguuguauuuuuugcccgugucucaauugugccaguucccagaguguugguuuugauuuuggaaguccuucccaaagguuuguuaggggagaacgccuaagcuuaaauuuugguuuuuaucuccguuaaaucagucaccuugaguuuuggcaacuguguaggcaguagacacuuauguuuaggaauuagaaaggcuucccccauucuuaaaacuugguagaaaugucccagguuuguauuaccacauagcuauuuagaaauaaguuuuuguuauggguggcuacuuuagaauaacauuuauugaaguucuaguggcaucaaaacccacuccgguugaacugcuugaauguaaauguuagcaguagguccuaguaguagcucacauuaacuguagaauguuucuuuugacuagcgauguguaucccuccacccuaugcugaccucggcaaagcugccagagacauuuucaacaaaggauuugguaaggacuuuuuucccuuuuaaacauaaaagagaaaaauauaugcuuggaccucuugaaaaaaguuaauugcuuugcuuuucuagacugaauacccugcugcacucaugccucugccagcugcauguguaccccacuuucuuagccuuucuucggucacaauugaaaagcuuguucuuuuuauuuuguuguuguuuuuugguuuuguuucaagacaggcuuucucucuguaguccuggcuguccuggaacucacucuguagaccaggcuggccuugaacucucagaucuaccugccucugccucccaagugaugggaggcgaguaccaccccacuccccacccccuagggagaggggaaagccuguacuuuauucuuuuaagugacaguucagaccaugguuggauagagcugccuagaauuacuguuuuauuuuugugguuaugacucuggguagguggaaaccuuagaguuuugagucaauuuuugugcuuucuugaaaauugauuguuuugcacauaccacuaccccuugcucuuuggugauacccuuuugggauaaaaguccuaaguguguugccauaaacaguaggccagucugaggaacugauuuuuaaucuaacguuuaaaaauggcuugaaaagggugcggcaggaaguggagccaguuauaggacacuaggcagcgcuacugucaccuuagcagagcugacugcuuguaaauguuccuucaugugcugugcauuuguccauuucugucccggacuuugggauuauguucacaguacuuugaguguggguauacgucuuuucugcagaagaaucauaucuuugcccucucuuuuugaaggcuuugggcuggugaagcuggaugugaagacgaagucaugcagcggugugguaaguuauugauucguuuucacgaagcuguuaauuucauagcccauaaauaucuacagcucuuuucccuuaaggaggcagaagcuaauuuguuuugaaugauuuauguguagucugauuuauuggcuuuguaugugauuucugcauuucacaugguuuuguuauauuccuuuauuauguauguuuuaccaugauugcauggagaaguugggaaagccauugcuuauuugggacugucuacucagguagaugacaagcaugaaggccgugacuccuguaacccuuucucuuaguaccugucagaguucugggcucugaguaguaacuugguuauuugacuacaaugaccauuuaguauaguggcuacauucuaacagccauccauggagaugucugccuguuuauccugacuggaaugucucuacagaauuugcuauuuucauauguguugauccuucccgacuguuguuaaagaagggagaaaguaaagcacuguucuccuucuucucuagaaguuuuuauugugagauuggagauggguguuuaauguucaugcuaaacuaugauugcucgguacugugugcaugcugcucugcauguaacugguaucuauuaaguuguuuguggugcuguuucuugaugcuuagaucuguugcauuuguggcuuuuauauuugucuuguccugugguuucuuuggucugugaagaagucuuaauuauuugguuaugguugagugacugacuuggauuaauagauuauagaguauuaggugacuguaaguauuuuuucuuuacuguugcugggccuugcaucucuacuacuaaucuuuauuuucagccuacugaauuuuaaauguguuugugcauguauguuguuuuaaacuaaaacacaccaucuuugucuuuaaaacguuuacuuuaagacugggaguguaacuuagcaguagaguguuuacccagcuauguaugagguccaguguuguaaaacaaacaaaaacacccuuucuauuggaaagacaaacuguaagucgaagauaaucagagaauuggaucaagcaguagauuuguaaacuaaaaauucuuguuggaaaggaaaggcugaugguaaaccagaacuaggaacaaguuaggaaguguaaggucuugaaggacauguaggaccuggauugaagaggggaugcucugcuuauacuugaguagaguugagucgucauagcacugaugguguacuacgcagaccugcccagaauuaaguccuacuaaggucuuuugauuucuugaacugcaggaugugcaggcuacccaaaauguagaagaugaugcuccagugauggagaggauugguccucuggcccuguuggccuuguguccugagcauuccuuggcacauguuaggcugguucuugaucucagggacugguggaugguaguagguggcacuugaguaauuauugucaugcaggauuaaaaacugcugcccauacacauuucccauguaaacuguuuguuggaagaagagcauacuucauguguauuuaaugucaucucgaugugcaugcagagcuccaaagcuuccauguugucaguucaguuggauuauccuauaauaggcugcgcuguuccuuugaaaaaacaaaucuaccuccaaaauguuauuuuguuaguuuuucaagacaggguuacucuguguagugcuugcuguacugggacugacucuguagaccaggcuggccuugaacucagaaauccaccugccucugccucccagugcugggguuaaaggugagcgcugccaccacugcuuggcaguguuugacauuucuuaacuuuucagguaucgaaauuucugauaaacuaaaaaccaaccaaccaaacaacaacaacaaauaauuuuagacauagcuuuaaagugacuagauuguagaggcauugauauagaaaccauaaaucagaacucagacuguuguaagaguuacauuuuaucuugggauauuuuacccacaggcugugcuugguaaagaaagauacuuuguuccucuaaaaaguucuaagauacagucucugaguucccgguuuaccuggugugcuacaggggaguggcaggucuuuuuggaacaaaaccaagguuaaaacuuuuuuaaaaagauucacuuauuuuuaaaauaaaaauuuauuuguuuauuuauuuuugauuuuuugagacaggguuucucuguauagcccuggcuguccuggaacucacucuguagaccaggcuggccuugaacucagaaauucgccugccucugucucccaagcgcaugcgccaccacuuccuggcaaaauguuuuuauuuuagguaucugaguguuugcugcauguuugucaugugugcuuagugccagugcugucagagucccuggaauuggaguuagagaugguugugggugcugggaccaagauuuggguccucuguaagagcagcaagugugucuacucacuggccauuuuuucaguuccaagccuaagcuuuuuaugauacuuaauauuaaucccuguauuaauuauuuucucugcugacaggugauguaugauacaaaccaagugugaaggaaucaauaaacucccacgcuuuuuuuuuuuuuaagauuuauuuauuuuuauuauauauaaguacacuguagcugucuucagacacuccagaagagggagucagagcucauuacggaugguugugagccaccaugugguugcugggauuugaacuucggaccuucggaagagcagucaggugcucuuacccacugagccaucucaccagcccaacucccacgcuuuuaaaagaacuuaauuuuauuccuguauggcuuuugccuccauguauaucugcaucauguuuauguuggacccacagagacccgaagagggcgguggauacugugaaacugaaguuacagacuuguuaaccaucuugugggcugcugggaaccaagcauaggucuguacaggagaaacaguguucuuaccuauugagccauuucuccauccccucccacugcuuuaaaacaaggaaaaucuggugagcugggugagauguguuggcagguacgcaccuuuacgcccagcacuggggaggcaggcaggucagccagcuucuuucucuacaaggagagguccaggcaccccaucuccacauaaggagacaaaaaccaaacacaacagcaaaaagaugauaauauaaguuauuuggaaaggcaagaaaccuagugaagacucaucuaaaaaaagcagagggacuggagaggcagcucagcaguuaagagaggguacugcucuuguagaggauucuaguucaugucucagaacccacaggauggcucacaaacugccuauaucuccaauuucagggaaaacagacuguucaggccuucaugggccccuguacuuacauauacaauuaaagguaaaucuucagaaagggaaaaagaaaaaauagaauauggacuauugaagaauuuaaauuuaacuuauuuaaugguuuucacaguaucuuguguguggauuaugugcguguguaggcaccugugucacagugcacaugugcagguuagaugacaacuugcuggacucuguucucuccaccaugugggcuuuaaagauggagguuaggaucagacuugcagcaagccuuuauacccacugagccaccucaccaguccuguguacuuaauucuuauugacucauugggcauguaagggacauucugguggcagucacuuggucagaggccggcuugucacuguuagguuugcuuaggaaaagcacaguggagagcuguaagggcuguauuagcugggcaguggauucuucaggcuuaggagaagguucaugaagcuguuuguugucuuguuaggaauuuucaacaucuggcucaucuaauacagacacugguaaaguuagcgggaccuuggagaccaaguacaaauggugugaguauggucugacuuucacagagaaguggaacaccgauaacacucuggggacagagauugcaauugaagaccagguagcguuuccagacuugcguuuguguuacucuuuauuuucauauuccagaaaggagauaucacugaacaugaauucuuuuuccucugaaauagauuugucaagguuugaaacugacuuuugacaccaccuuuucaccgaacacaggguaagugcugguguuuggugugcauugagcuuacaggccuugucugcgcuuacagcggcaucaauucugccuuugaccacugcucgacacugccagggccuugcuuucagaaugaacucucauuguggccacgcuuccuaccguuucugaggccguugugauugcaaguuguacacagcacagcucaguccuguuagcccauguggguuguuuucuuuaauuuauuuggcuguuuuuaacccuguaauugucacagugcaguuuguuuaaaucuguuucaugccaaccaugcaguuauauguauaaaucuuugucaccuguuucaaauaagugucuucuuuuuccagaaagaaaagugguaaaaucaagucugcuuacaagagggaguguauaaaccucggcugugauguugacuuugauuuugcuggaccugccauccaugggucagcugucuuugguuacgagggcuggcuugcuggguaccaaaugaccuuugacagugccaagucaaagcugacaaggaguaacuuugcagucggcuacaggacuggggacuuccagcuacacacaaauguguaaguuccuuacgagcuguugaggugcagguucucagaggauggugugugacaccaugucuuuugaugaguguuuaguuugaaggauuucucuugccguggguggcccucagaagcaugugcuguggaugcuugugccgcucaugcugucaggcuuggguuuaugccuuuuguagagguguuagccuuggcagucugccaucagugccuucucugacagaaugaccugugggaugugggauccuggguugauaggacgaucuuaacauccucacucaugcuguucggugaguuguggagccucacaccuuuaauccuaauuuggaaggcaguggcagcuguaucuuucagagauugaggucauguuagucuacauagugaguuuagguuggcuagagcuacauaguuccuuucuuaaaagagggggcaggguaugacauuuuuacccaacucaaguuagauacuauagaaaggacuuaacuguuuuuucuuugacaaaacuguauacuuuuaaaagauuuauuuauuuuauguauaugcguggucuaucuacauauauacccgauuaccagaagagggggcaucagaucacauagaugguugugagccaccagugugguugcugggaauugaacucaggacuuggaagaacagccaguguucuuaacugcugaaccaucccagccuugacaaaauaguauacuaguaaauaacgggagcacaaaagaaaacuuucucauaauccuaccagauagacacauaauuuaaacauuuuuuguauguguuuaucuguuuguuagggcacauauguagagauuaguggggaauugagugucccagggauugagcucagguccuuaggcuugguggcaagguccuaaagacccuauaagacaccucucuacuccuagauaacauguggcgccccccccccccccccaggguuucucuguguagcccuggcuguccuggaacucgcucuguagaccaagcuggccucgaacucagaaaucugccugccucugccucccaagugcugggauuaaaggcgggcgccaccacugccuggccgauaacauagcuuuuuguuuuuuuuaaagucucuuguguggcccuuccugaccugaaacucacugccuagauauauauaaucuuauuuauauuuugcuguucacuuuugugugugugcacaaguauguguguggugcugcuugggaguugaaugcagggauucaucuggauaggcagaauucagucauugaaccacaaccucaaugugugugugagugagugagugagugaaccucaaugugugugugugugugugugugugugugagugagugagugagugagugagugagcaagcgagcguuccauacccuuaaucccagcacuccugagacagaggaggacggaucucacucuacauagugaguuccaggacagcaggaccauauaaagagacccugucuuaaaaaaaaaaaauaaggggguuggggaacagaaggauuguggggaaggagucuagccugggcuacagaguaagacucacccugucucagccacaccagaaaagacuugacaguuuucaguggagcuucauagacuagcaugagugaugccacccuucccuacccucagcucuauugaaggaacccaggguuucuggcacacuaggcaagcacugugccuguguuaccugcucaguucuaguaguagcuacaccugcuacaguauugcccaguaccuuagaagugguuacugucuauuuuagauucuaauucaaaauaucuuauagaaauaaugggacagaauuuggaggaucaauuuaucagaaaguaugugaagauuuugacacuucaguaaaccucgcuuggacaucagguaccaacugcacucguuuuggcauugcagcuaaauaccaguuggauccuacugcuucuaucucugugaguaccucuugggcuuaggauggggcuuucugguugugggaauuacucugggaugauguagaaaccuucccugggauucaugcagucccauguuuacugaugggauuggaauuggaauacuccuuuuccuauggaaacugcgauagagguuugacuugcaagcuagaucucuggugauuuggaugaaaauggugugcccccccccccccccaugcacugucuccacuuggugagaauguauuaagaggugugaccuuguugcaagagauugggguagauuuugagguuucaaaagccucauguuuauggaucagauguaagcucagcuacuucuccagcacccugccugccugccugccugcugccaugcuuccuucccgccaugauggucacggacucacccucuugaaucaggagccccaaauuuaagugcuuucuucauaagcuaccuuggucauggugucugaccacaguaauagaaaaauaacuaauaaucacagaauaauaauugauaaauaaaauagaaaaauaauaauggggcuggagagauggcucagcaguuaagagcacugacugcucuuccaaagguugugaguuuaaaucccagcaaccacgugguggcucacaaccauccguaaugagaucugaugcccccuucuggggugucugaugacagcuacaguguacuuacauauaaauaaauaaaucuuuaaaaaaaaaagaaaaauaauaacaaucacagaaguucacuuacuuagagagcugauugaguuaguuuugcuaauaugccuaagcuccagguaaccagcauguggagccuugcuuggguggcuuguauuuuuguuggagaauaauaguacuuucuuugacuuugucuuuuuauaguuuauaaaguaccuuuagauuuuaucugagaagucacuagucuaacaccauuuuuacaggugaagagacucuaguuugaccgaaagagaggacuaaauauuacguuugguggugggguggcguggcguaaguaaagccaggacuagaccuaauguuuugaccuuaauccugucuagggcgaguagaauaucuuacugggagggacuguugccuaaaacccugaccuccaggacuuccuccccucugcuaagggcaaaaugagauggccacucuugucugaaucuuggcccuuuucuccuguuucugucuuuagucacaguggguugagauagaagugcugugaggggcagagaaucggcuuccaguucugguagcucaucagcuguuccugugugucaggaacggucuguacuguaugugcuaggaugaugggaaguuaaagucaggcaaguuacuuccguuacauaaaguacucuugaacuccaaggacaguauguuuugauaccuuuuaaaaaguuauuuauuuuaugcaugagugcucuuaugugcauguacaccugcaugccagaagagggcaucagaucucauuauagaugguuaugagcccaccaugugguugcugggaauugaacucaggacuucuggaagagcagccagugcucuuaacugcugagccaucucuccagucucgaguuuugaagcuuuaagcaguuauauuuuagcccuaucuuuugcuuuauguuuaaagauuuauaagcagagauagugugaaaaguacccagaaugcuuuucucuuuuaccagucaguggugcaucugugacugguacacucuucucagcacaguggucucuuuuacauuaaguguucuugucagauguaugcuuguggcacuaugacagaugguaugccagccaucagaaacaccuuucagcucacaguccuuguggaaauaaauacagcauuucacacccaaguagagcagcgccagaagcacugguuuuaucuuguguaugacaggacuagagucacugaaucacugcauauccacucacacagcacgcugcugcugcucccuuuauaccuguagccccaggaugcugaggagcuagcucugggguugaggggaggggagugggcucccccagccucuucccccccccccccccgcuuaccugugcauccuguggcuugcaggcuauuuguguucuguauuuguaggugaagauguaacaguuuggauaccucuguuagcaugaagguggcuuaguggagauguuagcugaggucguggagacugacauuagaaggaaugugggucgugcauguuccugcccagcagcccuuuggcuugaagagugaaagacacacaccaacaaauuuugauaugccuugacuagcucaauggcugggcauuucuaauccucccuguggcuagcacacauuuuccuuccaguauuccuggcuuuacaccuucuaaaucuauguuuuacuuuuguuguccuguuaccaucugggcagcaucuccucccuccccggccccccccccccccacacacacacacagagggcugcuuucccuuuccaccuacauugcuggaugguuuuuccucuguggcucuuaaaucucauuccucucucuggagucauggugauucucuucuccccucggucccuugccuucacagucuaaaaguccugucccaucuccuugcccagccauuggcuguaugguaguucuuuauuaucagucgaaggcagcugggagcaggaacucuuagugcugggagcacggcuuuugggagccaaaauaagacaaggcauuagaaccaguucccagcaugccgcuuaacauacuugcucuccagcgcuccucugggcucuggaaggccugggaccgccauccuaaauugucagggagauaaggaguugauaaaccaugcuccucgucaagccucaacuaguuaaagccaaguccagcagcuuagcggucagagugugaggaaggaaggaagccagccagccagccagccagccagccagccgugaggauggaggaaguagugaugcugagcucauaaacuuccuacuauguauucaaagauggcucucaccucuagugagucugacaggugccaucagugacauaguuacuuguuuuugugaguuuuuuuaguguauuuuuuaggcuguggauuaugucaggagcuguauacacauccuaagguguguaaagaauaucagguucugcugacgauuggauuuugaauucauaucuaauguucaaguggcacuugguguuuacuuaguacauaauaauauuuuaguaucucauugaccuaaaggcacaggcuucacaguuccaugauggggaaauuuccaagaacuuugucucccuucagaaauguuuuuuucucucuuucuaggcaaaggucaacaacucuaguuuaauuggagugggcuauacucagacucugaggccugguaaguaucuuugauaaauaaguuuuguuuuacagcucccucucaaaucccuuuaaaaagauucauuuauuuaaguuuauguauguuuugucuguugguauaucugcacacuagaagagggcaucugaucccaugggauuacagauacagaagggugggugaugggaauugaacucaggaccucugguagagcagccagugcucuuaacugcugagccguuucuccauuuguacguuauuuucaaaauuacauuuuuuuuuuuuuccugagacaggguuugucuguguaucuggcuguccuggaacucacucuguagaccaggcuggccuugaacucagaaauccaccuccccugccucccaagugcugggauuaauggugugugccaccacuuccuggcuucaaaauuacauuuuuaguuuauuauuuugugacccuuuuaagccucauagcuuaucacaccugccccucccccuuacuccuuauuuaagugccugcucugaauaagcacugcugccucauuguaaaaagccccacucuucacuguuuuaccauuauguaguuccucacuggugucuacugucucaggucaaagguuaguucccuucagguaacagauaccagagcagcuccaaacuugggcguggucugggucauaugcagcuucccaccuuguaggucugagauggagaauuuuguauuucuaaugggcucuggagcucacagcugcuuagagcaguugaucaacaagguccaaaagcccugguaucccaacuuuccuaauggggcaccugcuucccccaccuacauuuuaucuagacuuuuaaaaccuaaagaaaaugaaagugaacacugaaggggccaguucccgacgugcuaucucagacgagcacuaacuuaccuacuguguccugugucccugggugccucuuuuaggcuucaguugugaucuggucuccaguguuaauuuagucugaguaguccagugaagacgguuuuuagaacauggcuuuuagggcauuuugaacuuguuauuuauuacuaaccucccugugcccucagaugguguugaccaucaguuuuuagcaccacuguugaucuaggugcucucugcuggcuggagucaguguggaggcugcgugcugaggaagggccggcaggguggagugcucucaggcccaucauggugguuugcuuuguucacaggugugaagcuuacacugucugcucugguagacgggaagagcuuuaaugcuggaggccacaaacuugggcuugccuuggaauuggaggcuuaauccaguuaaaagaaaccucugggaacgaauaucagaagauuuggccuuaauauauuuccaugcgaccagcaggcuccccuuccuucccccagaaggugaucacaucaaaggaugaugaagcaagagcuguauuuuaaauauuuagacagucacuguuggcugguuccuaguuggaugguuaucagugcugccguggugcggcccccuauacauuauuuaaauguauuuaacuguuaaaugugcuacccaccaaugaugaaauagacguuuaugaaaaccgugccauggugugcauguuuguuuuauguuccuuuuaacauugacuauuguacugaaugagauggaucaguggcuguuuuaagaugagguaaaagauuuuuuuuuguuauauucacccaucauuagaauuacuuugguaaccccaaacaugacaaauuaugaauaaaacaaguguacauaacuaauggcucacguaugugcaguuacagauugccagccuagggucuaaucuucuuggcaaauacuuuuuucuggugagcauuuugcucuuuaccuaaaccugugcaaccaaauuccuugugucccuagcauaauccacgaggucuuugagauuacaauaaaauacaaggauacauacuuuaau

SEQ ID NO: 7304 - RNA, 3835 nt, Mus musculus
aggugugaagcuuacacugucugcucugguagacgggaagagcuuuaaugcuggaggccacaaacuugggcuugccuuggaauuggaggcuuaauccaguuaaaagaaaccucugggaacgaauaucagaagauuuggccuuaauauauuuccaugcgaccagcaggcuccccuuccuucccccagaaggugaucacaucaaaggaugaugaagcaagagcuguauuuuaaauauuuagacagucacuguuggcugguuccuaguuggaugguuaucagugcugccguggugcggcccccuauacauuauuuaaauguauuuaacuguuaaaugugcuacccaccaaugaugaaauagacguuuaugaaaaccgugccauggugugcauguuuguuuuauguuccuuuuaacauugacuauuguacugaaugagauggaucaguggcuguuuuaagaugagguaaaagauuuuuuuuuguuauauucacccaucauuagaauuacuuugguaaccccaaacaugacaaauuaugaauaaaacaaguguacauaacuaauggcucacguaugugcaguuacagauugccagccuagggucuaaucuucuuggcaaauacuuuuuucuggugagcauuuugcucuuuaccuaaaccugugcaaccaaauuccuugugucccuagcauaauccacgaggucuuugagauuacaauaaaauacaaggauacauacuuuaauacucugcaguuucuaaguuugugcaaaguuagagugaaucacuguuaacccauggaugaugaagggagaugcagggguggugcugaguggcuaaauaggcaugcauccccuuccuucugagccacgcuacagaaaguggagccuggguagauggaagcaacaggccaagagaggagaaagugggcaccauucucuucuauugacagcguugaaaagcugagcuggggucuggaccaggcagcccccuucgccaucaccugggugauauguauuaccuagugauccugguuggaaaaguaggaccgugccagcuucccuggggagguggugugucacaggugagaggugagugucacuucugagguguaguuuaaacuugagaggacagcuaagaaaauggguacuuugggacuuacccaauagaaauggugcauguuacugcccugugacccucagcuaacaaguguucuucaugcuggcucugcugagcgaguggacucaugugggcuaccagugcaucaaaggcacuucaaaauggauuggaccagguccccugugugcaccucaguauguacuugugacuugugaagaagggguagggcacagcuaguccccagaggguuggugguguguggcagggacucaguugugggcucacacaucuguacuuguagcagcugcuaagugcacaucacuugggccuuucuuaccccagaguggcaaaccuguggugucccagaaacuguccuuucugccucaguacaaagaacuuuaccuuucuucuagagcagcaaagcaccaggccucaggucaauaaagguuggcuccuuauagugucccccaaaaggacagugcugcaaaagcuucaaguuccugagguuucuugaaugagguuggcuucccacucugucugcuuugcaccuuggccaucagucuccucccuuaggacuuaaggggaugagggagcagauagaaaugccagccaaccuuagguccuguagucugggcuuccacugcacacaaguuaggcuggggaggcuucagcccugugaaaacaugaguagacugccagcuauaaaaggcccuaucucgacaucucuguggcauguggcugggaggccagagacagauagggucuucccuuauauccaagccuguuggaacucuacucagugaguacagcuaggacaauuuauuaaaacuaugcggucagauaaggccacaagccuuggugccagggagaccugcagggagggaacccuccaccaagugaacgcuggaagaggaugcucagaaggucgcguguccaguaccuuuauugucagguuuaaaagucaggucacuggcugggggucuuagguucucacacccaggcccuaagcuucguguuaacccuagaucuuaaaggccaaggagaggccaucauccaggggcaggaggcugauguagacccuggcgucccucaggaugcguucguucagguuccgcacacauucaacagucuuguuccugggcugaggcugcagcacuucuccgcgccacaggaccuacagauggaggggcggggccgucggaagugggggguagccgacccagagcuuuagccaggaggggcgggaccuaugauacucugggugggcuuuggggcggggcugggggguggggugggaagagcugagaagaguggguacccagccacaagaagcagcaguuuugccuuagcuaguccuuacucugaguacagcgagcacgccuccgggacguaggagcugcagacagcgcucguaguaggcgguacaguucucuuuguccgcguccaccacggcuaugucgaagguuccggccucgcccgccgcuaggagcucaucuuaacagggacagagggcaugugccgcuggcugagcuagggucucagcgggcugcucagggucgccaguuuuguuccccgggguuggacagugcugucugggucccucccgcacuggugcucacccaaugucugcagggcgggcugcagccgaaggucgaucuucugcuccacuucugccugcggaaggaggccggucaggccggcacgcccccgagccggagcccgaacggccgcagguguggggcucucaccugcuuccacaugggccgucccagcuucgggggcucugcgucaaccucgcaggucaccacgcggccagccuccggaagcgccaaggcuagggccagggccgaguagcccgugaaaguaccuguggaaggggacacugucaagcucaguucagggugcagggcugcccugugacccugguuuccagagaccauggcugcguguuccuacccagauccagagcuuucuuggccuuaaugagccgcgccagguuggccagaagcugggccuguucacaggucaucauggaaucccccugcggcugcuccagggucagcuguguggggagagggaggugccauucauaccagucaccccccccaccuccccccugagguuuugaaucauucaggggcucgguggcggguguggccuagaggggacaggucucagggaacccggaagcccagagaggguuucugccuagcucaaggucacacagccacgugagguccaccacgcuggaaguggggagccgguucucggucccaguccuacugaccagucgcaggcuccgcagcgccgggugcucucucauggagcggcucagcagauacugccacaggggauuguccucagguggcagcaggcgcucuugccgccuggacccccauggaggccaccguuucccugccggggagagggugccgagucagggccugcauuucugaccggguucuccggcucuucuccgcgcccuccucccauuccccggacugcagcagcccagcccagcucacccagcaagagaccaguagcgaaggcggcgcccagcgcggccgagcccagggccagugcggcugggauagauagccgagggacgggcugagccauggugcagguuagcagcggcggcggaggucacgugugcuggaguagcgaggaugggacugggaccaguaagccgacagggcuccaccuuguccgggcccugcccaca

SEQ ID NO: 7305 - RNA, 9351 nt, Mus musculus
cacaagaagcagcaguuuugccuuagcuaguccuuacucugaguacagcgagcacgccuccgggacguaggagcugcagacagcgcucguaguaggcgguacaguucucuuuguccgcguccaccacggcuaugucgaagguuccggccucgcccgccgcuaggagcucaucuuaacagggacagagggcaugugccgcuggcugagcuagggucucagcgggcugcucagggucgccaguuuuguuccccgggguuggacagugcugucugggucccucccgcacuggugcucacccaaugucugcagggcgggcugcagccgaaggucgaucuucugcuccacuucugccugcggaaggaggccggucaggccggcacgcccccgagccggagcccgaacggccgcagguguggggcucucaccugcuuccacaugggccgucccagcuucgggggcucugcgucaaccucgcaggucaccacgcggccagccuccggaagcgccaaggcuagggccagggccgaguagcccgugaaaguaccuguggaaggggacacugucaagcucaguucagggugcagggcugcccugugacccugguuuccagagaccauggcugcguguuccuacccagauccagagcuuucuuggccuuaaugagccgcgccagguuggccagaagcugggccuguucacaggucaucauggaaucccccugcggcugcuccagggucagcuguguggggagagggaggugccauucauaccagucaccccccccaccuccccccugagguuuugaaucauucaggggcucgguggcggguguggccuagaggggacaggucucagggaacccggaagcccagagaggguuucugccuagcucaaggucacacagccacgugagguccaccacgcuggaaguggggagccgguucucggucccaguccuacugaccagucgcaggcuccgcagcgccgggugcucucucauggagcggcucagcagauacugccacaggggauuguccucagguggcagcaggcgcucuugccgccuggacccccauggaggccaccguuucccugccggggagagggugccgagucagggccugcauuucugaccggguucuccggcucuucuccgcgcccuccucccauuccccggacugcagcagcccagcccagcucacccagcaagagaccaguagcgaaggcggcgcccagcgcggccgagcccagggccagugcggcugggauagauagccgagggacgggcugagccauggugcagguuagcagcggcggcggaggucacgugugcuggaguagcgaggaugggacugggaccaguaagccgacagggcuccaccuuguccgggcccugcccacagagccgcguccucgggcaccaucuggugacacauggccguauugcaaggucaggcugagaacaucucgccacccgguggcugcaugcggaacugcgucgggguauggagucaucucugcaccagggcucuugugagcauggggagaggggauaaagugaguguggcuaauggaggaauccaaagagacucgggaaugcuugcuggaggggugcccaaguuaaaggaaccaagaaccugguuuagagucaccugguuuccaagacaguauccuuaguggcugggaugcuggguguagcuuuuuugugugacgguccgucuuuccgagucuguuucuuuucuguaaagcagguauuacagccuuacuacgauaggcacgggauuccucgcauaguaggugcucaauagugguacuugcuguuauggucauuggcuagagaggguuccuugggaagcgguagcaucuuggcaggcagcagcugaguuccccuugcaaggcuaucugcuagaccgguguucccuagacauuuauugaauaucuacuauaugcugaacucugguggaagcaaaagacugugguaguuuaugacuuggaaacaacuggacagguacaacuggaaugcaguucaaguguuacugucccucuuuuuucuacagugaaauccuuucuagacuucgcucacaggagacucugcugaccugcccucagggaccuagcaauugcuuaaggcaucaccugccccgccccccacguacgacagguaugugccacagauaaaaagacccccaccccacuccaguccuuuggcccccuuccccccuccccuggcuucauucccaucugucugucuacauagccacuugccagccucuaguccucuucucccaguaaacccccuuuauaccagaacuguugcacaguguaauuucucaggggugcaccuugccucgggccaccaagaauacugucuugcagaguuauauuucacaacacucacugcacacaacacccgauggaguuccgguugaaaacacccgcacagugugccucacacacaggcuuaguaggcuauuggugcugucuuuaagagcuggaguccacagggccucagaggugguugcccuggaagucuguuucuuaacaacacuggccaggcccggagacccuccggaggcaggcagacaggugcaggaucagugagagagcccuagaccuggccaacugaagccaaugcugcuagaaucccgggccucggaggugagggcaggucuccaaucacaaucaggguagacuggcuucuugaccuaucagcaucugugcagggugcaggcaaacaggaggggaaccuacuuucucuaggggcagggcgggaucucagcugcuucuccuaacugcuccuggaacaggccccuuagacaagcucuuucuucuuguugacucucaaugacuugagaguccugaaaauaucucugaguuugagucaugcucuccagguaaggcccgaagaaaugugaguuccuuuagggcugagcacacagcaggcacuaaauacgugcuggcggggccacacugcggccagugauaacaacggggccacacugcggccagugauaacaacgugacaaccggaagcuguuacuuagcaccugcuggguaccaggugcucaacacccagccaucccuugaagcagcgguguuguuccaauuuucaagagaaggaaaguccugaauugaucaucucuccgagcucacugccuagcgccuugcccuccuaaauuuccaccgucuuuaucaguaccucccugggacgcacacagagggaagaggcagccguguccccgcuaggccucuucagcgggcuuguggcaccgaguccuuguccuuagccggagcccucuuccccauaucuggggaccgggauggcuugcaaguucucagugcaucucacagccuuccuccugcaaccuggcuccaggcaggagcgguggaggugggggaagcgggcgaggagggagccaugucaccauauaucccagucagauuaaaaaacuaauuugaaaagauuaaugccuuccauuccuguuacgcuggcucugauaccucugggccuguggccgcucugccuccugauuauugaauuuuuauggccugguaauuaauugcagauucccuguuuuguucuauuucuuuuucucugacauuuuaauuucaacagaaagcacuggucucuaugcagauucucucuggagacccuaauggucuauaaaacagaaugacuuauucacguggcacccacuucagcuggcgagcgauuguuugaaaccuugcugaucacgcaaaauuuaauuuucccaccucccucuccuuuuggucuucaucucuugucucuuccuaugcagggacagugccucucgaucuuuugcagggccuuguuguaggaggcugagucuaaagucaaggcaggguuugaucccuuucuuuggcaguggguucggaacugggugcaugcagauaaaugggcaugucuggccaaauugggucauagcuguucauagacacagggcugggacagacccuugugcuucugccccaugccuuccgaauucugcuucuuccagcccugcugacaucaggugggcuugucuccuucagagccagcgcccuaccccgcaguagccuggcuaggacagggcaccaagugaaggcagaagguucaauugaaccggaggacugggaacuugugucuccaggagccaggcuggugagacaagucaggggagggcgauagggccccaugggggcugucacuacagugcucauguuccaccagaggauaccggagccacucaguacucacugcgagauagaaagauggcccaguguggccggggcuucugggucuuuguuugaauucuuacaaacaucuggguuuguuguuuuaaacauugucagucaaccuauuugaacugugacugauucagcucacaggggcuccuacucauuccuagugcaaagagaagucacagcgcgaaguagaaucccucaggguugcuggcuucccgucccucuguggcccccaggaaccuucuucgucccucugggcccuccagggcccuuuccauauuugguuaguuucccuuuauccugggcugugaagauauucuuggguggauucccagggcguccugccccuguuucucagagaagcuugcagcuuggcuuccccauguccgggccgggacugccagauucugaagggaaaguugggaaaguaacgcaucuuaauuugaggcuuugggaggucaggcugagccucuggggaacccuaguggacugaggagggagguagaccauagaacggguuucuuggguuccucaaauugaccggggaggaacccagcaacuggggcaccuucugugcuuggauacugggcagcuggcacuggcaacacccaaagugcuucaguuuccuccucguuugagaggccagauagggaagcaguaacggacuccagaguuagauagaccuagguucaacugugggaccccagugaccccagccugccugagcucagaaccucucagauggauaaaaugggauugugacgguuuggcucuuagagcugccuguguuuggggauacugaagguggagcuuaguuacagaaagcugggucauuguggguguggcaaggaagcgaauauugggacccaccuuuccuucuguuucugcuucccauucuucacgaaguaaacagccuguggcaacucccccugccaccacgaggcacagggccagcauguccacacacagcaccuugcugaaugacuauggacccagaacucugaaaucugacccccuuucaagauggccucucccuguauaucccaggcuauccuugaucuucuguucuucucaccuuagacucucaagugucggaauuacaggguccaucaccaugcugcuuucgcuaacuugguuuuuuacauguauugucacugacugccguggguauggcguuuucuauugcuguauuaugaauauccacaaacccaguagcuuaaaaauaccagugcauggaccugagucugugagggaaggaacccuugugaggucagcacuguauacucaggaucucccgaggauggcaguucucagagugaggggggccucuccucuaagcgcgggaguugucugcacaacucacguccuucuuuugagaguuauccaccuuggaggccagucauggcgucuucugaugccucugauuucucugccuucuccuuugcuuccagggacucaugugaagucuucguuaucuccccguuuucaggugagcuggcuaggaacuuuagcaucuuuugccgguuaagauaaugauccaaagaguaacaucgacgguagaagccuuggggucagauuuuugccuggcccaaacuccaggcuuccccgaaugguuauaaggaggcuggccuccccuugccucuuuccuccaaugagcagauucagaaaggacagugugccaggcagggucuucugauaacaagccacagcgccaccuuguggcaaacaucagguucgacuuuacuacaaacaacagaagucucuccaaauagcacguggaagaggcccagaggcucaggcugggauguccuaccauaagauugcucuaauuaaaacccagcgccuaccacagcccucauagcuccgggagauuccaccacaaccaccgccgaacauucacauuccccuucuccuggaucaccacuugacaggucuuccacguuugcuggcaucuguagccagcucccgugccuguaggaguuucugagaaaagugucugucgucuuuucuaggaaggaagacgcaggcagaggccagcaucaucucagcguggagagaggagcugcggggaggcuucaaugcuacugcgcuaagccccccaggaaguauugcccacucaaagugcccacccaaaaccagccacucuagggguggcugcaacuuggcaccggaaugagccagucuagaaagaggagcaugcacgcccccugcuggcaacugcuccaguuacgguuuuccuuuuccuuuuucuucucuaguccugauuguccccuucuacccucucucaucucucaucugagacaggguuuuacuguguaauccagguuagccucgaauucacagagagccaccugcuucugcuuccugcuuacagugugugccaccacgccggcaaggguccuugauauuucuuuuucccuugcagagaaagcugcuucuacccuagcuggaccucacaauaucccuggcaagguuucugaaguggaacuucacagcgguccagggaauccugccagguguguaaacaggacaaagcaguuaauacuuaccgcguccccaucacuccuuaggauuuccuauuggccccuuuaauccucauaccguuagucuacagggacagguaccauuuuagccccaucucauagaugugagagccgaaacacagacggguaaagcagcuugucccacauugcacagcguauaaguagcagaguaaggauuugaacucagauguuuuaguuucaggacuuaacaauuuuuuaaggaccacacuauccugcaggaaaugccuuccucaucacguggcuucucuuuggggcaagauagcugcuugagcuccggccauuacaaauuaucuuccucagauaaucaggaaauaggaagggacaaaacgggacucacuuccuucuuuucauaaacagaacaacauucugaagggucccuauagaccucuacuauuccucuucugaccacagccacauggucauacuucugccaacaaauuguuuuuauguuuguaauuaugacaaaucacuugcaaaguuaaaggaaagaauaguuacugggaacaucuagcauacacacacacacacacacacacacacacacacacacaaagauacugaagacucagaaaggccaguaauuaucugaaggucacaaagcugggaaaggguggagguuagauguguuguuccuggaugaaacagguaucgccccagagacaugcucaguggagugcucagagggaaggaccucucauuagacuucccgaccucuaggaccacccagggccacuggucagaucuccagugucuuccagucccagccaccucucuggcccagaaccaguaucaugguaccaggcauggccagcaccgacuucauccaucccacuaaagcccacaucagcugugcucccugaauuucuguggcugacuccugagaacugaauaauucaagccuauguaaugggcuaaugaauuuacugacaagccaacguggucgcaguacuugcaguauagaaauacugagucccaggcaggcaggcaggcaggcaggcaggccuaacaugaagcuguugccccagcccucccuagggaacuuggccugauggaguagaaagcccacgucagccucacugguucuuccuccugcugaggagcauggucaggggaagagggcuggugggacuuuugaugggaaguagaacccgauagagcagcagacguggguaggaacacccaaccccuuccccacgugcccaaguaccacgguucuuuaugagguaaaucagguugaggcacuguagcccugucgcuguucuguguugggaauuuugggguggcugugagccccuggggaggagaccagcuuccuuccuccuaacuugcucaccuguagaagguuccugccgauggcuugcacaagucccucccuggagauaaccaacuacaaccccucucaacccuggcagacaugacuggagagggguuggaauggcugaggggcaggucucuagccuggaguagaauugaguccugugaagcucuucagcugugagaccccccgcccuccuguguucaggcucaccccucccucucugccuccugccuggagagcugcauugcacaaagacacuuacuuucccuuggcccuggcucugcuaugugucaggaagucuugucagcaaugggccucaguuucccaucuguaugcuggugagaggaggcucucagagucucuucugacucaaaagaaaugacccgaggggcaggaagcucucucugacccugcccagcccugcaucacucccucucaggccucuuccugggaacuccagagacgccucauugcucccugccugucagcagugugacagacgaggggccaggagaagauuccacaaaggcacagaucugagggagccacagcugagguuuguagggggcaguagccuuguuacacacucuagccccaagccccuggagauuauugcuguacuuguguggggagccuucucugagagacuagggacucuggauaaggagagggcaugugggccuuugacucgggauggaaguaauggcuuugucaggcacagaggccuagcuugccccucugucaccguugagcagaggcagagguaggccagggcugaccagcucaggcauuaucugugcccagguccagggcaguaccucaugauuuuggaaccgugaaaggcagccuguuuucugguggagcuagguuuaaacccugggagaccuagcagguguuccugcaagguacaggaguuugccacgccccuaggcacuaggcuccugacacacaggagcccucagcucuccauaauucugugaccaucagucauguagggcaaugccccaagcgccuccacagguagaggaugugacuacagaucacagagucucaagacagaucuccauuuuaaugagguaccuaaagggcugaagggcuuagccaauuaaacucuccuucccagacacuccucccugcaaaagguauuuaaccucaggccugcccugagaaagugggguaugauuucacucaucacaacucucggccaugacaauaaacgcuuua

SEQ ID NO: 7306 - RNA, 5645 nt, Mus musculus
auaauaagaaguaaaaccuuuuaauacaucaaauauacggaauuuuaaucuuuaaagcgauacauugucuauuauuuuagcacaugacguaaaccuuguccccuucucagcggguggacuuaaaaauuaaaaauaguuaaguguuccuuuuaaagaacaaaauaaggcaaaugagguuuuggaauagaauuguuuuuccuuuuuuuuuguuuucuuccagaauacauacaaaaaaauacccauucucuuucgaugguauacaccuuaaaaauaauugcaauuugaaaucagaguugacaaauugugacuuauuuuguuucgucguuuucauuucuuuuuuguaacaaacaugcauguaaauuugaguuucaaucagacauuaaauaagaacgcacaauacaaucauagcaauuuuaaaguaacauuaaagagaagaccccuaauucuguagcggcuuuguuuuuauuuauacucuacaagggaucggaggguuuguuuuccacauauuuacccucgaguuuuaauucccccccuccuccuuuuaaccuacggagcucaaacuaaauaaugcacuuuugaaccacggguccgcuuggagcuaacauaaauaaauaccaauguucaccggcgaaguccucagaugaacacuuuuucaauuaguuuuccuucuuuuucuauaaaaagucaaaugauuuuuuuucaacuuuuauaaaguuugauugggggaguagggguggaggagaaguuucgcauccaggcucucucgaucucugugguuggguggauagguaagauuuaaacuuucuuuucccuuccguagcccgggucuucugccccugcgggugucaggaaccucgcucggguccugccccucccucgcuccucccaucccccagauccuuccucuuuccaaauuccucugggccgcccucacugauaccccagugcggaggcaguggucagucucuguccguagagggcauaaggggaguaguaugguccgguggcggcaggcaccggcacuggggcaccgggcguggggagcgggcucuuggaauacgggugguagcggcugcugagucccagugcguggugggggcugcgcagcgccagagucccugggcugcccggugcgcccgacguggggaugugcaugugacaagccauggcugcugcugcggcgcuggcgagagacgaagaacugggguagcccgacagcaguuugucugucccugggaaggccguauggguccgcaaguggcucagcagcucuucggaaguggcgaagcgcuugucgcacggcccauuagcagacacccaguugcagaugugggggagcgggucguuagggagcaugaaaccguagggguagaggggguggccggcuagggagggugguguggcgcccgcagcggccgcagccgucagcgaggagugaacgccgugcagugggugcgugggguauacuagcggguaucccgauuugagcgcugcugcugcagcggccggaucaugagcgcacgaggcgcuggcggcugcagccccggccaaguggcuggcgcagugguagcugaggcaguaugggucccggcacaaacuagcugucaucacugauggaggcgacgccccggccagaggacucgaacccgcuggcuuacugcagccaagagagccggcugcggccgcugccagcugagccccuaccaggcugccagguuuaguggggucgagugccacaccguguggcaagaacuggggcggguagccagcguaggccccagccaggcugccuggguaggucaugcccgcaggggguagagggaacacugucuggcccgguuuguagggagauaccggggccaccagaccggagcccaaaaccgacgacgaggugggcgcgcuggggcccgaacccgagcuugagcuggaagagccgccacaguccgagccuagagccuugccuccuggacccccuuccgagugcugguucacguccacguuaauuccgccgccgcagcuaauccggccgugccccagcccggcggguaccccgucugccgaggcgcccccggagccuuugcugcugccaccgccgccagcuuccggaucuuucuugucguccuugcccuccgggccacccccggcggagggcagcaugccucccggcgaacaggccgaggcgcuggagcugggacugccuguccugggcguaaauggcuggcagguggcgcucgguacccggaauccugacuucucugcagcaacacccccgccgccgcccccgccgccgccgccuccgccgccgccucccggcuccuucuuaucugaaccggguuuggaguaaggcuugaaacucgacuuguccuccacgccgaugucgcucagcuucaaggggcccgacuuggcguccuugucgcccccagcuccguugccugcaccacccgcgccgccgccguuggaggcgaccgaggagaguuuggaagaaggcgaaggguccggcuucccuaucugcgaacauguuugagccagcagcgccagugggcucuucuuggcguccagcugcggagucagauggggagggguucacacagagaaagagagaaacccuuuagaaaccugcacuuaggguucuagugcccuucguaacagcccgcgaaaagcauuucaacuuccaggcgcaauucuaaguggcaccccacuccguauccuugggaaagaugccagaacccccuggucgcucuaggauccuuccugaauucuuuaagucacuacuuagauuuggaaacaaucucucgcaaauguuuugguuuucaucccuuuagauccagaauuguacccucuuccccagcacacacuccuugauucuaaagugugagugcuugagugguuggcgccuccgaggcuguguaaauauacuagcuucugaggaaggcgacuuuggaacaguauacaggcccuuguccgccuaggggccgaugggggagggcuagguacauagggacuuuaauacaaaaaggagacaaguuuguguggcuuugccccuuagaauuugcacccaauuucaucucguugcucucuacugacuaagguugaggaaguacuguccuuuccucccauccuggagcugaaucacuucgacugcccccacccccacuccgagagccccagaucccaggggggaaagaaaccccacaggaaggcagcccugguaggggacucagcuugaccccgagagaagguccuuaccucgauggggcugacgggcguggaaggcagggguugcaaauacucugggugcaaaauguggccaguccgugccgucagcaucuucagcaccuugaugggcaggcgguuagccuggcgcagggggucagaggggggcacagcgugcacaaaaggcuuggugcugccggccggggaggagccugggccguggccggagcaauuuccagaaagcgcgcugguccaggcaggguccgcgcugccgccgccgcugccgccgccgccgccgccgccgccgccgccgccgcugugcuuacugcuucuuagggcagaaagcgagggcgcugugcucaugacccacccgcgcgcaugggagcagcggggggagggcuccgagaugcgcggggcgggcucggggcugcgcgcucgcccggggagcgggagcagcuggaggaggagcuggcgcggcggacgcgggagccccgcgcgcuuucucgccgccgggagccagaagcgaauaauccuggguggcccgcagcggagccgugauggggcuagaagagcaggacagacugcgggaguguccccgcggugcgcggugucugccucgggcugcgcccugcgcugcgcucucccggccccgagccggcgcugcgcucugcgaugugugucgcugcuuguccagcccgggcucuggcgaggaaacucacuucaaaagcagcugcaccgagggggagauuaaagccuuugccgccuuccaaucaaaugggagcccgaggugauuggagggucaaggggaugugacgcgucccgcgccgccgccaccgccaggaaucucagagcugguuuuaaugggcagcucccucuucgccgccccucggcuuguccccucccucgauuucgcuacccggacgagauggacauuuauucuacguuugucaucuaccgccuuccuucuuuuuucucuucgucguucuucguuuucccagcaggaaaacaaacugaaaccuuuggagggagggaguguuaacagacuucgggagaagaaacgcaggcgguaauguggauaccugcugaacagucaacuccagggaugagugggagccuguauacaaaaaaaaucuuuucagaaauuaagauuuugcguggcgcggccacccggguaaggaaagucgaugcugcagaaagucugcccgcccgcuuggauuuccagagguucagcagcagagaaaccagaagcuagaagggcaacggaggcgguggcugcucguccucgcgacgugcgccgggcucuccgcccuucccggucacgugacaccgaaggacgcucagauuggggcuugagcggggggucacauguuuccccuguuucacacuucagccccccccccauucuugcuuucgucuugcuacucucccccccccccgcacccccuguuucucugggcaucuccaccccuccaucaauugucaaugugccucgaccgcaaucaaucaguuauuugucagcucuugucaaucugcccgugauuuaugucagcuuuuguugcugauuacaaggcgggugagacuugaagggaaaaagagagaccuagagugagacagaggaaggaagagaccgagaagaaacugaaggagggggaaagagcagcagccuccuggcaccuguguguguguuuguguguguggaggguguguaagaaaaagaaagaggggaaaggggcguccacagucaggaaaaugaaauagugagaguaaagugcgcaggugcacccaggacuccuagucuggagcaccggccugggaugugcucacucccucuugggguuguggagacagacacaccuucuaccuuugggugcuucggucaauccgggucgcccaguucgggucugcugaguaccuaagaacgacgcuggaggcgacgucuaacgcggagguuucccgccucucuggcauaaucccucccgggaauguaacuugaggauguccaguugucgaccucgguaguguucccaccccagacucgggaauuucuuuccaaagagccaugccaucaaauauagcccgaguucuggagguuacuuguagaauaaaccuccuuaauucugugacccguguucguagcgagaguugaauagcucaagagaagaggccugaccaugugcauaggcaaacaggucucaggcucgcucuccuccucucccggguccuucgccacuacccuccgcuggccaucccgacaguccugggagccgggacuuaaucgggcugcuggacggcaugauguagaccauccagacaggacugaccuaugcggggagaggagagggaaggaacgcgagagggaggggcggcugccuguggaaaccgguucuuccagggaagcggagcgggacuucggcguuccccucgauuugcgc

SEQ ID NO: 7307 - RNA, 1397 nt, Mus musculus
cguagaaaguagaagggggugagaagaggacacacccccuugcucggagggacuugggagacuuugaauuuccccuccccccacuuuuccgcagagcucuucuuuuguugucaaguccuuuugauaaaugguggggcugggagagcugggagccaggagccgaucugcgcccugcgcaggggcgggggcccagccuggagaccggguucggaccaccgcgcacccugagcugaaccgggcacgcucaggggacuuuuccuucuguuugccagccuauuucuuuccuaccaucccagucccccuucccuucuguuucuguccacgcggauaacgagaacuuucuggggugggggugaguuauauaauuuucucguaaguauucuuucacagaguuuugauuuuauuccuugauuccuuagguuggcaaaguuaaugggaugguaacucgauuaaugguaauuuggaaagaagagcggcuggggcugguguguguguguguguguguguguguguguguguguguguuaagaacauuggcuguuugugauccuccugcgacaauugagaaagguaaauuugugagacuauggcaagaucacaggcaccuuugugaaggugccugaaugaucucuggaguaagaaguccagcuuacguuuuggcagaauggcaaccccaaacucugccggguaaggucucugaagcugcuugcagccugcgggguguuagugccugccggugucucccacuguauggcucuaaaggugucacccucuggucagcuccugugguccuagcauaggaagcuaggccuugggccaccugccauauuggccucuuucauaggccuggagagugagaguugacgcuguggacagaacugaggagagcaggagcaagcgcgggccuaggguguccucuucgcuccggggguucaguuucuaggcucaguuugucucuuuuccuccaauuccaguaguuuucucauugcgcugggcaguucaagggaggccaccccagcucuucaagacugguagaaucguggaauggcucucgucccacguagauuacaugcgcucaccggugugcgccgccgggcuccgugagcuccgacugccgcguuaaaacucaacuccgaaggucggagcgcacgggggcgccugggggucugcguuccccgggcuuuggggaggcaccagcaucugagccugcgcaccucucaagggaggccaaaucucugaaggccgaguaagcuguggaaguuggaggggguguggggggauauauuguuauuaauuacuucaggcuaggccuaaugcuuccaacccucagaggugguuggcauggacguccugcggauuuuauuugcacacaauggacaugauuuguuuucuaaaaa

SEQ ID NO: 7308 - RNA, 2795 nt, Mus musculus
augcacuaguaccaagaugauuuugcuauauggaacaacuuaccuucaaaaauaaguuuguguccauguacuuacugaaaacaauguauggcaagaguucauggaaggaacuaggaaguggaugguugaagagccacauugaaaucagagcauugauuuagaaagucagagagaaccauggaaagggccgcacaaggagcgauggguaguggugacuguacccuuugggguugaagccuuugagacauucuauucuuucuggaaagcaucacagaaacauaggcucucaaguugaaccaucucucagcaacuugagauccugugauugcacucaauaacagcucaccaugaagaacaccuaccuucuuccuacauuuccaccuugucaugcaguacucaauuauuaaaacacccauggguccaccacacagauuaaaggaaaggaaaagauuuucagauuauuuuacaaaagaguccugcugguuauacuauuuuacagacacuaauauaauaacagacaccagggagaccaccaaaaaaaaucauagaauaaucaagaauuuaguuggaggaaugaguaugacacauucuugcuugcaguaagcuugaaauccaacuuaaaggagcacccuaaagagccaguagagaaaaaauaagcauggcuagaacacugcccuccaauagagcaggagauaagaaacaagcaguuugaagcaguuaaucaagcguuguagacuagacgguguuucagaguuaaguaugcugaggagcaacaucccagcucauucaggaacauggauggaucaaugauuucaugaguugaucgaguagucccugugcaccuguugcuggacagcuugugucccuucuuggcaacaggagacauguuauguagaacaugcauccaauaaagacuuuuaauuggaugggcuacauagcaaguaaguaccaugacagcuguggaaguuugacuuggauucuaaggaugggcaguuugaaagagucuauaaaaaguaaugguuugcugcagaccccaaggacagagcagugcagagggacagaaagaagaggagagaugagaaugugagacaagaauuuagacagcugagaaaggggcugcuuucaucccuauaaaaaggaggggagagauccauuucaaucaugaagguauucuggacugaagaugcaaacagcugagaagauguuuugggagguccagaucaugaggaagcccccuuuagcccccccgccccugugauucagguaauuauaaagggagaagucuggaugagguuuuucaaugaagaaaacauaggcuuagaugacaggucaguagaacugucuggaggcuauagccaaguuuucaggggcucaauggagcaaaccaagcugauaugauuaggacagaauaucuuuuuaguauugggagagugggaaacagaaaggagggcuuaaaauagagaaaaugaaccaguaacugaggguugagauacaggggaucugaaauagugaaguaaugaggcagacuguaaggaccaauuucuccuuuugucuuuaucucaugugguugccaugaagacuggaaugagugggaaaguagcaggucauucucggucaguuuuuacaccauggaaaugggguacacgggguacccaggucaucagcaugcccucuaaaguacccacagaaaggucuugagagguggucucuccuuucaucaguucauaucacccccguuguaccucaucccucaugcauagcacacccagaaccuucuaguugcaacagucuucauacacaaaaugcaaaggucgccuuguucugguggcuuuucuggaccgggguaaacaggaaugcuuuuuggccaagugaaaacugagcuccuuucuagguagaauauuacauugaaaagagauuuccccuggucuguuuaucccaugagaaacuucuguguuucuucuuguccuccaaagcugaccccgaagcuccccagggccugucuuaggaaacagcaccuguccugcuguuuagagucuucgauggaaauguacacacacaacacaugugccugucaaagcauccccgaacuuccugcccuagggauccaggagguagccauccaggaggagguugucauagggaaggacaggaggagguagucauccaggaggagguagucauggggggaaggagccccuauaacgagacaagucaagccccaggucuccacgaaaccagagccguuccccuucuccuuccgcuguguacacauuugaccagaacugcaacauuucaaacauaaacccagaucugccuggaaauccuaauuaaaaacguuccauucccaggugguacaaucacauccugccuaaagugucuggcucacggcccaccacacagaugccgaaaagagacuuuuccccacuuaacaccaaaaccuucauuugggauuucuuuaggggacaaagggaaaaaaaaaaccaauucagagguacccauaugcagaggucagccuacaacacauucauuaagggaaaagagcgugguuuguuucuuugucuuucacacuuugauugcuggcauggugacuguggcuaugaugaauuauguaaccagacaggaacuggagaagagaauaaaugcuggugcucugaaaugaccuacccaacucugucaucuguaacaaccagugauaacucucuugucuuguaaaaaggguuuguacauaacuuguacaugguuucauuuuguauuuuucgcagauuaaaaauuuauguauuuguguucuaaaacaa

SEQ ID NO: 7309 - RNA, 4780 nt, Mus musculus
uggcuucaguuuaaaaauaaaaaaagucaccuuuggguugagaucgagaauggaaaguuucagggcauaaggguaauuuuguuuuuucuucuuuuuucugggucuguucuaggcaagggcaguugaggugcuuucaugaaaguuauguguaaguauguaccaugugccucaccucuuuauggccccgugguguccccucuguuaaguugauguuaguaagauuccuccaucugucuagcacagcagaguguucggaguagaggggacacgugugaaauuggauauaagcaacuaauuggaacgcaaaggagaugauuaaaauuaagcuguaucuucuaccaagguggcuuuaucacauagagugcguuuuagcaccccaaaugagcaaugacucaggcucccaauuaguugaugacaaaccucuagagaggaugaagggccuaggggacuauauugacaagugggauuaaaaauggagacuccuuaggaguucuacuaaaaaaaaaaaaaguuacgaaccccggcuggaguaauagaucgguguaaugucugcgcgcaagcuugaggacccaaguucaauccccagagucuauauuaaaaauuugaaaagcuggauaugaucagugguguuugcaaucucaacaguagggccugggggaauggagacagacaugucucuggggcucaguggacagcaguagcuucuuccgccccuccugggaaaacugcaggaucaguggagcagggcaagggcaguggagcaaggacaggcacaaugccugagcuuucccacuggccuucacgugcauguguguauacauagacauccccucucacgcauguacaugcacccuccuccgcaaguauggacaggcccugacagcuagagugagcuuugcggagugggaugacuuguuuguuugugguccucuggcuucacagcccacuguugccaaggugugaagagacaguuguuuugugucaguuuuacuguuucugacaacuguuccugaggaaauauacauuugugcaacagaccgccuccaaugucaggucuaaauuuagaagccaccuccgacaggugcuaaaaucagucauacagaauucagggcggugcucaggaauacugaauacccaugaggcuaucauggccccugauagaacuuuugugucuuaggcccucaaguuugacagaguguggcauauuuucuguggaccaggcuccagacaaguacagugauaugucuucuuggaacuaaauccacacagcuggaggaagccaugccugguaugaugccauugcucccaucuggguaccugcacuuucaccuugacucuguaauguaccaucugugugucuggagcauccuuacccagagaaugagggcacagaaucuuuuuaaaaaauaauuuacuggggauggagagauggcuuagugguuaagagcaccgacugcuauuccaaagguccugaguucaaaucccagcaaccacaugguggcucacaaccauccuaacaagaucugacacccucuucuggagugucugaagacaucuacaguguacuuacauauaauaaauaaauaaaucuuuaaaaaaauaauuuauuuuuguuucaugugcauugguguuuugcccgcuuguguaucugugugaagguguuggauucccuggaauagagguacagacaguuuugcgcugccacaugggugccgggaauugaacucgggucuucuggaagagcagccagugcucuugacugaugagccaucuguccuguugaaucuuacucacucuggggucauuuccugaaccugagcaacaugauuaauauacaacauucagguugggaagaagaacuucaaauuauuguuccuuggguuuguaguggucucaacuaauaacacaagaaaaaagucuugguucugucaagcggacauugcccuggguuuugccuaguuucugcccuggaugccccuggaccuaccuaugagacaggacagcagggagccugggcccauggaucuaccucacauuuuuaauuuuacugacuacuuuagaggcaggaucugacuacuuuugagacagggucuugcuauacauccccagcaggccuugaauuuacagcagugucagcuucuugagugaagguccauuuucuuuggacaggaucucauguaucuagguuggcucagcacuuacuuuguagaugagaauggcggucuuucaacuccuuuucccccuaaggugugcaccauuacacauuuaaucguuuaaucguguggaccauccugauguauccguauagccuccuaguggauggagucuguacaagugaauuggcuuuuccgugucuguuuuugcaccugaagcuuaucauaagcagaguauggggaugaggggauagucuaagucuggguccaggcuuuggucuuuuugucacuuagcagugugaccuugggcaaaccaugaagccuuggucaacuugauuccuuccuuguauguggggguacauaacagcacuuuauuugaauugguggugagaucccauaaucuauguaaaguauuuacaguauagaaagcacugucacugugauaguucucugugcuguggaaaagaaugagccucucugggcuuuguuacagauggccuguguauguuucauauguuacauuguaacauacaguucuccuuugcuucaaauccucuaugcaucucuuauauagcaagcaagguaagcguugcauaaguaguugugauauuguauuauuuggggaauaaggaccugaaaaagaaggcugaauguauucagcacaggcacaauuuuguuucaacuauucccaauccucaguuggcugagucugccaguggagaauuauagauacggaaguuggcuuguauacaucaagugagauaacuucauucugcauccggcaagauaaugcauguaaaaccccucgaauaauucuugacaaucaguucucagugaacaguagcagcucuuaucuaaguagcuucuauugggaaaacacagucauauuuuuguaucauuucauuucagucugugucucauccaggaucuauacuagcucugacuagaacaaaacaacacacccccaccaccacagcagcagccaaacaaccgggcuugaccacguugucuggaaauuuuugccuguucagauucucaucauacaaguguucccuucuuuuucuagagggcacuuggggaugugaagccuggguacagagaagaggacuuuggggaagaacuccagcuauguugguggggaaagcucccuugggccuauggccucaaugcuuuguauaggacuguucagguuuggcagaggagcuucuuggaggagccgaggucuagcugugggaauuuaaggccuuggacuggguaccauuccuuugggcauccuggccugggcugaugagccaauugcuuaagucuucucugcuggggacagucucaguggcucuagagaccacuugagcacaacucuugggugcugaagagccagcuacuuagcauccaggaaaucugaugccuguauucagagccagggccacuuagaaaagaaggcugccagcugccuagaucgaaaaccaccuuauaggguuccauauacucuuucccuguuguuuuagguugccccaagagaccacuguuggccacaaacucuugugacuaauuaggagaaauccaugaaccucccaaguguugccagacagcagauugggcugggcugacucagggcugauuguguucuagggcugaagucccuaagaaaaauaagccaucaggccuuaacaagcauauggccaguuacucccucacaaucugcuguauuuuggaucuuaagugucccccaagccuuguguguugcaggcccuugaagaauuacuauagaaagguaauuaugggguucuaacccuuucaucaaauucuuccucuuucacaucccagugggauguauugguuugacucuugccgugugugaccugcuggcuugucacaggcccagagcaacgggauuauuugucugugggcuggaaccugagccuaggagauggaguguaccuuuccugucuauaaggugguuaucagauauuuauuacagucaaagaaagcuagucaaggcacauuaaaugauuuuugacuuaauuuaaauaaggcaagaaugacgaacacuucagcagucaaccagacuaggccuuucugagccuuuccuuuaacuucccaaggacaccaagaauaccaacugcauugauuucacugugaagcucaaugggauagagagcuugcaaaagccuugcaaauuauuucucucaagguaaaagaaaauauuuucuugugauucauugaauugguguuauguaguaacaugaauuagcauuuacacacccaaaugccucuugccugauauagccuuuugggagcccaauuuuggacguuacccuacuuacuuaggggaccguauaacagagcgagguuuccuaggcagucugaaguuaacugucccagauaaccuaaaccauuuugacugcauggggcugggaaauccagagccauccagcccacccuucuucugggucugucccggcuggguguguguacuuuuacgucuuucaugagccagccacucuuuggguaugagaagcuugcaucgcucagguuagagaaugccccuagcucaugagcccuacaucacagggauaauugugggccuugauucauagugagucugaaggcucuagagcaauauuaaa

SEQ ID NO: 7310 - RNA, 849 nt, Mus musculus
caaacagcccgaagcgggaggggaggaggcuuaccgggcuaacucgccucggcuuggggcuguguaggggcagcaggucauuuggcagugguggggcaugcggccccccaucuuccaggauguagaguauagcgccaccagccuagagguaggacuuugcagguguugcgccccucuaggcucagcaggguaccagaaggggaaaccaccaggugucugggguaggccgguuuucccaaaggggccccuaauagggagaggaguggcugguugucagcuagauucaguggacuuauugccccuagauucuaaggcuuggagacuaaggaagacccuagccaguacaguacaccugcugacagagaguucacucuuucguuuccaagaugccacguugugaguugcugaugaacaacuggggcaucuggaagucuguugguagucugugaccucugacagcugcagguggguuuguugguuguuguuguuuguuuguuuguuguuuccuuauuaagcaaagaugacagcagccuggugguugguguggaacaaacuggguagaaaaggagguuucuuaaagggcugcuuccuaguucuuuagacucgugugggaagggcaaauggaugacggguacucugcauucaggcuugccuuucuacauuucuggucucccguuucuccccuuuaaagggaaggaguccaggauuguucagcagccccugucccccgccccacccccagucccccuaucguugcacacagaaacuuccucccucuggacacuucuccaggcuggcagcuggaccacaacuuuuuccugugcuaauuaaaaccaagaugaucacucu

SEQ ID NO: 7311 - RNA, 1376 nt, Mus musculus
ucuuuugacuuuuuccaaauuuauuuaaucacauuauaucacaaucacagaccucugcccugcuuugucauugaguagagggaaauccuugcuguguaccagcuuaccuggcaccucaaguaacugcaggacuaggcacauccucucucacugaggccacacaaagcaggccaagcaggacaaaaggauccacacauaggcagcagagucagaauaaucccccacucuagcugcuggggcuucccacaugaagaccaagcugcacagcugcuaccuuuguguuggggugcaggaagggaccuagauccaguccauauuugcugcuugguugaagauucagucccuggggcccccaagguuuuagguuauuugacucuguuggucuuuuuguggauuccuuauccccucugaguucccaauucuuucccccaaguucuucucaacgcaaaagguuuggcaggugaggcuuugggguaguguacuucgguuuuguauuacugagacagguucucauggaucccaagguguccucagccgggcuuugcagguucaccuugagcuuagaucauccugcuuccucuucacccgagcuaguauuacaagagggacugccaagggcagcaaggacagcucuagucagcucugggcuucauauaugccaggcagucacucugucaacucaaguauaucuacaucuauugucuucuuaccacccgcaaucguguugcauugcucucuguguaagucacaaaggccugucaccaguccugcuuugguaucuuuggugcagagaggagaccaccacauucagucuagggccuuuucucccgaugggaccacucuuucaguuuccucugccaacaguucaucaaaguguagccagcacucugauggcuuccuucucuaucuuggaagaugucuuggagcaauuucaaaggcugagcacauggcuccuauacuuguucccgcuaauccacaucccaguuugcagccagcccugcaggcuguuccuggauguguuuuaaagcaccuguacaugaugaggugggugaucuucccuccuccacauccauccuagugucacuucucaggacuauugcugauauugacaaauggggguaguuugagagaggaacgagauauuucuggucaggguuugaaaauaaacacucaguuccccacucuggaagagcuaagauguucccaauuaagccaagaggaaaucucuggcuuuggaaggaggaagugcucaauggcuuccccugguccaggagaugcucacuugaaacugagcugaagggcaccucagcuucuugucaguucagggagacauacuccuuaguagggaguaaaggccaugccaucagcacugucuu

SEQ ID NO: 7312 - RNA, 1157 nt, Mus musculus
uaugugcagaagggaguccccaggcggguguggagcuggagaaagguguggguguuccuggggcuguuuagucucacacaccaggcucaaacaggggcaucucccauagggccccagggacuggcaccugucaggggacgggccugagcugagccuguaguuggcuuguuuguuucaacuuccugauagaacugauggaauuuacucucauccccuccuuccagcccauuuuaugccuuaggacccacuucuccugaagucuacgguuagaucugcagagccuuaccaaccuuggugagucuggacacuugaaccuccccaggccugcccaacucccugcaucagaugauguaaaacccucuucugaauggucccgggcuucuggagaguucucuuauauguucaccauaugucucuauccuccagagaugaggguggguuuuguuuguuuguuuguuuguuuuuaaauauuuuuacccaaagaagcuccaggauccuugaggucagugguaucuugccccugaggcgcugggucacaguaggcacauaauacaggcacucuaaaaaauuaaucugauuuaauacaaaagguucaggagagugggauucagcagaauucaagaaauccagagguuagugcaaaacagucaugguucuaugaaaucuauucacucuuucgcuuauucuauuuauucccauaggagaggugaaggucauuaaaaacucggcuaauugguuaugugauggucaaaguaacauguauaaacaaacaugcccaaaacacacaugcccaaaggcacaccacuaauacauccacaccaaaaaacacacgugccuacaaauagccaacaccaauauugguuuaaucucuaucauacaaaacuucuuguuggcaaaauagagcaaagaggaggacuccuucuguaguugucccucauuacaaaguucuagacgcagaucuggagagcuggcgcaguggcuaagagcaauugcugcucuaguggaggaaaccaauucagcucccagaucccacaucaggcugcccacgcccuucugcaacuccuguugcagaggauggaaugcccuccucuggcuuccucagguacugaaugcauggagugcaaacacaucuguguaggcaaaacacucauacgcgc

SEQ ID NO: 7313 - RNA, 4128 nt, Mus musculus
gggccagaauccucaggcuuugcagguagcagccagagccagcucggcagcaagagagggagugggagaggaugggauauuucagcuugagagcagcagcuguauaauagagccaggcuggguugucucugggccccacugucccuucucccaccucaaaguagcagcaugaaucaguucacugcggcaaugguccaggcgaugugacuugcauucuuaucagcuaccugauugcggucccuggaugugugaggcacaggaugugccuggcauaucaaccaucuuccuggugcugcagcuccugcuagugaaggcagagcagggcauccuucaagaccagcacuggccuuuaucuugucugagucucugggacaguccaaaauccuagaaaugcuuuagauagggccccagucugucucaaagaugccccaacaagccccuguguuucccagcagacaaaggauggaagggggaugaauugcacacagucuagaggcugcuguuacuaauauauuauucugacacacaaugaacugcaaaauuucccccaaaaugaagagcuugggucuuuggagggucugcauagauccggcagaguucaacccugugcaaaccuuggcuuuccuggagagccggggauaccaggcuccccaccaugaccccaaggggauggcaccuauugagaagaugcaucuccccagccaggaccucauuuagggaugguuggacaacggcaugcuugcuugguuguuggggguggggcuucacaaaccucccaacagagcacucugaacaacaauccuucaaaaaugguggcgcuuauccucuucugacaaaggacugaguggagcucuccccggaggugggaugaagcacacauugccuuuuaucuccccuucgcuuugagaggggagccggcuggugcagagcgugguggggagccauagagaaggcacucuggaaugaaaagcauaaucucucgcucccaaaccaggaggggagguagcuuucauccccgugugugcgugcaugugugcgaggcucuccauccuggaggcaucugaaugggagugagggcuuggaaggaugcuacacaaugcagugcuauauugccucuccccgggagcccagagcaggccagggguacacagcaucuaacuuugaaaccaagccuccaaucagcgauuuaaauaagaaauauaaucucauugaacaccaagagcugucgcucggagacgcuuccauuuacaaggcacuugaagaaaguccccaagccuccaguuuaucagaacagccagcuuuggacuauuucccugcaagagagaugcugggaggaggggaagcuggaguggcugcuaggaauccaggcugcaggcagcucugugugugugugugugugugugugugugugugugugugugugugugugugugugugacgugcuugccuucucuaggaaggaugugggugagaucuccagccacguggugcucugagaggucacuguggacuuccuggcucuggauggggguggggugggguggggucucacaguuuugucugucacacuuuggggacauuauucugagcaacugcuacauuucuuaacauagccuuuugaucucucucucucucuuuccuuuuucuuuccccccuuuuugaggucaaaugucuauaaagguugagguccaaguuucccugaugagaccagggugugugacagaguggacugagccucuucuaccuggguucaggagucugccuugccuugucugucuugggggaauuuugaccacagcuuuggagggggugcgcaaguucucgugacuauggguaugaccuugggccuuaauggagcaagcgggagccaauagccacaauagucccgaggaagauucucuugcuacuuuaauguagguguggaaagucauucacaaccccaguuuccccaucugcaaaaggacagcccaugccaggcaagcaggcuuuccgccacacgggauauugcuacuguggagaaggcguggccuuccucaucacccacugcucugguuauggcuauuguuuuuggucaucagcucugucuuaccuugccucacccuguucugcucagucguauuugcuucaaaauucaauguguuaaugucuauccugugacagguggggaauaggaugucagugugagauggaaggcuucuuggaggagaugucugggucuugagugggccagaaucugugaagaggagaggugagaaacaaguugaaaagacucauaggaagacagaguagagaugaggcugggagacuagucuauagagaugggaggcaaggugcuagguugccaaagaagggugcuggggggaaaaggugcagauuuccuugguggccuugugucaccagagugucaaugaucuuuggaaaaagaggcaagacugagacagguauauccuggaaccacaaaaucccagaggccugaggacagcacaaggcaggguagcaggaagucuggggccucauccugcuucuuucccaaucuccuagguaacgcucagggaucucuuacacaccagucacuguucucacucuuggguuguacuucauacuacccaugccucaagcaucuccguguaucccauuccacagauggagaaggugagaucaggugugccaguaaauguagcuagaaucuucuacucagagcaaagcaggaugagcacauuuggcagguucuuguguuuucucuuauuuucuugccucaggagagugagcccccugccccaccuugggugcucuugucucacuuugggguagaaaugaagccuuggcuucauuuaggauuuucucccucccagacaagagccaaaguacaucuugugugcccacaucagggggcaucaagaggagggucucagcuggcacccaguguaccacaaaggcgauguucauugcugacuuccaucauaguucugagagcuauaccugucaaggucacccgucuacagccugguuauagagcagaacucuaucuacaggguccuucagcuacaggaacuagagggggccacagaggacauuacuuagcuauauccacaguggugauaaccauacucagcuauauugacaucacacgugcuaaccaaaugcuuuaugaacuucaucucacagaaccuccauaacagccauagacaacugucucugcgaucgguagacauggaacuugacacccaaggaaguuugucuacucaccauggcuuacagacaauuugaaggugcuaaaacuacacugaaugcagaccucucccagccugcuuucucugcuuaggcugugggcaaauggcguagauccuugagucgugagcaggaaccugcagugucuauacaucuuuggccuuugcucggaggacaguccugaccgaaguuaucugaggaucucaacucaaggugagcagcuggacagcccuucccagauggcaggacuccaggccucccaccucuugguacgugagacagcacagaaugcugggggcccugcccucuuucaccucacccaggcuaucaaucgcuacuucacuaggucucucugugaaugguucuugaaccuggaauccaagccuccuucccauguuccuguccuucuucuggggggaccuagccuccugauggugucuucucuuaggagaccagagaccuuacuagagaagucugagucuguugcuggccccucugcaggcaucuuggacacaucuccacaguucauacuccuggccugacuaccguuuucacaucauagucuugccucacgcugagcagagcacuauccugcuuccugcuccuuaugcagauuccuuggcacuguggcuggaauagcuuaguccugggaaccugacuggaaggacaaggaaaugaagaaaggacagacacguguacagaaaagcuggggucaggaguaccaugcuugcucugauggaacagcaccagcuacacaauacccuggaccaucgguguguuuauuaugcauagcaggaagagcgguuaacuagucucaguaggaggacuuaguaggggagcugucucagcuuguaguuaucugagaggaggaagcuugaucauaaauacucauacuggaag

SEQ ID NO: 7314 - RNA, 7537 nt, Mus musculus
cccggcuugaacuuguuaguuuuaucaaaaguuguggaauugcagaaagaaucccaucauccaggccaugcagagccugaaaguucuaguguuguggccuucacagaggagccagaacguggggagggaaaagccacuggcuacagggaagagggcacaggcauggcagggcuacaguccaguccggacccuaggcuccagguaaggcuuugccucugccucucagcuucauggcagcugugugggaucuucuguuucuugcacuacauuugugcuuccuucaccgaucuucaucucagucuuccccagucuuccuucagucuugagccaucgucaccucugguccuuugagggcuuuuccugccacuccaccaaaccauuaagacaccgagucuuucuaggaaaaaaaaauuaagauggaucgagcacagauccaaagucaagggagccagugaggcagaggcucugugaaaggcaaggucccuccuggucucggaacauucacagcaaaccacccagaagccugccaagcaacugaggaguuuuuaaucauuguuucucucuucuggggagagggaaaaaaaaggagucauuuguagccuggcaacaaagaucuguguguucuucccuuaugccaagcuguaaacacaggcucccucagcuccgcauaaugaugcucauaugccacaaccaggaagucuugggacagcacaggagggcugcagacaccagcaaggccagcaggccagggugcaugcugcagaaccuggcagagccaugggacccaugggcuuuuggugcaaacccaagaacuugucagagagccccauacuucacccagcccaaggcaguauuuccuguuaggcagcuaugggguugggagccagguggccuaagugcuggggagaggacugcagguguccuuugggcuggaugagucuuucuuccuacugcucagggcguaauuuuucuucuuaccuuuguccuacucucugguggauggugcagguaaacaccuuucccccaagagguaucauggacuugacugguugcaaggaagauuccuuugaggcuaaagaagaagcacgugggaaguagccaugggagcgagugugccccaacuacucggcaucccuauaugggggucagacagaguagauguuaagaauguggucaggggucugauuuccuagaugcaaacccucaguaccaauggagugggcguggcaaguuaauuccuauuccaaacuuguauguccuaggccuggaugucuugucuuuagugcuaaaaugaugacagccaguauuaguauuacucuuucuaaaauaugugacagcaggcaaaugacauucauauuguagcuauuacacccggugaauguggcugugcuugagucauaaaucuuacuccccucagguaagccaaacaacccucagguaagccaaacaacuuagcugagauacuacacugcauccacuuaguggaguuccuggcaccaugauacacacacacacacacacacacacacacauauuuggggccggugagaagaucaguaccagagcacuuaccugcuacaugugaggcccuggauccauucucagaucugaaaaaaaaaaauuuaaauuaaaaaguugucucugaguucuuccugaaugcagggauggaggcacgccucccuugcaagcuguuguguucuuggcaggauguauacaggaccuaagagugucuccucauaaauuacuugcucagcagaaaaggagggaagaaagcaagccggcauaauuagucaggggugauacacacaggagcagccugaggaccagcccauaccaccagcuucuuguacuguccccagagggaugcaguuugugcauucgugucagaaaaacugcaaccugggaaauagaagaggggcccucuguagaacaccugucuguucagggaauggccagugaagggacaaaaggaaaggcuaaagaaagccacagacuagagggagaucacagagacaugacaccugaacauaacauauaaagccgggccaguugacuagacuaggacuggggaaaaugggcacaaccagggaaaaugggcacaaccaaacuacauggacaauggguaaaacuggaauauggucugcagucuagacaugucaguauauuguuguuuuagcuuuuaauuuagagcacugaucuaugcuuacauuacuaaucuauacuuacauuagugaaugucuccagucuuagaaagcauauaucagcacaguauacuuggauucaugcucaaauauuuagggaaaagggagacuucaaauucucaaaugauucaaaaauugcauagcauauauaauuauguccaaauauguaacauuuucugaacuauauuaauucaaaauacauuauacacauguguugauguuuuauagucacauauacaucauuuuuuccaaaauacauaugugugggcaugaaauauaaaaacacagacauaugaugggagagaaaaagaugaaaggaauauguuucagcucuguuauuaugucaagguaacaaagcuaucaccguucuucuggucuuuuacagguuugcccacuuggggacauuaacugaaaaccucacagaguguauuuguugacuuagcaugcaauccugacaugcaugcauauugcuggauagagaaguaguuugcucauuuucaugguugaguaaauucuguugcuccuguaccuauucacaugcauaugggcuguuuccucuucuuuuuuuuuuuaaacacuguaucagaaaacauacauacauguuucuguguugguucauaggaauggaguuguuagcuuaucuagcaugcaguguuugcaacccauguuaguggauucugacaaugucccaaauugauuuggccuuuuuaaaaaauaaacuuucaucagcaauccuggaguauuccaguuguucuguauccuugccaaaacuagguuuugucagcccuuggaguuuaaccauucuaaaauguguaugauaguaucuuaucacagacuuagcugaaaauucucugauggcaauuggagcugaguucuuucugucuguuggcuacucagauauguggcucuguaaagugacuauucaauccuuuugucagucuuucugugaacugucaugucuuauuguuuuggaaguuucuuuauauauucuauuuauauauucuaaaaguccuuugccagacacacugacugggaauguacucuuguucuguggucugauuuuuccaguuuuucaugauaugucuugguaaguuuuaauuuucaugacauacaaauuaucaguccauccccccccccauaugccuauaauuuaaccuuuaucauacuuuuaaaagacuaauccaagccaggcagugguggcacaugccuuuaaucccagcacuugggaggcagaggcagaggcagaggcaggcagauuucugaguucaaguccagccuggucuacagaguaaguuccaggacagccaagacuacacagagaaacccagucucaaaaaaaaaaaaaaaaaaaaaaaaaaaaagauuaaaccgaaguaugcuuucagguggaucauaauucuagaucacaauuggaaggguccuggccagaggccugcaauccaacucccuuuugcuugggccuuugaggaauggaggugcuugggaacacuagagggagaggcaugucuacuauugcaccuaggauucugaaguccagccuccucugcugaauccuaucucacagcuacagggcccuuuuuccaggggcgcauagagucguaaacagagaaaaugcucugugaggcagugacgcagacaugaaagcaguauuucaguucagggcaugggggcagccccaaaggugagcucugcgggugacagucacucuggagggagggaaaguccgugaaggcuucccagaggaggagaccguuaaaauggauugugcuggccucauaggagccuuccacacagacaaagcagagcaaagcauuucaaguacccaagaccaguaaggagcuggaggacuugguagacucccaucccaacccccccccccaccuaaaagcagaagauuugaauccauaaaguccuagcuaacaugucguaguacuggugauaauucacugucacugucuacaauauugagagaugcaggguaggggcugggguaaucaguauuggaagguccuauggagagggaggcccugagccuggccaggaauaccucugucugccuuucaguugcuguuucuggauaagcacagcccuggacaacccuagaucucucacaaguggagaacugggcaggccagaccccaagugaccuuaacggcauuuaauuucuuaaaaacaaacaaacaacuuauugguucuuuaugaauuucacaucaugaacaccaauuucacccaccccccacaucuccuucuaccuacccucuacccuugcaacuuccccccuugacaaaagaaaaagaaaaucucauuguggaagcuguggugugucacacaguauaacuuuucccccacauuucucuguuugcaaauuuucauuguaaugcguuguuaaucugucauaaggccucuagcuucugcaauucuacugauaugggaaccucacuggagauccucuuggauauccuguuguugcccugugucauggagauccuguaguuuugggguagauguuggggugagccaauucaaagcccuggauuugggaccaagagguaucugagcuggucagccugacggcucuuccacuggucagcacaguagagcugacccugguggcggggccacgagugagcaggcuccaagggcgugagugugggagagccugcccuacaauuugucugucuuguggugacaugggaaagguagaaaugaccuacaacaggcaggagagcuugucucuaggucaucagaguggcagagcuggccuugcccuucaccugcugcaguguuugggaacguagucuuguagcucgucugggcaguacaguagagcuggcccugaauguggggcuuguaggugagccagccugaagguguaagugugggagagccggcccugccucuugucuguugggagguggcacagaugagggggagauccucuguuccccuuccuugucccuuaccaucuaugacaggcaggaaaguuggcccagggucaugagaaugggagaauuggacaugucccucacugucugcaacauucaggaaaaugguuccugcacucaccugggcagcaggguagagcugggccugguaauggggguugcuagugagccagccccgaaagcauggcauuuaauuucaacuguagauuuucaagcaacucauggaauuuagaggcaagacgagcucuggggaggcaggaagggauguagagcccaggaggcacuggcuuccuucuuucugaggaacuccugucccuacauuagagucugacccagaugcccaugcuccacacaucugucaggggaucugaguggccagugaugugcugucaccuaaggaggcagggaaggagaguggcaccacuuggggcucuuugaguucaguccccucuacuauuagaagcuguuaaguugucuucugaaaaugggauacccaggguacaggccuccuccaucccuauguuucuagggaucucccagauauacacacaugaggaaggggaccacacagacauagacaggcacagucacacagaggacacacaagagggacauauacacauacaaauucacucacucacacacacacaaagggucacacacaaacauacacacacaaauagacacaaauggacauacacagagguacacauacacacacaggaacacacauggggagagacagacagaggggggaagggaaggagagagagagagagagagagagagagagagagagagagagagagagagagagagagucauaugcacauagacaaacagacaggcagacagacaaacaggcacacauaugcacucuacacugcuacucagguauccaagcauccuugagccaguucuacagugguuucaucuuugcugauugaaccccugaaucagaccaaaggcucugucuccucucuucuccccacuucuugcuucuguaccaucuugcacuugccgugccugcuuggguaccauccuuggccuuggaagcaggagaaagcuguggccccgaccacaccucagucugggaaaucugccugauuccaaaaguccuaucuccugaauccuuguguuauuucugugucggcacaccauccuagugggauaagugaacagggaacagauacucaaggguagccuggguacuguuggggcagccacagaugaaaccuucucccagcuucgguuuugccaccugcaaagugggauuuauacccaguugagcuuugcugaguccuguguagaaggacacaguucccagauauccacucugucauucgagagguguuuugcaggucccguaugcuaggccuggguacaggaguguaguaagugcuuccuuuguacuugaguuuccuguccccuucccuucauccaaagagauguuggaggccccaggaaaagagcuuggguuauuuuccucuggguagugcugcagggagauuguggccagacuuugguguggcugucacaagaacaagugugcagagcaagccuuaggaccguguggucagguguggcaucauggggugggaaugagacuccaaacgagacuccaagccagcuguucaauaguaauaaggcagggaagcagccacagauuccuugaaagucugagccuucaggcccgugggggggggggggggggacggggacaguagugcagaagguagaugagcaaaaucauaucuugaggacucacagguagacuuauguaagcauggagaggcaauuugacucacagaauagugauggauuggagguacggugaggugagagguaggagguagaggaggaaucagcuuauagcuacacugggcuuauagcuacacugaguuuauagcuacagugggcuuauggcuacacugugcccaggcuugaagucuggaaacaucaccuggacucugaacauucagcacacuaguguacccaauucuuuuaggcccauuuuauagauuaggaaacugaggcuuaggacucacugucuugucuaacaguaucuaggagcagaggugugaugagaacccaaguugaccaccuuuuccugccacucaacucuggcuccacucacucaguauuuucuuagccuccuaauagacucagcagugagcucaaagcuagcacaguccauaucuagggguugugauauaaacugaaccaggcccuccccucccucuaaacuucucauuugucugggcuguggagacccacacucaaccuuuaguuggcaugucaguuuuucuaauguucagaaggauaaguaaugggagauugccucaccucuauccccgaaagagcaugggcguggucagcagaagaugcucc

SEQ ID NO: 7315 - RNA, 7408 nt, Mus musculus
agaucuggauucuagauguacuggaccccaagcugagagaauugaggugauuuucauaaagcuacaucaguagguuuccagcuugaaccacaaagcaaaguccuagccaguguuguaaguuauaacuuauaaguuuauaagugaucgguacucugguguccaguguuuugggagaugcccccuuccguggcauaauucguaccuaaagucuggggcuucaggauaaggccggggucaggaagaugguggggcuaggcugcugcaucagcuugacccuguagcccgagcuggaccccugcccuugguuuucuucacuuuguuuucucauucugagcuuuaaguggccuaugaacaagccuagcucagaagccacugggaccugaugaagaucaccggaaaguggcaaaagagggccuaugguccugggccagcaucuagugucuaggacuuaguuucugagcaucacugugcacauacagagcugggcagcucagagaaggcagaggugccacgggggcacuuccuccuagacacagugacugaucccagggagggagaaagaagagguggagccaggggagaggagagagagugcugugccuggagucagcuggcuaaagcuauacccucuucugcacuggcuucuuccuccuguucuucaguuguaagggacuaccugugcugagugccacccccauccccuccaucaucccuugccuuguuaucuguucguccacuugccgagucccugcaauggguugggugggauugugaugaucagccccaagauuaauaaaagcaaccugcacagcaccagacaagagcuccaugaaugucacugccuccuugcuuccaauccuaaguucugaggauguugugggacaccuguggacacagcucugccucccacaccaggcucagacuccuggucaugaagagaggagauacacacugaacuucauggaaaucuguagcccaggccucucuggacuuggugucauaggaagugcccacucuuaugccugguauuuagucccccugaccuccagaugggugaagcuagcauuaacuugcaaccgaugcaaacagguccuuugcucuucagcccccagcuuuguguucccccuaaggauacuagguaccccaggagacuggauuucagcgugcuggguaaauuugcuaacacauagccaucaccagacaauaaggcuuuguucuaagcauccugugcagacugaucagcucaaaaccugugaccucaaauacacacaaagguuggugacuuuuccaagguuacacagcuaguaaguagggggcugcguggcauucagagccagacggacugcuucugagucugcacguuuaacuguuucucuucucucugcacuaguuuagugauuguuagaguucuugacgucaauuagggccagcccagacucucugugccucacccugaguaucaaaggaccccaaagaugggaaggugucagagacaaagugcaggccaccuggauagcuugagucauuagcauuuuuuauuauuuauuguuuauuauuuguuuguuuguguagcccagguuggccuugaacuuguuauccuccagcuggcccauauuccuuguucuuuacauuuaugguauuucuuugugucuaugugaggguguguacacacauacaugugggggucagaggacgacaugcagcaguugguuuucuccauguaccaugucggcucuagggauggaacucaggcugcuaggcuuagugacagguaccuuuauccacucagucaucaugccuuauaaccacuguccgcucccucgcuuccagaccugagugucugucugucugucugucugucugucugucugucugucggaucuuacuauuuagcccugcugaccugaaacucucuucacagaucaagcuggucucaaacucacagagauuugcuucugccuccugagagcaggguuauggauuuguuuuguuuuugguucuucucaacagggugucacuauguagaucuggcuguccuggaacucacuguguagaccaggcuggucucauggaucugccugccucugccuccugagugcugggauuaaacgugucugccaccauguuuguuuuguuuuuuaaaaaucucucugucucugucucucuuucuuuauaauaugugugguuauauguguguaaccauaauaugcauguuauagcacacacguggaggucagagaacauucuuaaauggugcucuuugccuuucaccucauuugagaaacugcaauaucaaaagcuuccagguuacucuugucuugaucucccaucuuguaccaggaacacuuggauuacagacaaguguugcucugcucaucuguauguggcugcugggaauuagaacucagguuuucauuuucucuuagcaagugauacuucagagccaucuccuaaaccucccucuuuuuuuuuuuuuuaaagauuuauuuauuuauuauauguaaguacacuguagcuguccucagacacuccagaagaaggcgccagaucuuguuacggaugguugugagccaccauaugguugcugggaauugaacucaugaccuucagaagagcagucaguguucuuaaccgcugagccaucucuccagccccaaucucccuccuuuuuaagacaagguuucauacaaccccggccaacccuggcuggccucaucaaguauuuacuuugcugagacuggccuugaacuccugaccuuccugcauuagcaucccaaaggcugggauuacaaguauucaccaccacacccaacagauauucuugcuugagucacagaucugucucacauuaguuaaccuuucucaacugcaaccggcucaccuacaccaggcaaugggugugaaccgcuggggucaggacaagggaugaauggcaacugcccacugaucuaagguuugcuguguuguggcugaaaggggauauaaacuagauuuucuccuaauccagaugcccuuuccugaccuacccuggcuguaaaucuaaacaggcaagauagauaauaacugcugauucuugucugucucuuccagaagguauuuacgagacugucggcuugcaacacucggagaaaaaguucccauacuaacuugcucacugccuggcaagcccuggauccauuucucccuccuguccuggagucccugagaaucccuccucucggugagaaugcaaagccugcuuuaagaucaaagcccuggcuuacuugauccucucacccguucuuccuuuuuagcacuauuggcugugguuggcuuuauuaagcuauaccuccuugagguaccagggaacaucagaggggggcuguuuggcaggaccucuguccugagaacaccuuuguguugggaagcugggggcugguauagaaaggagucacccauagggugacagugcuuuugguucugcuuucucagagcaauguucuagcuucuugggccccuuacauccugcagagaagcaaagauggccuggcuggaguucuggucuuacuucugucccugauacccagagaacuuguuuuugccuucaagccugccuuggggauucuuggagugggaccugcagucugguaaacagcugugguggguguggugcuccuucugucacccacagaguagaagcauucauuuauuucaaaccucaauagcuugggugcucucucccucucugugucucugucucucucucugcaucuucagccugugcuuucagugggaccggcacuggaaucccaucagucuuuccuguuugguauuuuucaugcugagcagcaccgagcauccccugacucuuccucccucuugcaccugugaaauggugcagaugccuuagauggugggggaacuugaggcuggauggaauaaguguccaucauccacaggucaugacccacaggauggcucacagggcuccaggcccccacaagaaaacuauuguucaacggagacucaggaaguggcuuucaucgucuugacaguuucugaauguggcaagggguggcuacucuacugggauaaguaguucucuaggcaguggcaucuaguucuuuuuuuacaacccccuguguagaagccaaaugaauaaagcaaaacucucaguaugcagucauaauuugucuagccuggagccuguccaggagaugagaaggcugcaggggacuguggcagggacagucccacgcuaggcaccgugagcgccuuaucugcucucugccacgcagcacacacugaccuagcacguggcuuuugccccuaggcagagcuaccuguguguuggaaggcuagcccauccucuccaucccucaccccagacagcccucaaguaaggauggagaagggacuaagcgauggugacuaaguacuucuucuguggcuccucacuggugagagugagggggugaguaacagagccgcaggcaggcugagccccaggagcccauggcacauaccaugccuaacagccacacuucgcugcggucucucccucucacccaugcuccuacuucucuacaguuuagcuggagccuugaccucccccaccacacacauccuggaucccuuccccucuacucgcaggcgccagugccuggacuucuaugcagaaagcucaagcccugcaucaucugguagggucacagcugcagauguagacaccuccuaccguggguggaugcccucauccccucccuauccccuucagccucuugguuuggaugggcuuagaaaguagacaccuggcugagccccaggcagcccuggccuugcacaagucucucucguagggcggggagagaugagcuaauucugugagaggcaggaagaauggccuucugacaagaagaggccuguccccucuggcucuuggggcacuauugcaagcugccuguauagagaaacagcugagccgccuaggaguugcuucuguucugaacaccccuaacaacuccaaugagcuccgaaggaauagagggaagggugggaacacacccaccuccuuuguaguugauagaucuuguaagucaauauuuugggacagugcuuauuuucugugccuaguguacucaagggcagcuucuguaccugacaacucuaaaacuaacuaacuaacuaacuaacuaacuaacuaacuaacucucucucucuuucacacacacgcauacacacacacuuacaugcuuucucccugucucugcuaccucugucucugucucucucucucacucucucacacacacauuccuaaauaaauaaaaacaaucugcucagucuauauagugcuacuuauacagauguuuugagggcugaccacuuaguguuggacggccauucgguaugcucuuccuugguaagcugguugguguuuuuaaaagguuaaccugacgacaucccaggcauucccacauggcccuuguuuuuaguggccacuguggccauggagaaacucagcccuuucccugagugcaaugcucuucccacaucugccugcuuucuaacacagcucugccucuucuccaaagugagguuuuaauacccuggggaucauccaacugcccuccccccaguuccuuagccugggaaugcugggcccacaaguuuccucccacugguccucuuuguugaagagcagagcaagguuacaggagcccauggcacagcccucagcgagaugggaguugggggaaccagggucauugccccagucuuccugggucacucaggaggagggauagcuuccuggggcccaaacuggacucgcuuucaagcaaauucugucacuagcacugagaacuauagggcuggagucugucugucccucucagagccucgauuuccuccucuguaaaugggugugcuaacaacagagccccagugaccucucccauggcacagagaacacagguuuuggccacaacacauaucugaugguuagucaguucccacaggcuggcaguaaaauccagagccauuuccaugggaucuggccugggaggggcgaaggcccggcagaaggaaggaagccaagcccucccccacagcccagcucugcagaguucacauggggguggggguggggaugguguccaggaggaagucugucccuggccuugagaaggugccccagccugccaggcaggcugguguuucaaggacaaggccuugccuuccugcuaucucugggggaacuggcagccacuaacaaauccccugcaaucugcacccaccaauccugccugcucgcugggcagccaagagccguuuuucacggggagcugcacacagcuuugucuuagagagacagcucuggcgggugccccugaauggggcuauuuguccuccaugcugaagggaaggcagcugaaugcucuguuggggugggcagaggcagagaggguggagaaaggcuaugggggagggugaagguagagauagcagccacgacacuaugagagaccagaagugcuguccaccacggaggugucucagagucaccaugcagcucggugagugcaaaaaaaaaucuuguuuccacagcaaugggacacugguauaugaccggccuucccugguguaaagagcccuggcugguagaaguugaaaugaccugacugguuuugggugccuuugucccaucccagccccacgacaaauuaacuacggggcugccacacuagugccguagaaggccccauuccagccccuaucccugaacugagagcucuagagugagacccaguaucucuuaagagccucuuccacagaucacaggcagagagaggcaaggcaugucucagugucuccacuaagaccagcugacaucugacaggcacaugacucauuagggaaacagagcaggcaugcaucuggggacuuaaagccagcaagcgacauuauuuccacucccguucugggaccugggcugcuguacuggaaggugugcuuagaacagaggucagaggucagagaacccaguagacuuuacccaucuuggggaugcagacccaagguuuccauucaaaggaugcagaacaucugcgugauggugcuacuccacgaagagcaaguaagugcacauaacuaacaggcauguccuaaaaccacacagcagucccacguccacagccagcucugggcagccuggcuguguuaagauuggcaaacacccucugccuguccccacuugaaucauuccucugccuccuguggucccuucuccaaaagcuugcuggugccugucaggauggccuggguauucuugaugccucccacaguagcugggugccuauucuaccaauagucccuuuaaaccacccaagcauccaagcauuggcuaugccagggagaaaaaagaaga

SEQ ID NO: 7316 - RNA, 4311 nt, Mus musculus
ugcugagcuacaggcuguucagcucuuuauuuuagugaucgaguacaguguuuuacaaaauacugagucagaugugucaugauaaugacaauaccaaaauccagacggcaaccagaaucugaauacagaaaucagcgauugaguacacagugcacaaaaauguccuccgacacugagcaggcucugagaaaagcaccuacccccauggagcaugugucuacaaagcuguugggcuuugggagggugaugcuggagcauagaagaggauucgggcggggaacugguugucuccuacugccuggcucugagaacaggaccccuggucaccugcuugugguccucuuaggaauuguggguugagaaucugaauagcucaggcacguuucuugagguuuacagaaaaaaacuagcucagacaggauacuuuuuguucagaaaccagacuuguuacggcaugguuacaaaugcagaagcuugguuuuaguuuuguuggcccuuuugccugagggcgagccuugagagcguugagggcugucuuccuaggggacccuugucccucugccagcugugguaauuagugacaagguccucuguguacaggcuggcgacuucaccaaccacaauggcacaggagggagguccaucuacggaagccgcuuucccgacgagaacuucacacugaagcauguggggccaggucuguggggcggagcccuguccagcgcucuugcuguucaucccgucgcuaugguccacacuugcccggcauccuugucaugcuccuucuguuagcauccaggcagcucagcaucucuuacuggguuucucuagaacuuucucauucauuacucuguaaaaaccaaacuuccuauuguaauuccagcacuugggaagccgaggugggagaauccaaaggucaaggccaucuugggcuucaaagugagacuuguuucaacaaacaaaaaccaaacagauuucccuaugggaauuugguuggggagucuuuaagcagaacccaaggcagagugugggagagucuagaagccauagcugggguuucaaucagcgcccccacugcgaccccugaacucuuuccacccaggcauucccccauugaaagccagcugucaguuaaggcacacaagcucuggggacugugucagcacugguucucuggucccaggaucugcagguucacgcguccucaauggagugugagccaccugcucucccuagcaacauuucaggugagguaccuccuggggacacagcucacccgugcuugucuuacagguguccuguccauggcgaacgcaggccccaacaccaauggcucucaguucuuuaucugcacgauaaagacagacuggugaguacaucacacgcagggccucugagaaggaagcuagaggaggucacagucgggagcuugaucugcagcuggcccgucugcucugggccaguggcuugcuucucgcugugugucugucugagagacagggaggaaucaaggcacaguuuguuuuucugugacugugucccaccugucuaccccaauggugcuguuggcuagaauuugauuugugucuugccugcacacacacugaauuugggaaaugcuucaguaaguggccucaugguggucugaguggaagccacuuugccuggcuuacccugauguuuccuuggcuugccucugcuauagaaugugcuuauggaaucauggguugugaggaauaguuuccucacacacuguuagcauggccgcacauggcucccagaccucccagcuuccuuucccacaguccuaugcugucuaagaaugccuuuucccugguaaaacuuccaccaagcaacaccuuucucugcauagaguucugaguaucccaggccucaggucccaggaggucagaggcaacagcugacugagaaguuuagaaaaccuguguucacaacuuuaaggaaaucuaagcgaugggaugacagccacacagggcugucagggucgggcauguuggugccagccccaucuucuuugcuccuuccauggaagccuugaugggccuuaaagcucugccccaggcuguccuuauucucagcugugcuggagcugagcuaagucccuguucuguucuuggaacucacagaucaugagcuacucaacaccuccaggcuucucacacuuauuuggugcucaguuugccauagucuguugugcagaugucuugcuuuuuugagugcugcaaugcccaucauuuuccugggcagaaugagaacaaccuacuucucauaaguaaggucaccaaaagucagaucaggcugccggacaaagcccagggugacagaacugggagccuggaauccaguggaaugcagcugaagagcucacaagcgguaacuaggcuuucaggguagugguguuccuuuggcaaacaacucugccgaguggccaggaugcuggguguuuucuuacuuggcucaacccuccccacaggcuagauggcaagcaugucguguucggccaugucaaagagggcauggauguugugaagaaaauagaaucuuucggcucaaaaagugggaagacgucuaagaagauugucaucacagacuguggccaguugagcuaacucacagccaaggugcuaggacagcagcaggcauccaugucuugauucacccagguucuccaaagaacaguuugcacccacuucuauugagucugaggaaggccacucaggcaugguccucccagaccaggcugcucuccacuguccauccugccucagaucccguuucugggcaucaguauggccaucgggccauguacccucagccgauguccccgugauugccaugugcgugugccuuggacauuggcaaugcugaccaguuagucagggaaggcuccugacucuuuuccuugaucaguggggauagcaguugcuauuuaauguugucuuccuccuugcaauaauuuaacauagaauucaagaucucaucgaaacaaagcugugacacucauggcacuguccgugugugaccuguguugcugugacacucacggcacuguccaugugugaccugaguuggcacaagccacagacacccccaacccccccaccucccagccuggcuucugagacaucacucagggcucuugugaaagucccagcgucaaugccuucccuccuggucacugugaauccugcuggcugcugcugugauuuuugaaagccugugaaauagaagcagcaggaccugggaacagaccugugagcccggucuuucugcucaaugugaauucccguggugaaaacuuacagacacugccugaccucaugcuguucucaagagggaagugucuucuggcaggcuuugcuuuuucuguauguugaauaaauccaaucuaucaauaauauauauguaaaagauuucugggacaguccuguguguucaucucaaaugugauaaauaaauccuauuuucuauaaaauggcugucucugguuuuggaaugaaauuuacaucuuuggggcucauuuguuuuugugacagggucuugcugugugguccagggucuugcuguauagccuuuggcuagcuucaaacacucuugaccuuccucaaugcuguugggauuacaggcauggaacauugacuccagcuggggccagucuuggaguuacuauguguuagguucuaugcuuugaacuguuuuuuguuuguuuuguuguuuuaugaugcuagggccuuugugcacacaagccacguccucagccuuauuguaaggaaauccguguagaacauucuguguccuaaccccaaguacuagcucagaagccacugagaacauccuugcuaccaucuguccuguaggaugguccagacaguccccaccgugagcacuaccucuaggugaagucccagcuaugcuuagugauugagcuucaguuucucucagcuacauaauguguacaugacaucuaggucuggaauugggugugacccaugugaggugcauggucuugggccagauguaucaucacagcaaucucuggguagugacuuacaagagggugacauuucccgugugucagagauccuuaggaaagggggcugagaucaccaaagguuagagguggguuucccuuuucucaugcugggucacugaaauguggaauucuucauugcugaauucucagggaagacaggacuggggcaagcacaugacuaagaguuuccuuagguggguagggacauagcauagcucauggagaagggaugugggcucuggcugcggugaguauug

SEQ ID NO: 7317 - RNA, 4311 nt, Mus musculus
caauacucaccgcagccagagcccacaucccuucuccaugagcuaugcuaugucccuacccaccuaaggaaacucuuagucaugugcuugccccaguccugucuucccugagaauucagcaaugaagaauuccacauuucagugacccagcaugagaaaagggaaacccaccucuaaccuuuggugaucucagcccccuuuccuaaggaucucugacacacgggaaaugucacccucuuguaagucacuacccagagauugcugugaugauacaucuggcccaagaccaugcaccucacaugggucacacccaauuccagaccuagaugucauguacacauuauguagcugagagaaacugaagcucaaucacuaagcauagcugggacuucaccuagagguagugcucacgguggggacugucuggaccauccuacaggacagaugguagcaaggauguucucaguggcuucugagcuaguacuugggguuaggacacagaauguucuacacggauuuccuuacaauaaggcugaggacguggcuugugugcacaaaggcccuagcaucauaaaacaacaaaacaaacaaaaaacaguucaaagcauagaaccuaacacauaguaacuccaagacuggccccagcuggagucaauguuccaugccuguaaucccaacagcauugaggaaggucaagaguguuugaagcuagccaaaggcuauacagcaagacccuggaccacacagcaagacccugucacaaaaacaaaugagccccaaagauguaaauuucauuccaaaaccagagacagccauuuuauagaaaauaggauuuauuuaucacauuugagaugaacacacaggacugucccagaaaucuuuuacauauauauuauugauagauuggauuuauucaacauacagaaaaagcaaagccugccagaagacacuucccucuugagaacagcaugaggucaggcagugucuguaaguuuucaccacgggaauucacauugagcagaaagaccgggcucacaggucuguucccagguccugcugcuucuauuucacaggcuuucaaaaaucacagcagcagccagcaggauucacagugaccaggagggaaggcauugacgcugggacuuucacaagagcccugagugaugucucagaagccaggcugggagguggggggguugggggugucuguggcuugugccaacucaggucacacauggacagugccgugagugucacagcaacacaggucacacacggacagugccaugagugucacagcuuuguuucgaugagaucuugaauucuauguuaaauuauugcaaggaggaagacaacauuaaauagcaacugcuauccccacugaucaaggaaaagagucaggagccuucccugacuaacuggucagcauugccaauguccaaggcacacgcacauggcaaucacggggacaucggcugaggguacauggcccgauggccauacugaugcccagaaacgggaucugaggcaggauggacaguggagagcagccuggucugggaggaccaugccugaguggccuuccucagacucaauagaagugggugcaaacuguucuuuggagaaccugggugaaucaagacauggaugccugcugcuguccuagcaccuuggcugugaguuagcucaacuggccacagucugugaugacaaucuucuuagacgucuucccacuuuuugagccgaaagauucuauuuucuucacaacauccaugcccucuuugacauggccgaacacgacaugcuugccaucuagccuguggggaggguugagccaaguaagaaaacacccagcauccuggccacucggcagaguuguuugccaaaggaacaccacuacccugaaagccuaguuaccgcuugugagcucuucagcugcauuccacuggauuccaggcucccaguucugucacccugggcuuuguccggcagccugaucugacuuuuggugaccuuacuuaugagaaguagguuguucucauucugcccaggaaaaugaugggcauugcagcacucaaaaaagcaagacaucugcacaacagacuauggcaaacugagcaccaaauaagugugagaagccuggagguguugaguagcucaugaucugugaguuccaagaacagaacagggacuuagcucagcuccagcacagcugagaauaaggacagccuggggcagagcuuuaaggcccaucaaggcuuccauggaaggagcaaagaagauggggcuggcaccaacaugcccgacccugacagcccuguguggcugucaucccaucgcuuagauuuccuuaaaguugugaacacagguuuucuaaacuucucagucagcuguugccucugaccuccugggaccugaggccugggauacucagaacucuaugcagagaaagguguugcuugguggaaguuuuaccagggaaaaggcauucuuagacagcauaggacugugggaaaggaagcugggaggucugggagccaugugcggccaugcuaacagugugugaggaaacuauuccucacaacccaugauuccauaagcacauucuauagcagaggcaagccaaggaaacaucaggguaagccaggcaaaguggcuuccacucagaccaccaugaggccacuuacugaagcauuucccaaauucagugugugugcaggcaagacacaaaucaaauucuagccaacagcaccauugggguagacaggugggacacagucacagaaaaacaaacugugccuugauuccucccugucucucagacagacacacagcgagaagcaagccacuggcccagagcagacgggccagcugcagaucaagcucccgacugugaccuccucuagcuuccuucucagaggcccugcgugugauguacucaccagucugucuuuaucgugcagauaaagaacugagagccauugguguuggggccugcguucgccauggacaggacaccuguaagacaagcacgggugagcuguguccccaggagguaccucaccugaaauguugcuagggagagcagguggcucacacuccauugaggacgcgugaaccugcagauccugggaccagagaaccagugcugacacaguccccagagcuugugugccuuaacugacagcuggcuuucaaugggggaaugccuggguggaaagaguucaggggucgcagugggggcgcugauugaaaccccagcuauggcuucuagacucucccacacucugccuuggguucugcuuaaagacuccccaaccaaauucccauagggaaaucuguuugguuuuuguuuguugaaacaagucucacuuugaagcccaagauggccuugaccuuuggauucucccaccucggcuucccaagugcuggaauuacaauaggaaguuugguuuuuacagaguaaugaaugagaaaguucuagagaaacccaguaagagaugcugagcugccuggaugcuaacagaaggagcaugacaaggaugccgggcaaguguggaccauagcgacgggaugaacagcaagagcgcuggacagggcuccgccccacagaccuggccccacaugcuucagugugaaguucucgucgggaaagcggcuuccguagauggaccucccuccugugccauugugguuggugaagucgccagccuguacacagaggaccuugucacuaauuaccacagcuggcagagggacaaggguccccuaggaagacagcccucaacgcucucaaggcucgcccucaggcaaaagggccaacaaaacuaaaaccaagcuucugcauuuguaaccaugccguaacaagucugguuucugaacaaaaaguauccugucugagcuaguuuuuuucuguaaaccucaagaaacgugccugagcuauucagauucucaacccacaauuccuaagaggaccacaagcaggugaccagggguccuguucucagagccaggcaguaggagacaaccaguuccccgcccgaauccucuucuaugcuccagcaucacccucccaaagcccaacagcuuuguagacacaugcuccauggggguaggugcuuuucucagagccugcucagugucggaggacauuuuugugcacuguguacucaaucgcugauuucuguauucagauucugguugccgucuggauuuugguauugucauuaucaugacacaucugacucaguauuuuguaaaacacuguacucgaucacuaaaauaaagagcugaacagccuguagcucagca

SEQ ID NO: 7318 - RNA, 13732 nt, Mus musculus
ccaggucucagugacuuccagguccccugccucugcuacugagugcugggacugcaggcaucgcucacaacacccagcuuccuguggcucuuuuuucucuggauuuuuccugugcucuuuucucuaacccuuguguugaaugguugaguugucuguuuuucaguuccuuaacaugaacauuucauuggcugcugaucuauugaacuuugauuuuuuuaaaaaauaacauuuucccuuuucaguuucuaagagacuuuacugcuuccucaguguuccauguguacagcauuuccuuucuguuuugcuuuaugaguagauuuccucugugucuccgagcauaucacuuguauucccucugauacgucucaucaauggcucucuacccucugagucuucucuuggucucuccuguucuuacuggagaucuuguucagugugcugggauccugcauugucaauuuacacacaaacagugcugaguccuugggcguggcucgagggaggugucaggcagggcucuauaccacuucucccuguguaaaaucauccuuuggucuugcuggucuucugcacauuaccuaccuuagguugaggcauugggccuaccuagaacucuuacucuuucagagcuuuugauaaagggaagugggucccuauugagcugggaaccugugcuggugccacacccugugcuucauaguacuugguaaggaggcaagagguccagggcuggccccuugcugugucaugguggcaagccacuuccucucugguugucaguuucuccauauguaaagggugggggagaaaaggggucagcuuuggcugaccagcuggccagaaugcucuguuaccugcaugcuuaaaucaugucaggugcuuaguuccccuccccauugcuggcuggguuuguugccugaccacagaaaacccagcucuuauuguggugacucacggugaccauggugacuguguugaccuaucacacaagugagcgagccuuaucugagccccuucuccagggcagggggagcgcccuuuggcuuuuguuguagaaaugauuuguuguggugucagggcuuuggugcuucuccugucaaagaggcuggccaggcuguaugggcugguggcagaccucagccaggaaggggucuggaggaagggagagguggcuacuguauaggcuagucugcuauuccuguucuuggagacaaacuuaguacauguuuuggugguaguauacaugccaugagguuugccguguugacuaauuuuagaugugcaguucagugacauugaacauucacuuuguaugcaucccucaccacagucuguuuccagaacuuucucaucgucccaagcuuacuguccccauuuaacaaucuucccauuucccuuuugccccagccuccgaggcagccaugucuuucugucugaguggaauuaggcagcacuuaccuuucuguggcugccuuauuucaguuagugugcuggcuucauccgugccaucgcacgcaucaggauggcccccguuuucagagugagcagcugauuuucuuuaucuguucaucacguggcuagcugagagaggucuugcuuuugcuugugggauccuguggcaguucuguguugaguuucguuuuuaggagccuuuacuguucucugcagucgcuguggccuuguggcuugucuagcaguuugaucucacagucuagucucaugauugugacugucauguuaaggugcucacagaguuguuccuuaacugggaaugaucugauugcuuggugucucuggugcugguagccaucccggucuuuguggcccauuccucuucagguggggccauuguuggcuuuccauuguugguguuccauagaggggaagaguuuccacuuguaagggcgccugcaguuggauugaucuguccuggguaauccagauucagaccacgcucacccaguguguaaucucagucacucuggacugacucuucggccauaggaggcggcauuuucagguucucuggagcacugggacugaagacuguaucuaggauagauuuggaggauaauggccuuguaucaggcuuugggguacccucuccucccuaauggccaaucagccugcccaccacccuauggcucagcuccugguaauuagaugcgcacaccaguuugaugagcucgcgaguuuugauccuuuaugauccuaucccucuugaguuauuggaaggaugguguggcacagaggcagugagugggcacagcaggacuuaguguauagagcaucuccagccugggggauuugggagaaacccagcugggcuuugccagagcuggagagaccagacaccuuggguguguguggggcacucucagauauugccauugcuccacaaugcugagcccauggccaucaggucccuuugacugugcuccauagauaguccuaguagacccucuuucagaccuggggcauaaccaauaguggggaauggugacacaaaagaacagaccuggggcuggagagauggcucagugguuaagagcacuggcugcucuucugaaggucucgaguucaauucccagcaaccacauggugucucacaaccaucuguaauuggauauaaugcccucuucuggugugucugaagacagugacaguguacucauauacauaaaauaaauaaauaagucuuaaaaaaaagauaggguuucuauaaaaaacaaacaaaaaaaacagaccugcacucccauauccaaacugugcucaaacauaaccuaaucucucucuccuucucccucuuccccacucucuuguuuauguguguguguccuucugucucugucugaguguguaugugcacauguguguucaagugcccagaguccagauagauaccuguuuuguguaaggccagaagcaagugucggaucuacccgcuggagcuagaguuccaaguaguugagggcugugaugcagggaucagaauucuggucccggugcucuuaacuaccugagccauccuuccagccuugcauacguguuucuuuaagcuugccucggucuguuugaacugcuguaauggaauacugugaacgagaaaggcuuagacagcagaagcguuuugcucacaguagaagcuguaaagcacacaucaagugucugcugaggaauugggucuggcucuguagcuuggccacuucccuccgugugcuuacaaaguagucucucucuguucggagagcucugcuauugugaccuagccaccgcagugcccugcuuucucauugcuucucgaugggccucaggauuauaaugggguucaucugggagacaggugcacucugcugcugcccgaagcagucagcuaaaaagccauaaggauggcuucagagguccugccugggcugcugcuuugcucaucacagugcacugcggugugugguuguagcaugcuuaccccauggcagccaagaugcagugaggaaaggcuuggaucccagugucuccuucacagacauuuacccaguggccuaggaccugccagcagcagucucucaucccccaaagguuccacugccuaccaguaugccccaggggcuugggacucagccuccaacagacacggaccuuugggggccuuucuagacccaugugguagcacugcccuugcuagccucugccuuucaaacuauuccaaccucacccccaccccuuugcccugccaagucccucuuugacucacucccccagcccccacagcucuccuuagcacaugccccaggggcuucugggaccucccgaacucaguuugcuguuuuauaucgggacaacccaauggaugaaaggcaaaaugauacaaugagagcauacucaguaggggagacuguuguauuccuguuuaauagaggugagaagcuggccaaaggaaggcucaguaauuugaccaggaccacccagcuaguaggaaccccacuuggauuugaacuuacguagucugccuucaaauuuuguguucauccuguuguccuacauugccauuaagaacacgggguuuagcugggugugguggcucacgccuuuagucccagcagaggcagguggaucucuguaaguuugaggccagccuggcuggucuacaaagugagauucaggacagcuagggcuacacagagaaacccugucuugauaaaaaacaaacaaacaaacaaacagaaaaagugggagcuugguuggugaucauuggcuauagaaaccacagguguguccugauucuuaacuccaugcuauucugucacaugagcgugaagcucagccucugagauuacuguugccagcaucaguagguccugugcaaaaguauaguguaguggcgaaagcccugggauucaaagccaggaggacaggauuugaguccugccuccaccauucacagauaccugggaccauagaggcuugcucaggacucccugguccagguccuugguagguugggccucugguccccuugccuggacagguaccuucaaguauuccaugcucccacuuccccuaagauaaucaacaccugagugcuguguguuggcugucauaggaacucaggguuaacauguagugagagagagagagagagagagagagagagagagagagagaaagagagagagagacagacagagagagagacagagagagacagagagagaagacauacacuuaagaguugauaguacuuagagacaugaaaaauuacccaggaaauaguuuauggugccuggaauuuucuuaaacaaacaagcagggcaguggauaggccuagagcagugguccucacccuuccuaaugcugcaaccacuugauacaguuccucauguuguagugaucucccaccuauaaaaucauuuuuguugcuacuucauaacuauaauuuugcuacuguuaugaaucauaaccuaagcaucugauauucgggauguauuuucauuaauaugaaaugacccaagggucaugacccacagguugagaacugcugguccagaugaguggcaaaauuggccuugaagcaauguuuuuuguuuuuuuuuaacuuuaguucuuuuaauacaucauuuaguuuuaucuuauguacaaugguguuuugccugucuaucagugugaggugucagaagcucuggaacuggaguugcuuacagacaguuguaaguugccauguaggugcugggaauugaacccagggccucuagaagagcaguuggugcucuugaccacugagccaccucugagccauccaucccuucagcucccugaaacacugcuuugcugaagcugaggguugagcaucuguuguccuauucugcuuauagauagucuacaugccaaccauugcucaucagagccucgaucauaugagucauuucgugaaacugcaaaccauugcugcguaugcgugguacgaggccagcccugaugacucugagugugugcuuacguagggacuggguguaucugacugcccucuucccucaagccaguagcccgaucuucccggagagggaaggaaguucuguggguugagacgcuaaaaguucuagaaaccuccaguuuaaaaccuguccccuguaucccuguaccauuucuccuguccuuggaaggaggcucugucagccuccuggggccaucagaccaaugguuacccguguagggacucagcccuguuugggaagagggcagcuuuucugacugcuaccccagaucacguucuaccacauccuggcuccuugaucugaugugcucuagugacaaauccaagggcugugggagccagauaagucuccaccuccauccuggugaccugagacagauaaguaaguuccaggguagacacacacugcacauaaauuaguaaagaaauaacauacguacauauagaauuaaaaaagaaagggaaaggguuugaggccaaucugggcugcaucgcaacacugugugugugugugugugugugugugagagagagagacagacagacagacagacagagacagagacagagagaauaugaaagaaaaaacuuaccuguuuucaaacaggugaaccaaauacauauguguguauguuuuuauauauaugcagaugcuuuguaaauauaugcauacauguauguguguguuaacuuauagguucgaaggcuuagugguugccucugggagaggggauaguguccuguccgucugccuuggguuucuauggauugcuuauauuuuguauuuucaaaauaaaauuuacagacucuugucuuuuugagacagcgucuuccuguuuagcccagguuggccuugaacgcaugauccuccucccacagcgucccuacuuuugccagguggauuauuugcaugcaccagcaccccaguuugugccgggccggggaucaaguccugggccucacugagccagaggaagcaagcgcaggaccagcugcagcccggcuggcucauugcuggcuugauguccgguaaugcuuaguuuucugaagauuggauugcaguguauccauccaucugccagugggcaguuguggcuaacacugcuacacugggaucugagccacaaccccaaaggcuugcuuguaggaagcguguggggucuucauuaggggugcucuugaggaauguaucgagauucuaacccucccuuuucuuccucuccaccccucuauugaaacuucugaaacccugucuuaaaaugaaccuuucuuccuucuaacuuguuuaucgcuggcauuuuguuacagugacaaaaggcugguucacacugucauccuauaaguuuuuaucucacuuggcccaauaccaagaucaugcuaguugcugguuucacaaaauauguuuaguuuuguaggaaagugcaaaaaauucucuuccuaagguguuguaccauuuagcauuccccacaguauuugcuggcucucucucuucugggcauggacauucuuauagcugugccgccuguuuccauuuauaacagguuccucucuguguacugucaccucuguggaccuucugguaagggaccuucucccgucucuuuccuauuauuugucucuaucacuauaucagaucuuuuaggaauguauucagccauuguguaguuuugugggguggguuguuuuuguuuugaaacaagcucuuguuauuuugcauaggcuggccucaaauccuuggccauaaggaauccaucuauccuccugccucagcuuccugagcaguugaaauuacaggguuuauuuuagcaccaugucuggcuuucuuucauuuacuuggggaaaaaaaaaauaugucaguaaggauugucagugccgggugauuugaacuguuuauuuacguguugagugagagcaaguggcucuuuauagccaacagcuggggaaagcagagugguagaccacaaccaccaccccccccaagaaaaaaaauguaaguccugauuugucugcuugagugccaaggggcucugggcccugguguggcucuuuagaccucugccugucagcaucagccuuuuggaccuguacuucaggccugguacuucagccaaccaccuaguuccuccuggcuucccugcccugcucuuggucagcuuccaucccuuugccgaaaggccagaccauucuuccccagcaccugcagccagcucuuauccuuucuguacagaaaagcuauugacagccaggcguguuggugcacgccuucaaucccagcacuugggaggcagaggcaggcagauuucugaguucaaggccagccugguuuacaaagugaguuccaggacagccagggcuauacagagaaacccugucucgaaaaacaaaaacaaacaaacaaaaaaagcuauuagcauagugggagaggucuacaauuuacucacucugagccaaucagcaaugggaauggcagcuugcuuauuaacaugauaaucgcagaggaucuucuccugugcgggugaggaagugucaaaaauuuaccuauccugccgccaggcacccggcugaugcccucauagcaauuaagcaauuaacaauuaagaaaauaggaacuaggcuugguguggugccacaugccuuuaguuccaacccuugguuggcagagguuacccuggccuacagagguccaggacagccagggcuagcuauacagagaaacugucuccaaaaaaaaaaaaaaaaaaaaaaaguguucacaaacuuucauagccaguugauagaacacguguggcguagauuguucccuaaagccagugaaccuuaaauuucaagggucacuacuuuauaggcaaaaaucuagacauagaacaagaggaaaaagaauggaauuccccucccuagacucagccaccccccacccacccaucccauguaaaaccucgugcuucccacccuaguaggaagagauggagaccugcagcaaaaucagccuauuuguacucucccguuucuagaggcccugaagagacugccccaucaaacaggccaacagucuuaauacuauacaggugucucugugucuuuauuguugaaccccagagacuccccaaagccccugacaauacaagcccucacauacuccaaaagaagccgcccagguggguucuguaucgacaggauacccugaggcuuaguccuaaaggaugcuggaugccaggaugcggggcugcguuuggugcucuuguaugaaggagcagucccacacucaucaaggcccagccgucuggguuuuaucauucuccacaaaggacuuuuauggaagcgcgguguccuggguaauuuuacuucagcuugacacaagcuagacucaugagagaggagggaaguucaauuuggaaaaugccuccauaagacugggcuguaggcaagccugugacacauuuucuaaaucagugauaagugugggagggcuuagccgguugugggugguaccauuccugggauggugguuuuggggccucugcgucagcuccugccuccaggggccugcccugcuugaguuccuguccugacuucuuugaugaugaacagugaugcauaaguguaagcugcaauaauucccuuucuucccaaguugcuuuuggucauguuuuuauuacagcaauagagacccuaagccaccuauaguugucuuauaagauggagagggccacagcuguuugaaucugcacagcugcauuugcaugguuccagggaggaaggaagggugaccuuugugcuguaguguuccugagagagucagagccagaagcuagaaguucucuagaggcaggguuaucagaauuagagccagaugucuguccuaugcagguggacucuccaugaggucccauguuugaaugccagaaggaggcauaugggacagaugugccuggcuguccaaaucacauuagccuugggaaguaucacucaccuguguauuuuucuucucuguuggaagauaaaguaagagaaggcuuuggucaaguggaagguagcaagugggucuauuggacaguagcccaccacauugucccauuugucacggagugcgagcacuggaaagggugagguccccagauguucucauucugcccccuugggagcugaggcgagcccgaaggccuugcugcucagcuggugauucuugcccugggaguuguaggugcuuagcugcagaguaucgcacauguggguuaauuaucucugggucccagugaguacaccaccuaacagaguauaagaggggauguguaggcugccaugauggaggaagcacagcaggauucgaaugcaaagcagaggcucuucacaucccuguggacuagggaguggaaaaagcaggccugggaccuucauggagcuagccuuccuucuaagggcuaucccuauuggcuuacugccuucagccugcccuaccuccugagacucuacagccuucuaaaauaucacgcugucuuaaacagguguucauauuaugaaagggacacuugugauuccuaucaguuacuuggaagaacauaaugccgugcacaccaaaucggugguuacggaacagcugagagagcuaagagggucacagugagucaccguagccagagacugaggggggacggaaaacuggcagacccacccacaagagagaguucacaggagucccuauaauggcucuaucacccagagaaccaaguucccaugcaguggagggggaagcaacccaccugcacugggaucucgggcuacccugugcuucggguccugacaggccucaggagggaaagagacgagggaacagauuccaacaauuccagauggaaguuggugugaaaaugaacgagagggagaggcuggaagcuaaguccggugggaggaaggacccaaggucacugcgggaagaguugcaguggaguggccuuggcagggcuccuuccaggagcugggugcugcuuuagccagggaacuccgccacagcucucccuccccggagggaggccuacccuccggugucccggcuguuggugcuaaaugagcucugugugugucauuuuuauuuguggaagguacaccaaggccgugugggauggaaggggguagcuucgugugugguuagaagugccugucugaaugaaucggaccuuuucuuaaaguugcuuuuacuaggcaaucaugaacacaucuugucuauacauggaacgcaucuugucuguuuagccuguuuuccuuccagaggugacuggcguuauccaguaacuguguacagugccaaggguggucugugcauguguauaccccacaccucuuagucugcauguuucugccuucuuucuuuaaaaacaaguguguguguguguguguguguguguguguguguugcaugugcacgggugucaggaucacccuggagcuggaguuacaggcagucaagaguggacauacauguuaggaacuguacauacauagggguccugaaaaaacagccguguaaagggcgagggucuguaggcugccagaucuccaucccuccaaggccauuuccuauuguauuguccacuguccucucucaacucagaggccaaaaagugggauaaaagucagguccccuuugugggaccagugauaccuuaaggaaauucugcggcuucccagggacagcauccugaguucuucagggaagccaacgauuggcagcuagaauaucuuagacggagacugucuagacaguaguuauuaaaauggggaccccagaucuaguacugugaccugggaacuuguucagaauagggaccaaacaaagguggagcccuugacguuuuaauaguccccuagcauaaauaaugccccugugagaaacaguggcuguccuggaaccugugggcauggcuguugagaccacgcauuucucgucauggccuuggccugcaccucugugcuuauuacagcagcaguagcugcuguguggcaagagcaggcagguugcagggcaguggcugaccuuuguuccucuggggccuuuuaauugacaugggacguugcugaagacuuguguacagcgggcagcgagagcagguguucugucugcuucccugggcucuuucuugcccuuguggccucauuuccauguaacucuuacuuucuuugggcuuugguaccugccaggcccuucugagggcaucucuuguuuccaagaaugaugacucccacaauaaucagguuauuuuauguuaguggaaugcucaggagagacacagaccugcuauuaaagauugugacagccagucuaugcuugcagcuugcagcuugcaucuugcaucuugcaucuugcagcuugggucugacccagaggcgcgcguguguguguguguguauguguguguguguguauguguguguugguugguguuguggugagcuugaggguuguacaugggaugcagggaaacaggguccuucauuguuguggaaggauaguaauaaggacaaguagacucugagucuugggcgaugcucuaccuagaauaugaugucagagagcguguugguggaaacagaaaccaggccuggaggagcaguugucaaggaaucaggcagcuggauuaugguguuguccccuccuguagcucugggugggccugaugaagcuggggacacccccccccccccccgcaggaagugugggcuggggcaugggaagccaaucccuucuauaguggccuggccuugggcucuguucccaagaugcagaucucagcaggccugcucggagccccuccacaugaucugaaugcacucucucuucuucuccagcucuagccaugagcuacccaggcuacccuccaccugccgguggcuacccuccagcugcaccagguaagaggacccaggggauugacucuuucugcagacugggggcuggagaggacuggggaggccugcucuacucugagacucuuucucuuuggcaaaauagcuugacggcucuuucccuccccuggcuguccccaggggacaagacagggagucacaaccuacaggaguauccugcaaaguguugcuacuaacacacccacucuguuucaaggaguaugauuuuggauuuugcagcaucggggucucuccuacugaggccaauaccaaaggccacugucccuuucuguauccccuuccccauggcuuccaggauccccuggugauggggugagaccacccaacuggggcagugacucagcuaaucuuccuucugaagacucgccugcccugcccuacccugaacuguuuccugaaaacauuugguuuccaugguaguaaggaaacugagggauucuggguaaggagacaggggccacugcacugcaaagauaguuaccauugagggaauccagcagaaacgaacaaacggaccagggaaguaccuugaucacugucacagagcauaucuagccaagcuagaccuuucucugaucuggcaguagugaccucaguccccucuucagcaaaaacacugccgucugugacaucacaugucaacuccucagcccuuaccucagcagcuggaggucacacuucugcagacaugaaugagugguucagagccuugccccaggacacacagccagccauguggucucccaacgggcuccuugauaccguccuucacagugucccugcccucugacguggcuucauuucucuccaucugagaauccucagcauuccuggaguccauggcugucacaugcucagcuccgcacagagccuaaggauggaucuguccucucacccaguggugcuggcuuugagaggacaaagcaugccugacuccccacuggggcuggaccugccuucuuccucugcuuucccuggcccucuuguuccauucuuucugggucuuuauaacauuggcuggaugcuggucuuccuugguuaucacagcagccccucugcagcccucuuuucuguucugucagugggccagggauacagagcuaauaauggcuugguguugcuuucaggugguggucccuggggaggugcuggcuacccuccucccagcaugcccccuaucgggcuggauaacguagccaacuaugcggggcaguucaaccaggacuaccucucaggcaugguaagucaggccccugccaagguaucccugggccagggcuauagggaucaaggcugcuuaccccaaguucucagggagaccucaug

SEQ ID NO: 7319 - RNA, 359 nt, Mus musculus
uuuauuuugcuuucugacucugugcuuguaccuucaacacguugacaaugauuuucugcuccucaauaaagaaagccugcuugauccugucacagacacacuuggcacacauggagcagcuauaggcccugcuuaccugcaucuuugucuuagacaagcgcauaaggacuacccuggcucucacagcaggcaacccuugcagucugagugggcacacgccacaugcagauuuaggugcuuucccaaccuucuugguauaaagguaaacaauccuguugucagggguucgagacagccucguuuuguuagaggcuguauuguaggaaagccuuugacaguaugucaaccgcuggaccaua

SEQ ID NO: 7320 - RNA, 59589 nt, Mus musculus
agcuguuuggaggguauaaauaggacucccauggacagugcuggaggaagagcugggcuugcuuacagagcuaguggcaugcugugggucuuguaucuucacugaucuuugcuucccugagagaggcacagcugagaacuucuggaguuccugucgguccuuccugcugaccuguguggaggcugaggccugauagucucugcuagauauugccaccauugcagauucguguuugcuauccugauucuggugaacuggacugcugguguauccauggaguguuugugagugaaucaagcugccacugcugaacugcuaauuuccagacaacacagacaggaguugcuccaaagaaccuuuucaaacaggucaacuccucacccccacacugguauccuuucuuucccauuaccucugguaggugguggauuaaaagggagguuaagguguuuaagaaccaucauuagaaaugaguuuugaaaaaauuaaaguuacagcugagaguuuuucaaacuuuuaauuucugguucccuuuuacguaauaacaucuuuuaaaacucaucccuucuugccuugaccuggagaaggaacugagccacuaguauuuguuagaaaguucagguaaauauauaaucucauuguggccagguccuaacuucugcaaaauagaauguagcaaaugccuuuauaaguuacaucaagaaucaucuuuuuuccauuguugaguagcaugucuuuuacucccacugaguccucacuaggauggcuguuacugcccauauucuuacuaauguuguauuuaugauuacuuguguccuuucugaaaagauggaaacaaaccaggaaugauggcauaugccuguaaucauagcacuugggaaaugcagguaagaagaacagaaguucaaagccacccucagcuguauagcaaguucaaacugcccgggcuaugaaaccuaucccaaaaccaaaugaaacaaaaauauuucuacacuuugcaucucaaaaaucucucacccacuaccucauuacccaguuccagagccacuuucuauuaauuuuuuaaaaauuauuuuauuaguauguguguuuugcuggcauguaggacuguacaucgcuuguguaucaaaguccagaagagggagucagaucaaguggaacaggaguugcagacaguuaagaacugccacgugggugcugggaacugaacccagguccucuagccacagagcuauuucucuagucucaauucucuuucuuaaauauuuauaauagcagaacccuucugcaaagaaguagccuaagauacgcgcgcgggcgcgcgcacacaaacacacacacucucucucucucucucucucucuccuucccucacuucugcuccccccgcccccaaauuggcucacucagacuuccaauggaucgaacaagacucuuccacaaauggaaaggcaauuguaaugguaaccucauggaggacccuuacagauagacucagaacaaucaaauaccucuguaacucauaacucagccaacagacauaauuaucaccacggccuccaguacucagcuccuuugauauacagucaacaauugaauaaugcaaagacaaccuucacacacuguacaaaaagguuauccagacagcgucuuuccuaauccagaguucggugacugacuagccuggcuggccagugagcuuugggaucauuucuacccaucacaguagguuacagaaaggaaucacugcucugggcuuucuuguggguacugaggauuugaacucagcuccucaaauucacauccaugcacuuuacugauugggccauucucccagcccugcacuguccccuguuaaacauucacaaacacuguuuuagggagugccucucagugcauuuuaucguuacgugcuaucuaaucuucccaucuuuccuucaaaaucugcaccuagacaucagucuuucagagauguguugcagugaucucuacuuucuaauuauaguauaauggugccuggccucucuauguuuugcuuuuguuguuauuguuuugagaggauggccaggauguagcccaggauggccccaaacuuucuauguagccaaggaugaccuugaauuucugaugcuccugccuccaccucccaaguagauccacaauguccagguugacuuugguuaguugguuggcugguuuggguuuguuuugggugguuuuuguuuguuuguuuguuuguuguuccuggaaauugaaccucauaaaugaguguucuauccuugaacuuuauggauggcccuauuucuucuauuugcuugccacuggccuauagcuauuuaugcucaaguguauuuaauugaaaagcaagaaggaaaucuacuggucacccagguaagugaaugcauagggcauuuagucuuccuucagguucuuuugguaaaaauuaagcuccaaaauacgacauugcaacucacacccugucucauguucacacuuuuguuguuguuaaagcuauaaaaauugcuuaaauaccaggaguuugguuaggggugaguagggaagucuggaaugauuuuaaucuugugcucaguguucuugguaauacuggaagagcagcaaagccaggcauucaguuaggguuuuuuggcucaagcagccgacccugucuuaagugccucucacaugggaaaaacaacaacgagaagccuaccaccuagggcuucagaggacaggaugcauaaccugagccagggcugugaccuggcugccaagccaagcaaauaugaucugaaguggcauuaacagaaggcuacuggccaguguaagaaagggaagaguccaaagguucacuuugcuggggcuagcucacaccuagagaauggugcuuccuucuaugucuuaaaacugauucaacaacuccaaguuuacccagguugggugacuccaugauuaacugcuagaauccuuugaagaaagacggacaaauuugggguaguuuacccaggaagcuagacaugaggauguaggauggcucuuuugaaacaauccaugggcuaucgucucuaaaagcuggacuccacaagaggaaggcuuuccuagcccucaugaacacgcagaaaagagcaguucuuaugcuuaagagccacugcaugugugggauuggcugagccagcaccagaauauucacauauaggauggaaaguguggagaaacgaccuugcucaagauccuuucagauuuaaaggcucuaaugacaaacucuacaaagguuaccauuucuuucugcuuaaccaaagauuauauaagguaguaugucagccaggagugguagaucauggcuuuaaucccagcagucuggaggcagaucucugaguucaaggacagccugaucuacagagcuuguuccagaacagccaggacuguaccaagaagcccugucucaaacgaauaaacaacaacaacaacaacaacaaagauaguauugcaaagaaugguaauuuguauccacaggccaaggguccagcacuguggaacagcugcucauuaaaguuuauuuaucauuaauaauaaaauagcauauaguaaagugucuggauugggaacacuuuucucuucuugacaauaagucagguuagcaauuaccuuucaccaauccagaaaauaguuccaggagcuguuugucuaucaugauaauauauggagcuaaagcuggauaccagauuuuuucauuucuagcucacuguccuuucuaauacuaaacaguacuguuuuuuucugaacaguagguuuagaaccuuacuugaauacagguuauguuuuucuuucugaacuguacugguucuuugucacaggcagguuguuuuaggcaaggacaguuucuaauuuaaauguuguccccaguuaauucuaugcuauccaaacuuuccaggugggacuagagagauagguggcucagcaguuaagaacacuuguugaucuuguagaagaguaaguaagguuugguucucagcaccaucguggaguuuacaaccaucuuuaacuccagaggaucuggcacccucuucuggccucugugcaaaccaaacuccacuucaguacccauacauacauacauacauacauacauacauacacauauaugcauacauacauacauauaggcaaaacacucauauauauaaaagaaaaaugauaaauacaucuuuaagaaagucuucagcauucauuacuacucaaguuugagaauacuugaccaucaagagauggaucauuucuugauggucaagaauuuuuauguguuuuaauguuguuugcuugcauucaugucugugcaccacacacacuccuggugcucuuggugaugagaagaggacauuagauccccuggaacuggaguuacaaaccaccauguggguguugagaauugaaccugguccuuugcaagagcagcaagcgcuccuaaccacugagccaucaguuggagccccagcuuuguucuauguaaaauagaaacaguaauaucacugccuuuugaggccguggaaaggcaugggaauggguuuugauaaauccauuguauguuaucuaucaucuuuuacacacuuuccuauuggguauuaccacguuuucuaauuacuuuuuuuuuuguuuuguuuuguuuuuugagacaggguuucucuguauagcccuggcuguccuggaacucacuuuguagaccaggcuggccucgaacucagaaaucugccugcuucugccucccgagugcugggauuaaagacaugugccaccacgcccggcucuaauuacuuuugaugaauaaauccuagcaggugcugaaaaaaaaauccuacuuagucguaucaugcuaugccaauaaucaauagcaauucaccagggcagauguuucuugagugcccagccuagagcugucuugacuucuuaacaaagguagcuugaaaccaggcccuuccuccaguguucagauagcaugguccaaaggugacugaccaacccgagauuccaagaaagucugcauaugcguaagaguugagagaguccgccagaccaauaaagaugggagcugccuugguagggaggguauucggagaguuaaaguacacaucucuaucaggggacugcaggagugaacacaggcuugccuuagaguucuuauacuugcugggcuagucacgaagccucuccgaacuucaguucccuuaucugugaagacaaauuagccagaggugguggcccaugccacuaaacccagaaucuuggguagcugugguaggaguaccaugagcuagaggccaguugggacuauguaaggcauagcuaaaaaagaaaagaaaguccuacccaacacuuaacaaacaauaguguucaccauaaugauauguuuaauaagaguuaauagguguauuugaacuuagcauaucaacugucacagaguaaaaguuuaauuaaacuacuguuaaccacuauguuuuaguaacacuuuaauaaugaacugggucguuccaagaauaauucauugcuguauuguuguggaucugagaugacgauuccugagccacuguuugaguuuagagaacuguaaaaccagcaggccagucugagcgagcagcagagauagccgcggcuuguagggaaaccacugaaccccccgcucccagggucacgugccucguggccgcgccccuauuccgggaguccggagcggcugcggcagcggcagcacucggugcgcgugcgcggaggccugcgcgcucugcggcgcgguccgcagcggaggcggcucaagcgccuaggggguggcggauggcucugccgggcccggcggucuuugggcccgguucccgcgggucguuggacgaggccggggcugaggggcgcgaggcggcggcccuugcggcggcgggagucgcgcuggaggacgaggaggaggacgauggccgccggggccugcugcgcugggacggcuucucggccuggcuacacugcguguguguggugggcuucgaccuggagcugggccaggcgguggaggugaggccgagccgcacccugugucuccacccuugggcggccggguccuggccgcugcucauccgggcguggcucgcagccccugcgcggcucagcugggcggugcuucucgacccuucggugggaggaucgugggcugcggcuaggggugaaaaguucuuuguaggccccuccuaaauacuuguugauguuccucuuuaaaaaaacaaaacaaaaaaccagcgauaacuggaggguaguggcacccagaaaagccuacagcagacaggauguuugcuuggaacuuucaagaaaggaacaauacccccugacauaugugaauuacaguagccaaacgugcacguccaaucaugugggcugacugacuguauugucaauugcgcuaacucguagaucgguccacugaguccaagucaaaaugcuuagcaugcauucucucccuuuucucuguuccccauuucucugugaaaugucguuggguucccauucccuccaagucucucccuagcauugcaaacagaauucaaggccuucugaaaacuaggcaagcuguccccacaccccucucccgaccccugcuguuucuuaauacugauucugugacaauucccagaaaccuaaugucaguggaaaaauuguuggcuuauaaaucuguuagauaucauaacaucuuaccuaaaagaccuuugaaucucacucauuuuugccaucacuuugcaucuuuuuuuuuuguuguuguuuguuagcauaaaagauuugucuuauuuauccaagugaaaaguuacuagaaaggcauuagaaagguguaugucccgaaguuuuugguauuuuguuauuguucuuuuggcaucggugaaagauucuaaucuuauucugauuugguuggucugguuguuccaaacgagaaacugcugcaucuuugucuuuuguaucguuacauaguucauuuaaauauugaguuuuuauuaagaucuaggcaccauacaaguuaguggacauacacauaaaaggauguucucauuugcauuuaugaauugagacaauaagguggggaucuaagaauuaaucuauuuagucaauaggaucaaauuuauugccugauacaguauucauuaaacguuuguugauagagggaguuaguauguaaagugauucuguauuuuauuugagacaggaauaacaaucuccaaagauugaagacauuuauuuuuaaagauuuguuuauuuauauaauguguaugaauguuuugccuucaucucugcauguaagagaauuuguaccuugugcuuguguaggcuggaaaaggggguuagauccacucagucugcaauccuucuggucauguaggugcugggaacugaacucacauccucuggaagagcagcaagugcucuuaacagcugagccaucucuccagccccucaaaacaauauauuaugcucguuauuuaaugauaaacugaaauuuuauguguagcaaaauaaaacuuaaucgguaagcagaagcugucauauuuggucaccuuuaaaaaaaaaaaagauuuauuuguguguggcuauuuugcuugucuguguguccaugcuccacacucauuccuggaggucagaggaggcaucagggccucugaacaggaguugcagacgguugagagcugccacugaaguugcguccucuggaagagcaucgaguguucuuacccagugagccaucucucuagccccauugaucgguuuuuguaaucucaucguuuggaacauugcuuuuaacaugaguauuuucuuuuuuaaauaaguggcauaucuugacagaguugaggugaugaaaaauaaucacuaaagguuauauaugaaauuuuauuucccauaauugccauuucagagcaguaucuuuacgaaguaguucuuagcuuuuuuuuuuuuuuuuuuucuuccugaacuuucaaaaacaaaagaagaagaguuugaacucucuuggaaaaugaguaggacaaacuuguguugcuagcuaggcuguuugcacugauccguggagguguugucgucgucucugucuggauuaaggaucacugccuuaaaguaaggagaagagaggaaggucccuucauaacggagcuaaggaaugguaaacacaguaagaugucaaugaucuggcuuugagacuggaucucacucuccucgaguacauguagcccaggcuggccuuaaacucacagcaguuuaccugucucaggcuacaccccucaccacuccaccaccuagugcugggauuagcuagugguuacgugcuaccauguuugggacagagcaauuuuguuuugcuuaucuuuauguggggugcauaugcaugcaugccacugugcacacaguagaguaagggacagaauaggagucuguucucuccuuucaccuugugaggccugugaaccaucucaggccugaaggcuuagcagcagcaaauuucuuuucucuaaacagcugagccaucucacuggcccuuggcuuucauucuugagagaaggcaauauguaaaccaagcuggcuucaaacucaagagaucugucuucugucucacaguguuuugccuuuuuaagugaacauaaagcaggaacaaauauaugaaaacaguugaaguuauauuuugcgcacucucucucucuauauguauauauauguauauguguauauauauauguguguguguguauauauauauauguauauauauauuuuuuuauguccugacccgcagcacaguugaacagggucugagaaaccaccuguggagagaaggggaacaggaaacacagagaacggacagcaagucaaaaaauucugaucaagcugacaaauuuuauuuuuccauaauugccauuucauagcaguaucuuuacgaaguaguucuuagcuuuuuuuuuuuuuuuuuuccugaacuuucaaaaagaagaagaagaguuugaacucucuuggaaaaugggcagguuguauacccauagaagcaggauauggggagggggaugacgcagaauugcuuuguuucuggggaaacgcaccuguucccaaaagcaggauauuggcuagguaaaaaauucagcaagagaaacagaacagaacggguugcuaggcaccuguccacaagaucuauagcuauuuguucuuaacuggggguaguauuuuccuacagaggccucaacuuuucccacagaaaacucaacuaagcuaguacuuuuccacuaaggccaagacuuaagcacuuauggcugacaggcaguuaacauucaaacagggucacuccauguauguguguguguguaauuuuuuugaagcugcaccuguguuggaacuguacaggaguagcaguuagcauggaauuagaaagguagauuuguguugggagugacauauauaguggcuccagcccugugucuguaaaguacaaccagggaggcucagaagcaggauugccaacuagcagucacacagacaggacaacacaguucuggaggcucccagcuuuccccaucucagcaucaggacucagggcucucugcuaggccucagagccuauauauuugcuccuuuuuucauuuuguuuuguuguuuucaagacaggguuucucuguguagcccuggcuguccuguaacucacuuuguagagcaggcuggccucuagcucagagcucaccuccugucuccuuagugcuggaaguaagggcauguacaagccaggcaaugguggcgcacgccuuuaaccccagcacucaggaggcagaggcaggcggauuucugaguucgaggccagccuggucuacaaaguaaguuccaggacaaccagggcuauacagagaaacccugucucgaaaaaccaaaaaaaaaaaaaaaaaaaaaaaggcauguacaaucacaccaccaccacugggcuauguauuuguuucuuaaaaaugcagagucagcacuuagagagucaugugacaaaagaugagauccuaaugaauaucuaguugaaggcauggagggauguuagcguucuuuaaaaagcaaaacagaacaaacaaaagaaaacaaaauauagaacuagagccucuuuaaguuaccaaagaguguggaguaccaaugagagaccugucugugcaggguauggugcugcagaccuguagacccagcacugaagaggcagagggcagccauggccagccuggccuacaggggauucccaggccagccaaggcuacacuaggacaaccugcccucagagagggagcaacagcaaaacuaagcacauaggaguuugagccacacauugcuuucuuugugggaucacaguagucugacaccauugcuuugugagguaauuaguguuggaaaagcauuuagaauaauauuugagacaaaacgauguuuugggcagcauugauuuuucuagaaaucuuuuuuauuuuaaaauaaggacaccaaaauguaaccaacuuaccccaaaucauaaaguuuuaguaagcuaggauuuugauuccuuugguuccaaaaguuugauuugcucuaauauuccagcuaucuugagugaaaacugaagcuacucagagaaauuggaagcagugcagaccuuugaaaugccagugauaaccgaaagugagauuccuaaguuagugacgucugccuuccucaagguaucgccuuacacagcagugcuaaguaagacacucugaauaguucuaacccguaaacucaaaaucaaaugcuucaaaagcuuaaaauuaaaacaaauaaauaaauaaauaaaaagugaguggccuuuaggucuuuagagcuuuacauuucugauuuaaucaguuaauaggagucccuuuaggugcgauaggaucaauuuugagggcaguaguguuaaagucuuguugcuaucuauuaaauaggaacauugaggcuguuuggaaagggcauacauaauaguaagcuugcuuaucgccugucauguucagagaacucuguauuaguauguuuucuguaaugauaaaauacuggacacugggugauauauaaagaaaagaaguuuauuuagcucacagucuuuuuuuuuuuuuaaagauuuauuuauuuauuuaauguaugugaguacacuaucacucuuuucagacacaccagaaggcaucagaucccauugcagaugguugugagucacuaugugguugcugggaauugaacucaggacuuuuggaagagcagucagugcuccuaaccacugagccaucucuccagcccuaacucacagucuuaauuguccaguaguauggcaguaacaucuauuaucaagggccuggcucugugaccuuaggagguggaauuacagugagaacguaaaggagucacauggugagaaggaaagccagacccugggguaggggguaguuccuuuuuaaaauuaaaaaaaaauuaacaguccugucuaggacuaacguccuugagaccaucauuuauuccuuucuaggccacuagcgcaacacugcacugggaccaagcuuccuacauaggaaauuuauguggauacauacaaaccacaugcaaacagcagacucgaucagguaccuuuuuaauuuuuuaaaaguacuuuuaauauuuuuaauacuguguguauguaugugaauauauugaguaccugaggugccucaggguacagaucccccaggaauuggguuauaagugauugggaggcaccugacaugguugcauggcugcuggaaaucaaacucggguccuuuggaagagcagcaaguucuuguaagcagggagcuaucuaucccuguguaaguaucuuuuuaaaagagauggauuguuguaccaggcauggugguaucuggcuuuuccagcauuuaggugaaggcaggaggguuuggaguuagcuaccuacuggguuugaagucagcuugggcuacaggagauccugucucugucucugucucugucucugucuccgucuccgucucccucucuuucuuucucucucucucucucucucauucucucucucucucacacacacacaccccucccaaacaguugagcucuugcuguguugcugagguccgugucagaagccugagaucaagugaucaucuuguuucugucucguaaauacugagaucacaggcacaggcuccugugccuuguucucugugaggugaugaggugagacuauuauuuaacuuuucauuauuauuuaaugaaagaguugauaagagcauacaguaagcuuucuauagacuaaguaaaaauuuuccaaugucagaugagauuuugaaucuuuuaaaacuugaaaaauuaaauucuuuaccuuacauaauaaaaauuaugugcauauucauuuaagaaaaaccauggaaaagaagaaagaucaccuguuucaugucuuggauagaauaugauaagcaaaaucaaaauaaguuaagugguuccuaagcauggccaaaagguuugcaggaaaauccaaagcauauuucagcuuagugaauagacuuuauacagaaauguuaugaucuucaguaaaauagaagggugugauacaauauaauuuaggcugaaggcaugugaauagcuaguuugggcauagugacguacaccuuuaguccuaaucucacacagaggaagguagaucucagugaguugaaggccagcucagucuacauagugaguuuccagcuagccagggcuauacagugagacugucucaaaacaaacaaacaaaauacaugaauaauuuuuuuccuugaaagaaaaauguuuagcgauggguauacugggagggaggggcuugaggucacugggagaaaggccauaauuugcacuuuuugacuuuaaggugaauuauuagcugugcccaggcauagacgguuaggaguuuugcuuguuuuagcucagguauuugcauaauguaugaucacucuaauuagaaucgcaguucagugauuuuuuaguauuuuccuaaaucacacaccucauaccacuaauccaguuguagaacauuucaucacuucuaaaagaaaaccaguucuacuaacagccuuuugucucagccuucggcagccacaagucuguguucaauuuuggauuugcuuccuguguacauuuuacaugaaugaaaucauacauauggucuuuccgucugcuuucacuucacauguuuucagguuucaucugucaggugugugcccagccuuuugauauugcaauaccucauugucaucuacaaaggucaagcuugagaacuacagaaccaaguuacacaaaaguaucucagaaugucuuaaguaaguuuagcauugguguugggcuguacucauugccuuccuggggugaggcaugcagcuggagauuggacacuggcagcucuucuuuuauggcugaguaguguaacauguguuugcucaugccacaguuuguuuaucuacucagcauucuggagaaaguguuucuguguggcuauugugagugcagcagaguacucuugcacuaguuuucacaugaauaucuuuuuccugcuuuuguuuguguuauagagauaaagugacuuggccauauaugguauaugugauacagcuuuaaaaaaaaaaaaaaaaaaaaacuaccaaaauguuucuaccagcaacauaaaaggauuccaguuuuuccuguccuugccacucucuaucuguucuuuggaauauccaaaugggagcagggaucuuuuaucuugcuuucauuuguauuuuccuuaugacuaaugauguugucuuugugugcuuuuuagcuguugacuuuuuaaauuucgguuuguuugaugcuacuaggguugacucuaggauguuccacaugauagcuugguagacaggacuauaucacggucuuaguuauagcuccagccccccccccccuuuuuuuuuuaccugagugugcaugugauacugccaguaacucaugcucuuaauuaucuuucuucagagaccacagucuucacacugaaaguagcugugcagggucauagcagauacaucuacuuuuguagagauaguuuguuuaaaacacuucuugacuugggaaguaaugucuauuacacacauucuuucuguauaaagacaaagugguaaauaaaaugagacaguucauagauaugugaaugauuuuuuuucugaaaaauauuuuuuuguuguuguuauacuuaggccuuaauuaucuuugucuugcuguguagucacaccuccuuucuuuauuguagcucugaagacucuguuacagucaacagagcccuugaugcucuccugcacuuuauuuuuuuaaaguuuuauuuguuuguguaguguauguguguguguguguguguguguguguguaagagguaagcauugaaagaauaguuaguaaaacuaacuguagaguugcuaacgauaaguuguccuaggccacucuugccaguaugacugaguccaacaagcuccugacccacugagcugccaggaaacaucccaguuuugagacaaccucacaguguugugcagguugccuuggagccuccgaaugguccagucugaccccagaauccucauuccugagcuuuucuucaaaugcugggauuacaggcccauaccaguuccuccagcuuuuacugagacuuaaacuaugacuuaaauagaacauuuaguaauggcuuuuagauguuaucucugcuuuuaaaaguacaacuaaaauaaucucaacaugagaaagggagacuuagguacacauaaaaaguauuacauauuaaauacuacugguuggauagaacuaauuugagaggguauccucggaugaagcaaagcugcuuuuugguuuuuaagucucuccucugggcuagagacuaucuuaaguguaaagacagagggguaaauuaagugaggcaguucucuuaugaauucccacuuggggaaaauugaaccgugauuguuuuuuguuuuuguuguuaaaagugacaaaaaccuaguucaagcuggcaugagaaaacaacauucaguuugcuuauguugcccucaguuaaugguaggcaaacacuguaccucuccagcuccauuccagcucucuucucaccuugagacaugucucacucaaucguccaggccagccuugaacucucuguagucgaggcuagucugaaacuuaacuuuuccugccuuagcuucucaaguaguucugauuguagaccugugccagcagaccaagauaugaaaacaauuuauugaugaaugcuauuucaaaaucuauaguccaaagcacaguuccauugaugagauaagcggugcuguaaagaguuagguuuuugccaccuuucuccuuacauugauuaaaauaauguaacauaugaacagcagguagaaaguuauuagaagagagcacaguaaacuaucacauuaucaaugggauacguuuuaaauguauucacauaauugcuauuugaagcuaagcuuggaacccaggaccagguguguguggcgagugcucaggaccauguguguguggugcucaaugcugagcucuacuccagcuacggggugggggguggguggcggguggugguggugguggaguuuuguuggaagcaaagagcacugaagaaauuugacauuugaaaacaagucaguuugagcucugucucagaguuagaggagaaaagugcuuaugauauuagaagaaagugcuaaacaauaugaagccauuguuuucugaauucccauaauuucuggucacauucgcauugcuaauguuuuucuuuaacagaaugcuuuauccuacacuugugacugagugcuguauucaugacccuccucccguuuugagacaaggucucaaguaucucaagaugcuccugaacucuuguuaccaaggaagaucuugaccuugaacuucugaucugauccucuugucucuagaauuaaaagcuugugccacugugccaaguuuauguggcucuggggaucaaacucccaguuccauuagugcuaggaaaacauucuauacuuccugccccauuuugaaucuuuagugcuggaauuucccccuaauauacuuuaaagcaagcacauuuugcuguuaaauguuacagugguacuggggaauugaacccaggaucuuaagcaugcuaaauaaaagcuuuacucccaacucuguaauuucaaaauauaaaguauauggcaugauacagacaauaaggauuuaaccaauaagaauuaaagaaaggcagugucaugauauacagcuauaauccuaucacuuggaagguugagacuggaggguugcuuucaguuugaggcuaccuugggcuacauaaaauccucucucaaagaacaaauaaaccuaaaacaaaacaaagcccccaaguucuuaaaaaacaaaacaaaacaaaaaaaaccccaaacaauagcaacaguaacaacaaaaacaaaaaacagguuuaguaguucacaucugugauuccagcacuugggaaacagaccagaagaucagggauucaagaccauccuugacuacacagugaaaaauggucuuaaacaaaacaaaacaacaaaaacuaaauuauaaacuacuucaaacugaaaaguuugcagacuuuucaaucauaaugcucauuauauaggaaauauuaaauuacaagccaugcagacauuugccugucucucagucucagcuuggugugggauauaggagauucuguagcaaaagagaaagcaaauaaccccucuccuccaacaccaacaccaccaccaacaccagcaacaacaacaaauaaccccucuccuccaacaccaacaccaacaccagcaacaacaacaaauaaccccucuuuuccaacaccaacaccaacaccagcaacaacaacaaauaaccccucucuuccaacaccaacaccaacaccagcaacaacaacaaauaaccccucuccuccaacaccaccaccaccaccaacaaauaaccaccaccaccaacaacaaauaaccccucuccuccaacaccaccaccaccaccaccaccaaauaaccccucuccuccaacaccaccaccaccaacagcaacaacaacaacaacaaauaaccccucuccuccaacaccaacaccagcaacaacaccaaauaaccccucuccuccaacaccaccaacagcaacaacaacaaauaaccccuuuccuccaacaccaccaccaccaacagcaacaacaacaacaaauaaccccucuccuccaacaccaccaacagcaacaacaacaacaaauaaccccucuccuccaacaccaccaacagcaacaacaacaacacauaaccccucuccuccaacaccaacaccaucaacagcaacaacaaauaaccccgcuccuccaaaacuugcaacaacagcagcaacagcaacaacaaauaaccccucuccuccaagacaacaacaacaacaaaagccauguuuaaaaaguauugaguacuuacuuucuugaggagagacaggugguuuucuuuucuuuuuagaauguuuuugagacaagaguuguguuguagcccaggcuguccugaaauucacacugugcugcccaggcuaaucucagacccauggugaucuuccugccucagcucaugugugcugagauuauaaacucuugccaccacacccugcuagaccuacuuuuuagccacuugggggaguggacuggucugcaggaggaugccuuagaccucugcuggcuguugcugacucuggcaggagcugcuuuggcccagagcugcuuccauuacagaggcugauaggcagcuguuuucccucagaggauucuguggucacugcaggugcagggaaaagacaguuauuuaaaggaaugggggcagguaggggugguuaccauaggcuguaugguagaaauuuuuaaaauuuuagguaaauguuuccuugccauuuuccucuaaguauuugacguauaguacucauguaaucaccuggaaaguauuauaucuugaacaaguaugaguugaaaauauagauucauguuuucuuuagauuuuaaguuucaaacagaaaaagggaauaaguuuagguuuccccagucuuagagcuaauuuugauguaaucuuuaaagcuaauguaacuucuacuuaguucucuuaacuucuuguuuuauuacuaaaaaaaaauuauuuuauuuuuuagaguuucaccauguuuucugggcuggccuugaacuaugggacucaagguagucucuugauauagcuuuacaaguaucugugacuacagaugacaccacagccuuaacuaugauuucuaaaaaacuuuuuggccauagccaacuagaauuuucggcauacccacuauaugcuaacguaacuuaacuucuuucuuccaggugauauauccucagcauuccaaacuuacugauaaagaaguaaguaagcacgucugucugucugucugucugucugucugucugucugcugucugucaccuaugcucguuccucgugcagugugugugugccggcaccgacggcucugcuuuucucuuucagaaaaccaauauuugcuacuugucuuuuccagacucaaauucagguaacuuuuuaucauaagauguuucucuugaaucuugugcauugaauaucauaugguuuguaguuuucguacaugacgaguagccagcacggcauguuaagauggcaugcucaguuuuagcucagcacuucauugauucugaguuuucuuaaugacgccuaguccuguccuuacugauuucacuuaaggucacuguuacagugugauaagguaaaauauaaaaaguacaauacauucuuuuuuuuuuccauuuuuuauuagguauuuagcucauuuacauuuccaaugcuauaccaaaagucccccauacccacccacccccacuccccuacccacccacucccccuauaaaaaguacaauacauucuuaaaauaaacaaaagauaguuuauuugguaacuuauaguguauaguuuauuuucaguucaaaacguaagaauuugccuggaacuguauguacaaaagcaguaaaaaaauuuuuuuuuuuacaugauguguguauaugaauguggguuugugcgcaugaguguagcacucucagaagccagaauaggucaucagaucccccuggaguugaaguuagaggcgguuaagagccacuaugggucgcuacacgcucuaaccacugagccaucucucuagcuccaacuuuucuaaaaacucauaaaccagcaagaauauaguggugaaagacuaccaucaguuauagaucccuguacucuuuuggcucuucuugagcuugcuuucucuaguucuaugagcugugcuuguguggucuuagcuguugauaccucucaggcuaccucuguauuuuacuuucaagacagcuuuauaaacuuacagugaccagaacacuuggcuucucaggccacacacaaacccuugaagcagaguuacuccaguuuucuuuccuuuucugcuuaucucuaguguccugacaauuuaugucaguuaaucugauuugagagauuugacagauuauuauuacuuuucuuuuuguauaaauacuugcaguuuuuuccccuuccuuuacauguguagcugagccuugguaaaagauaagggcccagcaugcuuccacugcaccacucugcuacuuuggugaaagauaugaaagaaaauuagauucuuacuaauuagagaucguucucagucaagcccagugggucuuuuguucugaucugaacugauuagaaccuuuaauuguuuggucuauagugauaacuggcugucauagaacccucccacccccaacccccaccguguguguguguguguguguguguguguguguguguaugugugugugugugauucuucuugccaugagaguggguuucacaggucaauuuccuggcuugugcaacaaaugccuugcuggcccaagauucuaaccucuggcuagauaaacaaacuuuuguaaauaacuacuauaguuuuccauauauguuuaccuucccacaguuuacuaagucuaaaaggcuaagcuuuuuaauguguuuggacguguuucugcaauuuaaccuuuuaaaauuguguacaaguucccagaucuagcucccuuuggguguuagcauuuuccguaaaauuuucagaaacagaaaauaaaauaaaauaaaauaaguuuuuuucuauugccccccuauccuccacucucgacaccagguuuuuuuuuuuguuuguuuguuuguuuuuuuguuuuuuuuguuuuuuuuuugagacagaguuucucuguaacuacugugacuguccucggauucacuuuguagacuaggcuggcuucaaacucaaaaauaaaaauccaucugccucugccuccaaagugcuaggauuaaaggugcaccaccaugccuggcuaaguguuuuuuauuuuaauauuuuauuguuauuguucaauuuaauacacagauccuagcuacugaaccccagagacuagaggaaaaacuucccuucuccuccaaacaagguuaaaaguuaauuucauguuauuuugacagccuuuaaaauuuuuaauuaauuaauuuauuuguaguacugggaacuaaaacuuugaccuuuagcacgccaggaaagaacucuuuaacacugaacuaccugagagccuuuuuguuuguuuguuuuguugguuugguuuggguuuggaggguuuuggguauuuguuuguuuauguagagauaggguuugaacuacauaucccuggcuaucuuggaacucacuauguagaccaggcuggccuugaacucccagagauccuuuugccucugccuccuaagugcuggaauuaaugaccuacaucuggcacuugauagccuuuuuaauaaauuauuuaauaguauuuguguaggucauuuuguuuuuauacauuuaaacucaaaaguaaaucuguaacagugaauuagugaaacugcuuuguaucuuggugggucacaagugcaggagaacccaagagcucucuggauaugugaaugaaagacacauacacaccagcuaauuuugauaugccuugacuagcucaaaggcugggccuuucuaauccucugcuguuagcauacauucucccuccaacuuuccugacucagcguuucaucucugcuaccccagacccaaucagggaaguggucacuaggccguuuucccaaauucuuuuuuuuuuuuuuuaaauauuuauuuauuuauuuauuuauuauauguaaguacacuguagcugucuucagacacuccagaagagggcaucagauuucguugugagccaccaugugguugcugggauuugaacucaagaccuuuggaagagcaguaggcgcucuuaaccgcugagucaucucaccagcccccauuuucccgaauucuuacuuggcugguugcuuucuuuccugcagcucugacaucggauccuucucccuccaaguccuggugguucucugucucucucucccagccccuugucuuacugcccagccauuggcuguauggcaguucuuuauuaucagccaaacccagcuuggggcagggacccucaggucuggacgugcagcuuuuugggagcugaaauaagacaaagcguuagaaccaauucccaacauaaaucuauagaaauaaaaauucuaauauuuuaggcauaugaaugaccuacagauuuuuuaaaaagugucuuuuuaauaaacugacuauaaaugaauuauaauucauuuuacccaaaaccugguugggacuaguaaaauugacaaaagaucuugaaaagcagaccuugauggucuagcagaugagcaugauuuggagagcauuucagagcucuggugcuauccaaaccacuguuuuuccucuuuauccuccaaauggaaguuauaauuacucugccaacuuugacuuaaaauuuccaaaauagcuuuuauugcugugaaaggaaaucguggcacagcagagcagacuuuaggaaagagucauaaauuagggcuuccuucccguguuacguuccccacccccacacacacauacaaaguagauaucauucuagacuguuugaaaacuaaacagaagaaaauguuuuuuacaauucacagugaaauaguuugccggucuacaauccucugcuuguacacacccuagaucuucaugaauuuagaagaaaacuugggcugguccuuguuucuguuucaugcauuuuuuuucugaauaugaauuuagaguguguucuuaucagccacacagccagacuuuucccucauuauuuaccguuaucaccaacugaauguagguguuccuucagccuaagcuauguuggguacugaaggacaauaaucuucuaucuuaaauaugucaagggagaagacacaggcucagugcagagaauuuuaaguagcaguaauucaaggaagaacaggccuuguggguagacuuggcuugcagacaauauuugugucaaacagcaaggacauuguaauauacuguauacuccuuaaauuaccugugcugaagcgcauguuuuuguuuuuuaacugucuguauggaccaauacuuuuguaaaauagaugcuaaagaaaauauuagaaaaaaaaugaaauuuaaaaaauauuaguaaaacaaaacuauaaauuuaugacacuaauaucagguugccagaaaagcuuuucagcguauucaacuuagauauuuauuuguucacacaccaguagccaguuuaugaacugguguuauugcagaagcuacaguaagacacguauacacugccuugccagugcuacauuucuauacucucccuugcacacuucuacacuuguacauuuccauauuucugaacuucugcacugugcacuuccuuacguuuguacuuguaugugucuguacuucugcaccuuagaagaucugaccuaaaguacucucucugagcaacuccaucuuagccacaguagucacagcaaggggggugagugcagagauuggaaggaugcagaguagagccuucaugcuuugcuuuuugguugcuguuguugugauggucaucagacucgcuuggagacuuggugauauucuuuccaucuuccuaguucugggguuacaagcauguaccaguaugcuuugcagagggcuagucuugaaguuuuaucauagucacauguauucugagccacaccauacccauguuugugauaauguagaaauagucuuuuguuguuguuucgagacagaguuuuuucuguacagccuuggcuguccuggaacucacucuguagaccagguuggccuugaacucagaaaucagccugccucugccucccaagugcugggauuaaaggugugcaccaccacugcccggcuagaaauagucuuuuacaguugucugugucaucaagaaaaauaaucuuuuuuucuuuacucuuugagugacuguuuugguauaagaagauucgcugaccauugcauacacuagcaagcguuugcugaaaggacccugauauagcuguuggugcacaugugccagugugcugccaugcauguguggaggccagaggacaagugucaggugucaguuuucuguuucaucuaccgguucugggaguugaacucaguucaucagauuugaguagagaacacuuuuacccggauuagcuguuuuaccagcuugcauguuuuaguaagcuaauuuuuagaguauuaauaguuuuuuaaaguaauuauugccugacaaauuuaauuaaaauuugcauuucaagagacuugcugaaaugauuaaaguugaaaauuaauuguuaauucagaugauuaagaugauaaguugauuauggacucuuacugaaucuuauaugguauguguuauuaaagggccuucucauugugaaaugaaaaauacacucaggaccaauuagcagaacauugcuagcaccuuaaagccccccucaagccucuuccccucccuccuccaaguguaaccacugauuguuaaaauaaggguuuuuauauuuuucauuauuuuuauuucuaaucacuaguccauguauccuaaaacauuacagccuugucuacuuuuaaaaguuuauacauuuggaaacugguguguaguucagugggguagugcuuaccuagcacacaggaauaacuaucuuuagugcucuucacuauguaacaugguggcaugacuaugaucucagcaccagggagggagggagggagagacaggagggucagaaguucaaggcuacuuagcaaguuugaggccagccagagcuacaugagauccuauguaaauguagcucuuauucucccaauguaaugguugucuggaggcuuacugccucagucugcuaaacuagaccuagucuuggaaguuucuagccucuguacaaucuuaucuagaccuagaacauuuucaggcucugagacuuacugcugaauaagcucacccuuucuugaacuuucugaacucuugcuggcuggucaacucagcuguucuggcucaaacuugucucccagcugacugauucaaucugacuucucucagccucugacugaauugcucugcuuggccucaugcuaacucuggcacucuguucuaaucuucuggcuccuucucgcucucuggcucauucuguccucaccugugucuagcuuguucuugcuucacacugucucuguacuacucuccugauaaagcugccuccucucuuuuugcacugccccucaaguagcuuuccucuccucucuucuaugagaauugaacauauccuauucugucaaaucuuucucugauucaucacuuugucugcuacuccauuaaacaucacuuucaaacauggaugcuuccuucuacaaacuaacuuuaccuucacugguugggauuaaagaugugugcuaaggcugagccaccacaacuagaaacagauuuuuccaguaaacagcagucucaagguucacaguguggucaaauacccugcaacaacucuauaucaaaaagauuuuaaaaaaauuuauauaguugaguaugguggcacaugccuuuaaucucagcacuugggaggcagaggcaaggggaaucacugaguucaaaacuagccuggucuauauagagaauucaggauauccagggccacauagugagacgcugucucaaaaacaaagcagagaaaguuuauaaagcuguagauugaaacaagaaguaguuguagaugugugugugugugugugugugugugugagagagagagagcgagagagagagagagagagagagaggagagaaagaccucauuuguuuauauauguaagacaacaucauaugcagacaaauuaaaagagaaaagaauggcauuggaaagagaaguaggaaacuaugaaaagacuugggaaucaagauggaguuuaccucuaacuagcaagguggccugcagcaaggccagaauuucucuauuuuauucuuuucaagacagggucucacucuguagcucuggcuauucuagaacucauuaugucgaccaggauggcuucagacuccagagaucuacuugccuuuaagcacugagauuaaagaugugcaccacuauguccuggaauuuuuaggcuuuuuuuuuccucuguaaaacaugaagaaauagguaaaaguuacaaggcuccuucgcugagcuauugaugaaacuggacaaacgucacgugaagccgcccugacuuccuuuucuuuguuuugcuagguugucuuggagauacccaguuuuguuuuagauuccgacagucuucugggagaagggugucacuacacugucuucuugaugaauuugacaaagauuuaccaguuuacuuaaaggugggaaagcauccaugugagaggaagcccuggcacuuguuccuuuagagccagcguacucagucaccuuugauaacuuuucaguguuguuugccuuugggguuacuuuaugaucuagcuguguuccuuaaguaagugaugaggauucaacauaugaguggaauugacucuaaaguuacuguucuggaaaugcugccauuauacauuguaaaaacugacuagcauggugaggugcuuugcuuggucaugaucuguugggaugggcagguggggaaccguuauauaauaaauaccaucguauuuaaguggucuccccugggccaguaccucagauuuuauuauaacuuagagcuauuuacugcaaauuuuaagaaaacgauguagcaucagagaaaauucugauuugaugguuuucugauuucaauuugcaagucuagaugugaauuaagaacauaagccgaugaguuccuaggggaaaaucccaccuuuaguucuuaggcuguaguuauaauuuccaggcacguugcagguuauuuuuucuucugguugcuguuuguugguaggaagguaucacuaacuuuuguauauugcuuacauauugacuuggguuauuaaagaagcccaguaaggauaucucuguauacauauguauacacacauacauauguacguacauacauacaaacacacauacuuuuuuugucuucuuucauagaaagauccugcauauuuuuauggauauguguauuuucgacaaguucgagauaaaacucuuaaaagaggcuacuuucaaaagguaauuuugaugugcaguauuaaaguguuuuauguuguuaugacuggagaaucgagagcuggacuuaaugguggcuaccuguaguuugaacauuucagagauggagauagaaaaaucuggaaguugaggccaaccuaggcuacauaggacccugucucaaugaaacuuaauuaugucugagauuuuauguuugccugagcuuuuuuauuauaggcauuugccccguuuuuauuauugauuuauuuauagacagagucugacuguguauguaauccugguuguucuggaacuugcuguucagaccuuacuggcuugugcucacagaaauccaccugccucugucuccugggugcugggauuaaagguguucuguaauuaaaguuuuuauuuauuuauuuauuuauuucauguaugaguguucugugugcauauauaucuguaggucaggagagggcaucagauuccauuacacaugguugugagccauaugugguuugcuggaaauugaacucaggaccucuggaagaggugcgcuuaacugcugagccaccuuuccagccaccauauuccauaaauuuuaauuauugagauguugcugucucuguacuuuuagaauaagggagaaaauaaacaaauuguaauauucuuauaaccauaaaaaccugcagguuuuuuuuuuuaaugagucaauaaguaaaauuuagcaacaucuuagaccuuacugcuucuaaccuaaauauaaucuguuuucauaaauuaaaugaaaaaaggaaaauuccuauucuaaugucagauaagguaaaaaguaguuuggaggauggagagauggcucaguaguuaagagcauuugcugcuguuacagaggacacaaguucaguucugagcacccauauugaccacuugcaagcaccuauaaccaaccccaggggaucugcagccuuuuucuggucucuguggacacccacacauauacacauaaauaaaaauaaaauuuuaauuaaaaagaacagcuuucaacaaaaaaaacccuacauuuaaaaauuaguguaguuugacucuaaagugaucauacugaaagucacaauuuuuaaguuuguagcuaggcuagaacagcuggacuguagaacauaauaggcauagggauuuggaccaagcaucacaguuuguuuuuccuuaguagaaagacuucauguggcgggacagugguggcgcacaccuuuaaucccagcacucaggaggcagaggcagguggauuucugauuuugaagccagccuagucuacagagcuaguuccaggagagucagggcuguacagagaagcccuguuucaaaaaaccaaaauaauaaugauaaugaugaugaugaaagacagacagacuuuauguggcuguauuuugauauauguuguauacaauagguagauaucuuugcuucuauugcugugauaaaauacacugacccaaacaaccuaggagagaauguagcuuauauuagcuguagucccagguuauaaguccaccguuguggaggggucacggugggaguagcaugaaacacuguggauacaagucauccacagcaugcucagccugcucuuccacucucagacaguucaggacccccugccuagggaaugguuucacccucagugggugggauuuccuacuucaauuaacauagucaagaaaaucucccacagacauaggccaaccuaguauagaggaucauucacugauacucuuuuccuaggugguuauagauugucucaaauugacaguuaaaacuaacaguuauacuuggccuuuagucuguuuugggggaaauuguuuuaccugaagagcaggaauaucucugaaugugccuuuaguucuuaaagcaguaguuuucaacauuccuaaugcucugacucuuuuauaguuccuugucuuauggugaccucaauauaaauuauuucuguugcuacucauaacuguuaauuugcuacuguuaugaaucauaauauaaauaucugauauacaggauauuuaacauacuacuccugugaagguugugacccacagguugagaaacacugccuuagauuuuaaugugauuaaaguuuuuaauuucucaguuaugacauuguauuuucuuuuaaacaucugcuguaaaaaaaacuuugucggggcuggugagauggcucaguggguaagagcacccgacugcucuucugaagguccgaaguucaaaucccagcaaccacaugguggcucacaaccauccguaaugagaucugacucccucuucuggagggucugaagacagcuacaguguacuuacauguaauaaauaaauaaauaaaccuuuaaaaaaaaaaaaaaaaaacuuugucaauuucaaaauccauacccuuguuuuugcugaauuuuagcucauuaauaauuguucaugaaaaauaaauggcaaaucuaaauuauaaucacuaggcauuaaaaaaaauuaccaaaccaaaaaaaccuuuguccccuuucuuucuuuccucagucauugguuuugaucagcaaacuaccuuauauucauuuuuuucacaccguacucaaacagauagcaccagaguauuuugaaaaaaaugaaccuuacuuggaagcagguaaguuaaauauuauauaaguuauguacucuguguguguguguguguguguguguguguaucuguccaugcauguucacauguuuucagagugcucaugcagauuugugugcgagccagaggugacucuuuggugguguuccucaggagccagucaccuugauuuuuggaguagggucucuuacuaagaccggaggcauuuuaauuagguuagacugacuugccagugggccccaguaaaccuccugucuuuuccccagugcuugaauuagaaccaugcauuguuaucaugucugacauuuuuuuuuuugaguucuggggaucaaacucaguucuucaugcuuguuuaguaagcacuuuacugauucuccuuaguccaaggaauguucucuuuuauauuuacuuuucguuuucacugauguauuuauuugcuuguuuaguguucgugugugcaugagugcaugcaugcaugucuacgugugagugaagugucagauccuccuuggagcuggaguuccaaauugcugugagcugccuggcauggguucuggggaccaaacuuugaucuuuugauagagcuauuaccacuuuuaacauuugaguccuaucuucuccaccaguaacacagguuacauacucuuaaagaaaagauuuuuaauaaagcuaaggugauacucuaaaaaaaaaaucagaagauuuaagacuuaaauccuaaaugauuugagacagcuacagaacaucuagugugguaucuuuaccuauaaauaccaaagugcuaucugguccuuucaaauguaauaauauaaauggugucuguuagaguuaguaauaagauuuuguacugauaguuccuggaguaccauugaacagaaauccaaaaacagaaacaguaguuaaaaaauaaauaggaagucugcccuugaagcuacuugucauucaacagguuuucuucuuaauuaaaaacguuuuuauuagcugggcgugguggcacacacuuuuaguccccgcacuugggaggcagaggcaggaggaucucugaguuugaggccagccuggucuacagagugaguuccaggacagccagggcuacacagaaaaacccugucucgaaaaaaaaaaaaaaacccaaaagcaaacaaacaaacaaacaaaaaaccaaaccaaacaaacaaaaaaaccaaaacauuuuuauugguggugugugugccacacacgugugagugccugaguggaggccugagagggcaucagauucuuggagcuggaguuguaggugauugugagcuuccugucaugagugaugagccaucucucuaccucucauucaacaguuaaccaauauauauccuagaacauaauacuucugaaaaaauuuuaaauuaaauauuucaucaaauuuacuuuuaucugcuguuauuauuaacauauuucucccauguuacaaaaagagcucuaacuagcaguguccauuuuaaauauuuuaucuuuucacuuacauuaguauuuuguuucauuuucagcuuguaaugauguugaccgauggccugccccagugccagggaaaacgcugcaccugccuaucaugggacuaguaaugaagguaacaacugacuagagucucaucugucugcucugaagaacucuacagaaagcucgcucacacauaggguuuguuuuaaacaaccugaugacauuuagugauguuaaugccuucacuguugucauugcugggagaccuuacagauacaccacaguugaucccgccucgaagaguccuucauacaucuccaggccccuccagccaggcagugcaccuaaaggauuagugcagcaaugguauuucucccuguggacuaugcacagauaaaagugcuucccucuaaaauccuacaauaugggugguaagaaggggaagaacacucguagucuugggugugaauugcuggaaauuaagauuaaacuagaaaagucauuguuuuuuggguuuguuuuuuuuuuuuuuuuuccagcucuaaauggucuuuuaacauuuagugucagaccaagcauguuuuuucuuggaauauuuuuguuauggugaggauuuuuuuauuuuuccuuucauugcuuuuuuguguauuggagauugaacccagggccuccuaagggcuaggcaagugcuucaccucugaguuauaguccucccauugcuuuguuuugaaggaauuugaauuuuacuggcagauuuugucugagugcacgcaaguucuuugcuauucaugcucuugugaccuuggacuuauccuuaacugcguuccuuccuuagaguuucgugauuuguaaguguauuugccccgaccccuucagcaaacauaacaauucugaaagcuugggguugaggguucccauuguuuccugugggguuuauucagaaguuuggcaggcuugagaggguguguuuggguguguguauuugugaagcagagacuggaaaagugagcaggaagccaugugauagacugcuguccugacuguuuccagcacauuugcuucuguguuuagugaucuccauuuguagacaugggaacuuugguuucccugcuccugcuguaacuaagaaugaacacccuuaguucuaaaaccccgcagaaacacuugcucuuuagagcacuuucaaagugcugagugugcuagguagagcacuugccauacagauaaauaauagcuccucucugucuuuaagguucggauucccacgugucaugacaagccugggaccacgcagauggugcaguuaacucagcagguagcaugaugcuaaagugaccguggcgcagccuggucacugaaacacccguuacuuuuaaauaguuggugauaaauuuucuaacauuucuuguuagaaauguuguuacuaccucaguagguccuggagaaccccacguucauguuguaauugugaggacuaaaugacaguaaacacuuuaaagaagguuuaacucuggcaaaagguguucucuuacaagaauaggcaacugaauucuaauuuuagaccguuaagucagaaggauccuggagcuuuucuuuuucugaaagcaguuucuguuccugcggguuugaaucuuucauuugaaauacuugagcugcuuuguuaccauccccacugugcuucaaguaaggcuacaggacagcaggagaccugagugcugguuacacauccccuaguguugauguacagcugggacccaggcucacaucuggccuugggcugauuccuacccacagaguuugugcuuuucucugcuguauuguuggagacuuguaagauccauucucucuggcugcuccuggaagagcaacuugucagaauggacugagugauagggcucauugguugugagauaguuguguugucauuuucauuuauuuacuauguguuuugagacagggucucacuguguagcccugucuguccaggaacuugcuagugaggcugagcuugaacucacaucaauucuccugccucugcuuuugagugcugguuuacagucuagucauguaccaucauuuugcuuacuauagccagauguggugguacacaccuuuaguuccaacaguaaucucucgugaguccauuauccuggacucuguggugauuucaggacagccaaggcuauacuguuagauccuguuuuaaacaaaaacaaaaaugaauuucuaucaauuuucguaacaucucccguacuuuuuccuuccuuuucuaacccuuuaggcagauacacacacaucuauuauuuugccuacuguucacgagguggaucuuuucagguaaagaauaaaaaagaugugaaauacuuugucuuuauaauuugugauaauuguuauuaacuuauggaaagugugaauuaagcuggaaggaaauacucauuaugggccccaaagauucuugaaaaguuaaaaaccaaauauucauuggguuuuaaugguaaaguccagugguucauccguccggcugcaagaaagcugaggugcgcuuuaggugcuacguggucaaauagacggguuuguuucauuugcucugagaauuguauuguggugaagcuagaaaaaguaguuaaauuuggggugaaauaucaugagauuuauuccuuuuguuaaaaaaaaaaaaacuucaguaaggaaaaaaaaagaaaccgcaaguacuauuauguuuuaaaauuuuuaaauaaaacaauauacucuaggauuugacaaaagaggaagaugccaagggagaagcuagcacugcucaugcauuuugcagagcaccugaucacggucugaaagugucgaguguagcccagcucaaacacgcacuguuugcagcuagccgugcaguccaugcgugguuucucugcagcccuggcuggccuaggacucagaggcccugccucacagugcugggauccaaggcugugccaccgcugcuuaggguuuugguuugguuuugguuugguuuuuugucuuuuugguuuuauuaauuaaaauuaacuagcuuauuuuuuuaucucauaaauuugcuuuauguuuuugcacuuacauauguuuugguuugggggaguguuuuugucuuuuuaacuagugagguuuguuuuguucuucagaaauacuuuuuuucucuaauccgcuagggaaaauugcuaccaaauaaggaagaaaaguaaauaaauaaagguuccucaguguucagacuuaaacacacuaauggaauuguguccucagagccucacgccuggcuuugacugugugcgugccugcugccugcauugccacguucucaguucauuuuucagaucaagcugucaggagcaggaagaauuuguaucaaugugaaguucuuggaaugauuauuuaggaauuugaaaggcaaaauuggauaaauaaauaauaaagucuuucuacuguguaaauuuuccagguguuucugcccaguuuuucuucacagucagaugcucugggaguuggugcucuugggagagccccugguggucauggcgccaucgccgucagaaucuucagaaacuguacuggcucuuguuaagugagugcauuugccucuugauucugauucuuucaguauguccaaccugcgauguucccccacucacagcaucaguccaugcaacagcuuucucagaauaugugagaagauugagucagguucaguuagagcugaaaccagguuuuuggugcuuugaauaacacacacacacucagugauauggaguuacaccucgauaaauuucaguuaauauuagagaccagugcuuacauaauacugaaagaauuugucuuuccgguguauaucuggaugucucauaguuguggaguggagccuuaauuucuguuccuucuguuccacagcuguaucucuccauuaaaguacuuuagugauuuucggccuuacuucacgauucaugauagugaauucaaagaauauacuacccguacucaagcuccgugaguaaacacaguuacuuuuguugacuaaguauuauuuuuauuaccaagauuuuguagaacuguguaauacguuuuauuguguaauacaauuuuaauuuaaaacuuugacuuacugagguuuggggagcuguuggaaauaauugaagauuugaagaaaauaaucauauucuuuccauuuuaguuccuguuuuacaauuguuuaccuucuuucuuagcucaaguuuuagaagaacauacaugauuuccauuuauuuucucuauuuuuugauuuccugcuaauauaguaucugcugcaggcuaacuuugucuauuuuuuuaaauagaacuucucuuuuuaaaauuuacuuuguuuuauguguaagcguguuuuguuuguauguaugucuaugcaccacaugcaugcaugugcacauggaagccagagggugucagacccccuggaacuggaguuacaaguagcugaggugccuuuuguguacuaggaagugaaccugaaugcucuggaagagcagccccugcucuuaacugcuaagcaucucuucagcuccccaggcuaacgucucaguaucuaucaacauuuucuuauuuucauugguugcgugagcacucuguugcccuauuugugugugugugugggggggggggcaugcggagaacacacacacguaugcacucuuuuuguuuuguuucuuuugagacagggucuuacguacugcacgcugaccuugaacucuguguagcuaaggcuggcuuugaguuucugagccuccugaugcuaccuuccagcuaugaggauggcagaugugcuguuuguaagauagaaguuccauucacagcucagacuggccuugaacuuuugauccuucugcuucagccuccucuuuaaauuaucuucuuuguuguuacuugguugguagguugguugguugguugguugguugguuuuguuuaacagaguuuuuucuguggcccuggcuguccuggaacucauucuguauacuaggauggucucauaacucaagcaauccaaaguuguugucucugccuccgaaguucuaggauuuaagaugugugucaccacugccuagcuccuuuaaaauaccuuaaucaugauccuccugucaccuagcugugugguguuguauuuuagucuucuguguagacuucuuccucugguguucccuuaaauguugauauuaucaaagacugugcucuguguuccucuuucagacagaucauuuuuuucuaaauagccuuaacaguauccauggucucuguuaagacccuauacuaaaacaaggagguagcuaagcagguaaaagcacuugccauacaagcugucaagugugaguugaagccccaaacacauguacagagcuggauguaguggcauacaucuguggucuaagcagccccacauuagaugguuggcagagacaggagaaaccccugggagcucugggccuguaauaugcauugugucaacagacggugaaauacucagcuacaggaaggugaaaggagugaaucaacuccugaaaacucuucagauaccauccccagcaugccaugguacaggagaaaguuuguuucuccccucccccucuccccucccccucuccccucccccuccuucuuccccucuccuucucccucccucucugucucugucucucucucucucuccuuccuucccuccuucccucucuuucucucuugcuuuuaugcaaacugcucuuucagacucuuucacucucucacacauucaauuaacauuuaauuaauuguaaugaauuuuaaagauccuauauuaacuuggcaugguaauucacucauguaaucuaaucuuagugcuugagaggcugcacaggaagacuguggaagaguucagaguuacccuggacuaacuacagaaucaaaacuuaaaagcuccuauaguaaugacuggaauauaucuuuguaccuuagaucuuuucagcacccagaucucuaugcagugcuguuguugguguucgugcaggaugugacuuacucccguaaguccauucuucuuuuugagauggaugucaaucccuagcacuguuggccuagaacucaccuuacagaucagguuguucuugaacuugauaguguaguucaggauguucuugaacuacugauccuccugccuuugcugcccaaaggauuauaccaugugccaccaugccccguucacagcugugcuucuaaugcauccgaaacuaagccuguccugacugguuucuuuuuacuucccucuuuuuuguucuaaccgccugucuguugauuucuugauaaaugguauuaguuuugacuuacguuaucaaaaacauaguauuaugucuucuuaccaugaccugcaacaaaucuuaacuaaagucugucaguucaucaacugaaaauaucuuuuagccuguuuauuauguucuuuccauaauuccuucuucagacucuaguuuuucuuugucugcaguugcuuucccuccauacagggcauucucuaauuuuccuuacauugaucuguagcauuuauguggcauaccuccacuugauucucuguaacuucucuuggcuuccaagauaacauauuaauuucuaaguguacacacuuggugcucuucucuuucuccuuccauucugcucaggaaugcugaagugccuguaauugucugugugguuuuagguagagacugauccgaccucacuguuugaaaugaauauucagcauugcccuuaccuucuuuggaaaacuacucaucuuucaaugucuguucucuaucuuugauaacucugucuuuuaaacccuggcagagcauaucuucuucuugggauugcugagcauuuuauuucccuuucagugucuucuaauuguugccaucaugacggaguuuguaugccuugauaccuuuaugcuguuuaagaaucaugucuuugggggacuggagaaaugacucaacaguuaaaaaagcacugcugcucuuccagaggacccaagucugauucccagcacccacaugauguucacaacuauccuuaacuccaguuccaggggaucuaaugcucucuucugaucuucuggaguaccaagcacacacaugauguacagacauauauacaggcaaaguacacauacaauaaaaugaauaaaucuaauaaaaagucauauguuuuuuaucuucaugugucuaguacugaauauguugccugucauuuaugaaauaauucaaguaaagggagcaauacucauuaucuuguucacucagaaacugucacuuauucugugauuuaauauuuauugucucauuuuuauacaggcccucagucaucuuaggaguaaccaaccccuuuuuugcuaaaacacuacagcacuggccacacauuauucgaauaggagaucuuaaaccugcagguaaugugucuccuugguguucagagugugugacaggacugggcaacucuccuuguguuugucucuugugguugacauuguugguaacauucuuggagacagccuggauaagggccuuuggaaaagaguauagcuucucacuaaaaugggccuauguccuaccccaaaagaaagcccaagaaagcugggcgugguggcgcaugccuuuaaucccagcacuugagaagcagaggcagacggaucucugaguucaaggccagcuuggucuacagagugaguuccaggacagccagggcuacacagagaaacccugucugaaaaacaaaacaaaacaaaaacuaacaacaacaacaauaacaaaaaagcccaagaaaacugagcuuuuuuauuuuauaaacuauaugaaauuggggauucuaguuuugcuugugaaaaaaaucuuauagaaaacugaaaugauagucagaugucauagugcccauguauaauccuagcacucaaaaggcuaaggcaggaggacugugaguucaaggccagccugccgccugcacuauauaguuccaggccagcaugaacuucauacuaaagacuguaccucaaaauaaggaaggaaaaaaaagcuagaauuauuccagauuuggcaugacauucucaggucuuaagacaaauguuguguaaccuugugcuguuguauugauugaggaaguccucauagauugaacuuuuagaaaaagacauacaguguuuggcuucuuguaggaauuuaacagguguuuauuacacgaauaaaugaauucugagauuggauguuuacuuuagacgucaauuuaaugauuccccuaacauuuaucauuaguuuucugagagauucuaaugauaauucagggaacagcuuacucuacucacaaaagagaugggagguuuuguagcuuaguguuuggggguuuuugugguuuuuacuuaucuagacuagugcgauuuacuguaauacaauauacugcuauuuacuuuucuuuccuaugaaaaagguucccuuagggauauagguagaaaucauugaugccauaguaugaucaaaaaaagggagcugggcaugguggcacauguuuuuaaucccaggaucccagcacuuuugaggcagagacaagcagaucucuaugaauucgaagcucaccuugauauucuuagcaaguuugagaccuugucucuaaauaaauaaauaaacaagaaagaaacaaacaaaugaaagaaggaagaaaggaaggagagaagagaaauccucaaaggcgcuggaaagauggaucagcacuuaaagucacuugcugcucuugcauaggaacuggguuugcuagucagcacucacugagugacucacagccaucuagaacuucaguuccaggggaugggaugccuucuucugauaccuauggacaccaggcauacaugcaagccaaacacuuauacauguaaauagaaauaaaucaguugauuaaaaaggaagaacucaccauauuguuuuccagaguugugcaguaaugaaccuucuuacugauaguauaugaagauuccccauuuuuauaccuauuguuuucauuauagccauuuuuuguuuguuuuuguuuuuugagacaaggucuuuauguagcccuggauguccuggaacucacuauguaaaccagggucaguuucucugcuagcucauuuaacuuacacugacuucccucuagcccccuccacauggcuggcacuuuacccuucuccacucagguuaccauuccaugcccucuuugauccucuugccucugcuugucucucugguugcccaaaguuccaccacguuugccccagcacuuggcugccagcucuuuauuauuaccaaucagcaguaagacaauggcaaaacaucucuuuggcuacuuuagucagugaagguugccccaccugcauguguuuugggcagguguggaaggaaaaacauuuauaaaagaaaaccuggugauggucauggagaugucgacaccagauccugccagcacuucucucucugcugguacagaauuaacaauuaaaaaugcagcauaaucaauacacuguaaggaaggucaccccaauagguuuacauuuucuuuucccuagugauuaauaaugucgagugucuuuacaugagucuuuuauaugccuucuuuggaaauguuuaagacuucucaucauugguugucucaguucuuuauaugucugggugcuggucucuuaucagacaugcuuuguaaauuuuuuauuguuuuacucucugagucccuguaaugacaauuuuggauuuugguuucuuuaaaacacacagaaauauaagaaugugugcucuuguuuuaaucccagauauggagauguggggaugcuuugaaugaccacagcaccugacuuugacuuaccucaugcucuagcaguggcaugguuuugcuagcuacagauaguuucugcaguugugugacauuuggaauucugggaacuuucucagaggguguaugagugguagggacugagaagaggggugaugguuguuggucguuuagagagguugguugugguuuguuaguagaagaaacacaaggaaagaaacuagagucaggacuauuucuaauaacuuucuccccucuaucuuuguuucucuccuaucuagugguugugggcuaaaggggguggggaagagugggaaaaagaaacacccagaaaguagcaaagaccagcuacagagccccuuuaggcaccgguuuucaguuuugaugaaguucauuguaucuaacuuuuccuuuacuuuuuuuguggauugagagucacuuucacaaaaucagauuuaauuuuacaaccaugaaugucuggaaugugucuuauggcacuguuugguuucuugaacucaagaagccagugcauauguuacacagguuguacagcauaaaauuauauuggggauucuggcuuugaaaacuuaaaacagaguuuauagaccuacaaaagagcauacccugugggccccagagggaaggcauggcagaacagagucugucuuuugggcucaggaguuuauaauuauccuauuauuguuguugaguuuuaacacuggcagguaguuaguccugaugcauagaaguuucuuuuucuguuuguaucuaccugguccauccacuuuauacgcaauggagaaauaaagccgaaggauaauguccucugaggaaaacacaguugugcugguuucucuuggcucuaauuguagacuguucauuucuaaucagaaaguggauugguuuacaacaagaaagauaaaauauuuggccuaaguuaagauguauguacagauauucaaaggugcauuaagaugauuguacuaaugugaaggcccucuuuuuugucuguuagcauugggcccugaauaacuuuguaaauuaaauauaaucacagaccuggauuguuuccuugcauuggugcccuuucccagaguugucuggcauccauuuuauguuuuuaaaacaguugaaacuucugugcaugcgagaagugagugagcucagguccaccugccacuccuuccauggauggcuagcacuggagccccgagucugucauacaccugaugacgucucugagucagagugaagccugcugcacugcugggcucuugucauuucucauuucaaaaagaaaaggcaguauuuucauuauuaccaagaacuuagugacaauaagaaauaggaaacuugggcuggagagaugggucagcugguaagagcacuggcugcucuuccgaagguucugaguucaauucccaacaaccacacgguggcucacaaccaucuguaaugagaucugauggaugcgcucucuggugugucugaagacagcuacaguguacuuaauaguaguaucuauaauauaaaucuuugggggcuggugagauggcucaguggguaagagcacccgacugcucuuccgaaggucuggaguucaaaucccagcaaccacaugguggcucacaaccauccuuaacgagaucugacucccucuucuggagugucugaagacagcuacaguguacuuacauauaauaaauaaauaaaucuaaaaaaauuaaaaaaaaaauaaaucuuugggcuggagcaagcagggacugagugagcggaguugacgggagcgagcagagguccuaaaauucaguucccaacaaccacaugaaggcucacucacaaccaucugcacagcuacagugcacucacauucauaaaauaaauaaauaaauaaguaaaucuuaaaaaaaaagaaagaaaaaacagaaaagaauaggaaacauucugcuaaauuauuucuuucccuggcauuuaguucuuguugcacauuauguuuuagccauaauauauagagcauguaugauuguaacuaaaaguauuaugauguugaugauggaauuuugugcaugguaggcaaacauucuaucacuaaauuacagcccaguuuacaagaauuuuuguuuuuucuuucaggugaaauuccuaagcaaguuaaagugaaaaagcugaagaaccuaaaaacucuggauucuaaaccugguauugacuucucuuauuuguaucuacuugugcgacagugcauguguggaggucagaggguggucugggagagguauuucucucucucuaccguggauuuuagagaugggagucauggaguguggcuugcacaaucaccuuucccugcugagucaguuuguuggcccguacuuuuauuaauuuuaaguauauacucaccuagguuguuggcuuuuucuguuuaucuucuuuucuuaggaguuuauacuucuuacaagccauaucuaaacagagaugaggagaucauaaaacaacuucagaagguaaauagcugcucauauuauuaauuaucuuuuaaaagauuuauuuauuauauguaaguacacuguagcugucuucagacaccccagaagagggcaucagaucucauuacgaaugguugugagccaccaugugguugcugggauuugaacucaggaccuuuggaagagcaguuacugcucuuaacugcugagccaucucaccagccccccauauuauuaauuuaaaucuccuccuugagguauguaagauuuagucaggcagugugcgguucuuguuuuguuauuguuguuuguuuuuauauaauaaugugaaguugaacuucacuuuuuaaacccucugcugcugauugagccucaugcaugcuagguaaaggcuuuaccuuuaacacauaucccuaacuuagaaucuuaguuuuucuucuuuuagcccuggcuggcuuagagcuuacuaugcagaccaggcuggccuugaacuuguaaucguccugcuucugccuccuaagugcuguauuacaggcaugugccaucuugcuuugacuugcauuaucuuugaaaaauuaaaaaaaucuguguguuugugugugugugcguaugaaauucucucuuuccacguuuuauuuggguuccaggggaaaauaccuuuacucacugcugcaucuugcuagcucugaugcacacuucccccccccccccgcccgcccccgcccugaaucacuuaaauccaaccuuagguuuguauguuguugcucaaccuuguaguaucagcacuaggaaacuugagacggaaggaucuaaguucuagaccuaucaggcccuugucucaaaaguagacacauagguauggugagaugacucaccaggggauggcguuggcugccaagcugacaaccugauucagucucugggaaggacccacaugcugcaagagagaggagaaaacuaacucccacaaauugcccuccacauauuuugcagugguauguaugugcuucuucccgcauccccagucauacacacacacugcuacauacaaaauaaaugcauaaaccugaguugucucaggauguccauaauaaagacagaacugaccccugcauguuguccucugaucuacacaaccgcuccuuggcacacaugcacacgcacacauacaaacuaauguauugaccaagccagcucagucaacaggaucucaagggagggagugaagguugaaaacgaagaaaaacagacaaaaugaucccagacuccagccagcgcugaggcugaggcugcuuucugucucugcagccugcucuguaacauucuagguacauccaaaacacacggucaguucuuagagcaaagacuacaaaagucaucaaggcggucacacagacaguacguaaguaaagcgcaagcaaagggucacacaggcagugauguaggaaagcagcacacaaagccccggggucacugggucucacaucccgaucugagcccagugacagaugccaaaguucuacaaguggcaccaaaagcucucaacaauguaaauaauuuuuuuuaauuuaaaaauaaucaaaaggcaaggggcugcaaaggugguucaguugguaaggugcacacacacauaaucaacaugccagcgcacagacuugaguguuggcucuguagauauggggaaaugccagucauucuggaaaccuagacauugugaaaauaucacuaacaguaagagaaaaauuggggggcuuuuuguuuuaagaaauguuaguaguauuaauauaauguauguaaaauaaagauuauuuucauugugaagugaugcucuuaaguaugugauaaaugauauuaauacauauauguucuuggguuuuacucugaggauuuuuaaauuaaauuuauauuugaaugauaaaugcaaauuauuuguauuaauauaauacugugguauuuugauacauguauauauuguaucaucuuucgucagguuaaacaaucccauuucuucaaacauuuaucauuucuuuguagugaaaacauuuaaaauccuuucuuguuuuuuuuuuuuuagauauuuaguacauaauuauucuaugauuacccugcuguacaauaagguauagcuugcucugucaagcuguaacuuaguacaguuacaguuaagcuuucucuccccagccuucagcuaaagcuuccuuuuacaaaauuuacaaaaugaacuuaaaauuaaauuauuucaguauaacauucuaaguauuuugguugguugguugguacuaaauuuaaaugucuaguuacaaaguaguuggaguugguuguuaucuuacauuuccugacacuaaaauauggauuuccauuuucuucuugcaaggguauacagcagaagcguccuucugaggcccaaaguguuauucuccggcgcuauuuuuuggaacuaacacaaaguuucaucauuccauuaguaaguuauuaaucuuaaugauuuacugaguguguauaaaugugauucccaucuuucaaaucuuaaguuauaugcuuugccaauuaauggguuuagugauuuacaauccagccacuuaggagagguguggaucccuggcuccaguucacuugguaaguaaguaguucacuaaggaaguagguaagucaucuggcuucagucugcuuguccuugagaugugccuaauucuauggucccugaauaacuuugaaguucauuaaugcauuuuuugaagcaggguuggaguuuauuaagagauggacaguguacauuacaagcacuagguuuaagagaaagaagaacaaucagaaagaucccugagaacauggucauaggcuucuugaaggguagucacacauuauaagucuuuauugagauacuaauacaauuuuuauucuuuuuuuauucaccauucuuuugaaauagacacagaauuauuugcauugcuuuuuuauuucugugauaagagacuauggucaaggcaguguauacaacaaaaguuuauuugagcuuauaguugcagaggauuagagucugugaccaucauggugggggcauggcaguaugcaugacgucacaguguuggagcaauagcuaagagccuaagucuugauucacagucuugaggcagagaaagcuaacugggaauggccugagcuuucaaagcucaagcuaacccucagugauacacuucuuccaacaaggccauaccuccuaauacuucccaaauguuuccaccugugggaguaaguauuuaaauauaugauccuauucucauucaaaccuccaccauccagaaugcauagaguuaaacugauuggcgucgggugguaaugaagggagggugguguaaggaucuugcacuugcaaagcaaauacucugccauugagcuacaucccuacacuacacuucugauauuaagagcaugggauguugagcucaaaacaauaaaauucaauccauaauuccaggugauaaacauuccaagauaccagcuagcuaccuuugauauaaaacuugacgauccauggugauuaccuaacaaucccagcacuuacaagacaggaacagcaggauuguugaaaaucagaggccagucaagggcccagagugcauuccugccucaaaaccaacaacaacaaaaaaccaaaaccaaaaaccaccacuaccaccaacaaaaagcccuucaacaacacugaaaaggccuuguauugcaaaggcaagagcagguuuguuuaugaacuuuacaguggugcagguggcuauaucuucauucguauuuguuacguaagaaccaguagucaaguauagucuccccugucugucucugucucucucccucucucucccuucugucgguccuuucuucccucccuuuugucuguccuuucuuuccuccuuauccuuggcuggcauggaacccacuaugcagaucagccuggcuccaaauuugggacaaucuuuuugugugucugccuugugaaugcugguauuaugugugccaccacaccuugcuaaauguagguuuuuuuaggugccccaaagcccauuaaagacuauuaaaguuguaucaccauaaagccacaauuuauuauuuaaguacuuugucacugugacaaauucucaguucaaacggaggauuuaguuuugcucauaauuucagagacuugagugaaaggucagccuguccacuguuuuaggcuugaagcaagguagucugucacagcagugugaaccuguagcagaggcugcauacuuugugagaaagggacaagguuucccauccaggguuguccugucugugaccucuuguaagguccuaccucuuccuagcucauuccauacaaguuuagcaguggauuaacccauugaugacuuuaguguuucuaccauucacucaccucucaguuguaucccagcuagggaaccaagcuuuaacauaugagucuuuugguaggaugcuuuauauccaaucacagaaacccuuacaguagugaguuuaauaccaguguuucauuuuuagaaaucgaaggguuuccacugaaucaguuuguuucguuuuucaagauaugauuucucuguguaguccuggcuauccucaaacucauaacucuguaaaccacagagaucucccugccuuugcuccccaagugcuaggauuaaagcuuuuagugggauuuuaacuuugggauuaaagaccacccaccuaacugaacuaauuuuuaaauuccuaugaacgucuugacuugugugucaagguuguuuuuacuagaugcuuaugucacuuauccaaagacaguuuacuaccaaauugcugcauuagaugucagucagucagcaugcagaccaguuuacccuaaagguauaauagacacuuuuggugauuguucuuuuuuguuugguugauuuuugaggcagugucucucuguguagaccugacuguccugaacucacagagauucuccugucucugccuccuaaaugcugggaauaaaggcaugcacuuuggugauuguucuauggauuuaugguacagcauccauagaacagaucauuacaaguggugcagauacccaaggaucaggucagguuuguguuagcuguuacagguucugauauaaauccccacaauaugugcaaagcuggguccaguucuucaucagaaauuacuggugggggaugucagaugcagcaaagagaaaguaacauucagaaaugcuccuacaaaugccccuuugaucauggugcuguugucucuuacugagaagagcugugcacacucuucaggaggaagcucuugaguaggugggugggagguguuuucugcaugauucagccaaucccauucuuuccuucuccuaaacaccaucuucuucagacuaggagcuguuguuucccaaaaugugaggaucuacuucagaagauuucucuuugucugguaccugggagugaggaggcugcucuagugagagcgguggcuccuuucuaucagauuuauccuagguucccucaaguauuugucuacaucacccuuauagauagaaaccaaggcuggaacuuuguuccugucucccuuauugcugagguauaccagcagcccugcagguugcucucuuaaagcacuaccugcucugugacagggacccagagggcagcagugucucucuggucagggucagugaagcggaauuggacucaaguggcuugcccugauguugcuuguauccuaaugcuacuauugguuccucaaggucuuguugccccagagauaagagaguccucauauagacccaagugacgcuaugugaccuugccccaaguuauuucugauuguugacuaaagaugccaacagccaauagccaagagacauaggcagguuuaggguuucugggccuguggggugagagcagaaccacaaaggagagaaagguagaggagaaagaaguccauggguuaggaguugugaaaacauggccccaaagucuggccauauagaguuaagagcagcccagaugaaacauaguaaguaauaacucaggguaaucuauuaaaaacuagauucuaguagcauagaggguagauaucugcccagcucuugugcuguuuaagguuuauuaugaguaauaaaaguuauguauguuuuuuaucuguaaaauaaaugaucaaagguggaguaacaccccucucccccgccccaggauuggaauuaaaaaugauuacaacagugcacugucuuggcccaagugggucaaagcagggagauccugugucuugguacauacauuuuucugaacuagccuguggugagauuuuauaucaugccugaguuuuguaccuuaagaggucgcccuagaguuucugucucuacuguuuguuuguuuuuguuuuguuugagacagaaucucacuauguaguccuggcugaccugaaaaucauauguagauuaggauagcuuccaacucaacagcgaauauacuugcuucugccucucaaguccugggauuaaagacaugugcuaccauaccuggcugauacuggguuuuggguuuuuguguguguguguguguguguguguguguguuuaaauauguugauaccauauccaggaagcuauauaacucugagaaggaaccuuagcacauccucauucugauguaggguagccuuuaacuauuuauugaauaaauaacuagauaauacagccauucuaagaaacuuagcggagugagauauaaauaucagcaguaugacagacagugucuuggucuggaaauugcaucauuaccuuuauguagcugcuauagaaucuacaaauguuacaugaaagcaaccugaagaucuuugauguucauuuuuagaaagaaaguauucuuucuugguuuggggauagaauuuugauccauuuaaaccuguguuaugcugaagcuauaauucagugguacaauaagcauuagugagaccuuggauuugaggccuagaaucaaacuacauuuuuuuugguacuuagcauagcuaaggugggccuugcgauucacuucuguauucuuagcacucaggaggcugaagcaggauugucacaaguugaaaguuagccaaggcugauggugucucacaaacaaaaaacaaacaacucgcacaacaaaccaaucaaaaugcagagcuguggagcccaaauccacaacacaguuccuuguguaagagggaguagaaaaaguauaagauccagagaaacaggaaguuugcugugagauuucaucucuuagaaacaucagaggcuaccuacacccaugaaaucucaccuguguggcugccuaaaugugacgggaacagugacagugacagcacuaguaggcaugcucacguggaagagaagacaaaacuguaggcgacuaaggaaugaugagcgugggagacauggucuucccuagggaagggcacaccagcugguuauccaguaccagguagucagucagaccugagacuuacagacaaguacuaguauacaggcacaacaggcacacgcacgcacacacacacacacccaaagcuaaagaggccauggauuugaaaagacacagggugagcugguaguuauauauagaagguuugggaggacgaaagagaaauggggaaaugauguaauuauaaucucaauuuaaauaaauagcaacaauugaauucaaguucaaauagagucuggcuagguugcuuuuugaagcuucaguuucccagcaguuucauuagcacaacauguuucaaggauuauaagagaugaagcaucuacaguguuacauauauuuucugacauagcaugcuuaauaauugucauuaaaacuauauguggcuggaaagauggcuaugcaguuagaagcacuuguugcucuugcuaaggaccagaguucugucccagcacccauuuuuagagguucaaaacugccuguuguucuaacuuuagggcauucagcacccucuuccgguaucuaugagcguucucucucucucuccuuccauuccucccucccucccuccuucuccucucucucucucucucucucucucucucucucucucucucucucacacacacacacacacacacacacacacaaauaagaauuuuaaaaauuaaucuuuaaaauauauaugagcgggaggcagagguagacagaucucugaauuagaggccagccugguuuacagggcaagugccaggacagccagggcuacacagcgaagauggauggauggauggaugaauuuagagccagauagaguagcauaguccuauaauuacaauuggugguaggaggaucaugaguucaaggauagcuaggaguauauagcaagaccccaucucaacaaaacaaacaaggguuguugagagggcuuggaaguaaaggcaguugcugcauaagccuggcaacucguucaaucccugaggcccggaugaagauggaaggagagaaccagcuccagaguuguccucugacuuccacgugugugcuggcacuuagacccauaugucauacacucacacacagauuauuaucaacagacaaaguuaugaacugggcacagugccauguaccggcuacuugggaacccaugaguucaagaucagcuuuggcaauacaacaagccacccaucucagaaagaaagaaagcaaaauuaaaaguagucuuuugaguguccaagccuuaguuaaauuuuguugaaacaugacuucccaauucauuuuaacuggagcagucuuuuguaggaaauggugaaagcauugaaggggggggggugagaauaaaugaauauaauuacuuaaaauuauuaaaaaacaaaacaccugggcucacuuuuuccuuuuauauauccacaagaccuaucacuuuuaugauuccaugaagcaugaaguuuuuuaccuuacaacaagcaagagauuaguucugcaguagacaccagcaagguauccuuuaauuuaggugugaugauaaucuaccuggcuauagcuucagaucccaaaugccgagggcuggguucuugaugaugcucuaguccauguucgaugccaaucacaagcucuagucugugauuacugauccauucuaaaucccauaauccccuucgugggguuucacuaauuuacuuggaugacucagggaaacacauguuagcugguuuauuacacagaacauuacaaagaguacagauagcuaggaugagguaugaagggagagacuaagcuugcacgaugucucugaaugugccacccucuaugaaugccaggguucuaucuuagaacucuuuaacccaugucuuuuggguugcuacagagacuuccuugcauagcauggcugaagcauggguaccuguguucacugucacugaugcagugggugggggagucaacagagccugucuggcagacuccuugaaguugugauccagacccuuucugaccagauagauuagagaacuggcuagcaacuuguauguagaaaggccauggaagacuuaagagaucuuuguaauguacuaugggagugaaauucugguuucuaugaacugccuguaguagggaguuacaaguuuugcacagaaacugggugaaaaaagguugugugugugugugugugugugugugugugugugugaugccauaguaucacuuggacaaccgcuuuauuaaaauguaaguucccuuaaguaagacuguguaagaacaccauacacacauacauacauuuauuuauuuauuuuugcuucaggaaagauauguggcaagcuugaugccuuugcagaaaaguauuucuccuuggaagguaugugauauucaagcaauuuccucuuucuguugucuagcuauacuuaacuucuuugaauagaccaguuccuuauuucuaaauauaucaugccuuguuuucuagaguccaccccaguuacggcaguuccuuccagaagaauuuaugaaaacacuugaaaaaacagggccucagcucaccucuggaauaaagggcgacuggauuggacuuuaccgguuaggcucuuuacuuauuuuccuccuagcuguggaucuuuacuuaaaaaaaaaaaccuaguugaaaaccaagauacucaucguauggguuucugaacuauaagaaaggaaggcaaggcuggugugguguugcaugucugucauccagacacuugggagguggagcaggaggacccagagucagcuuccuagcgaguuuguuuuucccaggcuucagagcaagccuggacuacuugagucccuguuuguucuuguuguuuugauuugcuuuguucuaagagggggauuuugaaacaagaaauaauucuuaacuaaacuuugcuuuuuuaauauuuauuuuguaggcaguuucuaaagucuccaaauuuugauggcugguucaagacccggcggaaagaaaugacucaaaaauuggaggcacuucaucuagaagcucuuugugaagaggucagaaaaaaguguauuaguacaugcaaguguucagaguacaaaaguauucuuagaggcuuagaguaauacucggacagcacuuuauuauauuuacguacuuauucuguguaugugugugcgugcaugcaugcugcagugugaguaugaucuggaggacacauuucagggccaggguuccuuuucccucaugcggguacaaggucuaaccugggguaucugucuugucaguagugucuuuauccacagagcacuacuuuauuauacauaguacgcacagcuaacauucuccuauccuguccuaugagucagggcucucucaauugucauguccuggagguagguggguugugaucugcauucugcugcaccuguaguucaguucagugagcuugccucagucugcacccccaugcugugaagccaugguguguuguagucugcuuuuuggucuaugagaacuagcugugcacaucucuuuccaauugugugcucagggaccuccauuaguagcaugaaaccaccugcagugggaguaucauaucugggaaacaggcaaauaugaaaggguugaguacaccugggaucagggcucaggccagcuggcuucuggggugaccgcgucaccgccuccaguuggcgcugugcauggcacugugcaugugguuggacugcauuucaucuuggucucacagccuacgacacaggacacuuguagagacuguacagucuaaaaaguugcauuuguauuuagcucuaaaugcugaggaaggcaggucacaguguuaucauuucugucagaaacuccuagugacuguggcuuuuagaaaaaugcuaugaugaaagcaaccucauguaagcccuauaaagaucuuauuugaagauauaaaauuuauaucaaguaauauguucguguuuggcuaucuugauuuguuagcuaacuauuccuuauaaauuacuaauauaauaaauaaagauuaguauugcauugagggcuguuuauuuuuucugucuugacaaaaaggccaccucagaaagaaguuuucuuauauuuuuguuuacaguuguuuuggccgauguugaaauuuaucuacuuaacacuuuuuugauuuucaugaaaauuacccuugcgcuuauacugcugugugggaguugugugccccgucuuguccuuccuuuccgcuggacucgcuggcuggaacagagaggcuccgaggcuguaccaacugagaauuuucuuacuguuguaggaccuccuucucuggauccagaaacacacagaaguagaaacaguggaccuuguguugaagcugaaaaauaaguugguauguaacuaaagagaugaggauagaaaauggaccuuucugggaaaauauuuucucaucugagcugacucuuacucuguuguguacuacagaagucguuuuuuaaaugagaacauuugagauuggccaguugaugguagaucucacuagaaauuuugcucauucaaauagaucaaaugauucuaaauuauuugaaagacauuuaaacaauuuuaaaaauuauuuuaugaguauaaauguauggccugcucuuaguaagugcaccauaugcaugcagugucugcagaagccagaaaauggcacccccuccauuggcagggugaagccauguauacacuaggaccugaacccagguuuuccacaaguguagccagugcccuuaacugcugaacucucuagccccucaaagagauuuaaaacagaaucuccugaacucucugaaaccauugucuuaccuagauuuuauggcacacacuauccuuuggccucaucuaugaguguauagaauggccuuuauuaaggucucuuuacaccccucccccacuugauguucucuacaauuuuaguuucuguaaauucuaggcugagaccuaaacuuccaagugaucauucuaaaaaaagguguuuauguagcaaagacaauauauucacacagauucacuaaaaccguuccuuauguaguugcaggcuggccgagagagcuuaccugugaagccugacacuguggagaaguuacggacacauauagaugcaauuauccuggccuuaccagacgaccugcaaggcauacugcucaagaccggcaugacauaacacuugucagguuuuccagccagaaaggacugugaagcaggaagcauacugacauucaucuagacgcacacugagcaagcucaggggcacagcacggaaauaagcagcaauugcuagauacagcuggaaaggcugagcggacacacagacauuuguagugcguucuguggugguuccacaaugcugaaauaccgaaagacauuuccauauuuuuaaucacguucuaaagugcucuuaugagagaccuauggggccaucaguguaagugacuccaaacugcagugccggcauugcagauauuuuuuuaaauuggugcugcuuugcccaaucauguugaacucaggggaauagaagaauaauguucacacuggcugucuucuuaagaaggaaaaacugaacuuuccaacuauaguuagauauaacugaggcuuauguagugccuuccauuguccuauauguuucacaggguccagcugcuaauuguaaggcuuuuucuuuuuuaauuaugauacauaauuucaaaggcauuaugucaaguaaucacuugcccaaaaguauuucuuguugccccucauguuuauugccuguuguuuuaaauuaucauguagguuuucaugucacaacucucuaccauuuucacaacuuaggugugucuccgaggaaggaggcacaugcaguucuggcuauggaagagcugauuucuccucucucuuuuacucacuggccugcauacacuagguagcuugaaugucuuuugaagacauucucacaaugaacaucauaguuguuuuuuaaaagaauauuuuuaugucaaagauaagccauucauguaauaauuauuugagaguuuuacauuuaccuuuuaacguuauuuguugggugacacuauuuccccuaguggaugauuuuuagaagacuuuuccuguuguuguuugacaugggaccuuuuguguaaaucagcauuacacuuuuguuuguuuguuuucauuuuguuuguacuaccuugccaaaaguagaaugagauaguuugguuucagaugggaguguugcagaagccacuguucagauaggcacacacaaagcagcacauguguaaauagcugugacuuaaguaccugcccuucugagcagccacacgguggcuucagaagccaucucuuauucuuuugcuguuauuuucaagggcauuccugauccaagaagguuucucugugugugugacuguggucucauaucuagggugccccuuccuuacucauggauacagucucuugaagcauaccacuguccuaggaagaauauggcauuugaaugaaaucauuugucuggauugauugauugaaaauuuauuuugugaaacaauacugaccuuucagaaaaggggcaacuacuuuuauaugcuaaaguacuucauaacuuucugggaaacuuuauuuagguagaaauggucaucuuauuauuuuucaaaaaaauguauuuuaauaauuucacaauuuauauacaguuugugacaugaauaugaaagucauuaguauuauaucaaggauuuuugaaauauacuucuacaggauauaucauuugaaguuuauuuugcacaccuaaagaaaaacaugaaauaucaauuagcaugauaaugcugucuuuauguuuaccacauauaacagaaacucaacacauggugaaaaccaaaucauauucaccuacuuuaucucuuaauuucaaauuaugcauuggaaacccaaggaagacugaaugguuaacuuaaauuuuuaugucaguuuuagaauuucagaauugucucuuucauuguuuuuguuuuuuguuuuuuuuuuuuuucgagacaggguuucucuguguagcccuggcuguccugcaacucacucuguagaccaggcuggccuccaacucagaaauccaccugccucugccucccgagugcugggauuaaaggcgugugcuaccaccgcuaggcucuuucauuguuuuuaaggaguuuaguauucaaacccugcgguuuguuuaauguguuaucuccaccagcauuagaaggaaucagugcuuaggguguucuguaaugccuagugccuucucuuuacaguggaaaagaggguuuguggaggcauuuauggucauuacccaaagcuugaauuaaaggccuuggauuuuaaaaaacuuagguagcuuguguuaugugucuucuuuuuugguugguuuuguuuuggagacaagcuuucguguauccuggacuggcuucacacuccauguguagccauggaugaucuugaacgucugcuuuuccugcuucuaccgccucagcguggagauugcuggccuguuccaccaugccuaguucagugcugaggccugagcccaaggauccaugcaucuaggcuagcacucugccaacugagcuacgugcccagcccuaacuuggauuucuuauauuugcaauacuuggagaaacauacauaaugaaacuuguacauuauuaaaauauuuuauuucuagauaguuuuuuuccaaaugaaaugaaaauccaaaccuuuuuguguguauuuuauuauaaacaggugaaaugaugagauccuagccagacgccggugguguacaccuuuaaucccagugcucagaaggcagagacagugaagugaaaugaaguguacugagguuuaaagcgguuuagaugugguacucauuauggguauuuguguuugaguuuacuuguuuuugaggcagggugucuuuauguagcucucaacauucugaaacucacuaaugucuggacugguuuugagcucacagagauuccaugucucucccuuccuagugcugugauuaaaggcaagugucaccaugcccagcauaauggauggaugggcacuuguaugggugcacaaaaaaucaacuuugagugcuguuccucaggaaccauacuuugguguuuugguuuguuuuuuugagacagaguuucucacugaccuggcuagcuaaagacucuaaaaauuccacacugaugccuacaggagaaaagguagguggguaagacucuucacugaggcagagauacuuuucuacuacugaggauaaguaauguucagaagauguagcuuuucagaagaugaguaaugaaguaacguaagaaaaugagauuagugauacaguuuacaaagccaaagggaaagcaagggcaaaaauuccacuguuuguacagcaauuaguagaccaugucgccuguagucucugaacagugagugauauauguuacauugagauuaaguuuuauuuauuugcaauacuugaauuugaucagagagccucaugcacaguaggcaaguuaccacuaggcaaaguaagaggauucaauggaauacuguauguucagugcaaugucugucuuuguaauccuucauaaccacuuaucacugcuagauauuaguacuauagaauauauccucucaaauguuugaauguuaagaaauaugcaguucccuuuugguuuuugcuaaguagccaaguguagucuugaacucacaauccuccuaucccagacuccagaguaguacaacuucagacauguaccacuguccccaguuauuuuuuaaaugagcuugaaguguagaaauaccuacagcauuaaacccaaaaggacuauauauacaacauuuguaagcaaagggaugucauuaagaaugauugguuagccgggcguggugucgcaugccuuuaauccuagcacucgggaagcagaggcaggcggauuucugaguuggaggccagccuggucuacaaagugaguuccaggacagccagggcuauacagagaaacccugucucgaaaaaacca

SEQ ID NO: 7321 - RNA, 27070 nt, Mus musculus
cgucuucgcugggcuccacguccgguaguucgcacgucggcguagcgggcucaggcccauugcgcgcaggcgcgguggcccgggcggcgccugcaacgcagggggguggggcagcgcugacgcgauucuguccgcguuggagcgggcgggccgccgccugagucuccgcggccgccgugugacguggcacagccgaacacuuaacgccgcgccggagccaccgcaccagacgccuagcaggucccggucccgcuacguccugucccgcggcuucgccgacacuccagccagcgagacaggucuucagcguuuucuccuccgcccacucgguugugagccggaaccgugaaggcccgagggcgcaccagacccccuccuuuugaccgucaagugccaccaccgcuaugggccucaccaucuccucucucuucucgcgccuguucggcaagaagcagaugcgcauuuugaugggugagugagggaccggggccggggaaggccaugugucuucgccagccgguggcccggcgcccagccuucuccggcugcggugggggagggcgaucaagaagcaucguucggggaacaaugggggcgaggggcgagggguuuguuucccacagaggcugagccagagaguugggccagauuuccucgcuccuggcuuuacgugccuuucucuuccugcuguaauugagagccuggggagauugagcggagauagauguaggguuagcucacacuggcggagcucauucuaaaggugccguucucagggugcaaucuuccuuccaccucacuucccuggcggugggcagcggucgagagugaagcuggccuauuccagccuuccuccuccucccccuuucuuggucguguacgcccugugcacacaaccaucgguauguggcccgggccaggagccgccuggggcaggaagugaccaggcccacuguggcgaagucacacuuggugcuacccaagauucggaaaaaaaguccggagacuucugagcucacuuugcuuaacuuugccuugcucuggauucgacuuucuuuucucgugauuaugaagccuauucugugaaaaugaaaguuaucccauggcugucuuucaguucuaaaccuguuugguuugcuaucuuugcucuuucauacgaaucuuauccauuuggccuggauaauaauaaaauccaaaagcuuuuagagacgaaaucuuuuuuuuuuuuaaacggauaguuguaaagcaccucaauugagcuacaaaaaaaaaaaaaaaucguuuguuuaaaaagcugccucgcugugacagguuuuauugcccagcggaggccuuucgcuugggcauuguaaaguggccucuccuuaguacagcagucuaccucacagcugaguugcaaggaccugaaugacgccuuuuaaaaagccccgagaacacugaauguugacgcuuguugagugugaggagcaaaggguuauuuugagcacccacuccuauggagcgcuucaguuuccguagugcugcagagcguggcuguacaaauuggcuauuguuaguuuguucagcuucuuuacaauucauaaaaacaauugugcgagauccauucacaaagcuaagugaaaauguuuucuuucauaguuuugcagauacucuuuaugaaaaggacaauuauuuuaggagggcagacuguuauuuaagcuuuaauugguuagaaauuggcaguaugaaaaaggcugaagucaaagggaggacuuugcacugugauaaauggguuucuuagagauuauccaguacaggauuguguuacugaaaaauaaagaauuuauugucgauguuacugucauugucagagucuugugauggcuaaagggauggagggagaagcgugaaaugaugguuuaagcacuguacuauguuugagaaacucuccuguccauccugauugaaagagaauggaaguagacaagcauuuagcuagcugagauuacggaagggguggaagucacgguuuggguuuacucuuuuuauuuaaguauuuacucacucagguuugcuauucuuuuuguuuuaaaaugacaucagggucucucuauauagcccuggcuguccuggaacucacuguguagcucuguagaccagauggaucuuaaacucauagauagccaccucccucugccugccaagugcugggauuacagguguacacuugucaugcuugugcccaauuaaauggucucugcugggcaauaaaaccuguuacugagaagcaguucuuaaacaguguuuuuuuuuuuaauagcuuaauuaagguucuuuagaacuaucuggcuuaaaaaaaugauuucuaaaaguugacuuucuaauuuuauuauuauccgacccagcuagauaaaauuaguuugaaagagcaaagguaguaaaccagcagauugagaacugaaaggcagccaugggaugaaugcccucgcuuugcuguucuuacuuuauacuguaauguagaaauacuguuuuccuuguuuaaaagcagucuagucauagagucaccuuucaugguaacucgucagaggaaguauaaaugucgguucugugugugaacugggaacacaguaguuuggaagucugguaauuccuacguuuugaguuuugguuuuugucuuuguggcuuuaugagugauugacuuugucauuaauaaucacuuuuaugauaacuuuucccauuugaguauugggaauucuaguuaaugaauuguucuauauaaaugugugcacaugugcucugcuucuguguguguguauguguuuacuuugugguaugguuuugagacuggaaccuuguucauguacucuagccuagccucacccuaaaugaucgguuuguuuuguuuucuucucuuucauaaauaggcucuucuuuuuuuuggugguggugggggaguucuggggaucaaaaucagggucucuacauaaccauugaacuacaucugugcuccuagauuacuguuuuguuuuguuuuuuuuagauuuauuuauuauuguauguaaguacacuguaacucucuucagacacaccagaagagggcaucagaucucauuacggaugguugugagccaacaugugguuucugggauuugaacucagguccuucagaagagcagucagugcucuuaaccccuaagccaucucuccagcccuagauuacuguuuagaaguguauaaagaaacaauaauuaaggcuguagagauggcucaaaggugaagagcuuagaggcucuuucagagguccugaguucaauucccagcaaccacauggugguucauaaccaucuauaaugagaucuggagcccucuaauggcuuguaggcauacaugcaagcagaacacuguauacauaauaaauaaauaaaucuuaaaaaaaaaaaaagacaguuagccagugugucugguuugccuaacuacuguggaaaugaaaacuuaauuuauguacuagcuaaucccccaagguuaauuugagauguuggaagauauggcuaauaguuaaccauaauuaaaaaaaaaaaaagccuagccagggcuagcaugauggucagugcccauaaugaagcacugagaaggcugggacagggggacacugugcuucagacacaacaaauacauagccaauacaauguauugaauguaacgucuuagaggcaauugaccaacagaaaugaugcacuagguauuuauaaggaaagcuuacuuguuugaauaauauuacauuuaaacucgaggaccaccugcuuuugucuuagaguacucagguagccagaguuagagagcaguagcucugaauuguaagcuaggucugucuguauaucugucuguauguaugucugucuaugaaaagguguacuuuuggcaaaugaguauuuaauuuuuuucugaaauuacuaauauauuuguagaggaauugcuaauuuuaaucuauuuucuuuggacuuggugagaaugcuucuggggauaaaaugucucuacuuacugagccaucuugcaaguucuuugagacagggucucauguaauuacguagcccaggcuggccacuauguagcuaaggauggccuucaauuucuguccuaccuccugaguacugggacggagccuccauuugcucauuuaaaaauauauuaauaaguaauaaaauuguacuaauacgugaggcuuuaaguuagagugauagauguucuauuuuauauaucauuuuauuagguaauucuggguucugauuguuuguuuguuuguuucuggagacaggguuucccugacuguccuggaacucacucuguagaccaggcuggccucuccuggaacucagaaauccgccugccacugccucucaagugcugggauuaaaggcaugcgccaccacugcccggcucugauuuuuuauuuuuuuauuuuuuuuuuuuuugguuuguuuuuaaguucaauuuagacaugaaaaaaagugaucauaacuuguaauucaaccuuucaccauuauuacauaauuuaugugggcauugaacuccagucuccucuaggaugcuuaccagugagcaucucuucaguacuuacuugucacaaauuuuuuuuuuuuuuuuuuacaaauuuuuccccccuucccuuucucccuuuugccccggaccugcuugcuccugucccuacuugucacauuuauucuccacauuuuagaaagcuuuauuccucuaaaauuguuuguguucccuuuuuacuuaauaaauugcaagcauuuuucauaagccacuauuuguaaacauaauugcuagccuuugauaauguguuucuaauuaauucauucaugaaaagaaaauaccccucaauuauguuggguagaaccaaaauccaaacauuaauuuuggcaaagccucaauuuauuuuucuguaucuguuugguccaguuucugucuaguuggucaaaucccugaggaauuaaauaaaauauuaagauauaauagucuuaacaucuuuaagauaacaucacaguauauaauacuauuugagagcucugacaucagaauuagcuuucuuaaguugguggguguuuugugagacaaggucgcauaaagccuaggcuagguuugaauucgugaaugccuucaagauggcccagcagauuaaggccuuugcugccaagccugacuacuggaauuugucccuagaguggaaugauggaaggacaggauugacuccugcaagcuguuuucugaccuucacaccacucugugcaugcgugcacacauacauauagaaacucacacacaaauaauuaaacagugauuuaaaaaaaaaagugccacuccuagagaaucauuauuaugucuacaaaguuguguaacaguugcaacugucagauggaguauuuucaugaaaucccaugacuuuuuuaucagucauucucacuucccucuuugaccauggcaaucacuaaucacuuugugugcuuuuucugcucuggguauuuuagcugaaggaauggauaauauauggcuguuuuacuucugguguuuucacuuggcaugguuuuuuuucuuccaaaguuuguguaacauguauuagcauucugugauguuuuguggccaaaugguaauuccaucauguagaaaaccguaguuuguuuaugcauuuaccuaucaguugguggaaguugguuauucauaguuauuuuuaguucucaugaauaaugucauugugcauauuugugaacagcuuuguguauagacucaaacucagagauucaccugccucugacuuccaaguguugggauuaaaggugugacaccccaucuggcccuaaagugaauuuugauguuaauaaaauuugaucauaaucacccaaaagagucuuacaagaacucuucauaagggggcuggagagauggcucagcagguaagagcacccgacugcucuuccgaagguccugaguucaaaucccagcaaccacaugguggcucacaaccauccguaaugagaucugacucccucuucuggugugucugaagacagcuacaguguacuuacauauauaauaaauaaauaaaucaaaaaaagaacucuucauagaagaauugaaagaucugauuggguuuugcuccuuucuccccccccccccuuuuuuuuuuuuugcugaaguuaccauuuagcuaccacccucagauuugauacuguugcauauuugagaaaacauuuuguguaacuguuaacuaacccuugugagaaguuaacuaaccuuuguagggucuguaaguaaggauaaacuagucauucugacuaauauaugucauaguacauuggaaggaagaaaacuguuaugggaguuaggguucaguuagagagcauuaguauaagaaaacgaguugcugcucgauucccauccuucuccacccccuucacaccccuucuccucccacacuagcaaagguagauucuuaauacuggagggaguauaaaccguguucaugcugacaagcccuaagccuuuucuguugcuaccaagaggagugguaacuuucuuuucuuuuaaacagcaucuccagagagaugcuacuguuugcagaauacagaguagaaaaggcuauauuauagguggaaauccaauuccuguagcuuuucauuacaugugaaaaaagucacaccuaauugcccaggaauauaaacuuggaugagugaagcuaaaaccuguuagcauuguuuucacauguuaaguugugguuugaguuaaacauuaaguagguaguuuugccuaaacuaguacucaguugauuuaguuacaaaucuuuuaaauucugggauaaaauaagugcaugcagccaaaugagauguucuuuaaaagaaaaaagaaaaaaaaaaguagggccaagaguggaagcacaggccuuuaaucccagcacucaggaggcaaaggcaggcaggucucugaguucgaggacagccgguacuauacagagaaaccaugucucauaaaacaaaacaaaaauaaauucaauuaaguuauuaguuauugaucuuuuauuuaugagagcuuuaguauacaaaagauguagguuuugagaauuauacuuaaacacauuuaauuuguucuucacuacuacuauaauagagguuuauauguuauaucccauaaacaagcauauuccccuacuuaacugugucucauggauuaagaacagagacauaauuuagcacaucccuguaauuuuagcacuucagagauaaugacagaaggaucaggauaucccagccagcuuugguacaauaugaauuugaggucaggaugggcuacaugagauccugguucagaaaacaagacaacaaaauuaagaauuagagaagaauauaauaggaccauuuuuauaacacaaaucaagacuuugaaucuuacuuaugcauauuugauguugauauagauuaaggugguggcaaaauuagucucaggagacuggacauaguuauauauguuacccuuagcauuaccagcuuucuaaaagacagauuucacacuuuuuuuuuucuuuuuuuuuuuuuuuuuuuuuuuuugagacuagguuucucuauauagcccuauauagcccuggcuguccuggaacucuguagaccaggcuggccucaaacucagaaauccuccugccucugccucccaagugcugagauuaaaggcgugcgccaccacugccugaccacacuuaauuuuuaacuauguguauauguguguucauuuguugguuguacacaugaguauagaccugaagaaggcauuagguuccuuagagcuggacuuacaaguacuugugagcccucugauggugccaggaacugaacuaguauugcucuuaacuacuaaagucaucuuuccagcuugaagagcauuuguucaagauauaauguguaaauaccaaacaaaggauuaauuuuuuucaucuggagauguagcauaguugguauacuauguuggcuucuuccauucuuaacaggcacagguugccuauaauccuagcacuaguauucaggaauauagaggcaggaauaucaagaguuaaagggcauccuuagccacauaaugaguuagaggccccucugggauacauaaaagacccuuucuccaaacaaaggcacucagcuaguuaguggcacagugcccagagguccgaacucaagucugccagauacucuuuuucucugucuacaggagcgguucuuaaccuuucuaaugcugagaccccuucauacaguuccucauguuguggugaccccuaaucauaaaauuauuuucacugcuacuucauaacuguaaaauucaugcuguuaugaauuguaaugcaaacaucugcuaugcagaugguguuaggcaaccccuguaaaaggguuguuagacuccuucccccaaagguguugcggcacagauaggaaaccaucggucuguaggucuaaagagaaaaaaggauuuugggaaguguugauguggagggcggugcagaaaugagagaaauuacauuuaacucaacuuauguaucaagcaguuaacuuuuacuuugaaacuaaauuguugaauugcuuccuuauguauauguaugaucagauuuuuaaaucugugguguuuucuucuaguuggauuggaugcugcuggcaagacgacaauucuguauaaacugaaauuaggggaaauagucaccaccauuccuaccauugguaagaaaaucuauagaugauuuuauacagugagaaauuaaauuuuguuuuuguuaauuguagagaugauauugguaaaacuuaacaagcuaaucuaagagaauucaacauuaaaggguuuauuuuugugguacuuuauuaugcacagugauuauuuugguuuuuuucuuacagguuuuaauguggaaacaguagaauauaagaacauuuguuucacaguaugggauguugguggucaagauaaaauuaggccucucuggaggcauuacuuccagaauacccaggugagaaaugccauauauuuguaacuuuaauuuauugauuuuauacugaauguuuacacggaguuuacauucuucucaucaccagucuuauucuuuaguauucucugacuggugcuuugaaaguucaguugugucgugaggaagaacuaaauguagcugcucugguaagauuuagaauggaagugauugaguucucaagaauaaauuauugcaggucuggugugguggcacacaccuuuauuucagcccuuagaagcagaggcagguggaucucugaguuuaaggacagacagggccacagagagaaauccugucuugaacccuccccuccaaaaaaauucccaaaauacaaacaaacaaaaagaaugaauuauuuuaucaguaguucuuuuuauuuuaaccuuaauuuugagauuaagguauguauuacaguggcucuaauaagacaaugguagaacuugauuuagcacaaugugcuuuguuaauuuguaaggccaguuuuauauuauauaggauauguuggcaugaaaaagaucuuacuaauuguguagguuagaaguguagauuagaaauuuggcucaauuuuggaccacugggggaguuuugaaaacucuccaguguccaaugauaggucagaaccuuggacauguaagcccagcagccucauuguccuagcauugagugugcauaccaaucaccuggguacuggcuuaaaauucagacugagucaaugggacaagcuucuuagauuuuauacuucuagcauguucucuuguggucuugaguuugcuaguuugaguuauuaaaacagcagcucuauugacauuguugaauuguggggaggccucuuucgugugacuagcaguauucuuagugucugccuauuaaaugcuaguaacagcucaccuucccagucaaguggugacaacuacaaaugcuugcacauuugccaaaaaccuccccagggacaaaauuauuuucuggugagagcaacuauucuaguucuccugaucuugugguuucauuuuuguuuuuucuuucuccccugagcauugguauugcagacaugcagcagugugcagggguuucuaagugugaggagccugacacuuagaagugcuucaagacugaggcgcuguagcugggcugccauggcagggaccuguaauuguagcacuuagaagggcuugggaagcuugaguccagccugucuacaaagcaaguuccaggucagcuaaggcugcaagugauugaggaguuccuugcuguugguaaccugcucucaguucuugugucucuccuacauuuuaccauaugacgguugcacaucagguuuuguucacuaccagaguugagaauuuuuugaaguaguauaguaaaauuugggguauuucagguuugcaguguugugcuuauucuccuuaggguauguugcuugguaguagugaacacacuuguugagugacugcaacaaucuuagcuggaguaguauaaguccauucuuauuaaguaaguguaugauaaguguuaagugucaaauaaguggcauaauuuauuacugaaaaacaaaaauguguucauucacauggcuuuggauagauuuugcaaaaguaaaggcuuuaagagccugauuggaaauagaagugaucacaaugaauucauguauagcuagugcauuaucaguuauuaaauauggucaguguguuuagccaguacucauugcaacaugcuagcaccuccaauuguuuuaagguagguuguagauauuuauuuuaaggaguauauuuuugaaacaaaauuaggcaugaugucaaucuugcugauuuuuaaaccuuaaaacaauaguauuaucccuauguuuguucuuaauguuuuguaagacaugugaaucaaugaauuugagauuagcuuuguuccuugccagagcauucuucauccuagggagcgcuugccugcuaguguaauuacagcuaagcugcuuaagcugacauucuuugcauuccuaaccaguucuucuaacucucaauauuuaauuuuuuuuaacucuuuuuuuuuuuuuuuuuuuuuuuuaacuuuucgagacaggguuucucuguauagcccuggcuguccuggaacucacucuguaaaccaggcuggccucgaacucagaaauccaccugccucugccucccaagugcugggauuaaaggugugcgccaucacgccuggcuuuuuuuuuuuaacucuuaaaauuuaaacacagcuaauuguuuauugugguaaauuccucuccccucauuaaauaauucuaguucuuuugcuuuucuaaauaauuuauuugcauuuuuaaaaagauucauuuuuauuuuguguguaugcaguuuuuugccuacauacauguaugaguacuacauacaugucuggugccugcagauaguauaggauauccuggaacuggaauuaccggugcuugugaacuacugugggugcuaggagcugaacccagguccuucacuugcacucuuuaacuacugaaccaccugugcugcccgcaauuuguuugacuuuuuaaguaaucuuuucuuagcagaugaacuuauuuuuagaauccuagcuuuuccauacuguuguuccuaggcuguuaacaagaaagaauuuauucuuaaaaucuuccucaacuaauguuacuuggaauugaugacauuauuuacauuuagaaaaaaaaugaaaauguaauguuagaaaaugaguuugggggggcuggagagauggcucagcaguuaagugcuaguugcucucacagaaggccuggguuuucuuuccagcacccaaaugguguugcacaacuaccuguaacuucaguuucagggggaucugaugccuucugacuccugccugcaggcuccuguugugugcauacuuaacacucaggcacacacacauacccauuaaaaaaauaaaauuaaaaaauucuguagggguuagaguuguggaaagacuauuuaaccaaacauuuaaguauaagguacauacuuuuuugguuuguugagacaggguuucucuguguagcccuggcuguccuggaacucacucuguagaccaggcuggccccaaacucagaaaacugccucugccucccaagugcugggauuaaaggcgugcgccaccaccacgccuggcucaagguacauacuuuuaacagagauguaguuuaacuacuguuucauuaacugagaauuucaaauacugugcaguuugaaaauuuucaagaaggucuuaaaucaguuguuuucuuuauuuuuaaauuuuauuuauuuuuuaauauuuauuuauuuauuauauguaaguacacuauagcuaucuucagacacuccagaagagagcaucagauuuuguuauggaugguugugagccaccaccaugugguugcugggauuugaacucaggaccuuuggaagagcaguagguuuucuuaaccgcugagccaucucaccagcucaaaucaguuguuuucuaaugccacuucuuuuucuguaaaaaaauuguaauauuugcagauaucuucuaaauucuuacugccaccuuuuuguuaugaguuucuuuugaucuuguaauccuugaaaauuucaugagauguuugcuuagggcuuguuucuuccaguuagagaguuagcagguuacauuauagagcgagauuuuuuuuuuguuccuauggugaaguauauaaaaacuauugacugaacagguuaaguugauguauuuaggaauauacacaucaacaacaaagaaaacgaugccgugaauuuaaaagagagcagagaguuugggguuacaugggagauguuggagggagaaaagggaagaggaaaaauaauguauuauauuuuaaucucaaaaaaauaaaauauaacuuaaagaggaagaaauuauauguaaacaguucuuuugcauuacuaaugaaauacuuuuucuuaaagaugauuaaacuaucaggaaguuauucuuauaaccacacaccugaaaacaacguguuaguauccacuauccaauucuccaauuuauuuuagaacaagaaaaguguguugucucuccauuucacacuuuguaugugccuuuuacugcauacauuaaucaauaucacucauaauuuuggggauccuuuguuuauuuuccuuuugucuucaccauugccucuguuugcucauuuucuucacuuuugagacugguucuuacauagcccauaguagcaaccuggacgucacuguagcugauaguccuugugaucuccugccucuguuuccugaauguugcgaucacugaggaguguaacaccagacucaguuuugcucaguguaagagcucaaauccagagcugcuugcaggcuaggcaagcauucuacucuucugugcuacacaaaagaccuggagcucuccuguuacuuaaauauggcagggaaggggaaagggcuacaguuguuucucuuagcguagagaaagguagucauugguuaauucgauuuuuaugcuuugugugugugucugucugugugcauauauguuuuggguuuguuuuuuguuguuuuuuuuuuuuuuuggauuugaaguaagauugauagguuaaaaucacauguugcuuaaauuaguuuucaauauaagccuugagcuuaucuuccuguuuuauuugguuuuuauuuuaacaggacuggcuuaggguuacuauugcuaugguaaaacaccaugaccaaagcaaucuggggaggaaaggguuaauuuggcuuaggcuuccauauauugguuuaucaucaaaagaaaucaggacaggaacuccagcagggcaggaaccuagaugcaggagcugauggaagguugcuauuaaccaguuugcuguuuugguugcucagccugcuuucucauagaauucaagaccaccagccuagagggcaccauccacagugggcuuggggcuucauccaucagucacuaguuaagaaaaugccccacaguccugccuauagcuugaucuuuguuuuuguuuguuuuguuuuguuaaauaucuauuugcauauacaccugcaugccagaugagggcagcagauccuaguaauagaugguugugagcaaccaugugguugcugggauugaacucagaaacucugcaagagcaaccaguguucucaacuaucuccaaccaucuccagccccuauagccuuaucuuauggaggcuuuuuuuuaugaaguucccuccugucagauugcaucagcugacauaaauuaaccugaacagaaacuuuuuucuuuuuaauuuaaaaucacuucccucucccucauucccuugcucccucccuccucucucugccugccugccugucugucugucucucucucucucucucugugucugucugucuuggggggguaccucugagacaaaacuugcauuguugggaggaaucuacucuuucaccaugugaguucuggggaucaagcucaggucauuaugcaccuuuaccugcugaacuaucuuguuagccccauguuagagacuuuuaacaacucuauuuguaaacccucagucuuaguuacgguuacuacugcugugaugaaacacuaugaucaaagcagcucagaaccaucagcccgggacagcacuaccacgggcugggcccucuaugucaguaacuaaugaagaaagugcccacagcugcaucccauggugggaggccauuucuuccuuucuuuuuuuuuuuuuuuuuuuuuuuuuuuuuuuugguuuuuuucgagacaggguuucucuguauagcccuggcuguccuggagcucacuuuuguagaccgggcuggccucgaacucagaaauccgccugccucugccucccgagugcugggauuaaaggcgugcgccaccacgcccagcagggaggccauuucuuacuugagguuuuuuccccucugaugacuugagguaaaacuggccaggacacaagaacauauuuucuaccccaagucuaacuaaauaacuuucgauacuguuuugguggguauuuuauauuuaguguauauuuauacuaauuuuaaauuuauuggaaaaaauuuucccuagggucucauuuuugugguagauagcaaugaucgugaaagaauccaggaaggagcagcugugcugcagaaaauggugaguauagacuuccaguugaucguuugcaagggguguaguguugagaucugucaguggcuacacaguuuagagguagaaauaaacuugggaaacuauauuguuuccagguucuuaagaaugcacaggaaagccuucugugcccacagucacuucuuuuagauuucauguaagugugguaaucauaagaccaggccuuccacagaguguguuaucuccacaggauagaauguaucagagcuacauggaucuguuuuugguacacuucuugcacuggaagauaggaguccaaaaaaaaaaauaaaauaaaccauagaauggaggaugauuggcuuuaaacagcugugcugcaggaauggcagcucaggccugugauucucagcacuuggcaagcagaaacagcaaaaucucaauuuugaggcuagucuaggggagaaacaguaacaaaagcaaaaaaugucuccuuucuuagaggcaaaucuuuauuugcucaaacugagggauaugagauuuuaagagugcuuaaaaauuuacauagagaaauuuacuugguguucaauagcuuguuuaauguuaaauaaaauguaugcuucggaaggcuguugugcaugguuggccuuuccauggguaacugcuaacgguuuagccuuuauccccagcuucuggaagaugagcugcaggaugcagugcugcuccuuuuugcaaacaaacaggaucugccaaacgcuauggccaucagugagaugacagacaagcuaggucugcagucucuccgaaacagaacaguaaguauugauaggcgacacuaagcuccucucugggaagugucgggguaaguaggcugauugauacucagcugucuguuaguauuguuguaguuguuacuguuuggagguagggucucacuuguagucuuggcuggacuggaacucacuauguagacuagucuggccucaaacucaaagacaucuggucaccucugcauaugccauguuggcccaguuuaaauguauaauaauuauuuccuuugaacauacaggacauuuguaaaaauaggguaaugugauuuauaggacuuuucuuuaacugcauugaauguugcuuuuaaaaauacugauuuucuauuuuuaaauuuuauuuuuaauuuuaucuucuguauuaauguauuaacaauguugaguugaauauguagagguuacagacauucuuaaauuuguaucauugaaauagcucuccagcuauuuauuuuuacuauucccugugguguuggggugugaacccagauguuucuugugcaagugaggguaaucacccaaacacugaauagaaucuccaacuuagcaaggacuuuauacuuggcuugcuuuuuuuagguggugcucacuaaauauaaauagucuauuaauauaauaauauauuaauauauagucugcgcuggccuuaaacuuaaggacauccaccugccuccugcuuuucuuuccucagugcaaggauugcaaacaugcaaucauacuaagcccugcauguuggauuguucauaaaaagcccaggauguaucaauuguaacuuagaucauacuguccagugcucuuugcuuauugacuuuaaaagaaaaccuuaugaaaaaaccucuacugauacauguuugaagauauuuugaauacaaaauuacaagaaauacugugccugcuaucaaauagcuuaacauuuuacaucagugauugauguauuggcaauauccccauacauauaaauuguaucacaaacaugagaccuugguuuuuuuuuuaaaaacaaaaaaacaaaaaacaaaacaaaacaaaaaaaaaacaaaagcaaaagauacugcggaaaacugaguguccuguccuuuacaagagcuuugcucuaauuugccagcaugacagauacuauuuauuuguuguguagcauguugcaguguccuacauggauuuaaaaagauacacaauaagagaacuuggccaugugugguggcacacgccuuugaucccagcacucgggaggcagaggcaggcggauuucugaguuugaggccagccuggucuacaaagugaguuccaggacagccagggcuacacagagaaacccuguggccuugcaacaugaaaauaaaauuuuauucuaaggugaaagaagacuauucuguuaaaaauaaaaguaucaacaaacaucuuucagaaguuuaccccuuuacacugggaauguggcuuaauggcagaggacuugccuagcacaugcagggcccugaguacgaucuuuagcacuacaaaaaucaaaguuuaugucaugugucaggcucauguguugccuuaguuuaugaggaucuuauggauuauguagguaguuugagauuuucccauuauuccucagauuaugucggggagugguaaacugauaaguucauugaggaauagauggagcuuuaaauggguagagugagaagcaagaggugugagaacauaccugaaggaugaagguugaaugaccuguauaguuagcuagaacauuaaguucauguuugugggauguaaguacuuauuuccuuauauuuaauacagugaccuuuuuuuguauacuuguaaccacuggcucaguaguacccuuaggcauuuauggggaggagcuuaauauuucauuuaaaaauggcacuguguauugucuuguuaaucaagggcuuucuuguucuuuuuuucacagugguauguccaagccacuugugcuacacaaggaacuggucuguaugagggacuggauuggcugucaaaugaacuuucaaaacguuaaaugaagcuggauaucuaaccaaggacauguuugauagaauuggucuaggcuuguuacaacaaaauuaguuugcaucuugguuauuaaaggauaucugagacagguuugggcagaaauuacagcguuuaaaacuuguuuuguugccaauuauuguuuaccaagaacaauguugcuauuuagcaauaugcuuggguuuaagagaaauucuccuugggaaagaaaaguauccauuauuaugcuucccuugaaccuaaaugccuggauacagagcuauccugacaccuuuagacagaucugagugguuuuugagcccaaaacaauaauguuuuaaaguuauucccuugauacuuuacugagaccuuuaucauuccucagacagucugcugauuuaaaaauguagcauuccauuuguauuuauuucuacccuuugccaaaaagauuuuucuaauaaugcuuguacaggccaaggccgugguccaaaacacuauucaguuuucuuguacugaggauccccccaccccaccacccucacauuauugacuccuggcuucuaucagccaaacuuugaugugguuuggauuugauagccaauucugugcugguugcaaagaguucauauugagauaacuuuuaauacucagcagauugucuuccuuuauauuguuaucuuuuuuauguugcauguugcuuuuggaaucagccugacucuuugcccaguauaugauaguucuacugguauuuuacuguuuauugaugaacauaucuucauuaagaauuuuuugaaaacucaucaaauucaaugaauaaguuuucuucauaacccauuuggaauuauuccuaauaaaaugauuuuaaaaaacaugauuguguguucuuuugagacuuugcaauauuugaaacugauuuccuuacauaacaaaguauggccaaaucccagugaauuuacuuaugguuuaaguugucaguaaacuuagccauggguuaucaugugcauuaaaguaaggugcacuaugaagaauuuuaauuuuucuaguagaauaccauuugaagcuaugaaguucaaaggucagaucaagaagaacaagaacaaguuaucauaauaugaacuccagaagcagaguaugaagggguugcugaugaagcucagccagugaugauucauuggugaugaagcuugccuuguauacagugaguuugagcccacuaucacgugccacagagauggcagaaaucauuguccacuuacugaguuugaggccagcauuagaccuuucucaaaaaaaaaaaaaaaaaaguaauuugacaaguggguaugcauacauuuggcaacuaacauuagguagaaugcauagcuaagugaugcuacucugagaauaguccauaggcacugugggaugcaggcaauauuaaaaaaaucaagcuaccaucucuccugcccugccagucccugcucuaguacugguacuggugagccacaacacugucccagcagggucccacuccauauguucucaccacugagcuacucucucccagcuagcgaguucaucucgcuucaccacaacgccccauacaccccacaaucagccaucuccacaccuaguuacccaguagaaacaugaauuuuggugguuuuuuuuuuuuuuuuuuuuuuuuuugguuuuucaagacaggguuucucuguuauagcccuggcuguccuggaacucuguagaccaggcuggccucgaacucagaaauccaccugccucuaccucccgagugcugggauuaaaggcgugugccaccacuacucagccgaaacaugacucucaaagcuuaauuauccaaucagauuuauauagcaagagcacaauuuacaaggugccaauacaauaauuucagaaccaauugauaaagcuuugaccuaauuauucuaaccuugugacaaucuuagcuacuuguggcuguuuaaaaccacgugggaucaggaucaucuuguuugucugccuccaaguuggcuucucuucugugaccucucccuguccccaaaacuccuagcucugccucccuuuucuuguccaaucacaggucugccagugcccuaaugugacuggacagagaaaguccugcaacagugggauuuaacauuccaaaugucagcacaagauguauacagacuuccaugcuacaguggcaacugugauacaugccauaacuacugguuggagugaauuuugucuauauugucucauguauuauaaacugauuuuuuaugacuuacagauguagauaaacucauggaucaaaaaauguauuucuuuucuuguuuguguucuugagacaggguuucucuaacagcccuaauuguccuggaacuugcuuuauagaccaggcuggucuugaacuuaaaagauccaucugccuuugccucccaagugugggccuuaaaaguaugaaccacuacacccagcuucaaaguuuuauuucugaagucaauuacaugcuuguaaaauguguguucuuauauuguucacaaaauaaaacccacuuaauuuagcaaaguaaacugaaguuaagcaguuucugaguaucugaaauaggugauugagaucaaguauguuuaauuagugugcuucauuugaugugguugaaauauccuuagcccuucuuuccaaguaagagaggucuucuuucucucuugagaaaacuaaaauacaguacaguguguguuuuuuaugggauauaaaauagaaaaugugaagcuuccguaaguuaagggguuagaguguaaguuagcacuacaguuaacuaaaaucuaagcuggagggaugacuuaguggucaagcacuggcugcucuuccagauugccagcacccagauggggccucacaacuaucucuaccugcagcuccagggguuccaaagcucucuucuggacucugggggcccuguacauguggugaacagacauacaugaagacaaaacacauaaaaugaaaaaauauuaaauauuugccaggcagugguggcaaauaccuuuaaucccagcauuguaguuaguuacauuuaggcaaauauuaauaacaagguuauuuaaaaaaaaauauuuaauguauaugaguacacuguagcugucuucagacacaccugaagagggcaucagaucccauuacagaugguugugagccaccaugugggaauugcugggaauugaacucaggaccucuggaagaacagucagugcucuuaaccguugagccaucucuccagccccaacaagguuauuucuguaguccauguaacauguuuaagugacuaaguuaacacucaguaaauagcaacugccuucucagucaguguuuacaguagaagaaacuagguucccuugcaacuuggaauuucuacucugcaaacgagugguguguauucaguuucacugggcacuuaguacucgcucuuagcaacuguucuggcuuuaguuaacaguuuuuuguccagauguaauaccauucaaauagacauguaugguauucugucuacacguucacuuuccacaauuucaguccuuauguuccaccauguuuuaaaaauuaaauggaagguuuaaaaagaauuaggcuuuaaauaacauaucuuacuaguauauuguacuuauaucaguuaaauuaucuuaaguauguaugcacacacacaagauugauacagauaugaugcuguuuuaggaauccauuuggagucauguucccuagaggaaagaggaauguaaauuagaaagugaaagcgguguauuucauacuagaauaccuguaaucaggaaacuuaguguugaggauguguaaaaaucagaaccucauguuuugcugguagagauuaugcaccugcuuucaguaaucuagcaguuucucaaaggguaaguuguuuuccacaugacccaacaguucugcccccauggaagaggaaugcccaagagaaaugaaaacacccacacagaaauuguacacaaagacagaaaaauuauuuguggaagcaguaugaauguccauuaaccuacaaguagauugaugaaauuuaguacagccuaacaauggaauauucaucauuaaaaaucccaguacugaugcuacaacauggaaauaccuaaacagucuaagugaaaagaagccagucacaaaauacaugguuuuugaaguacuuauuuaugaaaguccaaaauagacauuucauggagacagguaaggggguugcccgagcaaaccgaguaacuaucuuuaaguaggauuucucugacauucaaauaccaaaaccucuuaaaguuaccaccaccaguuuaagaauagggaaagacuaggauggugggaaauaugaaaggguuauguaacuuguuuuagauaaucuguaauacuaccauuaacccaguuuuauuuuaacugucagucucauaauucaggcuggccuccaacuuacugaacagcugcggaugacacugaguggauucaucuguuuccaccucccaagugcuaggauuccugcuaugugccaccuuuaacagcugucaaaauagaguguuuuccaugucacuuugucuggauguaugguuagcaauaaugcuuuauguaugauaaauucuuuuuuuuuucuuuguuuuuugagacaggguuucucuguguagcccuggcuguccuggaacucacucuguagaccaggcuggccuugaacucagaaauccgcuugccucugccucccaagugcugggauuaaaggcaugugccaccaccgcccggcgauaaauucucuuuaaagugccuuuucaauauaagaaagucaacuaaacugucaaauucccuacagaaucaaucccaauaguuguaggaugcacauacaaacuagcaaaaaugcaaccuacagcuauuucaguauccuaaggaaacgugcaaugguagcucuccaggguaugagagagaauugccagaugaaauaggcuuaaauucaccacaaaauggauauaugauggagauaguuuuuuaguguccgaaagaaauuguuuuuguuuuucaaaacaugguaacaggccuggucauccuguaauucugaccaggcuggucuugaacucagagaucuaccugccucucugccuucgagaccaaaggcaugcaccaucauacccaacuuccaaugaguuuaaaaaugaacaauuuaaaaaaauaaguauuacagagccaaguggugguaguacacacccuuaauccucacacuuaggaggcaaaucuccaguucgaggcuagccuugucuacauagagaaacccucaggaaaaacccacaaaacauugcagagcuuggguuuugacaaaucaacaagagauucccaucagaauaaucagauuggaagcugaaaaguugaaccgacugcuucaacgguuguuuuaucuaguuuuuguuuauuuucuucuuggugauuuuuaaguuuacagguauggguguguuuugccugcaugccuggaguccagagaugccaguuaaggcugugggcucccuggcccuggaguuacaaaagguugugagccaucaugugggucuugggaaaugaacuccggguccuuuggaagaacaaguggucuuuucaggcucagguuuaauguuuuaauuaaaacuuauuaauaguucuauaguggaugguaucaaccaguucaacugaugagcuuaauguuuaaaauuagcuucuauguaaauuaaauuuuagcaucuguauuauuaagacacuaccuuaaguggucaaguaauauuuucccuaccucuuauuuaacaggguaaaugccagcuuaaguuuauuggcuuaaaguuuacauuaacuugaauuuagagauuuuuuuuaaaaaaucuagaauagcuugaacuuucaaugauuauacauaauuuauauuauaaauuauacucaauuauauccaucuaguuuucucaaaacuuagacauucuugccaucugcuaaucuguaccuuuuagauuuuaaaguggaccaauuuaaaaguaaguucucugcaguugcugaagggugaaauauggccuuuugcugugcaggucuuaggccuuuaccaaaauucuuuauagucacgguuguauuuuuaacuuugauauucaguuuucuuuaaaggaagcaauaaaaccuuuccuacuugacgcagaaaucauaaaacuaagcagcagcugcugaaaguggcucugggaagagguuugcuaagcuguuuaagauaagcuugcuugugacugcaacaacugcaauuccaaaguucaaagcgugucacugaagugugaacaggauggcuguuuaaaaaauggauauaauuugugaggauggagggaaccugaaccuguauauggcagugagggagguuuaggguaguguagccacugugggaaaggauggcauugcugcagaaagcuacagcacuucacuaaguuauauucucuagaagaacugaaaacagauguuuggacugggugugcagcucagagcaguccauacaccagcccaggguuugauucccuaguacuaacaaauuaaaaagaggauguuccaucaaaaacuugagcauagaucuccacauacuagucacaacaggaaacuaaccaauccaaaugcucacauaagcaagauguauuauccaugcaguaggaaauguguaaaagagaugaaguauugguacauacuguuacacagauaagcuugaaaaacaccagucaaaucggacagauaucagaacuggcagaugaugugucuacugguagagaaugaggauauacuuuaggcuucccuugugaagugaugaaaaugccuuagagucggcuacacaacagugaauguauuaaauacaaguagguuuuauguauuuaaaugauuaguuuuaccucagugcuuugguauuguaaccagaaugcaauauuguuauauuguaaugcuaaaaauucacccagguaauaacucaucaccacuuauuagaaauggcauauuucuuagaaauuaggaccauagaacucacuuuauaagugaaagcucuuauccucucuacaaaugaaaccaagauaauacuucuugcaaguaggcugagcaaaagguuuucaaacacauuuuuaaauaguguuuagaaaauugguguuggcuguauuuuagaagacuucccuacugaguuuuaugaugaaaacuacaaauuuuaucuucccuuacaauauagagauuuuacauuuuagaacuuuaaagaaaagauacuguagccagaaaugauauuuuugcuaaugaauugcaaacuguuaguguuacugggacaacuuuaagagugauuuuagcagaauaacauacuuuaaaauauucacauuuccuuuacuaagaacuugugacauaaaugugguuugccacaacguugcuagaguucucagaaucauuaaaauuaaauacuaaaaauuucaaaacuaauagaaaaauucaaucacgaagauaacuuuaaacacuucugauuaacgauuaacaccuuguccuaaguacaaauaaguuugguauaaucuucauagaauuuguggagugcucccuaccuuugcacauuguaagcuggagucaguucuuuacacuucauuaucagaauauccugaaauaccuguauauaaucugacuauaccauuuaauccacaaauaucaaauuuaaggauuuaggacaugggaugcuugguaaaucacaguucuacuucgccacggaguuaauacaggaugucaaugcauggguaugaauuacaaacauuuuucuuucaaaaugcucacuucuugcugaguaaauuacuguuaauuccugaaguguucaaguaaguuugucaacaugguuaucugaaggcaaaacaaaacuaauuuugaaaaggguuguagcucugauguagcuuggaguacuaaacauggcuagcaugcucaggauucuggguucaauccccagcaacacagaaauaaaauaauacugaaauaauauuuuguaaaagaacuaguucugacuauauaaacugccacuaaaaugcucucaaaaguggcauguacacggcugggaauauaacugagugcccugaauuugacccgugggaagagaaacuaccauauuuaugaaggcacaauuugguaacaucaacuuuucaucagcuuuuuuauuuuaagcaucccaagaaacugucauuuuauauuucccuuuaaauaauaugaauaaagguucaaugugaagugcaaaugaaaugcuuauauuuuucagacuuacuaaccuaagaguaucugauaacagaauauggaaaacacagaucacauuagagaauauggggaaaaaauggauuuacagauuaaauaauuugaagacuuggaaaauaagaccucuuuuugagguaagaggccuuuauuaucuaugcuagaaauuaagugcagaaagcuaugcuuaugcuacaguuaaaccuggacaugacaaagcaaccgcuaaagcaucaccaagcagacauggugagaacaaaugcaguaaaagcaucuaaacuagauacuaaucaacacagcuuggaauuucucaucuucaaauguuggcuucaucuucaaauuuuuuauauaaauuauguggcacuauucuguuccucaagcuauaaugcuuacaucuauaaaaaguuuauuucagauauugacaaaaacccauuguccccuuuuuuccuauguauguagcccaagcuggccuugaacuguguaacccagaccagaacugaccucgacgcaguccugccucacguaccugagcacuaggauuacagcuauaaagcaccaugccugcuuccccuuuucccugugugcuuauauuuuaugaguaagagcaaaggcaagggaucaagucaaguccccgucccuuugaauacucuuuugugcuuguauccuacuauuaaaaugagcucaagugcaaguaagaagacaaaguagacgcguuugaaccgucguuuguacacugaaaacaacgcaggaaggaaaauaccuugcuaacugaaaaacgaagaagcuauaagaauugguaaugguacauuuuaaucuuuuguuaaagcuccaaaauuauaauaaauucuaaccaaauugag

SEQ ID NO: 7322 - RNA, 54925 nt, Mus musculus
ugccaagcccaagcccucacucugaagcgauggcgucgacgcuuuccccgggcguggcacucuccucuuuuggcgggcucggcaucgcgaggcuccgcccuccuggaacggucucucugcagucgcggaggcgggcucugcauuucuauugguagagcggguccgccgaggccccgcccccucccgggcccgacgcgagcacguuggguagccagggccgguugaaaagccgcccgaauccggagcagcucccggggcgagaggcacgcuuagggccgcgguggcgguuaagaggcgucucuguggcuggagugcgguccccgggggcggaggggccgggugggccgagaccucggcggccuggcccgccgcccuuccuccccuacgcccgucgaccuugugggcggaagcucccuggagcgccucacgcccgcgcgauggcgacugccgcggagacggaggccccuucgacggacgcgagcuggaaaagccgcggcggcggcggcggagacgacgggaugaagccagcgcuuccggagcuugaguccucccuacaaaauggcggcggcgacggcggcggcggcgcggggccugaggagaccgcggcagcugaagccgcccggagcuacggccacgagcagccucagcaaaccuccgaagcggccgcggccgcucugcccaaaggcgccgaagagccggaaaggccuuuuaggcggaguuuucagauccccaggaagagcagagaaaagaaagguggugccuccccuuccucccacccccucucucgcuucccucccccuccaucuuuuucauuaagaccucucugucuccucuccccacacccauccgagacacguaaacacgcacgcaagcgccagcagccucuccgcucacggccacggccgcccagccgcccuuggugcgagaggauaggguggaaccacgcuccgccgcucccccucuccccguggaaguuggaaguagcucagguuugaagcguuuccauaaggcugcggcuccccgagcggaaagauggugcucggugccccucuuuucccccaagccccgaaggcagagaagcugaugguggccuccuaaagaugcuucugagaagucugcuuguggaaguagccuguggccauggauucugaggcuuucuccaaggccacugcguucuaaggacaaguguuucucacuguggaaauucuucagcucugugugucuacuugaaaugugcucgaugucagcgucuucuauuuagaaaacucuccauuaguauaugcgcuccaugcaguuuuccaucacacuucauuuccauguaguuuuuuuuuuuuuuuuuuuggaaaagcauuagcuuacguagguucuucuguauaacuuccaagccuagaaugacuuuucuuaaacgauuauaggaacaguuggguugcuuacuuuuugagaucuuagugccauauuguaaaacguacacuuuuuuuuuucuuagaguagguuuugacuguccgauaauuuggaauuuucuggauuugacuuaaacacuuaccuucuuacugcguguuuuuuuuuuuaauuguuuauuucccaaaucuuuuuuuuuugucauuugaauaucugaagauuuagaaucuugauuggaaccgugcaucuggguaaccaacucucugcacaacugagauuaugaaaguauaaagaaaguuccuuucuaaauggaugacaaagcgaaggaaauagcaugagaaaccaugcagagaaggaugaaguugaucuuugccggcugaagugaauguuucuagaaauacucuuuaaaugauguaauacuuuaggguguagggcaagacagugaauucacuugaugucguuaagguguguauggcugugcugauacaagaaaaguuagauacucauccccaaccgccaguugguagaaaaggugagaaguacuuuuaaguagggccucauaauguaguaagggcuuaacaguuucaagcuguaucaaaccuuuuugacauccuauuuuggauuuuaaaugacuaaggcuuugaacaaaucauuaaaacaagacuuuaaaaagggaccagaaaacuggcuuagaguccuuuaggauucuguuugaaaauuuaguaagguaguauguacuucuuaaauuucauaagccaaauccagaaguugcucuaaaaugacugcccuugaacauacuaaaaguggcacagggaauuagggaguauaaaccuuagcugcuuuuuccguggagucugauguauuccuugggggaaaugagauaguuuccauuuugccuagggauaugauuuuuacuuucucaauuguaagggagguuguaguuagaaaaacaugguaggguuuuuuuaaauuuuuacugaaaauaauucuuaauaucuuacuguaaaucaggcagcaguuguucaaauaguacauaauagggucaaaucaaaacuuuacaaaaaccaaauaauagaaucuccuuaaguuguucagcccuucgacuugaaaugcuccugucucagccuuccugcuagguggaauuacaggugauaucaugaucuauuaauacagcgcuuucaaguaacuauuuuacccaucucagauuuuauucuaaauugggagaaguuagucuuugaauuucaauuuuauaguuaaaaacauugucacuuuagaacaguuacaagagucuuuuuccuuuuuuuuuuuuuuuuuaaagacagccuuacagccuuuuacauaguccuggcugccuuggaacucacagagauccaccuaccguucucuucagagugcugggauugaaaauaagcaauaccagccuuaccugucucugucugucugucucucucucucucuuuaaacaucacuuaauuggauauagugugcaacacagaacaaaugguuggaaggaaaacaaaauaguauagagacuguuaaguuuccuuccaucauugaugagaagguuugaaaguauguuuaggauuuagcuugguacuaauggucaucugacuugcuaguauaaaaauuuuuuuuuauagauuuaccagucuuaacuguuuucuggugaaacuuaaaguuuggauguuaauuuuuaaacaauuucuuaaaauaccauucaguauaauuuauaggccaugcugccaucaaacaugcagccauccucuugucucaaguuuccuaagugcuaaaguuucacagaaauaggaacuuguccagcucuugaaaguuuccuugaugacaauagcaugauaucuaaaugcugccauuuuagugguauacuggcaagcaauauuguacuugauagguuguagacauugcucuuuguacauaauuacaucucaacgauucuuugugguagguauauguccauuuuacagaaaaacugaaguacugagaagucacuugucacuuaauaaauggaauuugaacauguauagacaacuuggaacuacucaacucuagugagguuauuccuaauagucuaaauuauauuuuuauuuagggaggcaggguuuauuuuggcucacaguuucaggguauaguugauuaugcugagaagucauaacagcacaagccuggcagauaaucacaugacaaaacaucuguaaucagaaaacagagaugaaugcucccuccucccccaugcucccugugaauuccaagcuggccucaaacucaaaacuuggauacuacuacuuuagccuccuaacaccgccacgaguggcuuuauaaucuagaauuuaaguuagcuuuuuauuugaccaguugugaaauugcaaaguuuagcauauauucaaccuuggggagaauuuugagauggaaagauuauguucacuguaaguaauggcagauuauauguuuuagaagguuuuguauuuuaaguuuuuuucagagcaaauacagauuuauuuauagauagaacucccaagagugggagggaagaccuagggauaaauacucauauuuuacugauuauguauguuguaguuuagagagccacaaaaauugaauuggccuguagauggaucaccauguuuuauucuucuauaucuagugugucaucaaaaguaaauuaaacuugauaguugaauuugacaguauuucucuccaaaguucuugggauagacuaaugauacacuuucuaaaagauagucaucuuuucuaacaaaauuugcaguugucuuuaaaaaaaaagaaagaaguggaccaggucuuacuguguaacugggauggauuuacuuccugccuccaacuccucaguugcugggauuggaccugauucugcaguugucuuuuuaagucaugguguuuuaguuggaauggauaacuggauuuugaaagcaguaauuuuucuacauagacguaaaccugggcaggaaauuucauauuuguacugguccauguugacuuaugccaguguauuuguuacuaacaaugcuguguucauucaauauugauguagagauauagcacauucuuuuuuuuuuuuuuuuugagacaggguuucuuuguguaguccuuggcuguccuggaacucacucuguagaccaggcuggccucgagcucagaaaucugccugccucugccuccugagugcugggauuaaaggcgugugccacuaugcccggcgagauauaacacauucuuuuuuuuuuaaagauuuauucauuauuauauguaaguacacuguagcugucuuuagaugacaccccagaagagggugucaauucucauuauggaugguugugagccaccaugugguugcugggauuugaacucaggaccuuggaugagcagucagugcucuuaagcgcugagccaucucuccaguucccgcgaagauugaaguuuuguuuuuguaagauuuauucauuuuauguaugugaauacacuguagcugucuucagacacaccagaggagggcaccagaccccauuacagaugguugugagccaccaugugguugcugggaauugaacucaggaccucuggaagagcagucagugcucuuaaccgcugagccaucucuccagccuuaacacauucuuaaaacauugucagguaguaauuuuuuagauagagccauuuacaaaucaguuaagaacaaauggagucacacuguaaaugguaauuaaggccgguagauaccagccuuggacucagaauuacagaccaaguuuggucacuagccacuuugcuaauuauuucauuuucucccuguaguucaggcuggcuuuguacuuuuuuuuaaauuauuuuuuauuagcaucuauuauauacaguaauggguuauggguuucauaugacaucuucaugaugucaucauaaccccauuaaccugcuuuuaaugcuccucugaacaccuuggaacuggaguuauaguugugagcugccaugugggugcugggaacuaaacuuaaaccaaugucuccuggaagacuagccaguauucuuaaucucuugagccaucuuuucagcucucccacuuacuaaucccaacugguucccaacuuuuuggggaggggguauuggugguguuuaggguuauuuacagcauggcaccccagucuacaccacagaagagaaucucccccugcaucaaccauuaaugguauaaaucuucagagaggaauggaggucuaucauuccuucucagucuuguguagaucaugcauaggcaaucaaaaaggcaaucacaacuuuugaguuaguagccaugccuugucuggaaguuacacauacacaccuuuucaccaacuuguacauucuagguauccagacuauucuuauccacuguugcuaaauguugggggagugacagguguuccacuuaugauuagcauucagcagucauuuauucucugcuuuaacagucaccugguacaaaaugaagcuucucuuauuagagcugacagcaguacuauucuaugagcuugccuguaacuuuuggagcgucugucucagcccucuaaaugcugcaauuauggauauaucuaccacauucagcugguauucuuuguggugcucuugugguucuggggguagaacuuaugacuucuugcuugucaggcaaaugcucuacuacugagaaacauuuagucccauccauuggcuacuuaaguuauaguuacuuuuagaucugaaagcuuacauucugacuguuuacauguuuugauggcaguaccccuugcuuuuuaaaguuuagcauaucauguauauauaguauauaagaacuacacugacacaaaauaaauuagucaaaaauaauggguaccccuugcuuuuuaaaguuuagcauaucauguauauauaguauauaagaacuacacugacacaaaauaaauuagucaaaaauaauggaggaaaauguucuuuugauuaaagaaauaugcuauuuuuugaccuauauccaacugcuuaaaugucaauucuuuuuguguguauguuauguggguauggcugaagggauggaacucagggcaaguacucaaccauugacuucuaucacuagcuaucuucuuacucucccucaucccaagacaagguuucucugugucuaucccuggcuguccuugaacuucggcaucuggcuuguacuuuaccagcuucuuagguacuuuuuauguacuuaccugccuuuuuauguagcuuccagggauccaaacucagguuaucaucacgauuacacagccaucucaccagccacuuuuauuuuuucaguuguauuauaguaacuauguugacuuuauuccucaggaugcuuguauauauccagucuuaaaguagguacacauuggcuagcacacacuguuauaauaacauguaauccaaaucacuuuuaauuuuuagagcuacuauugugauacaugccuaguuaguuaaagauccagauaugucaccaggggguaguggcagcccaugccuuuaaucccagcacucaggaggcagaggcagauguagagggaucucugaguuugaggcuagccuaguuuagaguuccaggauagccagggcuacauggagggacccugacuugaaccugcccccaacucccaaaaaggaauggauaugucauuugacauuguauccuuuauagucuaauaaaaaugaaaauauaguaaagcagcuuauuuacaguuaucuuuuccauggcauacuucuaaguauaaaguugagcgaugguggcacaugcuuacaauucuaguacgugggaagcugaaacuggaagaugacauguuugaggucagccuaggaugcauagugaaucucagacuauuauaaacguuuuguguaagaccuugugucaaaauauaaauguauguacaacaguauuuucaguggaacccaaggguuacuuuuaauauuuauugaccuugaaaugucuuggaaaaaaauauaggcuuuuuuuuuuuaaauuuggggaaaguuuauauguacagauuugguuuuugaaauuuauuaaaugaaaaauuucauguauuaaaauuucagguuauuaggacaaauuuuuuuguugucauuguuuguuuugagaugggaucuuacuguguagccuuggcuggccuggaacucaaucucuagaucaaacuggccucaaacucagagaucugcuacuucuuuucuccugaauguguaacuaaaggcauguuccaccaugcuugauaauuaaaccaaauagguuaaaugauuuaguguuauaagaauuccggugccagagagcugucucugcugguaaaacacuugauaucuaagcuugaguuugauuccuagaaccauaguugacugagagaaccaugugaugguuguucucugaccucuagauguacauccugucaugaguguacucauguucaugcaugcacacacaaauuugagccaguugugguggcacaugcuuguauuuccaguauaugggagacuuugaaagaaggacuugagguuagacuuggcugcccagugagaacuuguaccagagaacauuaaauggacuguagacuggugaaaacacaagggauacaaacuuaauuguguuaacugugcacagcuacuccauuuugcuuaguacuuuuguuguaagggccugugauucaccaaagaaugguaccccagacucaaauauguacacaaaggcaaagaguguuguuuauugugcagaaauuaccagcacacagggaucuccauauaccaaaauggagauguugagugaguuuacaggcucuguuuuaaagccugguaggggaccagggaggagugggugaccuuuugccuuucuuuaccucaguugguuggcucuauuuuucaggguguggguaucauugggauuggucaagguucuggggaguuugggguacuuucuggaacguuugcuaauuaacuaggcucaggucagguguuagagcagcuccugauugguugcccucaaggggugguuuuucuuggcauuugacuuguuuuggacuuguuuaguauuaggaaagagaaacuuaggccuaguucuuaagaaugucaguucggagccugucauggagucugccuugcuuagcccgucauggccccucucauugcccugccuuacauaauguauuuggcauauaauaguuauuaggagaacugcaguuuugcauuuuacaacgaacugggcuuuuaaguuauauauaucucaucugcuacaaagucaguaaaugauaaaucugguguuucaguuuuuacuguauagcucuacaacucuuuugcaguuugcuaguauugggcauugcaccuaguuuuugaaacaugcuagaaaaauguuguauuacuuuuuuuuguuuugaagacaagccucacuaguuuuuuucaguccacccuugaacuuucucuuuacuuagccaucaaguagcuaggauaaggcgguacauacccuuaauccuggcauuugggaucucucaguucaaggccagccugaucuacagagugaguuucaggacuacacaaagaaaugcuguuuucaaaaacaaaaacaaacaaaaaaagauucuggcuuggcucaaaacccuucaucuuagcauuugauacuuaaauguucuauuuuuuauugauaauaaagcuauuugaguacuguauauuacuuuaacuuuaaagcccuggcugaccuggaccuuauucuauuagacuagucugccucaaaguuuugauuacccuccucuuuuuuugauuauccucuuaucucugccuuuuaaaacaaauuuuuguaauuucuuuuucaaauguaaugugagguaauacacaaauggaacuuuagaucuuuauuauucauugcuuuguaauggaugugaaaaauuacaaaguuugguuuauaggaauuauagacaugagcuacuguguuagauuuuagcuuuuauuuaugguaaaucuuuauaguuguuugacugccauagucuuaaacaugcuuuuucagugcaguguaaauaggaauugagacaaguugagugcaugcauagguccuuaugaagguuuaagcaauuuagauuaauuuauauuauaagaauuauaauuaauauguuauacauuauaaggauuaauuuauauccuugagguuuauaaaaccauaacuuuuuguaucugaggccaggucaucauuguuuaaaggaacuaguuagucuagguaagucuuaauuuuucuucagugaguuacaaaaauaauuugugugcugugaaugcauguacaucuaucuacacaugguuaugcaaguggaggacagaggacaacuuuuugcaaggauauuagggauccaacucuggucaggucugugcagcaagcuagucaccuguugugccauguaguugguugucuuuagugagugcuaauaauaacucuugcaugccauaaaguaacuguuggggccuuuggucagaaaaccuacauuuaugauagaauaaucuuagaauuuguuuauuuuuguuucucuuuguucuuguuuuuuuuuaauagcucuuuuccagccauuaacuccagggucucgagaauuugaagauguuuuaaauauucuccauucaucuuaccuugaaccaucaucaguaacauauuuuaacuauagacgagcuugcuugauacauaaugaacuuuuggaaaaagagguauguauuuagccuggggaagaagucuuuucuuuuccuuucuuuguagaaaugcauuuuuuuuuuuuuuuuuuuuuuuuuuuuuuuuuaaggaaagguaacuuaaaaggugaaaauaucuucuuggugcuaggaauuaaaccagggucugacucaagucucaacaagugcucuaccucugaaauacauccccacucuguuuaucuacuguguuaaauuguuacuaauguguaguuacccagaauccugaaauaagucauccacauaggcauaguuuacuauagaguacuuaguuguaaauuuacaauuaaguuuuuuuuucuauuuuuuuuucuuuuagguuuauacauuuuuuuuuuuuuuuuuaaagauggggguuuuauccuaguccagaauagcuuagaauuuacugaguggucagguugacuuuaaacuuaaaguaauccuccuguaucagcuuuccaagaguuguacuuguaaaggcaaguuguugugguaccccucacacauccgcaauagaaauuuuucugaaaaaaaguauguacaaaguugacaaugaauacuuauaugcaaauuagauguucuuugaauuuaauauaggaaaauccagcauguauaauucuuagguaacacacaaauggaacuuuagacucuuuacuauuuauugcuuuguaaucgaugugaaauauuacaaaguuucguuuuuaugccaauugguuuaaugauguacuacuaaaauuuaacuuugaaaaucuuccugaagggcacuguuacaguuccuaaagaaaauaaaaaugugacgguuuaauguaguuucaugguauaguagggguuauuuguuaauugugcauggaaauuuaucugaaguuacauaauugagccagccugaauacagauacagaaaugcuagcuauuuugucguuuaaauagauacguguuugaaucucaaaguaaauccaggaguuuagaguacuugacuaguaugcaauaguaguucuguagcagaggcugcccuugaacacugggggaucuuccugcuucagccuccagacugcuggcuuuaagugccacuguaucuggcaugaauaaacuauuauauucaguaugccauguaaagugggagauaaaaagaugaaaaaaauuaauaauucuugggggaaauuagggauauaguaaauuuuuaauagaaaauuagcuaacauuggugaauaccuagauacuuaugacuauucuauguguugggacuuaagauggaaaggaauaaaaugaagauugaauagcagaaacagagauuuuugguagcuuuguuauuuauuagaaaaauuucuuuaauucacagcauaaugaaacaaucacguuaaguaguuaagcagauuuauuuaauuuucuuucuuuuuuuuuuuuaguuuacagaaaagagaagagaauugaaguuugauggucguuuagauaaggaacuuucagaaucuuaugcauuucucaugguugaucgguaccaggugagauaauucuguuuccauuguaagugauuuguuuccuaauuauucuuuugauaaggauaagguaaucuuuucuucuguuuuccauggagggggaggagagugagaauguugaauucaaguugccagucuuggugguggugccuuuacuuacuaagcauccuacuaguuguuuauuuuauuucauuaauuuguuucuuuauucacuuuauauacccuuguuuauuuuuuaagauuuaucuuuauuuuuaauaaaguaugugcgcauuaguuuggguaaguguugacucuccugaagcuagaguuacaggcaauaguuagugauccuccugacaugagugccgggaauucagggugaauucuccagcagaauaguaugagcucuuaaccacugacccaucucacuagcucuuguuuguuuguuuguuuguuuguuuguuuguuuuggggggggaugcagggggugacuugcuaugcauuucagguugucuuuccuugaacuuagaggcaucuugcugccagucuuuugggguuauagacauucccuguaaccuaacguuuuuauuaauguauaaguagaacaaauaauucagaagggcaaauuauguuuuguaauuucuuuuucaaauguaauuauuguuucucugaucaugucuguuuuuuuccccuagaauaaaaacuuuuuuuuuuuuaaaugaaaacaagacucucuuauauaauguugauucuauguuuuuuuaaaaauguuuugcuugaggcuagagaggugguucagacauuaaggcacuugcugcucuucaagaggacuugaguucaguuucuagcaacugacuauauuggucagcucacaaagcaccucuaagucagcuccagagaaucuauugcccccuucugguguuucagagcacugccacacacaaguacauaauucacauaacuaagaauauuuugcuggucuuaauucucuuuugcaggugaggauaucugacaaguagcauaaagaaaaaugaauuuuugauaggauaaccuuagaaauuuaagccaguuuuacauugauacuuacuaguuagcugagaucugugugugaaaauuuuguaauuauagauuagaagauaaaauuuugaaguuuuaaaaauuaacuuuucuuguuaauuugauuuuaaacugaaauguuuuguuuacauagguucagagcauaugugaaaaaggauugcaggugggccaauccaaaauaacaguucuuggcaguccuuccauggguaauuuuucuuguuucucauuuguacuuaacuauuaaguugccauuuaaaauccuaauugcaguauaccuauagucacuaauuaaauuaguaugcuuuucauauuuucaaauaaggagacuaguauuaaguucugaaauaaaacacugguuuuauuucuuuguuucugauuuuaaauacuuugaauugaucaaauguuacuauuuaaaauguuuuaugauuuugaaaaauuauacuaauuuuauauuuuacucuggauguugucuuuaguauugcuuuuaaaaaguugucauaccuccuauuccuuuuauuauugguuaaauaauuugauuuuuuuaaaaauuaaacuugauuguucacauucaaauuauuuuuuucuuuuagguaucuaucuuuguagguaugcagaucucuuacaggcuaauccuuuggaggcuggggcaguaggcgauguuguuauuuuuaaaaucaugaagguaauuuuaacuuguauuuguacauagaaaaggcaacauuuaacuuggacuuuaauuuuaagugacaugacuuuaggaguuugaguuaaaagccuauauuugguaguguaugaagaguugcugucuuuagauuaucuucauuuaauaauuauguauguguugggguacacaugccacaggaugcaugugaagaucagaggaaggcuuggggcuuggggguguuaguucuuccuucagccuugcggauaauuacaacucaaaaccucagguuaucagguuuggugguuuuaccugcugagcuaugucacugccagcaucccccucucuuccaccuccauuuuccaaaugaaagaaugaaaaaaaagaguaacauguuggugauguaaguagguuaacaguuuaauagcacuuguauuucuucuuuauagcauauaguaaaaaucauguuaaguggacacuuaaaaauuuuuuuuauuuuaggguaaaauaaagaguauuuaugacccucucaguguaaaaagcuuggaauccauguuaaguaaaaaugcuuuggacccuaccccaaaacaugaaugucaugugucuaaaaaugccaguagaauuacaucccucuuggcauauagagccuaugagcuuacucagguauguacuuggauccauuuaaugugaaagauuuaugugugucugucugucuuuuugugugcugauacaggagcuugcauuuguaggcuuggggucuggaagaaaaggggaucagaucagaguuggagguacaggauacucaccuggcuuguuaagaggguacugggaccuaaauucuggucuucauggucaaacaagcaagcaauguuaaccacugaaccaucucauugccgcaccucuuggaaugccugccuuucagggccuuagaaauaccuuguuggugaauaccauuuguuuuucaaaguaaaggucaagccccuuggcuaucuuacuucacaacucuauguucuauggauuuauuggaaugcagacuuaguauauuuuuaagccuuaucuuaaaaacauauguaguuuuguucucuuuucuaaaaaaaauuuugagaggucucaguacauauauuagaacucuuuauguagaucaggcugacuuugaacucaaucugccugccucugccuuuuuagugcugcuauuaaaggccuauacugacaagcguggcuuuuuguugauguuuauuucuggguuuuugagacaaggucucacuauguagucuuggcuggcuugaaacucacgauguaggcuggacuguuuucaaauucacugagagaucucucuugggucaaccucccaagugcugggauuaaagaugugugccacaacacuaggcuauuuuuugaucccaggucuuauuuagguccauccuggucucaaacuugcuauauacuggaagcuagucuugggcuccuccuuccugguacucccuuuuuccuugucuggcuuuuuuuuuuuuuuuccuuauccugggucuuguuuuauagcuuagguugaccucaaaaucaucauccucuugucucagccuccugaggcuugggagaaucuugaaugcuaggaaagacuauuuuucuuguucucagcauuccuuaguugcuuguaguuguaucuaggguugaagccucaugagcuuccccccauaacaaguauguaaaagauauuuguuaaaaguagugaccuacugucuauuaaaauaauguuauuuuaaaaauuuauacuuuaaaacauaagcagucuuuucguucccccaauuucucucagaucuuuuccucuucccuauucacccaaguccauuuucuuucucaaaaaaauaaaauaaaauaagauaaaagaaaaaaaccaaguaagacagaaaauaccaaacccaaacaaaaugcauacaaaaagcacagacuguuuuguguuggacagcuacucccagauaggcauggugccugccuuggaguaugguuguuauaauaauacauaguguugcuucaucagagaaaauugauuuccccuuuucugucagauaucauuugcaaauaguuucuuagugguaguacuuugugucuacuucccuuucuucaugcugggauauuaucuguggauuuguguggauguuuuauaugcugccaaucucuuuuauaugcuaacagucucccugauuucauauguguaucaguuuuguuguagcuagauaaugcuguuuccuuggaaucuucuuccucucuggcucuucaagucuuucuguguccucuuccgauagauccuugagccuugaggaaggagggcuuugauaaagacaucccauuuaggacugagucccacaaagucauucucuguacauuguggaucucuguuaauuaaauugucauguacugcaagaagcuugucuugugaggguugagugaugcucugauguauagcaguaggucacuaagagggauuuuauuuuauuaauauguucgguucgcagaauaagaguucuaguuuuucgauuacagcccaugaccuguuuagucucagauucuuggccacuuuagcagugacggggcuccauuucauggauguacuguaaaucaaacugaagaauguuggguuauuccauuuguaacuaccauuuaugcuacuguuacacuagcaucucuugcaggcuggccgguugcuguuggucacaugcugaugauuacuucucuccucuguugcucugcugacugcuuccuagcacgauagacaguauguguguguguucauagagcuaacgcucuuaguuaggcaccagcuccauucuuccuugucuucagugguagggccuuacugucagguuguauagggcaaccaguaaccauggcaauagccugugauauuuggauaggucugugggaccccuuggcgaaugauucaacaagauguaauccauucuuccucugggauuuuuacuuggcagcguaagaugucuaacuaugggcauuguucucuugcauuguaugcugaaccuagaaguaaauacucaucagaaauuuuuguuggggcuggacagauggcaaaucaguuaagagcauuggcugcucuuccaaaggacuugaauuuguuugucagcaccaaauggcaauucacaaaugccuuaauuccaguuccaagggcucagauggccucuuuuuugagacagacauauauguaggcaaauguucuuaaacagaauaacaaaaauuuucugcaguacuuguggagaaguuuggcuccuuauuaagguaucuuaguggauaagacauauggcuggguauuuuaagaaaaauuguauuauguaagacaucaggagcuuccucaguucacuacuuuuagauaauaguguuacugguagacuugaaguuaguuacugaguucucuagaacuuguaaaccagagcuuuauauauauauuuuaaaaaguguuuuagaagaaguuugagagaaacaacauuguuaaaaucaguaauuucccagggaaaaggacuugguuuauugacucagacauucuuuuaaaauagaaaucagggggcuggagagauggcucagcaguuaaaagcucugacugcucuuccagagguccugaguucaauuuccaacaaccaucuguaauggaaucugaugcccucuucugcugugucugaagacagcaacaguguacuccuacacauaaaauaaauaaauacuuaagaaaaaaaaaacuaaaauagaaaucaguuuucugcuagccagcgugaugacugucgugaccaggggaagggaagaggcuugugaguaguaagauaaucugcuugaacauucacaugcauguguagucuuuugcacaccuccuuugcuucaguuuucacaguugaguuccaguuuuguuuugccuuuuguacuaacacagaaaaugauauuugauauugguugaaguuuuagcauuaguauuuuacuuuuucuggggugaccuagcuuaggcuucauuuuacaguauuuuuuuaaagauuuauuaauuauuauauguaaguacccuguagcugacuucacacacaccagaagaggacaucagaucucauuacggguggcugugagccaccaugugguugcuaggauuugaacucaggaucuucggaagagcagucagugcucuuacccucugagccaucucuccagccccuuacaguauuuuuauuaggaaguuaauugcacauuucugcugucaacucuucugaacuaaacuucugggauagcuugguaucagguacauaaaaugcauacaaaauacacuuuuuuguuuucagccaaguguacaagcucuaaugguucuauguuaucaacaaaauaauauauuuucucuacuacuuuccuauucuaaaaugauaauuuuguacuuuuuuuauuuuuaguauuauuuuuaugaguauggcuuugaugaaguaagacgaagaccaagacauguuuguccguaugcaguugugucuuuuacuuacaaagaugauguacaaacuccaaaguuuuugucuccauugagguaagucaguuuuauuuacacaaagaaguaguucagaagcgaccauuguccucuucaacuuuuuuuugacauaaacuagauguuuucauauucaugauaaguaaaauagacccuuacuaugaaaaguguaauuugauucaccuagcuaaguuguagaacuuuuuuuucuuuucaacauuuauauguacuuuaauaaauagcaauuuuaaaaguuaaaaguuuaaacugguugugguauaugccugcacucccagcacuugggacauggaggucagcuguggcuaugcagugaguuugaagccaucuuugcuucaugagucuaaguuccucaaacagaaaaauuuuguuuuuagcucucuuaaaaauugacuuucuauaaaaaucuuacccaaaccaaugaaauauuuaguugaaugcaaagauauuccuaguuuuaagagucaggugauauuuauuuucuuuuuuaauucauaaacauaccuaaaauaacuguucaaacuacuguuuuaaaaagcuacuuaucuuuaaugaugcauauuuuuagggugaccgcuauugguuuuuaaagucaaaugugcuugauaagagguacuuuaguuguguuuuuguuuuuauggauaaaguuguucuggcuggcuuguagcuuacuauaaauagcuuaggugggaagaaccugccuuagcuuccggagugcugauaugagccaccaagcccuggugauacagcacuuuuuuuuaauauuaauuaauaagcuuuuaaaaccucucccagccgagcaugguggcucacaccuuuaaucccagcacuugggaggaagaggcagguggauuucaguucccaucgcuugcugugcacgugugcagcgcugggauacagacaacagccaccaaacaugauaguaugucaggguccuaaauguuaacguucauguuguuuccaaucaguaauaauuuuccuuucuuuuuaaaaaauuauuuguagaucuaacagcuuuaaugcagauagaaacauagguaagagucuuauuuuuuuuuuacuuuuauaaguugaaaguauaaacagugaaagauuaaguuaaguguuuuguuuuauuuucauaauaaaaauaugaaacauaaaguaggugaggucauguuaaaaauguaccaucaguauuugaucauucaaacauaaggacuucuuuuagaagauggaccagaauuucuagcacuugaauuggaggggggggggggaagauaaauuggguuuuacaauugaacuagagguuuugguuuugauaaagaaaauuuuaaacgguauuguuuuuuguuucuuuauuacaaaaaugagaacaaauuauaaacaacuagaagauaggagacauuaaucagguuuaauauagucuccuuuggaauaaugacuguauuguuuguucugcuuucuuaaagggggcacuuagacagauuggcucuuccuugaaacuggaauguuuuuuuguuaaagggaaaacauaccucaaacuagaaacauaugaaccuuucccuuaagggcaugucacuucugugguuauuuuauacuuaaaaccuuauuucuagauacuuuucauuucuaguaaauguuaccuucuggguuaucaaucaacuggacucuuauuucuuuuguuuagauaaguuuaacuauaccuuguggaaaggacaacuuuuaaauaaaggaaagcuucucuguuauauuucuuugagguccgccaaucgugccuuucuaccugucaagcuguaaguauguugcacuaaaagaaaacagugggaggggcagagggaggaugagagggaaggggagugaggacagacuauaaugacacacacaugcacacagucucuauuucacaugauaaucuaaaaagguagauuucaaaaaauaaaaagaaaauaguaaucgacaguaaaggggucuaucaguuucuucuuuaguuuuuuguuuguuuuuuuuuuuuucuuuuuaaaaaaauuuguuugaggcuaucauucuggauuggaacucacaauauacuccaggcagucuguuucaaccuuauguaugauagauuuuaaggaugcgccaccauuccuggcuugcuugcugucuaucuauuguuaauuuuaaauuuuacuguggucuguuuaaaacuuaaacacaaauguuaaacauguuucuaaaacaguugguuuuguaauuucagaaaguuuguuagcaaacaagcucugguucagcacuuugacggugucuagucagauguaugugguauucugaaugguuuuaagucugaaagaugagguuaaaauuuuauucuauguagauuuaguuagcaguuuauuauauaauagacucaaguuggccagucuuaucuauguuugguggcacauagcuaguaauccuacuacuuaggagacuaaggcaggggaucuugagcucaaaggcagucuuggcugcauagugauuucuagacugcagaccauagugaaauccugcuuuaaagcaaaaagaaaaaaggguugguugguagugguggcuaaacauuucuuuguugaaaagagcuuugaugugguaaguuaauguaugcacuauucauguaauauacauuagaauuaaaaguuuauuguuaauaucacagaaaaugauguaaaugcuuaaagauguaggucaaugguggaaugcuugccuaccacacaacccuaggguuugauaaucugcaucuccaaaagauaaacuaugccagcucauaauuuaacuguaaaugacaacuauauacucuuuuuguuaguaaaauuggcauguaggauuaacuucugacauaagaaucuaagguuggcaauauugccaguugcuacuuaccuguauauauuuaccugagcuuccuguaucagguccucuuuagaauaaggugagcuauuaauaaauauauuuucccaucagcuguauuuauuuuauugucguugagagaagguuucagguaacaguuggcaacaaguucacuuuauagcauaggaugaccuagaacuuaugauccuccugccuucuccaccacccaacuguuggcaguacagggaagugccaccacaccugcuuuauaugauugauuucaggcccuucuguaugcaggacuguaagcacugagcagcggcacucuuuacccugccccccccucaucaagcauauuuuaaugauguaucugauaacauugcuagaguuaaaaauacaggaaugccaaacaugcucuuauauuuucuuucaguccugagaaauuggauguugaaacaguuaugaguauugauuguuugaaacagaaaauuccuccuucauucuuuuauaaagacacauaugugggucccaaugaagguaaagaaauuaaauuucauuuauugaaauauguaagaagcagaccugauuuuauauuuuacuguguauuuuuucuuugucucaguuuuaaagaauggaauguauuguagccuuuaugaaguuguagaaaagacaagaauuggaaguaauauggaauguuuacugcaaaaacuggagaaagaaaaacuugugagugaaaaguuuuaaauauucccauuauuccuugaaaauauauuauuauuauuauuauuauuauuauuauuauuuuugguuuuucgagucaggguuucucuguauagcccuggcuguccuggaacucacucuguagaccaggcuggccucaagcucagaaauccgccugccucugccuccugagugcugggauuaaaggugugcgccaccacgccuggcuccgaaaauauguuauuauuaauguuuuaauuuauucuuuuggaauuccuacacagucucuauuggaugcucucauuuaguuaguaguauuuuauuauuaguaguagaaguaguacuuuuuuacuuuggagauggguucuuguuauguagucuuaucugaccuggaguuugcuauguaaagcagguauaguaagauauaguauucuuuuuacccaggaccguagacuuuauuuagacccauuuuuauuauacauugugauuauaaauguuguaugauuaucaaaaauauuuauggaauacugaaugagacagacuuugaacaguuauuuaaauauaguuugauagaggagaaaaaguagcuuugcuucugaaaauuuguuuuuauuuuauguguguguuccuguauguaugugcccugucaucucucucuaugucugucauagagagaauuaauuacagauucaaaagaacaagacauuugaagaauguuuaagagauacaagaacuaucagggaggaaguauuaaggaguuauuucauucagugccuuuaagccaguauuagugugggaauuggauuuuguccugagaaugguagauuuucaggaaauagagagaguggggaucaggacuugaauauguauacaaucucucucucucucuuucuuaacaauaucuuuuuuuuuaaacauuuaccuuguaccuucuccaaaauuggccauauaauuggucacaaaacaggccucaacacaugacaagaagauugaaacaaucucaugcacccuaucagaucaccacggccuaaggcuggucuuaaauaccaacagaaaaacggaaaacacacauacacaugaaagcugaacagcgcucuacucaaugauaacuuggucaaggaagaaauaaagaaagaaauuaaaggcuuuuuagaauuuagugaaaauaaagacacaucauaccaaaacuuaugggacacaaugaaaacagugguaggaggaaaacuuauaguucuaagugccuccaaaaagaaacugaagagagcuuauaauagcagcuugucagcacaccugaaagcucuagaacaaaaagaagcaaauauacccaagaggaauagaaagcaaaauaaucaaaccaaauagaaacaaaaagaacuauacaaagaaucaacaaaaccaggaguucuuugagaaaaucaauaagauagauaaacuagacuaaccagagggcacauagacaaguauccaaauuaauaaaacucagaaauggcaagggagacauaacaaggaaauauauauuaaaauaacuguucuguuuuuugaauaucaacaguugaaaauauuaaaaucauguucuauaaaaaaaccaacacagaucauaacuacuucuaauuucucuauaaagaaagguucauuguuuucauguuguguaggaaacugcaucuuuuuuuuuuuuuucaauuuuuuauuagguauauacuucauuuacauuucaaaugcuauccugaaagucuccuauacccauucccccugcuccccuacccaccgacucccacuucuuggcccugguguuccccuguacuggggcauauaaaguuuucaagaccaaggggccucucuucccaaugaaggccgaguaggccaucuucugcuacauaugcagcuagagacaggaacucugggguuacugguuaguucauaauguuguuccaccuauaggguugcagaccccuucaccuccuuggguacuuucuucucuagcuccuccauugggggcccuguguuccaaccaauagcugacugugagcauccacuucugugcuugccaggcacuggcauagccaaacaagagacagcuacaucacaguccuuucagcaaaaucuugcugguguaugcaauagugucuguuuggugacugauuaugggauggacccccagguggggcagucucuggaugguccauccuuucaucucagcuccaaacuuugucucuguaacuccuuucauggguguuuuguucccaguucuaagaaggggcgaaaugugcacauuuuggucuucguucuucuugaguuucauguguuuugcaaauuguaucuuggguauucuaaguuucugggcuaauaaccacuuaucaaugagugcauaucaugugaguucuuuugugauugggcuaccucacucaggaugauacccuccagaucuauccauuugccuaggaauuucauaaauucauuguuuuuaauagcuguguuaaauguaccacauuuucuguauccauuccucuguugagggacaucuggguucuuuccagcuucuggcuauuauaaauaaggcugcuaugaacauaguggagcaucuguucuuauuaccaguuagaacaucuucuggauauaugcccaggagagguauugcuggauccucugguaguacuauguccaauuuucugaggaacugccagacugauuuccagggugguuguacaaacuugcaaucccaccaacaauggaggaguguuccucuuucuccacauccuagccagcaucugcugucacaugaauuuuugaucuuagccauucugacugguaugagguggaaucucaggguuguuuugauuugcauuucccugaugauuacggauguugaacauuuuuucaggugcuucuuugccauucgguauuccucaggugagaauucuuuguucuguucugagccccauuuuuuaaugggguuauuugguuuucuggaguccaccuucuugaguucuuuauauauauuggauauuagucccuaucugauuuaggauugguaaagauccuuucccaaucuguugguggccuuuuugucuuauugacagugucuuuugccuuacagaagcuuugcaauuuuaugaggucccauuugucaauucucgauauuaacugagauaacaugauaacugccaguugugccagcaccauuuguugaaaaugcuguuuuuuucccacugaaugguuuuagcucccuugucaaagaucaagugaccgaccauagguguguggguucauuucugggucuucaauucuauuccauuggucuacuugucuguugcuauaccaguaccaugcaguuuuuaaucacaauuccucuuuagguuaggcauggugauuccaccagagauucuuuuauugagaagaguuuuugcuauccuagguuuuuuguuauuccagaugaauuugcaaauugcccuuucuaauucguugaagaacugaguuggaauuuugauggggauugcauugaaucuguagauugcuuuuggcacaauagccauuuucacuauauugauccugccaauccaugagcaugggagaucuuuccaucuucugagaucuucuuugauuucuuucuucagagacuugaaguucuuaucuugucuagucccugauuucuagugggauugcuuccagcuucucaccauuuacuuugauguuggcuacugguuugcuguagauugcuuuuauuauguuuagguaugggccuugaauuccugaucuuuccaagacuuuuaucaugaauggguguuggauuuugucaaaugcuuucucagcaucuaacgagaugcucuuuugguuuuuguuuauauaguggauuauguugauggauuucuguauauuaaaccaucccugcaucccugggauuaagccuacuuggucaugauggaugaucguuuugauguguucuuggauucgguuugcaagguuuauugaguauuuuugcaucgauauucauaaggggaauuggucuaaaguucucuaucuuuguugagucuuuaugugguuuagguaucagaguaauuguggcaucauagaaugaauuggguagaguaccuucuguuucuauuuuguggaauaguuugaggagaacuggaauuaggucuucuuugaaggucugauagaauucugcacuaaacccaucugguccugggcuuuuuuuuugguugggagacuauuaaugacugcuucuauuucuuuaggggauauaggacuauuuaggucauuaaucugauucugauuuaacuuugguaccugguaucugucuagaaauuuguccauuucauccagguuuuccaguuuuguugaguauagccuuuuguagaaggaucugaugguguuuuggauuuccucaggaucuguuguuaugucucccuuuucauuuaugauuuuguuaauuaggaugcugucccugugcccucuagugagucuggcuaaggguuuaucuaucuuguugauggaaacugcaucuuuuaaaagguaaauauucauuguauauacacuugaguaauuuuggaaguuuaacucuaaagaucauuuaaauauguuauucuaauauauacauaaauauauuucugaaauuuuauagaacugaagaucccuaaagaauuaugcauuacuuuaaugaaaauccuuaaguucaaaauguauuaaaaauuggaaugacugaauguuauuuauuuuuaauaucuuuucuauauugcuuuaaggcaccuauaucuacauuacuuaaacuauuuuaguauauucacauuuguggaauggaauauuuuauuauucuaaucuauuuacccaaugcuaaugauaaugauuaguguguuuucagagucucuuauuuaguguguuuuuccaauuuguagcuccugggcugcugucauuuguaaaauaguagauuucuaugauaugauaccuuaaacuacccaugugagcuacucauuguuuccucagcauguuuaaaaauucacaacccuuucuacuuugaaacuuucaaagaccucucacaucugccacacauuaauccuuccaguucuaugcuuauauggacauucuucauuuguuuguacaagcauuaaaauucuuaucaaugcccugaaaaaaauuuaaacauuuaccuugguuacuaauaagucaaagauguauuggguaauaguccauuaaaggguagugguagauucaaugagaaaucauaauagugagacugaaauggauguugacucgguaguauccagugcaguacagagagaauaccuaguuuugguagagucagguuagaugucagauugugauuggagagugaauauauaguugcaguguguaugguauagcugaaugagaaauagguucagagaaggaaauugcuucuuuucaugagaaaugaauguggucagcuaucaaguuucuauagauauguagaacuuuuauuuuaauaguggguuaaaaauuuaauacaaguuuucaacagagaauauuauuuuccucacauggagccuugauuucuagguaaucaaauggagauuuuugucaguaauuuucagagcuugcaacuucauuuaaaauggguauauagagcuucaucagguacauacauauggauuuaaucagucucuggcauaauuauaucugagauagauuauauuugaaaccuauauuacaauauuaaacaauuuuugcccugaguauagaaguacuuggcauagguaucuuguagugauaucagucuuuucuuccuuguaaguauaaauacacuuuucgugauugguugguuuguuuucugagauggagucucauauaacuugggauacuauaaagcaaggauagccuugaauuccugacccucuugccuauaucuccagaguacuggaauugcaguaauccaccacuacuaacacuuguggauuuuauugugaauauaccuuuauauuuagaucucuuacuugccucugaaugcccaauguaauuacucuucauaaugaaaauucuauucuauuccuaguugagaaagugaaaaaaaaauuuuuuuuuucaaaugauugcugccuuucaggaguccagagcagugggcuuauguuaguaguugccuuucuaggccauugguuuuuuuuuuguuuuguuuuuuuuguuuuguuuuguuuuuuguuuuuuuuuuuuuuacacuguagcugucuucagacacuccagaagagggcaucagaucucauuacggaugguugugagccaccaugugguugcugggauuugaacuucgaaccuucggaagagcagucgggugcucuuagccacugagccaucucaccagcccgagaaagugaaauuuuaaauaguagguuuggguauauagagauacuguguuucagaagcuaacuauuuagaguuuguacaguaagagguuaugguaucuguucaguuccuuaaaaauuacaagucaggauaggaaagaugacuguuugggcuucaccuaaacaaguguguuaggguuuggaagaccaggucuucguagaauuguuauggucuuaaagggacaguggcaacccucaaggaccugcuacuauucaaugauugcuguauucugauagucagacuuuugcagucauuuaucagucuuguaaauguaaauaguauuuuacugguuuuuuuguuuuguuuuguuuuuuaagcuugugggguuuuugguuuuuuugugacaggguuucucuuacuauaaccuugacuuuucaagagaacuuacuguguaacccaguaaacucucagagaugugucuguuucugccucccgaguucugugauuaaauguuuacacugcuacucucagucccaugauuauuugaaauuaaaaaaauaaguagguaaaccaguggugguggugguagugguggugguggucguuguguaugccauuaaagcccagugcucaguagacagaggcaugcagaucucugaguuugaggccagccuggucuacacagugaguucuaggacagccagggccacacagagaaacccugucuaaaaauaaaacaaagcaaaacagccccacaauaaauaaauaaaugauguuuuaguuagaauuuuacugcugugaaagauuccaugaucaaggcagcucuuagaaaggacaacauuuaauugggacugacuuacaguucagagguucagucuaguaucauuagggugggaguggggagcaggcauggugcaggaggagcugagaguucucaagggcaccccaacuccaacaaagccacaccuccuaagaguaccacucccuaggccaagcauauucaaaccaccacaaacaauaaaauauauuuuguaaauuaguuucuauuaaugccuugcacccauuacucacuuuucccuauauuuuucuugagaggcuuguauuuuuuugcuaauuuaaacuuugucuuuauucuuucauuguguaacacagggcucaaacuucaugccucaaacuauguagauaacucccuaagucauuuauugaauaauccauauuuauuauuuucuguguguaaguguacauguguugcuggauguugaauccuaggcuuugaguucuagcaaauacuuugcuucuuagcuauaucuguagccacauuuaaguucaauuucuccuaugugugaaaaugaucugccugucucugcccccugaguccugguauuaauggugugagcuacuacccagcacauaacuaaaacuaaucuugaaacuauguucccugaacuauuuuuuuuccuuuaaagauuuauuuauuuauuauauauaaguacacuguaguugucuucagauacaccagaagagggcaucagaucucauuacagauagugguugcugggauuugaacucaggaccucuggaagagcagucagugcucuuaaccacagcgucaucucuccagccuccucccugaacuauucuugaaacucugccuugaucuccuaagugcauaaccacuccugccuguggauuuaguguucacuguuuuuucuuuuuuuuuuuuuaacuuugauauagaaauguguauuuuaauuuguaaauguaugauaacacuuuugcuuucuuauucuaauuuaauugcauuguaaucugaauugauguuaguuugauguuuguuuggacuuauguccuauguguuuaguuuuuuaaugcauccucucuucauaaguauauauuccauaauuguuaaauuuuagcuugacaaauuuuauuuauuuuagaaaagaaaagaguuuacuaagcacauuuuuuuuuuauuuguucugagauaugguuuuucuaugcaacucuggcuggacuggaacucauuaugcaaacccaggcuagccuugaacucaguggugaucucuuccugcuucugguuaccaaagacugugauuaguaggguaccgguuuuaauauggauacaaguaugagauucuugucuuucagauucagcucuuagucuucaguauuuuuuguugguagguugaccccuaaccccuugugccgaacauggaauuuaggaauucauauguguuaaaccacuucuccuacaaagcuauaauucccagcucuuucuuuuuauauuuugaagaaggaacuaucagagauucccagucuaaccugcagcuugugaucuuaucucagccucccaaguagcugagguuauaggccugugccaccagaccuggcugucuguguauauuugugugcacaugucugaugcucauggaggccagauaaaaagugcauuggaacccccaagaaccuccauuugugaauacuaggaaccaaacccugguccucugcaaaagaagcaaauacccuuacugggcaauguuggcgcauggcuuugaucccagcacucugaaggcagaggcagguggaucucuugaguucaaggaccccuuggucuacagagugagcuccaggacaaccagagcuacacagagaaacccugacuugaaaaacaaacaaacaaaaaaagcaaguacucuuaacuguugaaccaucucuccugcuccugcuuuguaaaucuaucacuuugccauagugaagaguuuuaaucuaaccuaguaguauucucuauacuuaguagaaagugugucucuuuaaaaguaguaguaauaauaagguauauguaacuucugucuccccaaacuacagguucuuguuaaaccuuuaggggaauguuucuguuuuuuguaauuucugguauuuuguauguuacuuucuccacauaguuaaaagguccuuauacuauuuaucuuucaggucaucucuugacagguaaaauuauguaaugugaauaauacuuauuaaauaacuauaagauuaaauuuuggcagcauauuucauugaacauuauuugaauuuucauaggcaguuauuucaaagccugcuuuauacccaguguccagcauacugccuugcaaauaaugccuuuugugcuaaugagaaauaaguuucuauauuuaacaucaaguuauuuuucacagauaauuauaauuauuucaaaaacauucucaguauauuauaaauaauaaguucucacuugauugcaaucuuuagcaguuaguuuuggugguuuuaauguuauuuucuuuugccauagugaagaguuuuaaucuaaccuaguaguauucucuauacuuaguagaaagugugucucuuuaaaaguaguaguaauaauaagguauauguaacuucugucuccccaaacuacagguucuuguuaaaccuuuaggagaccgaggauaccuuuuucuucuuucuccuuuccagaugguuucuccauaugguagguagucuggcuuuaauuuuuacaguuaagaaaaaaaaaguuaaaauauuuugaugaugaauuuggcuuuuguucccccuuuuuagaacaucagacugucaagucacgaauccuacaugcuuuauuucuguuucaagaaccuagaugccuaauuaucaguaaguuguuuuuuaaugucgaaguaugcuugcugguagacaguuauugaaaucuuuucaguaaggcaacauucuuucucuucuacaacuuacuuuuggaaauacugggauuauuuuuguggaaucaguaauauaaaacaugacuuugauauguucccucucuccauuuuuuuguaugcuguuacuccugguuucgaaguuuuauucuuuuuguuguugauguuguuuuuucuucaagacuggguuucucuguguagcccuggcuguccuggaacucacuuuguagaccaggcuggccucgaacucagaaauccgccugccucugccucccgagcgcugggauuaaaggcgugcgccaccacuaccugcucugaaguuuuauucuuaauggugacaauuugguuugguuuggcuuuuuugagugcuuuaauuagugauguuugauuauaauuguuucuguacugaagcucauuaagaguuuuauguggcacaauuuucuuuuauucauuugugcauucaagucuuagugauuuuaaaguaucauauacgauauuuagcaugaggccuuucagaguuaacuagaauuugggauauuuauguuagagaagauuuugcuguuucucuucuaacaguaaacauguuauaccuggagcagguacaacuguagcuacucgaugcguggaugugugcuuauggggaaauguguuuaaaguuaaagaaaagaaugacuuuauuauuagcaaacugauacugcuccuccacccccacuccuugcaauuuacuugcuaccauuuguguuaaaugugggugaaagaagugaagaugauuagcgaguggauuucuuuccguuaaagcugucuucuccccuugcacuuguguugguuccuggccugucuuaagcagacgcguauugcucaucuguuugcugugcugugugugucagaggccggcgcucacuggcucugcauucaaguucagauguuguuauacuucaguaauacacacauuuguuuuuuauuaguuuccuuauugcuaauauaguuuauucuuuugguuuuuuuuguuuugcagcacaaaaagguauaaugaauacaacaccacuggagaagccugagaacuuagcagauauauuaaaaauaacucaguuuuuacaguuuucucugauucaauguagaaaagaauucaaaacuauaaacacuauaaauuuucauucuguuguugaaaaguauguaagugaauuuuuuaagcgagguuuugguucggguaagcgagaguuuuuuauguuuucauaugauucacgauuagaugauagaaaauuccuauacucagcaccaagaaauaaaucccauauugaugacugcuuacauaccuacauuuaccagccagaaauguaucaguugucuauuuuuaaauuaaaagaguuauuugaggaaaauuggagacgccagcaguuuaguccacugucagauuaugaaggucaagaagaagaacugaaugguucaaaaaugaaauuuggaaaacggaauaauucaagggaugaaacuacugaaccugaacagcagaagucgucucauucuuuggauuaugauaaagauagagucaaagaguugauuaauuuaauucaguguacaaaaaaaaauguggguggagauccagauccagaagauacaaaaagcaaaaaugucuugaagaggaagcuugaagaucuaccugaaaauaugagaaaguuugccaaaacaaguaauucaacugaaaguugccaucuauaugaagguaaaaugauacccugcuuuuauuacaaaagccaaaacucaugaccuugguucuguucuucccauguuagagauauucagauuacuaagccuaagagccaaaaccagaauuguccgggguauuugguuagguucagauuuuaugucccccccaacccccauauuuuuuaauuugcugcaggguuucacacuggagcucugacuggccuggguucucaucacuuuuccuuccucagcuucccagagugcacagugaaagacgugguugguugacuuuugaaguuuuuacaguuuauuaauccuaaccuuagaaauauuacauugucacagcagggaagucauugcaguggcuuuauacuuucuccugauauccacuccagcuuacucuuuugcuaguacuaacauuaaccuuugcaguuugccaacuuuccauuuucuuucuagucauauauuccuuuggcuaucugcuugugguccuuuucuuuuacaacaaguuaugcucuucaaguguauguuaggccucagauuuucuuuguacaauccaagaaaauguaaaccauccucaauuuaguuaguugccuugccaccgccaaaauggguucugaauccgaauacaaggcucugguuugguuuuguauauuucauguuucuugaauuucuucuauucuauucuauucuauucuauucuauucuauucuauucuaaauaaaugacuuuaauagucauuuauuucuuuugaugaaguauuugguuggucauaaacuucuggucuaguuauuuacuauguuguuugugaugaugacaaugccucaagcagaucaagaauaaaaagugaugucuccuguuuuuauaaagaaaauuaugauaaaauacaaucguggccauucauuucuguguauauaccuacuuucauacugagauggcaaaauuacagcaaagauugugcauggcccaugauauuuaaaauauuuacagucugaucuuacauagaaaaacauuuacucugguaugccauauugcugaauugcuuaguuuggacuaauacgauaaaguguacucaucacuuuuaaucagagcuugaaguuagcuccuauacuuuaaauuuuguuuaugcagugagagauguuuguuugauuauuuuaggcuauugcuuaaugaauggacccuuauaaauuaaaauuaaauuucuucuauucaggcauacaauuccuguuguugcuuuguuguguacuuuucaguugauagaaaugagagcuuugucauaauguauuuaaguauuccaaguaaguuaaauauucacauaguguuuuaacaauuuuauacuggcuaguuuagaagcaugaaaugcgaguuugaaguuuuguguucaggaaucuuugcuguaguaauucacauucuuccauuguuuauuggacaguuuuacuucucugcuuuucuaaugcguuuguuucguacuagguuggacagauuaauguccuugcuuuauuauuuacuuuuaugcucugauugaaccaaaagccuugcucaugcuagauaagcgcucaucaaaucacuucucuuuuuuugaagcaauuuccacuaaguuacccagauuggcuuuuaacucauuccuuaguccaacuucuuauccucuugccuuggcuucccaaguauuugggacagguguaugucaccagacguggaaccuuuauuuuuaauucugaauuaucuaugugguagucguuacgugauaucuucuaauuuuaaauuaauuaagaugaaauaaaaauacauuucaccagcuguacaacuauauuagaacauaaagaaaggaacgcuuaaccauuacagaaaguucuauuugacugugcugcuguuuuauguaacuuucaaggcuuuuugaaaauuugauuuaggucuuuuuacuuucagugucuaugucuuagcucuuuugugaccuuccugguuuuuagauuuccuuaaucauuucagaauccucucuguuuuaacuuaagauaaauuucauuuucaguauuuggcuuuucaagacucuuucagaguaauaagggucuggccaugauuauugcucuuccauguucuucagauuuucagaaacaguuacaguaaaggucauaaauacauuuagucccuauccauaaaugucuuacaagugacuuuuaaguuacauuugauuuuuauaauauauuacauuuuguuauccugucauagauugaguauacuggcuuuuaaaauagaagagaacuuuucuuuguuuuccucagaaucuccacaguccauuggcuuacuuggacaggauccuaacuugagagugcagcaggaagauuccgggaacacuggggacauccacaagcuuuauaauuggcuaucggaagcacuagcaaaugcacgacacucagacggauuccugaccgagacagucaacaaggcuuuaggauugaguaguaguggugccuaugaagagcugaagcaaaaaugugauuaugaguugaacucuacuuuagauaaaaaagaaucugagcagccugcuuguacaaaaauugaaaaugugcauuuuaaggaugcucagagcccauugcuagaaguggaugcagcaucuguaaaguauccuccucuucugucuagcagugagguaggcauuaaccauaagcuacauuguaaaguguaaacagccuacuagcuauuguguguccucaagaggguuuagguguacuucagggagugcauuuuccuucccaaaagaacaaaggcauacuccuaaguagagguguuuguccggagggggauucuaagcuacucuuguugaaaaaaggguaaauacugaaguaauuguuuccuauaugcuugugugcuuuauauaaucuaaaguuuaacuauuacccuaaaacuaggacuagauugucagauuagcauagcaggaguuaauuuuauacuguuuuguaaagaaacaaguccuagagauccuggcuguuucgugcuuuaacagaaucaagaugaguuagaugaagcaacuuaacuuuguuacauaguguucuaaguuagguguucuguauugugcaaauacaaaugaauagauagccuuuggaauuaucuuugagguaauucuuaguuuugcuuacuaaggaauugaguuuguuguguaugguuugugcuuuguagacaaaucauuuccuguauuagucuuucuuaaacgaguagcugaaucauugaggaauaauacaagaugcacuauauucuuaagaguucauagcuaauuuauucuugugccuuugaaaaaaaguuauguaugcaugucucagccuuucuguauguaguuuguggauauccuaaggagaagcuggugguaggagguuuaugugguaggcagugaaauguuaaguuguacuguuaguauuucucaguguauuuaaugagagugugggccaagcauugccugcuuccuguuuguguaacuauagcauuuauuccuacuuauuuaagcacugucuguugguauuuuuuaauuacaauaagaaagauauugcauauaaaauuuaaaauauaagaguuuaccaguuaacugcuuuaaaucaacaccaguuuuacauuguauguauuacuuuaaagacuuauuuauuuauuuuauucauaugaguguuuugccuacaugucgauauauguaccacaugccccccuggugcacucugagagcaguagaacugucagauccuuuggaauaacuagaauuaagauguugugagcugcugugugggugcugggaauugaacccuugucuucugugagaaguccuuuauugcuaaacccucucucuagcucuaaaauaaucuuuuuauaaccuuuuuuuuuuaaacuguauuuuaauuuuguguauaugugugacauucagaggauaacuugaaauuucaugcuguuuuuuuuuuuuuuuucauugugugaauccugaagaaagcuccuucaggucaccaggcuugguggcaagugccuuuauccacaaagccaucuugccaggcuccagauaaccuuuaaggauaauauauauuguuuauuuuguucauuuauuggaaggaaguguguguuuguuuaugacaggguuuuacucugaaccuguggcuugccuauaacucauuauaugguugaucauuauaugaucauacuuuugaucauucugcuuugccuuuugauccugauuauaggcaaacacuauuauuucuggcuuuggcaaaauauauuuuaaugugaagcuagaguauuacaaccuuaccauguugcuuuuacucauuuguaacauguagucugaaguuugaacaucugcugugaggaaguaguauggucucgacauuaaaauuaaaaggaaaacuauuaaauguauguacuuuuauuucuaggauccgaauuuaauuaaugucaauaauuuugaagggugcagucucugucccacgguuucuauugagcauggauuccuuagacaacauucuaagucaaaugaugaugaagagacagaaauacauuggaaauugauuccaauuacagguaaggagcaguaacucauuuggugauagguuugcuuccuuuuacuuaaggaccaguuucucggagaguuucaucuuuucuagauuccagucuugggucaugagguaccuaucuuacuuggcucugccgugagucuuuauuuugaacaauauauugcguaucacuauucuuuauugacauaagcaaguaucugcaaaggggucuauuaacauagggauuauuuagggcauaguuacucuuguggacuugagcgggauauuaucaauugaaaacuguugacagcaauuuggagaaggagguguuggaaugaagugaugcuguuuggguagccauuacuuuucaacucacuaaccuaaacuuuacuucaacaagcucucuguuaucuagaguauggucauguugaggcucaucugugugaaggaagguugguuuccuagugauugauucuggagcacagccugaaaagaccaaaugcaaauaaccaacuaaagcuaucgaaccccuggugguugacaguuguugaaagauugucauuuguaauauuuuuucuuguccaugcacacacacuacaugcucuuaauauuccaacuucuuauucauguuugcuaguucaauauauuuggaauuguuuucugggcacaucuuuucuauuccuguaccuuuauuuagcuuuuggaaagaaaucgaaggaagaaugacuugcugaaaaguaaauggcuugugaccuacaaucuaugagaccuauagggagucugagaagaauuucuaaaacucgaugaguuuccgugggcuucagcacuucauaccucuguacuucauaccuuacuggagaaggcaagagacccuagaccugaugcuagagagggaauuacuacucuuuuaugaaauuggaggcauagugauacuugaaaaucaaauagaaaauaguuuguagguggugguuaucuuaaucuuucugcauuuaaacaccuucauaauuguuguugaguugcuuaagaaggaauauagcuguugaucuucgacaucaccugaguggaaagggaaacaacuucccauuuccaaaugaccuaucaaaaauguuuaggcaaaaaaaggaauauuccuuuguuagcauuugugguugucugaaaggugccuaaugggcgucacugguaucugaagagagacuacaaaucuaauggaugcuuuccucaggagggaaugcaggaagcccagaagaccagcaugggaaacauggugagaaacaaacaccaggugagaaggcccacuuugcuuuucuucccaaugugcccuucuucggaauugcuaguugcauucugguucuucaaguagggcauggauugacuuugugcuccauacagagaaaucuaggcaagauuucuuaacuauuauuuuuaaauuauucacuuaauuguaucacauguuuuuguuacacacauaaucuguguucuugucuaucugaucgggugacuuaggaaaaugaaaauguuuuucuuaauguguuucuucagauagucuauaagagccaaucuuuauuuuuuuuauuuuuuauuuuuuuuguuuuuucgagacaggguuucucuguguagcccuggcuguccuggagcucacuuuguagaccaggcuggccucgaacucagaaauccaccugccucugccucccgagugcugggauuaaaggcgugcaccaccucacccggcuccaaucuuuauuuuuaauaacagaauguaaaaaccauuucuuuuccuuuucauacucuguugauaaucuugaaaauuuuuuggccuacuuuuuaaguguaaagcuaacuccuacagaugguuuaugagauugaauaccauuuccaguagcaaaaggaauacugauuagcuacuugcaguagauacaaagaugauagauagucucccuuguuugacugaacucaguucuacuucauuguguguguuuguggcauuuucuugacugagauugauagugaucuauuuaaauguuuccauuuguuuuaauaccuuacucuuuaagaaauccuaugggccuuuuuguuauuuuaauuuaggaagaaaguuacaugauguuuuguuguaagacguuuuagagaagucugagguuuuuuuaauuuauaaguaaagcuuucuuuauaaacuaacucuucucauaauuuucuucaagaagaucuuuaucucuuuggaaagaugacuuauuuuugaaaauacaugauguaauaaaguacacaaaugcucaguaaugcucauauagguauaaacuguaugacugcuacccaagacaagauguacaacagucccaggacccuucuguauuuucuucuauauuuucuugugucaugauaucuccauucacaauugauggccacuaaucucacuuucuuuaccauauuuuaauuuuuugucuugauaaguugaauccacucaugccuguuuggcucuuucauucaacuuuaugucaagguuucaucuaugcuguguauugccaguaauucuuuguagaagaaacaguuaccuuguuugaacuuaauaauguucuuuagacauacgcguuucuuuuccuugggacacuguauuuauauuuuuuaugaaaguuagaucuaagggauauugucguaugagaaauaaugcauucucuucacauguuaaaagucacaugacugguacuuugucaacacguugucaacaaucaguaaaauaacaggcauuauagacauugaccucuguuaaaucauuuauugaugaagaugugcuuuuaauugauaaagaugagcuuuuuaaaacauguucuuaaaaucauuuggaguaauuuauuuaaaauaaaauugaaugauguuuauucauaauuuaaagaaauuuauuuugcuuuauuuaauaaagugacuuguggguguguauuggguaugaggaguacauuugacuauuuuagaugugaauacauauauauggaggccagaggaaaacauugguuucuuuauugcuuuaaagacagggucuucacugaaccagaagcuugcccuuuaaguuagucugguuugccagcaagucccugagguuccccucucucaaccccacaguguaacaggcaugugcauccauaccuagccuuuaacauuuuuuccuggagauuugaacugugguccuaauguuugcauaauaggugccuuuccccacugauuaucccucuaaaauuguuaaaauaaaguuauuauuauuguuacuacuaaggguuucccaguguaaccugucuuugaacuaggugugcagauuaggcuggccuugaacucacagauuugccuaccucugccucccaagugcuaagauuaaagaugugugcuccauuccuggcuugccccuagaaauucuuaauauggaaaauuuuacauagguguuuaaguuacauuuaauuuuuuaaaaaaagaugcuuaaaacucauaucuugauaauguccccccacccccagugguaugauggcuuaagccuagcucuuauuucaaacauacguuaaagacaaguauauugucaugaaauaaauguauugaaaacuaccuauauuuuaaaaacuuuuauuauuuuaaucaaaauaguugcucucaguuuaucuaguacucaggacgcuggggcaggaauauuuaugaguucaaagcuacccugaccccaccucauaaaaacaaaagggaauugggaguguguguuaaacaacaacaacaacaacaaaaagaaguauguuuacuuugcccucaauaggucaaucauugguuaccaacuucuuauauaucugucuauauauuuuauaugcauuuuaaacuacauuuguaaguuaaaguguagaacauucaguauuucucagucuuaaagaacuugagcuuuauauuucauauaguuuuaauuguugacauauuggguauuuuacuuucuuguuuagacauuuguaccugcuguucuugcucuguaaguguuuuugcaguaacugaaugcagugguaaugacauugaaaaaagugcaaguauggggauaauaaaaauggaauuuuuuuuguagaaagaaugcacagcuacaucugagcauaaacuuggauuguaaauucacuguagguacuauagguuugaaaauuuauaaauguacuuucugauuuagagucaccauuuucuauauuacaguagugauauauuaggaaaucauguuagcuaagacuuaaggaaauuguuuuucauuuuucaaucuuauaauuguguugauaaauuuuuaggcaaagaucuugacuuauuucuaaaacuauacuacuaugaauuaauguuaaauauaguuuccucuuauauuuaaaaacagacuuggggugcuuguuuugaaaaguaguguuaaaaacuuaaucauuuuuaaauuuaagguuuguggagaaaacaacaguaugaucucaucagaaguuguagucucauuacuguuggguuaaacaaagacuuuguaaucuaagauuccugguagcuguacuguuucuuauggaauuacuucaaauuaaaugccaauacuugagggcauuaucaaagguacuacucaaugcaguugugaaauauggucaauuccuuuuuuguugagccuuucuuuccugacagaaugagucugauccguuagccaaccuacaugugagggccagccuaaaaauagguaguuaauuuucuaagauguuaaaugcugcaauauuucuguugggcuuucuuccaguugccuuagacucauucuuacacugacaugucacugucuugauugggugugcaauauagcaguguaauaguuugcuaauaucagguggauagaaugguaggaaaacaaaaaguagaagugacuuaccauuuguuuaugccagucaggcgcuggugggguuuuguuuuuguuuuuguuuuuguuguuuuuaaacuuuuuuuuuuuuuuugguuauucgagacaggguuucucuguguagcccuggcuguccuggaacucacuuuguagaccaggcuggccucaaacccagaaaucaaccugccucugccucccaagugcugggauuaaauaaaccuuuuuaaaaagaggcacuuuagaacacuuggaagaaccuuucagugcuguuacugaaauccaaagcguagccuauaaguagagcagauaggacauaggguuuacacaguuuauugagguauuaaauuuacuuugcaguggauauuuuuaaauauauaccugagcugacguguuuuuaacugaguuuuuuuguuuuuuuuuuuuaaugcuacucauuuggauugcucuuuuaauaaacucuucuuguauaggaaugaaaucaccaggagaacagcuggugugccugccaccaguggaggccuuuccuaaugauccccgggucaucaauagagaaagaagcugugauuaccaguucccauccucuccgucuacagacacucuaaaaggcacuaccgaggaggacacuguaacagcaggucaggcgauggcaguggaagagcagugugugccagcagcagagcuuccuagagugagcgagauuacagaaaauacaguguuaggagaguuccaucuuuucucuaggaagguagaagagauuuugaaggagaagaauguuucauauguuagugcaauuuccacaccuaucuuuucagcacaagagaagaugaaucgccuuucugaguucauacauucuaauacuucuaaagcugguguugaggaauuuguagaugguuugcaugaaaaacuaaauacuguuguuauuacagcaucagcuaagggugugaguuugccgccagcaguuagcgcuaaucauucccaugcugcagcagcauuggcuucucugggaaggcguguugugucaauuuccucaagugacuucagugcuaaagaacuuuuugagccgcucuguucugaacauuuaaaagauaacaacucuaaugaacaguauuccucuucaguggaaguagaaaugaaucggccacaccauugcaaagaguuaauguugacuucugaucacacuguaccuggugauacaguccuggaacccacagaaaaagaaauaacaaaaucacccagugauauaaccauuucugcacaaccagcacuuucaaauuuuauaagccaguuagaaccugaaguauuuaauaguuugguuaaaaucaugaaagacguccagaaaaauacugugaaguuuuacauucacgaagaagaggagagugugcuuugcaaagaaauaaagguaacuaaugagaagguaaucauacugcuauauauacucaauggucugaacucugcaaaauugaauuuuaaagguggccauaauauacuuucugaauuuaguaauucauaauugaauaauagcagugcauugaacuaaacauagaaccuaugaucucaguauugugguaucagacuuuuuuuguuuguuuguuuaauuuuaaauuguuuggauauauaaguauaagggccuccuggggcuguagcuaaguaaguuugauuccccacucucauggggauaagaaaccucugaucacacuguaaguuuacuuuaauuuaaaaaaaaacauuuaaaaguuauuauuauuauuauuacuauuauagggcacuauauggugcauguauggaaguccuaagauaauuugcgagaaucaauucucaucccuaauuaggcccuggggaauaauuaacucauguaguuaggcuugguagcaaguacuuuuaccugcagaaccaucuugcuagcuuuugauuuagagauuuaagauaaggccauguuuacuuguuuuuuuuaugaaugacaaggaaaauuacagagagguaauuaaguucugguguucauuucauaccauuccaguggaaacaccuguccagaaaugguauaaugauauauuuauuugucauuucuuuucuuuuuuuuuuuuuuaaagguuuauuuauuuuauguaugugaguauacuuuugcucucuucagacacaccggaagaggacaucauaucccauuaaagaugguugugagccaccaugugguugcugggaauugaacucaugaccacuggaagagcagucaguguucuuaccugcuaugccaucucuccuucccuauuugucauuuuugauaucuugaccgugucagaguuuguuuguuuguuuguuuguuuuuugguuuuuucagacaggguuucucuguguagcccuggcuguccuggaacucacuuuuuagaccaggcuggccuugaacucagaaauccaccugccucugccuccugagugcugggauuaaaggcguacauacaccaccacgcccggcugugucagagcuuuaaaagaugaaaaaaugugguggucccaaaagguucccagaauuauagaauaccauuucugguauuugaucuuuggguuuugaaguaacuacuuguuccuacuuauggaauccauuuucagugacaaguuucugccuguuuuguuagaggaagcagaaggauuaaaaauaacuuaaaauaguucagaaacuuagaauuuauaacaaauguuuaauccuuuuaucuuuuauaagguaucucauguuagcuuguuugaugugguauccuggguaauacacagagaguauugaaaugaaaaaggaugcauagcacuauuguccucuucuuucguuugguuagaaagaugaaaagagacuuguuuacauaauuauccuguaugauugaauguagagcuucuuaacuuucccccacacucuagaaacauuucgaacagagaaaucugcacgcagcccauagccauguguuguuauagugguagguaagagauaagcugaacacuguucugauguguuuguuccguguaauucucccuuuuuaaagauggauuguuaaacacccacgugacaucuauauugaagagauagguaccauaauucucuauggauggaguuuugaauuauaguguguuaucauuauauacauagaguaagagauuaucgcauauaaaucuuauaaaaaaauuagauuggaacauuauuuuuuguucuuuuaaagagggucucaccauggcuauucuggaacucauauauaaaccagguuggccucaaacuuaaagagaucuaccugacccugcuucagaggugcuccuagcagggcacuuucuuuuagucaguaaucacuggaaauuuucuugcggaacuguuaggguaaaaaauuauuaauaacaauuuaaauuuuaaauguuucuuaagacuguuuuguuacuauaucaguuaaacaguaguauccagaauaaauuaugaaguuuauuuuuuguuuuuagucucuuguuuuuuuugagacaggguuucucuguguagcccuggcugucuuggaacucacucuguagaccaggcuggcccgaacucagaaaucugcgcgccucuuuccccaagugcugggauuacaguugugcaccaccacugccuggcaaaguuuuuuuuuaauauaaaaagaugacaguugccagcagcccuaucagauauuuuaccuuuuuauuaauaaacuaagguaauaugagaucuuccuaaaaauuucagaguugaaggcaaaaaucguuguggaaaaauggugcuucauacuggcuauacaaaaauguggucuugaugaguaguaaaccacuugucaagcaaccuggguuuugauuaugcuauuugaccagcucugcuacaguugagaaaauugaucuccuaugucuguggaaugaagacuguccccuccaggaucauacaguuuucuucagggcuaaggguuucaccaggaggcaaaguacaagggagcccaagggcuuacuauccacguccugugaaagguaguaguauauuaccaacauugagagaaaugcuaggugguugaggcugcuguguuugaagauauaaauuuggcagaaaugguaaaauuaguugugaauaccauugcucauacgaaaaaugucacaugaauacguuuuagaugaaaugaucuucagucauacagugcucugaaaaaguauuauaauaguauaauaauaucccaaauauuuagcuaagccagccuaaugaaagcaaacaggagacagggaguagcuaauaucagguccucuuucccaugcugggagucagucgggguauccuggguuuacuguaauaguggagguaagugggucaggaguauaacagcaauuaagcuuuauuaaauaugcuuucuaacauugugagaaugucuauucaaaccaaaccguaagaguagauacaauggccucuauggucuuuuaaaguaaaaguucauaguguccuagguaaagcuuaucaucuuacauugcauuuuucauguuaaauugauguuugcuagaaaguuuguuaauguugacuuaguuguuuuucuuuacaggaguaucuuaccaaauuaggaaauacagagugucauccggaucaguuuuuggagagaagaucaaacuuggauaaacuauugauuauuauucaaaaugaagacauugcagguuucauucacaagguagauaaaguccaguucacuauuuuguuuucuaaaacuaucucauuguuaauucugagaacaaagauuauguuuuuaagauaaagauaaauucuuaaguaccuuuccaggagccagcuugugagaauuguguauuuguaaaacuuuuaaguuacuauauguuaggaaucuucccugcuauucagauuaguuaagcugugcaggauucuuaauguagagguaaggaguguucugcuaacucuugguacuguaaucuguauuugaaugugcagacaaaccuugccucagacuggccucuuacuacuauucuugcacucuaggcuuucuuccugucucaucuuuuugagacaguauccuguauagccuagaaagguuccaacuguguagccuaggcugcccuccuaauccuucuuccucuuuaucuaguggugugauacagauaugagcaccacaccuggcuccuaggauugaaaucuguuauggguuagagauauauuagcauuuuauccauuuuguguuuucagccuaauguaaacuccuuaguauucuguuuauaaaugcuaguuuauacugugaaguaauauuuaaaauagugugugauuuuccaauacugagcaauaguauuuuuuuuaagacuuuauccuuagauaagccuauacuaaaauauauuuauuaguucauuuauccaucuuauuucugguuuuguuugguauuuaacaggugccuggcuuagugacuuuaaagaagcucccauguguuaguuuugcugguguugauagccuggaugauguuaaaaaucauacauacaacgaguuauuuguaucugguggcuuuauugugucugaugaaucaauucuaaaucuagagguugucacaauugguaagaaugaguacauuauuuuuaguacgugauuucuugggugugguugcccuagauuuucauggaaaauuaaaauuaugagauaaaaaaauguauugcuuauugugccauucauggggaacuggcuuauuucuguauuuuccugagccucugcuaccucacaaaucuucucuaucuuauauauaaaugcuuucauauaaaucuggucuguacuaccugccguggcacuuggcuuccucugguagugguauugauacuggguuguuuguagcuguuaguuuuaaguuuccccucagagcaagauaagucugugguaaauaggaaaguagauaggucuguauaaauacaaacaagcacuucuuccagaaauauuuaauacuaacuuuaaaaacugaauuucauugccucuaacagagagccuuaaaauuuuuuugacauuccuugaagaacuuaguacuccagaagggaaauggcaauggaaaauccacuguaaauuccagaagaaacuaaaggaacugggcagguaagaaaguauugaaucauuguugguuuuuaacguuguguucauacaacuuuuuuuucuuuuuccuaaauuuguggauuaugaaguuuucauaugucaacagaaaauaaauggauguaauacugaauuauuauacucucuuuaaggaagaagugguauucuuguugacaaacaauuuggugaaguccucauauaguuagaauugcuugugaucugcaugaacacaaggauuugaaaauuuccuacuuuuuuuuuacggugcuagacuggaaauguacugugagcuacaauuucaagcccuuuacaaauauugacucuuuuauaauauacauacacaauguauuuuagucauacccacuccucauccaacucuucccagggcuuuccccccuuaccauauucaaauucauguccucuuuuuuuuuuuuccccacuggaacauagccauccuaccagggcuaacauuuaguucaagaaaauugacacuucugugcuagaugccugucagcugccaguuguuccuuaccuagggauggagccuccucaguaucuuucccaccugugcuguaauuuugacuggcuugauuuugugcagguuuuggguaagcaacucuagcuguuguacauucuugagugcaacagaccuguuaaagucuaaaauacaguuuucccacaacaucuggcucuuaggauauuuuugcucccuguuuuacauaauuaguucucugagucuuggggagaaggguugugcuauagaugacauauuuaaagucauuccuuuaaaaacuaaucuguaucuguccuccaaauuagacccuauugcaauuuauuacuuuagauaccguaaccaaauagucaaggauuggucucacccugacgagaucccacuagaacagauucauauguauauaugcuuugauuucuaacaugucuggaaauuacuuccuuggaguacuaguuacaaagauccacaaacaguaugggaaguuuggcaugcuguaucugguuaguagggcugucuuuauaaucuaauuaaguauauuagauuucuaucagggagaauuuccuaagucauauuuuuuuuucuuuguggagcauguuuauguggaauacacucaaccugugcauguagaggccagagcaggacguuauucuuucuuuccaccuuaacuugacuuaagacagagggccuguuccuggaacaaaagcuacacuggcaaguuggugaggcaguugucaugaacagccuaucuucucccuugcugggaugguagacacauccagcuguguguguugggggugugaauuggguccucaugugugaagagcacgugcucuuacucacugagccauuuuuuuuuuuuagugcccaauuuuuuuuuuuuuuuuuuuguaaguuaauuuuuuuccugugagauagaccucuugcuguauaauuccagccagcugcuaucuacuuuguagacuaaacuagccucaaagucaugagcaaauccuucugccucugcuuccaaagugcuguauaggcauauaccaucaaaauuggugcuaggucacagguuuuucauugucacuaacacccacugacauucugugacagucgucaggaaauucaagguuuaauucuaguguucaguuauauauagccuuuugaguacuggaauuaaaaaaguacaauaccauaccuaccuaauacuguuuuagccuuugucuuuuuuacauccuaugaaacaaggaaggguuaagucuugacuucauauagagcauaauaccaagacccaaagguuuauauuuucugcaggcuuaguaaugugacccucaucuuccuuuauguacaauuaauagccuuuaccagguuuuaccuuuaaguauuauuacaaauagcuuaaaagccauguguucuguuaggaagaguuauacuauacuauacuauacuauacuagauacaguauagccuaggcuguucacguccugaagucauauaauuuuagaccacugugcgcaacuuuuuuuuuguucuuuuauguccuuaaaguuuaaaaucaauaaagcuaaauuuuacuuaauaaauaguaaauagauucagguuuuagccuaaaguacaagacccuccuuaaaaaacaugcuugucagaugcacaauucccauuuucuucucuccuaaccaacauucuuacaccaaacaguaagcuaaacaacuuuuuuuuguuguuguuguuuucgagacaggguuucucugugcaguccuggcuguccuggaacucacucuguagaccaggcuggccucaaacucagaaauccaccugccucugccucccaagugcugggauuacaggcaugcaccacuuuuaaugguuguuaagaaaaaauugccaguauucagguucugaacucugcuuacucucccagaaugaacacgaaagcucugagucugcugacucuucugaauguguaucagaagaaacaucugguugagauuuugucuuaucacaguugugauucacaaacucgaaaugcuccagaaauggacugccuuauuaggcuucaggcucagaacauacagcagcgacacauagucuuucuaacagguaggagcaugcucuugcugcuacaggaaaggugcuggagugggucaguuuuaacauaugguggaaaagauuuuguugagagcaggugucaguuuauguacauuuccuuuuuuuagagaagaauaucaagaugguuuccaguuauacagacaauggaauugucguugcaacuacugaagacuuuaugcaaaacuuuacaagucuugugggcuaucacaacucaguuacagaagaaagucuuccgccgcugcuuggugcuaaugagaaccuugagucccagucagguaacuuuucaguaguuuucauuuucuuuaggugaggcagaauaaggaaugguuuuguuuauccaauaaugaaauguuuauuugaaaccauuuaccuacagugacaucacuguagaacuuagcauguacaagaucugcucauugauuauaccauaguuaguacggagugguuuguuacuguauaggcuauauauucauuagucuauacuguggacaacauauguguauauuaagcuuuauugccugcuguuugcugucaguuuuuuaaagccagauagagggauuguugggcuacaaagguccuuagauguaugugcuaguuuaauaucuuacuaaguagugagacuaucuuaccuucagucuuccgugagauggccucugcuuguuccagacuuuaaaauaaaagcuguucuuaaauuauucuuggugaaaagcagagauuacuaagcauucaguugagcuaaccaguuuaguaauucagugcagcuacaugucagaaguuuuauuuuauauuugucuuacgaaauacugaauuaccguguaacuuuagaugcuguuuugacauuaaccccuuuggagcugggaguugggauuucccaacauuaaacgugaacacauuucgcagaagcuuuuagcaucggauuaucuggacacucacaccuagugugaguguugugacuaagugaccuuguggcagaagaccaagcuuuaagggauuguggacuuugcagauccugacgcacuauauugugugaguaguguguaauuaauaacuaaacaaauuguauuacaauagagaagggcuuuuuguuuuuuaaauguagcucuuuuagaaaacgaugaaaaggaugaagaggauaugucccuggauucaggggaugaaaucucacauauagaaguauucagcaauguucauucagaaauauuggcgggagaaaccaaaggaucaaguggaacagaucaaaaaaagaauauccaaauugaauugcagucaucucuugaugugcaaaacaguuuauuagaagauaagacuuauuuaauugauugugaagcgagcgcuccuauugauagaguaugcucugaaggagagagcagcaauucagcagaacaggaugcguauagcgacuuucaggcugaccaaaaucaguuacaaaugucccaucaguguagucauuuuaauguucucacgcaccagacguuucuggggacaccauaugcccuuucaucaacucggucucaagaaaaugaaaauuacuuuuuaucugcuuacaaaaacucggguacagagaaaucuccauuaaguuaaggauguguucaaggagaaauuacagugauuaaaaaaaauagguugugguggacuuuguauugaugauuuauaaacaaguuucuuggccuuucugaauuuuuuuuccuuuccuguuuauuuaaaucaugauggccuauauaacauugaagcaucugaaaauuugaaauaauuuuuugacauauuguaaucagauuaucucauguuagcaccuuucaguuuuacauuuguuaccuguacuugggcuucaaauugaagucuguuuuauauguaaaauuucauguuuauaaaagaaugguaaauaguaaugacguucuuuaaugucagaugauaacuaauuuugcugaaaugucaacuauuuauuuugauuaaagcuuuuguauaguguuuuuacacagguauaagccagcaguguaaauauuuauaggauuuuggcuuaguaccucaagcuauauuuaacaguacaguugaauucuagguagugaaucuauuguauagaauaccaaguagaauuuucucagucuuuagguuuagcugugaaaacauuugcuucauuuaaauuuugguuaacuuuuugagaucucuuugauaaauaauauuuugugugauccuuuaguuaaaugaacuuuuaaaaguggagcuucugcuuucaauacuauuggagaauuuggaacagaucuugaaguuuuaauucgaacuugguguuacacuaaauguggagauaaauuuuuaaacccucaucucuugccuacuguuacuaauguuaacuucaaagugugaaaacuagaaucuccacuuaauaugaugaaaaccaaauuuacagaagagaaaaaccagagugaaaugaauuuguauuauuaagagucuauccuuguguuaauaguacuuuuuaugcccuaaaagaacuuuuaauagaacaaaugagcaaugcuguuagcaggucaggaaucuccagauucuacccugguaaguagaaaguacuuuuauacccuaacaugacaagagauuuuuuuuuuugaacuauaaacuuuuuuauuguacuuagaaaauacaucauuucacuacauaauguaaaguuugucauugugugcuugaaaaaugcuguugcgugguaagcauauuuaaaacgaagaacuaaaauuaucuucuugguuugcaguuaaggguaugagauucguuuccaacuccuuuuguuucuggagaagacccugcaaucacauugauauuuuagugaagguauauaaccaacuuaaauauuuuuuucucuuucaaaaauacaugauacaaaauaucauugaacucucaggauagaauuguuauuagacauagcuuaaguuucuuuuuuuuuuuuuaaguaauucuuguaauuuggguguugucuagcuagaacauuuucuacuaugagaacaacagggauaguuuuuguuuguuuguuuuucuuuucuuuuuuuuguuuuuuguuuuuuguuuaccacuauuggauuucuaaagugaaaucuacucucaagugcucuaagaucaugagaagacacagucagagucuuaccauucccaguauugcucucagcucugcugaacagcacgaauaagggugaggugaagcacgaacaucccaguccuuccuucucuugcuccuuuguucacccagguugaguccugagcucaagcuagcuauauguaagcucuuaaaggacacagguaaauggugucugagcagaggguaagcaccacacaggccaaauacaguguaauagccucaggauagguuucagcacauuagcaggguuuauuuuugccuguguaaaagguaguaaaaauguauaauuucauucuuugaacagauauauucuguucuuaacuuuaaaaaauggaccauauugguuaaaauucauuaaagcauaauuguauauuuguuucuugguuuuagcacuuuauuguguuuugauguuuuaaauguacuuuuuuguuuguuugguugguuuuugagacaggguuucucuguguagcccuggcuguccuggaacucacuuuguagaucaggcuggccucgaacucagaaauccaccugccucugccucccaagugcugggauuaaaggugugcgccaccaccgccuggcauauguacauauuuuuaaauaaaaguugucuuaauaugcaaac

SEQ ID NO: 7323 - RNA, 2346 nt, Mus musculus
ucagaaacaguuacaguaaaggucauaaauacauuuagucccuauccauaaaugucuuacaagugacuuuuaaguuacauuugauuuuuauaauauauuacauuuuguuauccugucauagauugaguauacuggcuuuuaaaauagaagagaacuuuucuuuguuuuccucagaaucuccacaguccauuggcuuacuuggacaggauccuaacuugagagugcagcaggaagauuccgggaacacuggggacauccacaagcuuuauaauuggcuaucggaagcacuagcaaaugcacgacacucagacggauuccugaccgagacagucaacaaggcuuuaggauugaguaguaguggugccuaugaagagcugaagcaaaaaugugauuaugaguugaacucuacuuuagauaaaaaagaaucugagcagccugcuuguacaaaaauugaaaaugugcauuuuaaggaugcucagagcccauugcuagaaguggaugcagcaucuguaaaguauccuccucuucugucuagcagugagguaggcauuaaccauaagcuacauuguaaaguguaaacagccuacuagcuauuguguguccucaagaggguuuagguguacuucagggagugcauuuuccuucccaaaagaacaaaggcauacuccuaaguagagguguuuguccggagggggauucuaagcuacucuuguugaaaaaaggguaaauacugaaguaauuguuuccuauaugcuugugugcuuuauauaaucuaaaguuuaacuauuacccuaaaacuaggacuagauugucagauuagcauagcaggaguuaauuuuauacuguuuuguaaagaaacaaguccuagagauccuggcuguuucgugcuuuaacagaaucaagaugaguuagaugaagcaacuuaacuuuguuacauaguguucuaaguuagguguucuguauugugcaaauacaaaugaauagauagccuuuggaauuaucuuugagguaauucuuaguuuugcuuacuaaggaauugaguuuguuguguaugguuugugcuuuguagacaaaucauuuccuguauuagucuuucuuaaacgaguagcugaaucauugaggaauaauacaagaugcacuauauucuuaagaguucauagcuaauuuauucuugugccuuugaaaaaaaguuauguaugcaugucucagccuuucuguauguaguuuguggauauccuaaggagaagcuggugguaggagguuuaugugguaggcagugaaauguuaaguuguacuguuaguauuucucaguguauuuaaugagagugugggccaagcauugccugcuuccuguuuguguaacuauagcauuuauuccuacuuauuuaagcacugucuguugguauuuuuuaauuacaauaagaaagauauugcauauaaaauuuaaaauauaagaguuuaccaguuaacugcuuuaaaucaacaccaguuuuacauuguauguauuacuuuaaagacuuauuuauuuauuuuauucauaugaguguuuugccuacaugucgauauauguaccacaugccccccuggugcacucugagagcaguagaacugucagauccuuuggaauaacuagaauuaagauguugugagcugcugugugggugcugggaauugaacccuugucuucugugagaaguccuuuauugcuaaacccucucucuagcucuaaaauaaucuuuuuauaaccuuuuuuuuuuaaacuguauuuuaauuuuguguauaugugugacauucagaggauaacuugaaauuucaugcuguuuuuuuuuuuuuuuucauugugugaauccugaagaaagcuccuucaggucaccaggcuugguggcaagugccuuuauccacaaagccaucuugccaggcuccagauaaccuuuaaggauaauauauauuguuuauuuuguucauuuauuggaaggaaguguguguuuguuuaugacaggguuuuacucugaaccuguggcuugccuauaacucauuauaugguugaucauuauaugaucauacuuuugaucauucugcuuugccuuuugauccugauuauaggcaaacacuauuauuucuggcuuuggcaaaauauauuuuaaugugaagcuagaguauuacaaccuuaccauguugcuuuuacucauuuguaacauguagucugaaguuugaacaucugcugugaggaaguaguauggucucgacauuaaaauuaaaaggaaaacuauuaaauguauguacuuuuauuucuaggauccgaauuuaauuaaugucaauaauuuugaagggugcagucucuguccc

SEQ ID NO: 7324 - RNA, 2346 nt, Mus musculus
gggacagagacugcacccuucaaaauuauugacauuaauuaaauucggauccuagaaauaaaaguacauacauuuaauaguuuuccuuuuaauuuuaaugucgagaccauacuacuuccucacagcagauguucaaacuucagacuacauguuacaaaugaguaaaagcaacaugguaagguuguaauacucuagcuucacauuaaaauauauuuugccaaagccagaaauaauaguguuugccuauaaucaggaucaaaaggcaaagcagaaugaucaaaaguaugaucauauaaugaucaaccauauaaugaguuauaggcaagccacagguucagaguaaaacccugucauaaacaaacacacacuuccuuccaauaaaugaacaaaauaaacaauauauauuauccuuaaagguuaucuggagccuggcaagauggcuuuguggauaaaggcacuugccaccaagccuggugaccugaaggagcuuucuucaggauucacacaaugaaaaaaaaaaaaaaaacagcaugaaauuucaaguuauccucugaaugucacacauauacacaaaauuaaaauacaguuuaaaaaaaaaagguuauaaaaagauuauuuuagagcuagagagaggguuuagcaauaaaggacuucucacagaagacaaggguucaauucccagcacccacacagcagcucacaacaucuuaauucuaguuauuccaaaggaucugacaguucuacugcucucagagugcaccaggggggcaugugguacauauaucgacauguaggcaaaacacucauaugaauaaaauaaauaaauaagucuuuaaaguaauacauacaauguaaaacugguguugauuuaaagcaguuaacugguaaacucuuauauuuuaaauuuuauaugcaauaucuuucuuauuguaauuaaaaaauaccaacagacagugcuuaaauaaguaggaauaaaugcuauaguuacacaaacaggaagcaggcaaugcuuggcccacacucucauuaaauacacugagaaauacuaacaguacaacuuaacauuucacugccuaccacauaaaccuccuaccaccagcuucuccuuaggauauccacaaacuacauacagaaaggcugagacaugcauacauaacuuuuuuucaaaggcacaagaauaaauuagcuaugaacucuuaagaauauagugcaucuuguauuauuccucaaugauucagcuacucguuuaagaaagacuaauacaggaaaugauuugucuacaaagcacaaaccauacacaacaaacucaauuccuuaguaagcaaaacuaagaauuaccucaaagauaauuccaaaggcuaucuauucauuuguauuugcacaauacagaacaccuaacuuagaacacuauguaacaaaguuaaguugcuucaucuaacucaucuugauucuguuaaagcacgaaacagccaggaucucuaggacuuguuucuuuacaaaacaguauaaaauuaacuccugcuaugcuaaucugacaaucuaguccuaguuuuaggguaauaguuaaacuuuagauuauauaaagcacacaagcauauaggaaacaauuacuucaguauuuacccuuuuuucaacaagaguagcuuagaaucccccuccggacaaacaccucuacuuaggaguaugccuuuguucuuuugggaaggaaaaugcacucccugaaguacaccuaaacccucuugaggacacacaauagcuaguaggcuguuuacacuuuacaauguagcuuaugguuaaugccuaccucacugcuagacagaagaggaggauacuuuacagaugcugcauccacuucuagcaaugggcucugagcauccuuaaaaugcacauuuucaauuuuuguacaagcaggcugcucagauucuuuuuuaucuaaaguagaguucaacucauaaucacauuuuugcuucagcucuucauaggcaccacuacuacucaauccuaaagccuuguugacugucucggucaggaauccgucugagugucgugcauuugcuagugcuuccgauagccaauuauaaagcuuguggauguccccaguguucccggaaucuuccugcugcacucucaaguuaggauccuguccaaguaagccaauggacuguggagauucugaggaaaacaaagaaaaguucucuucuauuuuaaaagccaguauacucaaucuaugacaggauaacaaaauguaauauauuauaaaaaucaaauguaacuuaaaagucacuuguaagacauuuauggauagggacuaaauguauuuaugaccuuuacuguaacuguuucuga

SEQ ID NO: 7325 - RNA, 21681 nt, Mus musculus
cagucuguggggcaccgcaucgcuuggaaaguugcugcaggcuccgaggcaccgccuccgccguccggaguccggauugugcggccgcugcauugccaucuccuuccgcggccuccgccgggccccacgaccgccccucggaccccggccgcgaccgaggaggugggcagccucggccgccauggaccucuggaguugagucgccaccgcggagcucugcgcccuccguccucucgcucuguucucucuggaaaggcggggggguggaaagaagaagguuaacccgaagaaaggaagaaagaaagaaggggaccagaagggggaagccaacguucccccacaggcuagcuguccaucaaccgcucaagccaccaagcggcagaaaguucagggcugccuugaacccauuuucuuugcgccugguuuuugccagacucuaaaaugaaaggacaaaauuuggcgcugacucuugcagcucugauggcgacuugugcgauuucagcggcaucucccggagaaaaaaccaugcgugccugauuguucuguggucccauagccgccgccgcugcugcugcucugugugugugugugugugucugugugugugugugagcgcgugucucugugucugcgugugugugcguuuguguguguguauguguguguguuugggugugugucuguguguacacagagguucacuagcuaacucagcugcaggagcagucccuggaagcagacguuucggccacagacccagagaggaggagcugacaaucaggaggcgugagccgccuggagucugcagaauucguggugugaaugaacugggggcaucuugggcacagggauugcccccccuccuuccccgccucgggccacaguugaguaguggggcauuuuuuuucaccuucuugugaagaauuuuuuuuauuauuuguuguaaagucuuuugcacaaucacgcccacauuugggguuggaaagcccuaauuaccgccgucgcugauggacguuagagagggagcgccucgccgcggaacagucgccugcgcgcccucgucggacccgcggcuccugcacuguguccccgcucggcccugcgcuugcugcucgcccgcgcgcgccggcgcccucucgguuccugggcacauuuccacgcuauaccaacuccucugcccgaguccgggcgccagugcucgcuuccgcuccgggucgcugcgcccacccgacgcgcccaggaggacuccgcagcccugcuuuggauugucccccaaggcuuaaccccgacgcuucgcuugaauuccucggccgccuucgcucggguggcgacuuccucuccgugcccccucccccucgccaugaagguaaguguucugugcgcacggacgcucccuacuuuuucccccccuuuucaaaguuaacugaacucuuucaaucuaucccuauccucuccauuucucuaacugccuggagaaagcuaaacuccaauaucgccggcagggacuccuaucuuuucgucccuuacccuggggacacugccucugcguccuuggagacuuuuugcaccggcuauucuucaaaccuuuucaacuauggagaagagcgagggcaggaaagacaguucgggucacaggcggcgcgccuuuuuaccucgagaacuggaguguaguuuuacuacguguauuucagugacuggauaaugauucgauucaucaaguauauaucaaacgcucauuucaccggcacgcggagauuguguggcugaagcucugaggccggaugaggacuguguuaggagaaacggcugcgagacuaaggaaacuaggggccaccuacccuagagcaacgcacaccccacccccaaccuccgaucagggcccaguucccggcucuccaggucgaguaacccgagcguucccggccccugugccuuuaagagugccuggcggggggccagagcgcaccccgcgcggggagcagggucgcguuauuagcuuuauuagcggccucugggugagcucagguccuuuacugcagcauugggggcggggaguagugguccuaguggcuuuaauccugcccccugagcggagucaaccuagugcuuuggagacucuagggccucugcguuucgagaucgggcggggguuaguuugugaacucguguuuguuuuaauugucaguuguauguuaaagccgagucacacacucugagggucaccgagaguucacuuuuacaaaaaaguuaacguuucgucuugaaauauaacuagcaauuuuccaaacaacuuuuccuucgguuauccuccacgccucgauaacaauuuccauuuauacuucauaccucucauuuccagcuuucuaguagggaguaaggugaagaucgguacgaagcuguuuccuaaaagcaaacaacguucuuucuucaaagaaaggguuuuaaaccccggugcuucuaaggcccuguuuuacccucuaugcccuguccgagccacagcuccguggucucacuuuaaaugaacaauucgcuccugggaaauaacuugggucgggugaugaggucguaccuccucagcaucugcugucuugacgauauuagcacaccuagccagauuuaauuucaagacauuuuccaucaggcgaggcuuugcgggggggggggggauuuggaggagacaauguuguaaguacccagcaauugaggaauggcggaaaguaggguaugagaggacgcguugggacccuugcuuugcuuuggggacuuggggagcuggagaucaguuuuugacaagcuggcuuuagucuuggcgguucggcccuagauccuccaaaggagguccagcccaagacccuggucuucccuuccaaagcgcuccugugcacaaggggcgcgcuacgugccggcaaaacucuugagcuuuaacgcggccuuucuaaccggccgcgcggugccggcugcccccuguuggccaucuggaaauaaggccucucugagucccaguccuucaacuuugcaccccuggagacaacucagccccacucuucccaccaagacccuucuaaggucuccgccaggggacaaucuguguuaccccgagcuucaaauagaaaagagccauagguguaacccagcaaugaggccuugggcaauuuggacuaaggauuucgacccuucuggucacuggugagggagugucacaguacaaggccucggguguggcccugguugucucaccaauucuuucugugguccuggaugcuuguuguguuucccucucucagccucugcuucuucauccauuaaacacagaaacaaaaacagugauuuuguuuucauuuaugaacuucgucuguaaaaaaaaaaauccccuguaaagauugggagugaaccgaucuuugauuucucacucucucuuggggcuacacaacuguuuuagacaaaugacucugugcucaguuacucgagguaauuguguguggguccuugagaacccugggggaacaucgcugaagcuuaggaaaagagccgaaguuuaucuccuggacuauuacuguucuccgaucuccuggcaauucugggucacucgggaauuuuucagguuccuuacccugacugcagcuccagacaaccucuggcuuaucucacuggcuauuucugccugcugcaugugcucugaccacguguauucaugaagugggacagguacagcucagcugggcccaggcccuaaagauggggagcaacgcuucuuuugucuacucccccuuaagcagacauuggucauuucuucauugucuucucucugccauucuugaagccggagaaccaaguuuguuccagcgacagaguucuucucccucaaguuucuccaucggucuucuugguucagagaaagagcagacuggagaacacuguucaauuuccaucucuucaagaacagagaucugggaguuucccaucuuccuuuucgccacugggagccugggucacucucuuccgccuaguuggcaucucucaucauuuccacucucagacgugggcccuaaauguagaaucuagcagaaggaaaugacccaacugggaaguagggccacugcccccuacuucccgccccugacccuggaaaaagacucugugccuagccgcucuaguugggagcugagcacuuuuauguguguccuguagcuauguagaccgaggaaauagucuuuuccaccaacuucccucucuuucguguuggcaccuuagaucagcgcugcagccugcaccucucaccuaguccacccugaaagcuuugagguuuccuuuauggggaagcagcagcaucgagauucagcgucuuuggcuucaagacucgcaaacgcuuuuccuucgcuucacccaccccugcgcugcaccucuuaaaagcccgcacccuccacuguacgccggggaacgacagaugcuccggcuucucagccugcuuucccaacccuauuggaaaacauuuggcucguucucuggauaauuuugaccagaacuuuuaaaaaaaaucuauauaacucuguugcgggagucucccgaaaguucuccuuccacaccgucuucuucgcuucgauuucuccuaaacucaccgggucggauguuuuacacucuagaguggaaguguuccuuagugaguucgcugugaguuccuugaaucgcucagauuuguggggcugcaacagacuggagaggaaagaaaaccgagguuuccaggcaagugaagaggguccaaggcagaugcugcucucgggacucuccggccgaucuccuugggacaccccuaagcuguaaccgaggagaccugaguccaguaaacccggugccuccgcucgcuguuagccaggguucugggaacugguggauuugccccgggggcgucggccgggauaggguucgguuugugugguuucggcucuaacaaagagauucccuguaauccgccgaaucuguuaucaauuucuccaccacccgcgccccgccccgcgcgccccgcccgcugugaagcuccaaaaguuagugagacccgccgcgauuugagagcuggagcccuucgcagcguguguguaucugugcauacgaguguguaagugugcacgaggguguguauagauguggugugaaugugugugugugugugugugugugugugugagugugugugugugugcgcgcgcgcuuuuagcuuccacuagggacucuaaaccuuugcagccugggccgcgcaaagaaagacccugaagcccaccccuccccuggaggaaacuugacacuucaggcggggguagggaaggagacugaaccuucuuucucuuagacuggggaaacuccacauuuccauucucuccaggaugcguccccagcuuugcugugcuuuggggacggccgagccgagacucggagcacugguuagcuggcacugggaagcacuuaaacuccucuaccaggagcccggaggugugcaagcccaagggguggcucgaaaaggaaagcuaccgccugcuccaaggccccuuagcauuucuacugccuacaggguccccuucaucccuuuugcggagcuggucucggcagggccuucgccuggaagagguucaccuuucuugccuuuccaaaagaaggggcucccucgggggcuuugggcaucacagaguuacacuuaucagagacguaaaggggaacguuggaaaccugcuccucguacccacacucuucucucuccgccgccgccugcagguggaaaaaucaccagugggagcagccugagaacucucugcccccgaauaucuucaggaaggaaacuucuccgcccggcucccugcgcccuggaggccaggggcacugcugaugcuugggagcuggcuccgcuuggggaccugucgccucggcuccguuugccaacauuuuggaacugaaugaacugagcccgacuugggccagagaggcuagacuggaggcaggguagcaguguucuucaagacacaggccugcaguggugcgaugaaaacauggggacaacuccaagagaaacaacaggcucuccgugguuuucgccccgccucccagccgcugcuggaccuggggaccagagggagaguaaaaagucagaauaaugggguccaagagaagggaaggguaggggaaagauccuccccuaaaggaacugaagccggauacuucuuucuauccgagaccuacgucuccucucguacugacuugaggccgcuggcaggagggggcaggcuuuccggguucccuggggugggagagccgacccucuucccauucauuaucccuuaccccccaacuccaucuacuccccgccccaaacuggcugaagcagauccuaaaggaaauccaggcugcucuuccccaucuggaaguggcuuucccaaaaucggccccguaaacugauuauaaaacauacgauguuaauucggagcugcauuucccagcugggcacucgcgcgccucgcuggucccuggggccucgcccccacccccugcccuucccucccgcguccugcccccacccccacccccgcgccggccaccccgccuccucgcagccuccggcagugcgcuccacucgccuucgcgcucuucucgcccauggaauuaauucuggcuccacuuguugcuccggcccagguccgggagaggacgaggguggcggcggguuaccgagugaauuuucugggagggaccgagcgcagcgggaaacuagagggaagccagggggugagggacuggaaguugcaggaaaccugguacccgggcuuugacucaacagcauugagacauguuuguaaucgcuggcgugccccgcgcgcaggaucccagcgaaguaagacuuccuggugagggugcguggguggauuaauuuggaaaaagaaacugccuauaucuugccaucaaaaaccucacggaggagaagcgcagucaaucaacaguaaacuuaagagaccucggauguuuccguuguuuaaacuuguaugcuugaaaauuaucugaaggcaauaaacaucugcuccuuucuuuccucuccagaagcccauuggaauauuaagcccgggaguggcuuuggggaccgcuggaggugccaugucuuccaaguucuuccuaauggcuuuggccacguuuuucuccuucgcccagguuguuauagaagcuaauucuuggugguaaguugauucugugugccuauucugccuuuaaaaaacaaaaacuuacacuuggacuauguuauggccuuagguacauucaucuaauguagaugguauauguucuaugagcuuuuaaaaugugaauuuucuuguaacccgcucauuuuguaaaucauacacucaguuccacggggaaaucagaauauauaaaucucagccuuuuucuaugaggcccuuguugagauguggguuuacaguaacaucguguacuaaaagggaaaugcacuucuuuaauaauuguaagucuaucuauaacguuugccacccccucaccagguaaaauaaaaaugaguuucccuuuuauuuuucugucguuugagguuauuaagccacagugucugaagcagcagaguccuagaagacaucuaacccccaaauagagaguauuugcacuugaaauuugaucaaagggaggugaacuugaaauagucaaaugucccuaaaugagguuuucucucuggguugcagugaaucccggggauuguguguggcaccauucuggauauuuucucccugguaacagaauagcauuuuuuuucuuuucuuuucugacuguuaaaugugacuucuggucauuggauuuccuaacuugaauccuucauauucacuuaagaauccccuuuaauaugucuaaaaacaugggggauuuucuucagucuguauagacauccccaucuguguuuccauuucucggaagguacugcuaucuccuaccuaauuaucucuacuuuugauguuccugaauuuucaaggaggauucaucuaccuuguagguaccaagucacuuucucuaaagccaguggcuggucucuggaaaccuccacuucccccccccccccuuucucagugacuuucagaaauacugguucagguauguagugacugcagaagaaggcaaugaaaacacugacugagggagccagauggcuggguggggacugcacaauaccucuguuuucugcaggguuuaaacagaggaguucuaugaagcccuucuccuacuuugucaugcagacaaacaggagagaaaaggcauuuguuugcuucaagccccugaauggcugacagguuuuugggaaggagggagcuaccucuagaguucacguaaaucuugaaugaacaucucccccuccccuuugcaggucucuagguaugaauaacccuguucagaugucagaaguauauaucauaggugcacagccucucugcagccaacuggcaggacuuucucaaggacagaagaaacucugccacuuguaucaggaccacaugcaguacauuggagaaggugcgaagacaggcaucaaggaaugccaguaccaguuccggcaucggagauggaacugcagcacaguggacaauacuucugucuuuggcagggugaugcaaauagguaggacguguugggaugcccaucaccuuugucugcaaaggucuuuguguuugcuucaauguuugaugagcugucugcuuuacagccugggugauggcuugggagaugcauucuuuuccagaaugguuuuaauuucugauccccacuucugauugcaguuucuaacuccuugaaccagaucaguagagugacaccucauaucccaucguucucuaugacacuucauguuuuuuguaaaaugcauuuuauuuaaaguagaagcaguauccugcuuugcuuugauugaucaaaaguagauguggcaaagcagagccauuuaagcccuuuuaaaacuaaaaacccuccugaugguugugucuuaagccacaauccaaauggcccaaguugucaucuuuuagaacgcuggcaaugccggcaguaagguuuugauuuuccuaauauagacauuuccugaggcuacagagauauauaaaguuaaaagcuuuauuuuuagucccagaaagaauuuuaauaagaagugauacaacuugugugugugugugauuuuugacaacuggcagaaaaaaaaauacauacuugggcuuucaaccuagaaacucugucauagcaauuuuaauuuaauguuuugugugcaguuugaguuuuaauuucaaauauguuguugaguuuguuguuccauucagggaggagacagcauuuaaauuggaccaaaagaaaaaaaaauaauugaaaacucaguuugccugugguuuucugcaguagucugcgauccuacuugacagaugggcccuguguguuuucuagugugaauauuuuaggucucuuuaguuuuaugcaaacaagcccuuauaauuaauaagacugcagugacuccaaaaguaagaagcaauuuaucaaggcaauuaacuguuuauacugacuggagauaaagaguuggcuuaauauccaucacagauggauaaaauacuuuugaaagaaaaccuuaaaaagugcauucauugagaacaaaaaagaguugucaguggaugcuugagccaagggacuucauaagcgaaaauaacacagguuuggaaaccacuccucuaauccagugggggaacagccugccgccccagccugcaagguucauggggcuuuguccuuucugucaaugauuaaaaugugcuaauguauauccuggggucggacugaaguagcaaagcccagggaagcgggaaugaucacuagauauagacuguuuuaagguagccaaauggggauaucguagggaccuuacuucugccuuccgaaacuucaagagagaaguuaaaaccuccuucagaguuuuaucuaaaugucaagugcuguuggguguuuccuuuauaagcaccucaaccgccuuuaaaaccuguguucucacagggacaggaguuagaaaaagccaggggaaggggcaguugcaagugcuucccaacugugaacucacuugaacauagcuuugauugacauccuccuuccucucccuccucauccuuggcagggggcuugcucuaggcaagaguguacuagauaagcucucacuugcugagugaaucuaaauaccgccuaaaugugguccaagauucaaagugccuguguccucaaggccugagcagagcuccuacuccaaacaccugcguuuaauugucuccucuuuggucuuugacugugugguacucccugguagggacuggacgguggggcuugugugaguuccacccucucaaagucuggugaggugagagugaccagugaccagugcugugggugggccaucggaugcuccaggaagcacagcaugcauccagguucccaaguaccugguuauccucgagcagaaagccaccugccagccuagguuugacucucaagaggcuuuuuaaauuuuuuccuuaauauuugaaagaagggaaggagaguaggaaaauuauaauaaauuuuucuggaugagaaggaucagagacugaacuccaagaauggaacaaagucuuugccuucuuuuuccgagcucaggcuuugcuugaagucagugaguuuugggacaguugaaaacaccucuggugcccaaggugugcccgggucacuccaaaacucucaggaucccagggauguggagaggaacacuugucugugagacccugacccugugaggggccagcgucugagaagcuccugcugccaccucugaccccucuccaggcucauuuuucuaaggugccaguugcccuggaggcaccgugcgcagcagccuccugaagggcccccagcuucauuuuggaaacauucucauuuuucacccguguuccuuuuccccaccagcuuuugucccucuccugucuuuguuuuuagacugugaaaagaugucaggaaggcaccauuuuuaagggaugugaggauccaagucagccuagauuucaugcagagggagacuuaaccaaaugagcagccauagagagacacagaggcuucacacagccccagccaagcagagcucuucaaacugcugcuuuuccacagucaacaauuagcuuagagacuccuagcagguuuuguauucuggaugaaaaucaaaaugauugagcuagauauauggguuaaaaaaaaaaaaagcucuguaggauuuguguuuuguauaaaagcccuuuacgcucugugcauucaaagggcagugucucagcccccucuguccucugaggaucaguuuaucuccucuuccucuacccacacuuuuaucccacaacccucuccugcucagaccacaccacuucccacauuaucaguguuaaucuucaaauaacccccaccaauccguuugcucuccugguuuauuuccacucccccuccccagcccaccccacccccagcgcacacacucugccaucuaaaguaaagccccacugggacuuucuggucccaucuuccugcccacuaccagcacacuccugaugggcuuuuguucauuuguuaaguguaggagggggagucuguaugacuuaagccauaggacuuccuggggaucacaaauggcccccaugaacuaugggacaguacuaauccuggagagggcagguaccagagucagcaggaccauccuccuggauaggccuucucuuugggguuggcugagaucagcugucuuuguucugccccugcuucauaaagauugcuugcaagcuuccuaacuguaugagaaauccagucugguacaggggauguuagcaucagaagggaccuuuaguucgugggcauucauuucaauacucuuauuuuacaguugauucugaaagugaggcaugguaccagucuuuccccuacaugcagguccagcuuccuucaaugggcacaauguuaaccuuucucucucacggugcagcugguuaucauguugcuucuuguuacauuagcaaugucuccuuuugcagguagagcucaggcuggcggauggggcucccauaaguguucuguggggaaaugaucuucacacuuucuaucuauuccccucccuguucacccugagucuguucuccuuuucuuuaucuugucaucucaccacuucaggcgaaggccauggguagagagagcacagagcaggagaguccagugguccagggcaguaguugaugcagaaccaagaugaaccaggaagcuguuuuaaacuuaacugcuuauucucauguagggguggugguggcggaagcagcacacacuuuuaaucccagcacuuagaagguggaggcagggagaucuuugaguuugaggccagccuggucuacagaguuccaggacagccagggcuauacaaagaaaccaugucuugagaaacuaaaccaaaccaacaagcacaaaaaaccaaccaaccaaccaaccaaccaaccaaacaaacaaacaaacaaacaaaaaaccuaauugcucauucucaaaugaagaaauuccagggcagguuuagcacuguugugcagagugguaaagagggaagagcucagagggucccauagccgggaagagaguauagcugcagagaaagggugccagguagaaacuauccguggcccccaggcuggcuugagauggggacuugagauauacagaggcuucuaagccuagcaaauucugcucuguucaaggugaaaacaauaugcacauuagaacaaggguuaaaaaaaaagucuagccuaguucugagcuuucuuucaaugacuucuuucaugugcauguuuggaaauaagacguuuugaauaucuucaaucgggguuaaugaaaaaucaagccagcaggauuggaauccugccuagacucuaaaacauccuagcagacgcagguauugcuguccccuuuguuauuuguuguugcuguaugugacuggauccauccuucugagcuugucacgaggugggcccaggccugaguguacauuuuggaguggggcucuguaugggaugucaacuagagguuuaucucugccgguucacuucaguagcagcugaggcauguuggggucggucucucucucucucucucucucuuucucucucaccaaauaauccagauuuucuguguuagggcuucuuccucuucuugcugcaggggguuucugucuaguuuuuuucugcccgcagugggccugagaacuguuugcucccguguuuugacgagugguuucccccagccccacaaugggguucaaggccagagugcuggggaucccuaccucuccaaugaucuauguauguuggggcucucucagccuucuccagccugcacaggccagugcguuaggggucuuagugacgccccgccuucucuccccccauucccagcaagauuuaggcuucuguguggggcaggcaaucuagugaccccucauccuuaaucgcaggcagccgagagacggccuucacguacgcggugagcgcagcugggguggugaacgccaugagccgagcaugccgggagggcgagcugucuaccuguggcugcagccgcgcugcgcgccccaaggaccugccucgggacugguuguggggcggcugcggagacaacaucgacuauggcuaccgcuucgccaaggaguucguggacgcuagagaaagggaacgaauccacgcuaaggguuccuaugagagcgcacgcauccucaugaacuuacacaacaaugaagcaggccguagggugagugccauggucccccugccaccaccaacccccauaccauuuauccccaaccugcacccccuguacccucccaccacacacaggaguuggguccuggcccccucaguucaggucucuccggauacucauaccuuggccuaucuguauauacuuggcauccuccaucuuccucggcucugcuccuuucuggcuuucucuuucucuuuucuuuucuauuuucuuuuuuccuucucuucucuccucuuccuuucucucuuucuuuuccuucccuucuuccuucuucacucacccccucccucccucccucccuuccucuuuccuucccccucccucucucccuuccuuccucccuuccuuccuuccuuccuuccuuccuuccuucuuuccuuccuuccuuccuuccuucuuuccuuccuuccuuccuuccucccucccucccucccucccucccucccucccucccuuccuuccuuccuuccuuccuucucccucccucccucccucccucccucccucccucccucccuuccuuucauggucuuucaagucaggguuccccccuuccccuguaguccuggcuguccuggaacucauucuguagacuagacuggccucugacuuagagauucaccugugaguacugggauucaaaguuuuuuuuuuuuuuuccuugagucacuucaucauuugugggccucucuguagaaagguaggcauucuagaaagcccucccccucuagggggacugacugauccacaaaugaacucuggagauccagcucuuuucugagaaguaugcuguguaucuuuuuagcugguccccacagauggucacaguagaggucaccauuuguggcuggguuucaguuuggggaaagcaccaagcaaggccaaggccucacuuuaacuuggacacuuauuuucuuuuucccugucugucuuguggcauucuguagcagaccugaugggcccuuuuuagggaaaggacagacauuuuagcaguuuggcauuuuuaaagucugaccaucagacaaauccaggguggcuguagagagaagagaaacugacauucuguccccagccuuccugagccuccugcuuccccccucuuuccuuccccugguguggauaugaaaagcuacuccaagauauuuuaaaagacccuuuuuuccccugcgguuaaacacauggcacuuuauggcugcuuuaaaaugaaggggugaaaauguuucuuaacuuuggcagcauugaaaaccagggucauuaguuuuucacagaacccaagguaggugccaggaacucucuggucagagauuucacucuucuguauuuuggggcgaggaaaaaggaagauaaucacagaguagaacaaggaggacuggaaggagccucuggccccaacacccuagucucacagauugggaaacugaggccaaccacuuagcagcuacggaagaaaagcggugcaucuauguuauaagucucaguuaacauacuuuaaacagaugcauuggagccuagggcugaaacacaggggcguggccacuggagaugcugacugaaaaucagauccucuggugucguuguccacauuugcauaucuuccaguggccgugguuacgacucccacuugugguccuugugaagauggagugagaucaggcauuagggccacaccauaagaaaucugacuuacaacaaugcuuccuuugguucaagcucagauuauaguuuaaagucagucagcagucagugcuugauaaaugauacguuaauuauuaaacacugcagaauacuaggaccuagggaagccgcagaucauggagauaauuccagcuaacuuccucucacaucugagggugucaaugagauugugcuucccugaggggccagguuguugccaccuagagagcgccacucucuugcuugucacuguuguaaguccagccgugauugcaggggagggguccagcuccggucucugaaaaccccuaagggugcauuuccaggaccccaucauccuggcaucuuccccucuguguaggauccaauggacacauucaaccagaaauguccccugccaucuuuggaacuuccuuaucucuucuuuccuagagagaaauccugaggggcuugucuauugcagggaagggucaagcuuuuccaagugucaagaggaaccccccucccccagaagguagaaagugaccuggcugguuuuguugcccuuaauaacgauaguugcaucuucuaaggugccaugucuuugguuuuguucugucaugggaaggaugagccaaaggaaggaucuuggucaguaagaaagaggcacagaaaccagcucuucucuaaaauggagguuagguaccuuagaaaguuguacacuaugccagaaaaucauauuaacacuuuuuagggcauuaacuuuugguuuuccuuaaaaggggagcaaagguuaaauauauuugcaaagccuuccucagucugaaagucuuuauggcaagucuuuauggcaaguacugugggccccuaguaaaagaaaguccuuauaauuccuuggaggagggagguaauuguucaggcagaagcagcucuggguucuggacaggcccuggccagugcugccauaccaugaugacucugaaaggucgcuggcaugaggagcugugggcaguaggacuauaaauaggcaaccaccaccucccagacuguugggcacaguacugugggccaggccuaugagcacugcuccugggaggccugaggugacugggcaaaaaacccagggccauggccccaucacccuggagaaagaccaggcuuacugaauggauuuggagugccaagugcuuccuuggcuccuucaauuuuacccuccuguguaggaaguuggugccauccaaaggugccaaauagguuuagaaaggggcagccaguugccuaaguucaagggcaaaguuagacauccucuguccacagcugcaaggugguccucaagaccuaggguaggacaggacagagucgggauguagaggguacagcaguggacauaauugaagcccagaccaaguuccccuacaaccugguugugugaucugugugagccuccuuccuaugccaccguguuaucaccuguuucuacacaugccaccaagcugcuagcaugacuggaugaggucacaggugucacagcagguguccugauagcugagcuaacacaguaguacaguagaaugggagagcauugaaacccugaucccacuggggauagaccccuucccagcucagcacuuaccaagucacugaacauaggcuuggugucccacugucuggguucaaauccuggcauuccccacuggccagugguugggcagaacuugucucucuaggccuccauuuccuucucugcaaagaaauggauaauagcacaccccucagaggcuuggaugugggucugcguucagguaggauaggcaagauauggagaucucauuguacugauaacguuucccucccauaaaacuggaggccacugggaucaguuucuuuuuuucuuuucuuuucuuuucuuuucuuuucuuuucuuuucuuuuucucuuucuuucuuucuuucuuucuuucuuucuuucuuucuuucuuucuuucuuucuuucuuucuuucuuucuuucuccuguucccaucugaaugugauagugguggacagaaugauaaagacuaagaaguugcagaguuucaaagaaggcaauacaauauuucuaguggugggaaaugaagauguaacacagccuugaauucagccaagggacauggcugccucuacaaaguguguacuaggcccaugccugcaucucgccuccuccagggaucaguacaauaaccuucccccuuucuuccuacagacaguauacaaccuggcagauguagccuguaagugucauggagugucuggcuccuguagccucaagacgugcuggcugcagcuggcggacuuccggaaggugggcgaugcccucaaggagaaguaugauagcgcggcggccaugaggcucaacagccggggcaagcuggugcaggucaacagccgcuucaacuccccgaccacgcaggaccuggucuacaucgaccccaguccggacuacugugugcgcaacgagagcacuggcucgcugggcacgcagggacgccugugcaacaagaccucagaggggauggacggcugcgagcucaugugcugugggcguggcuaugaccaguuuaagacagugcagaccgaacgcugucauugcaaguuucacuggugcugcuaugucaaaugcaagaagugcacggagauuguggaucaguucgugugcaaauaguggugugccugcccuucacccagucccacucccaggacccacuuauuuauagaaaguacagugcuucugguucuuuuuauuucucccccaagaauugcagcuggaaccauguguuuuguuuuguuuuauuuuguuuuuucuuuucuguuaccaucuaagaacucugugguuuauuauuaauauuauaauuaauauuuggcaauagugggggaaacuaagaaaaauauuuauuuugaggaucuuugcaaaguuaguacaaaauuucuuucuucugaugcuacaggauaaaggggaaaaacuauguauucgaacuuagcugugcaguuggggguucacaucuagaagguguaggagccauuuucuucucaaacagagaguccuuugagaugggugguauccaggugaaggaggagguacagacccaugaauaacaguuccugugaccaaaaugaauugcaggugcucugguacaaaagaucuuaaauauagauauauuaaauauacauauaugccaaaaauacagaauaugagacacucccuaacccagagguuaccagccugguuuuguggguuuuuuguuuuguuuuguuuuuucuuuuuuuggguuuuguuuguuuguuuguuuguuuguauuuuugguguguguguguguguauuucuagaaugaucuuuuagaagguacaagcaagaaucucauaucuucagaagcaggcauaucauguauguuacugugucccaccuacagauacuccauucaugaaugggccuuuuucuaacaguucaugaauauuggggagccggugggcugggggagggagguccccagaaauuagaaaacuugaaguuuccuacauugaggccauaaucuuguguuagcccagcugauucuuaauaccagacuuuuagauccauaaaggaauuuuugacuaaaaaaaaaaaaucuuguuuugaaagccaucuuauuuucuuaaaaaugaaaaauuacccaugaaucccauuugcaaccccucacccccacaggcaacaagaaagucccauguaguugagcacugcgaacaccucugugaggagaugauggcagccaucuuccugcaugaucccaugcccuuucuggacucucugcuggccaugcuuccgaauggcagcccugguggacacucacugcugguagggcagaaaauguacacgaggagccauguucagaaccagccacuuagggguuguucucugaggcuuuucuuuggagguacgguaacuugauguguuuugaugauaucucuuggcccagggaguccacagagguguugcagcuguuugguuguuauccuccugcguuuagacuuuccauuugugcuuuuccuauuacccugcagguguacccuaaaacuguuccuaguguacuugaacaguugcauuuauaaggggggaugugguuuaauggugccugauaucucaguuuuuuuguauauaacauauauauaaauauacauauauaaauauagauauaauuauaucucagugcagucugggauuuagaccuacaguuuucucugggcuugcucucugccuggaguaucguccuucauugcaguccaauugggauuucuuuuuuuccaaaaauuuugagucuuaacauugaccugugacaggauccuaccacgaauaccaggaagcaagcuaagacucggaggaagcucucagggcucauguccugaauguauguugguuagaaaguagccuuucugcuuccugcccauggccaguucuccacccucucuuugguguucuuuguggggagggcacugugguuugucgcagcccuggacuucgagaggcucccagaacccaggaucaccagccuccugucuguuugcuucacuccuuucccagggaggacuugggacuguccugucugacaggacggaucugaguucccgaagcaaaccagcucaccacauagauagcuaguuuaaacaauguuuuaaaauaagggcaccucuguuucaaaagugacaucugcuguguuguuuucgaggccugauacucuuacaagguuugaaaaaaaauguguguauccauucaugggcuugguagccuucuggucaccucaguccuguggcucuuaacuuauugcccaacaauauucauuuccccucagcuacaaugaauugcaagcaaaagauguugaaaaaaagcacuaauuuaguuuaaaaugucacuuuuugguuuuuauucuacaaaaaccaugaaguucucucucucucucucucucucucuuauuuguuaaaucagauuauguucuuuuuuuguuuuuguuuuuagugauucauguuuaugagcagaguggaguuuaacaauccuagcuuuaaaaaaaaccuauuuaauguaagauauucuacgcauccuucagauauuuuguauauccccuauggccuuuauucuguacuuuuaauguacauauuucugucuugugugauuuguauauuucacugguuaaaaaaaagaacauugaaaggcuuaugccaauggaagauagaauauaaaauaaaauguuacuuguauauugguaagagguuucaguuguccuucagcuaauucauguagagaaauauuuuuaguugaagccacaagagacagcuuagggcaguuauguguucaaauaacagaagaacagacuuuuuuuuuuuuuuuaaaccaaacccaaacuguugggaaaccucaauagagcucuauauguauuggaacaaaaguggaauucucuucuccuauauauguuccuucaaaaagagagagagaaucaagcagauggcuuaaagcuggucacaggauugcucacauucuuuuggcauuaugcaugcgacuuaauuguuugagaguguguugcuauuguaacaucccagagaugaaucaaaaaggcucacccucucacccaggagcagcuuuucagcuuauauacacaugcauguacaugugugugauaugcaugugugcaugcauguuuguauuuuugugcuugccacuauaacuauugcaccucucuauucgguuugacugaagaggggucuugugggacaucucugugucccagucuuuaugggaagaaagcaagggucugcagagaacaggaacuaaagaaucccugugugaugugcaauuaauagaaggccuccugcuuucuggaaauguagaccagaaucuggccaggacuguagacugauacauuaucugguccuuugccuuuuucuuuucccucccugccccucccccucuugcuuuauggauaaccuuguaacauauugaaaccuuuaaaggaaaccaagaaugcauuauuacacacacacacacacacacacacacacacacacacacacacacacuacaguagaccaacauauagaguguuuaaaauagcuuuucugggcaaauucaaacaacuuguggcucuaggacgcacaucuguuuccguuuuucuucaguuguauauugacc

SEQ ID NO: 7326 - RNA, 21681 nt, Mus musculus
ggucaauauacaacugaagaaaaacggaaacagaugugcguccuagagccacaaguuguuugaauuugcccagaaaagcuauuuuaaacacucuauauguuggucuacuguaguguguguguguguguguguguguguguguguguguguguguguguaauaaugcauucuugguuuccuuuaaagguuucaauauguuacaagguuauccauaaagcaagagggggaggggcagggagggaaaagaaaaaggcaaaggaccagauaauguaucagucuacaguccuggccagauucuggucuacauuuccagaaagcaggaggccuucuauuaauugcacaucacacagggauucuuuaguuccuguucucugcagacccuugcuuucuucccauaaagacugggacacagagaugucccacaagaccccucuucagucaaaccgaauagagaggugcaauaguuauaguggcaagcacaaaaauacaaacaugcaugcacacaugcauaucacacacauguacaugcauguguauauaagcugaaaagcugcuccugggugagagggugagccuuuuugauucaucucugggauguuacaauagcaacacacucucaaacaauuaagucgcaugcauaaugccaaaagaaugugagcaauccugugaccagcuuuaagccaucugcuugauucucucucucuuuuugaaggaacauauauaggagaagagaauuccacuuuuguuccaauacauauagagcucuauugagguuucccaacaguuuggguuugguuuaaaaaaaaaaaaaaagucuguucuucuguuauuugaacacauaacugcccuaagcugucucuuguggcuucaacuaaaaauauuucucuacaugaauuagcugaaggacaacugaaaccucuuaccaauauacaaguaacauuuuauuuuauauucuaucuuccauuggcauaagccuuucaauguucuuuuuuuuaaccagugaaauauacaaaucacacaagacagaaauauguacauuaaaaguacagaauaaaggccauaggggauauacaaaauaucugaaggaugcguagaauaucuuacauuaaauagguuuuuuuuaaagcuaggauuguuaaacuccacucugcucauaaacaugaaucacuaaaaacaaaaacaaaaaaagaacauaaucugauuuaacaaauaagagagagagagagagagagagagaacuucaugguuuuuguagaauaaaaaccaaaaagugacauuuuaaacuaaauuagugcuuuuuuucaacaucuuuugcuugcaauucauuguagcugaggggaaaugaauauuguugggcaauaaguuaagagccacaggacugaggugaccagaaggcuaccaagcccaugaauggauacacacauuuuuuuucaaaccuuguaagaguaucaggccucgaaaacaacacagcagaugucacuuuugaaacagaggugcccuuauuuuaaaacauuguuuaaacuagcuaucuauguggugagcugguuugcuucgggaacucagauccguccugucagacaggacagucccaaguccucccugggaaaggagugaagcaaacagacaggaggcuggugauccuggguucugggagccucucgaaguccagggcugcgacaaaccacagugcccuccccacaaagaacaccaaagagaggguggagaacuggccaugggcaggaagcagaaaggcuacuuucuaaccaacauacauucaggacaugagcccugagagcuuccuccgagucuuagcuugcuuccugguauucgugguaggauccugucacaggucaauguuaagacucaaaauuuuuggaaaaaaagaaaucccaauuggacugcaaugaaggacgauacuccaggcagagagcaagcccagagaaaacuguaggucuaaaucccagacugcacugagauauaauuauaucuauauuuauauauguauauuuauauauauguuauauacaaaaaaacugagauaucaggcaccauuaaaccacauccccccuuauaaaugcaacuguucaaguacacuaggaacaguuuuaggguacaccugcaggguaauaggaaaagcacaaauggaaagucuaaacgcaggaggauaacaaccaaacagcugcaacaccucuguggacucccugggccaagagauaucaucaaaacacaucaaguuaccguaccuccaaagaaaagccucagagaacaaccccuaaguggcugguucugaacauggcuccucguguacauuuucugcccuaccagcagugaguguccaccagggcugccauucggaagcauggccagcagagaguccagaaagggcaugggaucaugcaggaagauggcugccaucaucuccucacagagguguucgcagugcucaacuacaugggacuuucuuguugccugugggggugagggguugcaaaugggauucauggguaauuuuucauuuuuaagaaaauaagauggcuuucaaaacaagauuuuuuuuuuuuagucaaaaauuccuuuauggaucuaaaagucugguauuaagaaucagcugggcuaacacaagauuauggccucaauguaggaaacuucaaguuuucuaauuucuggggaccucccucccccagcccaccggcuccccaauauucaugaacuguuagaaaaaggcccauucaugaauggaguaucuguaggugggacacaguaacauacaugauaugccugcuucugaagauaugagauucuugcuuguaccuucuaaaagaucauucuagaaauacacacacacacacaccaaaaauacaaacaaacaaacaaacaaacaaaacccaaaaaaagaaaaaacaaaacaaaacaaaaaacccacaaaaccaggcugguaaccucuggguuagggagugucucauauucuguauuuuuggcauauauguauauuuaauauaucuauauuuaagaucuuuuguaccagagcaccugcaauucauuuuggucacaggaacuguuauucaugggucuguaccuccuccuucaccuggauaccacccaucucaaaggacucucuguuugagaagaaaauggcuccuacaccuucuagaugugaacccccaacugcacagcuaaguucgaauacauaguuuuuccccuuuauccuguagcaucagaagaaagaaauuuuguacuaacuuugcaaagauccucaaaauaaauauuuuucuuaguuucccccacuauugccaaauauuaauuauaauauuaauaauaaaccacagaguucuuagaugguaacagaaaagaaaaaacaaaauaaaacaaaacaaaacacaugguuccagcugcaauucuugggggagaaauaaaaagaaccagaagcacuguacuuucuauaaauaaguggguccugggagugggacugggugaagggcaggcacaccacuauuugcacacgaacugauccacaaucuccgugcacuucuugcauuugacauagcagcaccagugaaacuugcaaugacagcguucggucugcacugucuuaaacuggucauagccacgcccacagcacaugagcucgcagccguccauccccucugaggucuuguugcacaggcgucccugcgugcccagcgagccagugcucucguugcgcacacaguaguccggacuggggucgauguagaccagguccugcguggucggggaguugaagcggcuguugaccugcaccagcuugccccggcuguugagccucauggccgccgcgcuaucauacuucuccuugagggcaucgcccaccuuccggaaguccgccagcugcagccagcacgucuugaggcuacaggagccagacacuccaugacacuuacaggcuacaucugccagguuguauacugucuguaggaagaaagggggaagguuauuguacugaucccuggaggaggcgagaugcaggcaugggccuaguacacacuuuguagaggcagccaugucccuuggcugaauucaaggcuguguuacaucuucauuucccaccacuagaaauauuguauugccuucuuugaaacucugcaacuucuuagucuuuaucauucuguccaccacuaucacauucagaugggaacaggagaaagaaagaaagaaagaaagaaagaaagaaagaaagaaagaaagaaagaaagaaagaaagaaagaaagaaagagaaaaagaaaagaaaagaaaagaaaagaaaagaaaagaaaagaaaaaaagaaacugaucccaguggccuccaguuuuaugggagggaaacguuaucaguacaaugagaucuccauaucuugccuauccuaccugaacgcagacccacauccaagccucugaggggugugcuauuauccauuucuuugcagagaaggaaauggaggccuagagagacaaguucugcccaaccacuggccaguggggaaugccaggauuugaacccagacagugggacaccaagccuauguucagugacuugguaagugcugagcugggaaggggucuauccccagugggaucaggguuucaaugcucucccauucuacuguacuacuguguuagcucagcuaucaggacaccugcugugacaccugugaccucauccagucaugcuagcagcuugguggcauguguagaaacaggugauaacacgguggcauaggaaggaggcucacacagaucacacaaccagguuguaggggaacuuggucugggcuucaauuauguccacugcuguacccucuacaucccgacucuguccuguccuacccuaggucuugaggaccaccuugcagcuguggacagaggaugucuaacuuugcccuugaacuuaggcaacuggcugccccuuucuaaaccuauuuggcaccuuuggauggcaccaacuuccuacacaggaggguaaaauugaaggagccaaggaagcacuuggcacuccaaauccauucaguaagccuggucuuucuccagggugauggggccauggcccuggguuuuuugcccagucaccucaggccucccaggagcagugcucauaggccuggcccacaguacugugcccaacagucugggagguggugguugccuauuuauaguccuacugcccacagcuccucaugccagcgaccuuucagagucaucaugguauggcagcacuggccagggccuguccagaacccagagcugcuucugccugaacaauuaccucccuccuccaaggaauuauaaggacuuucuuuuacuaggggcccacaguacuugccauaaagacuugccauaaagacuuucagacugaggaaggcuuugcaaauauauuuaaccuuugcuccccuuuuaaggaaaaccaaaaguuaaugcccuaaaaaguguuaauaugauuuucuggcauaguguacaacuuucuaagguaccuaaccuccauuuuagagaagagcugguuucugugccucuuucuuacugaccaagauccuuccuuuggcucauccuucccaugacagaacaaaaccaaagacauggcaccuuagaagaugcaacuaucguuauuaagggcaacaaaaccagccaggucacuuucuaccuucugggggagggggguuccucuugacacuuggaaaagcuugacccuucccugcaauagacaagccccucaggauuucucucuaggaaagaagagauaaggaaguuccaaagauggcaggggacauuucugguugaauguguccauuggauccuacacagaggggaagaugccaggaugaugggguccuggaaaugcacccuuagggguuuucagagaccggagcuggaccccuccccugcaaucacggcuggacuuacaacagugacaagcaagagaguggcgcucucuagguggcaacaaccuggccccucagggaagcacaaucucauugacacccucagaugugagaggaaguuagcuggaauuaucuccaugaucugcggcuucccuagguccuaguauucugcaguguuuaauaauuaacguaucauuuaucaagcacugacugcugacugacuuuaaacuauaaucugagcuugaaccaaaggaagcauuguuguaagucagauuucuuaugguguggcccuaaugccugaucucacuccaucuucacaaggaccacaagugggagucguaaccacggccacuggaagauaugcaaauguggacaacgacaccagaggaucugauuuucagucagcaucuccaguggccacgccccuguguuucagcccuaggcuccaaugcaucuguuuaaaguauguuaacugagacuuauaacauagaugcaccgcuuuucuuccguagcugcuaagugguuggccucaguuucccaaucugugagacuaggguguuggggccagaggcuccuuccaguccuccuuguucuacucugugauuaucuuccuuuuuccucgccccaaaauacagaagagugaaaucucugaccagagaguuccuggcaccuaccuuggguucugugaaaaacuaaugacccugguuuucaaugcugccaaaguuaagaaacauuuucaccccuucauuuuaaagcagccauaaagugccauguguuuaaccgcaggggaaaaaagggucuuuuaaaauaucuuggaguagcuuuucauauccacaccaggggaaggaaagaggggggaagcaggaggcucaggaaggcuggggacagaaugucaguuucucuucucucuacagccacccuggauuugucugauggucagacuuuaaaaaugccaaacugcuaaaaugucuguccuuucccuaaaaagggcccaucaggucugcuacagaaugccacaagacagacagggaaaaagaaaauaaguguccaaguuaaagugaggccuuggccuugcuuggugcuuuccccaaacugaaacccagccacaaauggugaccucuacugugaccaucuguggggaccagcuaaaaagauacacagcauacuucucagaaaagagcuggaucuccagaguucauuuguggaucagucagucccccuagagggggagggcuuucuagaaugccuaccuuucuacagagaggcccacaaaugaugaagugacucaaggaaaaaaaaaaaaaaacuuugaaucccaguacucacaggugaaucucuaagucagaggccagucuagucuacagaaugaguuccaggacagccaggacuacaggggaaggggggaacccugacuugaaagaccaugaaaggaagggagggagggagggagggagggagggagggagggagggagaaggaaggaaggaaggaaggaagggagggagggagggagggagggagggagggagggaggaaggaaggaaggaaggaaagaaggaaggaaggaaggaaggaaagaaggaaggaaggaaggaaggaaggaaggaagggaggaaggaagggagagagggagggggaaggaaagaggaagggagggagggagggagggggugagugaagaaggaagaagggaaggaaaagaaagagagaaaggaagaggagagaagagaaggaaaaaagaaaauagaaaagaaaagagaaagagaaagccagaaaggagcagagccgaggaagauggaggaugccaaguauauacagauaggccaagguaugaguauccggagagaccugaacugagggggccaggacccaacuccuguguguggugggaggguacagggggugcagguuggggauaaaugguauggggguuggugguggcagggggaccauggcacucacccuacggccugcuucauuguuguguaaguucaugaggaugcgugcgcucucauaggaacccuuagcguggauucguucccuuucucuagcguccacgaacuccuuggcgaagcgguagccauagucgauguugucuccgcagccgccccacaaccagucccgaggcagguccuuggggcgcgcagcgcggcugcagccacagguagacagcucgcccucccggcaugcucggcucauggcguucaccaccccagcugcgcucaccgcguacgugaaggccgucucucggcugccugcgauuaaggaugaggggucacuagauugccugccccacacagaagccuaaaucuugcugggaauggggggagagaaggcggggcgucacuaagaccccuaacgcacuggccugugcaggcuggagaaggcugagagagccccaacauacauagaucauuggagagguagggauccccagcacucuggccuugaaccccauuguggggcugggggaaaccacucgucaaaacacgggagcaaacaguucucaggcccacugcgggcagaaaaaaacuagacagaaacccccugcagcaagaagaggaagaagcccuaacacagaaaaucuggauuauuuggugagagagaaagagagagagagagagagagagaccgaccccaacaugccucagcugcuacugaagugaaccggcagagauaaaccucuaguugacaucccauacagagccccacuccaaaauguacacucaggccugggcccaccucgugacaagcucagaaggauggauccagucacauacagcaacaacaaauaacaaaggggacagcaauaccugcgucugcuaggauguuuuagagucuaggcaggauuccaauccugcuggcuugauuuuucauuaaccccgauugaagauauucaaaacgucuuauuuccaaacaugcacaugaaagaagucauugaaagaaagcucagaacuaggcuagacuuuuuuuuuaacccuuguucuaaugugcauauuguuuucaccuugaacagagcagaauuugcuaggcuuagaagccucuguauaucucaaguccccaucucaagccagccugggggccacggauaguuucuaccuggcacccuuucucugcagcuauacucucuucccggcuaugggacccucugagcucuucccucuuuaccacucugcacaacagugcuaaaccugcccuggaauuucuucauuugagaaugagcaauuagguuuuuuguuuguuuguuuguuuguuugguugguugguugguugguugguugguuuuuugugcuuguugguuugguuuaguuucucaagacaugguuucuuuguauagcccuggcuguccuggaacucuguagaccaggcuggccucaaacucaaagaucucccugccuccaccuucuaagugcugggauuaaaagugugugcugcuuccgccaccaccaccccuacaugagaauaagcaguuaaguuuaaaacagcuuccugguucaucuugguucugcaucaacuacugcccuggaccacuggacucuccugcucugugcucucucuacccauggccuucgccugaaguggugagaugacaagauaaagaaaaggagaacagacucagggugaacagggaggggaauagauagaaagugugaagaucauuuccccacagaacacuuaugggagccccauccgccagccugagcucuaccugcaaaaggagacauugcuaauguaacaagaagcaacaugauaaccagcugcaccgugagagagaaagguuaacauugugcccauugaaggaagcuggaccugcauguaggggaaagacugguaccaugccucacuuucagaaucaacuguaaaauaagaguauugaaaugaaugcccacgaacuaaaggucccuucugaugcuaacauccccuguaccagacuggauuucucauacaguuaggaagcuugcaagcaaucuuuaugaagcaggggcagaacaaagacagcugaucucagccaaccccaaagagaaggccuauccaggaggaugguccugcugacucugguaccugcccucuccaggauuaguacugucccauaguucaugggggccauuugugauccccaggaaguccuauggcuuaagucauacagacucccccuccuacacuuaacaaaugaacaaaagcccaucaggagugugcugguagugggcaggaagaugggaccagaaagucccaguggggcuuuacuuuagauggcagagugugugcgcuggggguggggugggcuggggagggggaguggaaauaaaccaggagagcaaacggauugguggggguuauuugaagauuaacacugauaaugugggaagugguguggucugagcaggagaggguugugggauaaaaguguggguagaggaagaggagauaaacugauccucagaggacagagggggcugagacacugcccuuugaaugcacagagcguaaagggcuuuuauacaaaacacaaauccuacagagcuuuuuuuuuuuuuaacccauauaucuagcucaaucauuuugauuuucauccagaauacaaaaccugcuaggagucucuaagcuaauuguugacuguggaaaagcagcaguuugaagagcucugcuuggcuggggcugugugaagccucugugucucucuauggcugcucauuugguuaagucucccucugcaugaaaucuaggcugacuuggauccucacaucccuuaaaaauggugccuuccugacaucuuuucacagucuaaaaacaaagacaggagagggacaaaagcugguggggaaaaggaacacgggugaaaaaugagaauguuuccaaaaugaagcugggggcccuucaggaggcugcugcgcacggugccuccagggcaacuggcaccuuagaaaaaugagccuggagaggggucagagguggcagcaggagcuucucagacgcuggccccucacagggucagggucucacagacaaguguuccucuccacaucccugggauccugagaguuuuggagugacccgggcacaccuugggcaccagagguguuuucaacugucccaaaacucacugacuucaagcaaagccugagcucggaaaaagaaggcaaagacuuuguuccauucuuggaguucagucucugauccuucucauccagaaaaauuuauuauaauuuuccuacucuccuucccuucuuucaaauauuaaggaaaaaauuuaaaaagccucuugagagucaaaccuaggcuggcagguggcuuucugcucgaggauaaccagguacuugggaaccuggaugcaugcugugcuuccuggagcauccgauggcccacccacagcacuggucacuggucacucucaccucaccagacuuugagaggguggaacucacacaagccccaccguccagucccuaccagggaguaccacacagucaaagaccaaagaggagacaauuaaacgcagguguuuggaguaggagcucugcucaggccuugaggacacaggcacuuugaaucuuggaccacauuuaggcgguauuuagauucacucagcaagugagagcuuaucuaguacacucuugccuagagcaagcccccugccaaggaugaggagggagaggaaggaggaugucaaucaaagcuauguucaagugaguucacaguugggaagcacuugcaacugccccuuccccuggcuuuuucuaacuccugucccugugagaacacagguuuuaaaggcgguugaggugcuuauaaaggaaacacccaacagcacuugacauuuagauaaaacucugaaggagguuuuaacuucucucuugaaguuucggaaggcagaaguaaggucccuacgauauccccauuuggcuaccuuaaaacagucuauaucuagugaucauucccgcuucccugggcuuugcuacuucaguccgaccccaggauauacauuagcacauuuuaaucauugacagaaaggacaaagccccaugaaccuugcaggcuggggcggcaggcuguucccccacuggauuagaggagugguuuccaaaccuguguuauuuucgcuuaugaagucccuuggcucaagcauccacugacaacucuuuuuuguucucaaugaaugcacuuuuuaagguuuucuuucaaaaguauuuuauccaucugugauggauauuaagccaacucuuuaucuccagucaguauaaacaguuaauugccuugauaaauugcuucuuacuuuuggagucacugcagucuuauuaauuauaagggcuuguuugcauaaaacuaaagagaccuaaaauauucacacuagaaaacacacagggcccaucugucaaguaggaucgcagacuacugcagaaaaccacaggcaaacugaguuuucaauuauuuuuuuuucuuuugguccaauuuaaaugcugucuccucccugaauggaacaacaaacucaacaacauauuugaaauuaaaacucaaacugcacacaaaacauuaaauuaaaauugcuaugacagaguuucuagguugaaagcccaaguauguauuuuuuuuucugccaguugucaaaaaucacacacacacacaaguuguaucacuucuuauuaaaauucuuucugggacuaaaaauaaagcuuuuaacuuuauauaucucuguagccucaggaaaugucuauauuaggaaaaucaaaaccuuacugccggcauugccagcguucuaaaagaugacaacuugggccauuuggauuguggcuuaagacacaaccaucaggaggguuuuuaguuuuaaaagggcuuaaauggcucugcuuugccacaucuacuuuugaucaaucaaagcaaagcaggauacugcuucuacuuuaaauaaaaugcauuuuacaaaaaacaugaagugucauagagaacgaugggauaugaggugucacucuacugaucugguucaaggaguuagaaacugcaaucagaaguggggaucagaaauuaaaaccauucuggaaaagaaugcaucucccaagccaucacccaggcuguaaagcagacagcucaucaaacauugaagcaaacacaaagaccuuugcagacaaaggugaugggcaucccaacacguccuaccuauuugcaucacccugccaaagacagaaguauuguccacugugcugcaguuccaucuccgaugccggaacugguacuggcauuccuugaugccugucuucgcaccuucuccaauguacugcaugugguccugauacaaguggcagaguuucuucuguccuugagaaaguccugccaguuggcugcagagaggcugugcaccuaugauauauacuucugacaucugaacaggguuauucauaccuagagaccugcaaaggggagggggagauguucauucaagauuuacgugaacucuagagguagcucccuccuucccaaaaaccugucagccauucaggggcuugaagcaaacaaaugccuuuucucuccuguuugucugcaugacaaaguaggagaagggcuucauagaacuccucuguuuaaacccugcagaaaacagagguauugugcaguccccacccagccaucuggcucccucagucaguguuuucauugccuucuucugcagucacuacauaccugaaccaguauuucugaaagucacugagaaagggggggggggggaaguggagguuuccagagaccagccacuggcuuuagagaaagugacuugguaccuacaagguagaugaauccuccuugaaaauucaggaacaucaaaaguagagauaauuagguaggagauagcaguaccuuccgagaaauggaaacacagauggggaugucuauacagacugaagaaaaucccccauguuuuuagacauauuaaaggggauucuuaagugaauaugaaggauucaaguuaggaaauccaaugaccagaagucacauuuaacagucagaaaagaaaagaaaaaaaaugcuauucuguuaccagggagaaaauauccagaauggugccacacacaauccccgggauucacugcaacccagagagaaaaccucauuuagggacauuugacuauuucaaguucaccucccuuugaucaaauuucaagugcaaauacucucuauuuggggguuagaugucuucuaggacucugcugcuucagacacuguggcuuaauaaccucaaacgacagaaaaauaaaagggaaacucauuuuuauuuuaccuggugaggggguggcaaacguuauagauagacuuacaauuauuaaagaagugcauuucccuuuuaguacacgauguuacuguaaacccacaucucaacaagggccucauagaaaaaggcugagauuuauauauucugauuuccccguggaacugaguguaugauuuacaaaaugagcggguuacaagaaaauucacauuuuaaaagcucauagaacauauaccaucuacauuagaugaauguaccuaaggccauaacauaguccaaguguaaguuuuuguuuuuuaaaggcagaauaggcacacagaaucaacuuaccaccaagaauuagcuucuauaacaaccugggcgaaggagaaaaacguggccaaagccauuaggaagaacuuggaagacauggcaccuccagcgguccccaaagccacucccgggcuuaauauuccaaugggcuucuggagaggaaagaaaggagcagauguuuauugccuucagauaauuuucaagcauacaaguuuaaacaacggaaacauccgaggucucuuaaguuuacuguugauugacugcgcuucuccuccgugagguuuuugauggcaagauauaggcaguuucuuuuuccaaauuaauccacccacgcacccucaccaggaagucuuacuucgcugggauccugcgcgcggggcacgccagcgauuacaaacaugucucaaugcuguugagucaaagcccggguaccagguuuccugcaacuuccagucccucacccccuggcuucccucuaguuucccgcugcgcucggucccucccagaaaauucacucgguaacccgccgccacccucguccucucccggaccugggccggagcaacaaguggagccagaauuaauuccaugggcgagaagagcgcgaaggcgaguggagcgcacugccggaggcugcgaggaggcgggguggccggcgcgggggugggggugggggcaggacgcgggagggaagggcagggggugggggcgaggccccagggaccagcgaggcgcgcgagugcccagcugggaaaugcagcuccgaauuaacaucguauguuuuauaaucaguuuacggggccgauuuugggaaagccacuuccagauggggaagagcagccuggauuuccuuuaggaucugcuucagccaguuuggggcggggaguagauggaguugggggguaagggauaaugaaugggaagagggucggcucucccaccccagggaacccggaaagccugcccccuccugccagcggccucaagucaguacgagaggagacguaggucucggauagaaagaaguauccggcuucaguuccuuuaggggaggaucuuuccccuacccuucccuucucuuggaccccauuauucugacuuuuuacucucccucugguccccagguccagcagcggcugggaggcggggcgaaaaccacggagagccuguuguuucucuuggaguuguccccauguuuucaucgcaccacugcaggccugugucuugaagaacacugcuacccugccuccagucuagccucucuggcccaagucgggcucaguucauucaguuccaaaauguuggcaaacggagccgaggcgacagguccccaagcggagccagcucccaagcaucagcagugccccuggccuccagggcgcagggagccgggcggagaaguuuccuuccugaagauauucgggggcagagaguucucaggcugcucccacuggugauuuuuccaccugcaggcggcggcggagagagaagaguguggguacgaggagcagguuuccaacguuccccuuuacgucucugauaaguguaacucugugaugcccaaagcccccgagggagccccuucuuuuggaaaggcaagaaaggugaaccucuuccaggcgaaggcccugccgagaccagcuccgcaaaagggaugaaggggacccuguaggcaguagaaaugcuaaggggccuuggagcaggcgguagcuuuccuuuucgagccaccccuugggcuugcacaccuccgggcuccugguagaggaguuuaagugcuucccagugccagcuaaccagugcuccgagucucggcucggccguccccaaagcacagcaaagcuggggacgcauccuggagagaauggaaauguggaguuuccccagucuaagagaaagaagguucagucuccuucccuacccccgccugaagugucaaguuuccuccaggggaggggugggcuucagggucuuucuuugcgcggcccaggcugcaaagguuuagagucccuaguggaagcuaaaagcgcgcgcgcacacacacacacacucacacacacacacacacacacacacacacauucacaccacaucuauacacacccucgugcacacuuacacacucguaugcacagauacacacacgcugcgaagggcuccagcucucaaaucgcggcgggucucacuaacuuuuggagcuucacagcgggcggggcgcgcggggcggggcgcgggugguggagaaauugauaacagauucggcggauuacagggaaucucuuuguuagagccgaaaccacacaaaccgaacccuaucccggccgacgcccccggggcaaauccaccaguucccagaacccuggcuaacagcgagcggaggcaccggguuuacuggacucaggucuccucgguuacagcuuaggggugucccaaggagaucggccggagagucccgagagcagcaucugccuuggacccucuucacuugccuggaaaccucgguuuucuuuccucuccagucuguugcagccccacaaaucugagcgauucaaggaacucacagcgaacucacuaaggaacacuuccacucuagaguguaaaacauccgacccggugaguuuaggagaaaucgaagcgaagaagacgguguggaaggagaacuuucgggagacucccgcaacagaguuauauagauuuuuuuuaaaaguucuggucaaaauuauccagagaacgagccaaauguuuuccaauaggguugggaaagcaggcugagaagccggagcaucugucguuccccggcguacaguggagggugcgggcuuuuaagaggugcagcgcaggggugggugaagcgaaggaaaagcguuugcgagucuugaagccaaagacgcugaaucucgaugcugcugcuuccccauaaaggaaaccucaaagcuuucaggguggacuaggugagaggugcaggcugcagcgcugaucuaaggugccaacacgaaagagagggaaguugguggaaaagacuauuuccucggucuacauagcuacaggacacacauaaaagugcucagcucccaacuagagcggcuaggcacagagucuuuuuccagggucaggggcgggaaguagggggcaguggcccuacuucccaguugggucauuuccuucugcuagauucuacauuuagggcccacgucugagaguggaaaugaugagagaugccaacuaggcggaagagagugacccaggcucccaguggcgaaaaggaagaugggaaacucccagaucucuguucuugaagagauggaaauugaacaguguucuccagucugcucuuucucugaaccaagaagaccgauggagaaacuugagggagaagaacucugucgcuggaacaaacuugguucuccggcuucaagaauggcagagagaagacaaugaagaaaugaccaaugucugcuuaagggggaguagacaaaagaagcguugcuccccaucuuuagggccugggcccagcugagcuguaccugucccacuucaugaauacacguggucagagcacaugcagcaggcagaaauagccagugagauaagccagagguugucuggagcugcagucaggguaaggaaccugaaaaauucccgagugacccagaauugccaggagaucggagaacaguaauaguccaggagauaaacuucggcucuuuuccuaagcuucagcgauguucccccaggguucucaaggacccacacacaauuaccucgaguaacugagcacagagucauuugucuaaaacaguuguguagccccaagagagagugagaaaucaaagaucgguucacucccaaucuuuacaggggauuuuuuuuuuuacagacgaaguucauaaaugaaaacaaaaucacuguuuuuguuucuguguuuaauggaugaagaagcagaggcugagagagggaaacacaacaagcauccaggaccacagaaagaauuggugagacaaccagggccacacccgaggccuuguacugugacacucccucaccagugaccagaagggucgaaauccuuaguccaaauugcccaaggccucauugcuggguuacaccuauggcucuuuucuauuugaagcucgggguaacacagauuguccccuggcggagaccuuagaagggucuuggugggaagaguggggcugaguugucuccaggggugcaaaguugaaggacugggacucagagaggccuuauuuccagauggccaacagggggcagccggcaccgcgcggccgguuagaaaggccgcguuaaagcucaagaguuuugccggcacguagcgcgccccuugugcacaggagcgcuuuggaagggaagaccagggucuugggcuggaccuccuuuggaggaucuagggccgaaccgccaagacuaaagccagcuugucaaaaacugaucuccagcuccccaaguccccaaagcaaagcaagggucccaacgcguccucucauacccuacuuuccgccauuccucaauugcuggguacuuacaacauugucuccuccaaaucccccccccccccgcaaagccucgccugauggaaaaugucuugaaauuaaaucuggcuaggugugcuaauaucgucaagacagcagaugcugaggagguacgaccucaucacccgacccaaguuauuucccaggagcgaauuguucauuuaaagugagaccacggagcuguggcucggacagggcauagaggguaaaacagggccuuagaagcaccgggguuuaaaacccuuucuuugaagaaagaacguuguuugcuuuuaggaaacagcuucguaccgaucuucaccuuacucccuacuagaaagcuggaaaugagagguaugaaguauaaauggaaauuguuaucgaggcguggaggauaaccgaaggaaaaguuguuuggaaaauugcuaguuauauuucaagacgaaacguuaacuuuuuuguaaaagugaacucucggugacccucagagugugugacucggcuuuaacauacaacugacaauuaaaacaaacacgaguucacaaacuaacccccgcccgaucucgaaacgcagaggcccuagagucuccaaagcacuagguugacuccgcucagggggcaggauuaaagccacuaggaccacuacuccccgcccccaaugcugcaguaaaggaccugagcucacccagaggccgcuaauaaagcuaauaacgcgacccugcuccccgcgcggggugcgcucuggccccccgccaggcacucuuaaaggcacaggggccgggaacgcucggguuacucgaccuggagagccgggaacugggcccugaucggagguuggggguggggugugcguugcucuaggguagguggccccuaguuuccuuagucucgcagccguuucuccuaacacaguccucauccggccucagagcuucagccacacaaucuccgcgugccggugaaaugagcguuugauauauacuugaugaaucgaaucauuauccagucacugaaauacacguaguaaaacuacacuccaguucucgagguaaaaaggcgcgccgccugugacccgaacugucuuuccugcccucgcucuucuccauaguugaaaagguuugaagaauagccggugcaaaaagucuccaaggacgcagaggcaguguccccaggguaagggacgaaaagauaggagucccugccggcgauauuggaguuuagcuuucuccaggcaguuagagaaauggagaggauagggauagauugaaagaguucaguuaacuuugaaaagggggggaaaaaguagggagcguccgugcgcacagaacacuuaccuucauggcgagggggagggggcacggagaggaagucgccacccgagcgaaggcggccgaggaauucaagcgaagcgucgggguuaagccuugggggacaauccaaagcagggcugcggaguccuccugggcgcgucgggugggcgcagcgacccggagcggaagcgagcacuggcgcccggacucgggcagaggaguugguauagcguggaaaugugcccaggaaccgagagggcgccggcgcgcgcgggcgagcagcaagcgcagggccgagcggggacacagugcaggagccgcggguccgacgagggcgcgcaggcgacuguuccgcggcgaggcgcucccucucuaacguccaucagcgacggcgguaauuagggcuuuccaaccccaaaugugggcgugauugugcaaaagacuuuacaacaaauaauaaaaaaaauucuucacaagaaggugaaaaaaaaugccccacuacucaacuguggcccgaggcggggaaggagggggggcaaucccugugcccaagaugcccccaguucauucacaccacgaauucugcagacuccaggcggcucacgccuccugauugucagcuccuccucucugggucuguggccgaaacgucugcuuccagggacugcuccugcagcugaguuagcuagugaaccucuguguacacacagacacacacccaaacacacacacauacacacacacaaacgcacacacacgcagacacagagacacgcgcucacacacacacacagacacacacacacacacacagagcagcagcagcggcggcggcuaugggaccacagaacaaucaggcacgcaugguuuuuucuccgggagaugccgcugaaaucgcacaagucgccaucagagcugcaagagucagcgccaaauuuuguccuuucauuuuagagucuggcaaaaaccaggcgcaaagaaaauggguucaaggcagcccugaacuuucugccgcuugguggcuugagcgguugauggacagcuagccugugggggaacguuggcuucccccuucugguccccuucuuucuuucuuccuuucuucggguuaaccuucuucuuuccacccccccgccuuuccagagagaacagagcgagaggacggagggcgcagagcuccgcgguggcgacucaacuccagagguccauggcggccgaggcugcccaccuccucggucgcggccgggguccgaggggcggucguggggcccggcggaggccgcggaaggagauggcaaugcagcggccgcacaauccggacuccggacggcggaggcggugccucggagccugcagcaacuuuccaagcgaugcggugccccacagacug

SEQ ID NO: 7327 - RNA, 3323 nt, Mus musculus
uaauuccaugggcgagaagagcgcgaaggcgaguggagcgcacugccggaggcugcgaggaggcgggguggccggcgcgggggugggggugggggcaggacgcgggagggaagggcagggggugggggcgaggccccagggaccagcgaggcgcgcgagugcccagcugggaaaugcagcuccgaauuaacaucguauguuuuauaaucaguuuacggggccgauuuugggaaagccacuuccagauggggaagagcagccuggauuuccuuuaggaucugcuucagccaguuuggggcggggaguagauggaguugggggguaagggauaaugaaugggaagagggucggcucucccaccccagggaacccggaaagccugcccccuccugccagcggccucaagucaguacgagaggagacguaggucucggauagaaagaaguauccggcuucaguuccuuuaggggaggaucuuuccccuacccuucccuucucuuggaccccauuauucugacuuuuuacucucccucugguccccagguccagcagcggcugggaggcggggcgaaaaccacggagagccuguuguuucucuuggaguuguccccauguuuucaucgcaccacugcaggccugugucuugaagaacacugcuacccugccuccagucuagccucucuggcccaagucgggcucaguucauucaguuccaaaauguuggcaaacggagccgaggcgacagguccccaagcggagccagcucccaagcaucagcagugccccuggccuccagggcgcagggagccgggcggagaaguuuccuuccugaagauauucgggggcagagaguucucaggcugcucccacuggugauuuuuccaccugcaggcggcggcggagagagaagaguguggguacgaggagcagguuuccaacguuccccuuuacgucucugauaaguguaacucugugaugcccaaagcccccgagggagccccuucuuuuggaaaggcaagaaaggugaaccucuuccaggcgaaggcccugccgagaccagcuccgcaaaagggaugaaggggacccuguaggcaguagaaaugcuaaggggccuuggagcaggcgguagcuuuccuuuucgagccaccccuugggcuugcacaccuccgggcuccugguagaggaguuuaagugcuucccagugccagcuaaccagugcuccgagucucggcucggccguccccaaagcacagcaaagcuggggacgcauccuggagagaauggaaauguggaguuuccccagucuaagagaaagaagguucagucuccuucccuacccccgccugaagugucaaguuuccuccaggggaggggugggcuucagggucuuucuuugcgcggcccaggcugcaaagguuuagagucccuaguggaagcuaaaagcgcgcgcgcacacacacacacacucacacacacacacacacacacacacacacauucacaccacaucuauacacacccucgugcacacuuacacacucguaugcacagauacacacacgcugcgaagggcuccagcucucaaaucgcggcgggucucacuaacuuuuggagcuucacagcgggcggggcgcgcggggcggggcgcgggugguggagaaauugauaacagauucggcggauuacagggaaucucuuuguuagagccgaaaccacacaaaccgaacccuaucccggccgacgcccccggggcaaauccaccaguucccagaacccuggcuaacagcgagcggaggcaccggguuuacuggacucaggucuccucgguuacagcuuaggggugucccaaggagaucggccggagagucccgagagcagcaucugccuuggacccucuucacuugccuggaaaccucgguuuucuuuccucuccagucuguugcagccccacaaaucugagcgauucaaggaacucacagcgaacucacuaaggaacacuuccacucuagaguguaaaacauccgacccggugaguuuaggagaaaucgaagcgaagaagacgguguggaaggagaacuuucgggagacucccgcaacagaguuauauagauuuuuuuuaaaaguucuggucaaaauuauccagagaacgagccaaauguuuuccaauaggguugggaaagcaggcugagaagccggagcaucugucguuccccggcguacaguggagggugcgggcuuuuaagaggugcagcgcaggggugggugaagcgaaggaaaagcguuugcgagucuugaagccaaagacgcugaaucucgaugcugcugcuuccccauaaaggaaaccucaaagcuuucaggguggacuaggugagaggugcaggcugcagcgcugaucuaaggugccaacacgaaagagagggaaguugguggaaaagacuauuuccucggucuacauagcuacaggacacacauaaaagugcucagcucccaacuagagcggcuaggcacagagucuuuuuccagggucaggggcgggaaguagggggcaguggcccuacuucccaguugggucauuuccuucugcuagauucuacauuuagggcccacgucugagaguggaaaugaugagagaugccaacuaggcggaagagagugacccaggcucccaguggcgaaaaggaagaugggaaacucccagaucucuguucuugaagagauggaaauugaacaguguucuccagucugcucuuucucugaaccaagaagaccgauggagaaacuugagggagaagaacucugucgcuggaacaaacuugguucuccggcuucaagaauggcagagagaagacaaugaagaaaugaccaaugucugcuuaagggggaguagacaaaagaagcguugcuccccaucuuuagggccugggcccagcugagcuguaccugucccacuucaugaauacacguggucagagcacaugcagcaggcagaaauagccagugagauaagccagagguugucuggagcugcagucaggguaaggaaccugaaaaauucccgagugacccagaauugccaggagaucggagaacaguaauaguccaggagauaaacuucggcucuuuuccuaagcuucagcgauguucccccaggguucucaaggacccacacacaauuaccucgaguaacugagcacagagucauuugucuaaaacaguuguguagccccaagagagagugagaaaucaaagaucgguucacucccaaucuuuacaggggauuuuuuuuuuuacagacgaaguucauaaaugaaaacaaaaucacu

SEQ ID NO: 7328 - RNA, 1234 nt, Mus musculus
gcugaggaaugagaugaguuacuggcauuugaaaaacaaguuaguggagaacaaagcacgcuucgcuucggcuuucccaggaguaauacauacccccaggccgucugauuuggaaccuguguacaagaacuuugaaggcccugcuaaucucagaagcugcuguaccuuguuccaucccugcagcaucucucucugccugccacugagguucucacucccauuuuacagguaaguagagugagucacagagggaccauuaguuuuugggucggcagugcaaguuaaagcugucuucuuuuggcuguucugcaauucacuguagggugaauggauggcacgugagaccugcccacaccaucucauuaugaacagaagaggugcauccuggcauccucuugccacaucagcugcacacccagaucacccaccguaagcagcuggggagggugagguggaggugauucaaguucauggacugcauguggcuugcuuugugacaggguguuguccuguguggacuuuugugcaguuuuguuguccaagcugggguagaaaccaaagauauuuaugcuugaagggaaggcugggggucggggggugggucccaggccagggugcuugggugagaugggauguguuucucuagcucaaucccuccuucccaacccagccuuucuucuucuucaaagagcacucugauuauguuuggggauccagccugcccucaccccuaguguaaacagaggcaagugaccuagccuggacagucaggacucucauuccccaacuguaugaugugucacauggccccauaagccagccaagugucgagggauaauuggccagucuagaucaucuugcuuggauuuuaacagacgucuucucaaccuccuuuucuuccuuuucuucuacuccauauuggauuugcaucugugaaagcuugguacuguugaugccaccuugguuucaugagaaaagaaucugaaaucaaugccaagaagaauaaguggagcccaagaggaagaaaccaaugucuguauuauuugagccccuggauccagcugagacugugcuuauaaauauccuacuuacgggagacaaugcauucuccuuccuucaccgagaugauuuggguuguauuuucugucacuauugcuugaaaaaaguucugauacaugauaucaggugucacauucacauaacucuaaauaaaggaaaugugcuuuucuggaag

SEQ ID NO: 7329 - RNA, 1333 nt, Mus musculus
uuuuuuucucuucuacauuaacucuuuccugacauggccuguuuucucccuauuaauuguuggcuguaaacaaucucauugugcugucaguggguagccagcuaucaucauacagauucuucacgguauuauaaaaauuaacauggucacccaaaagacagacagaccagagacaaagaguguuuggcugugggucccuguaucugcucccaucggcuucuggauguugucccacugauggccacuggguuagaugucacucugugaguauagcagaaucccaucgggcaucauuucaaugacuuuaauuuaauuuacuuucuugccugucauauuugguucuauccugggucugccccagaaucaacuaagcagggcucacaggggcucauagaaacccaaagcaacaaacacagacccuguaugggccugaccuagguccccugcacauacauuacgacugccuacaaauggaagggaagguuucgcugccuuuuuuaaaaaagagaaacagaaggaguugaucugggggagagaagagguaaggagggacugggaggaguggaaggagaagaaggcuugguuagaauccauuguaugagaagagaauaaaaguucaaacaaagugagacaaagaguggcaacaucaaaaugguagacuuccauccguccacagcaaacguugugcuaaaugcuagcaacagcuggaguaaccaaaaugguagccccucacacguaagucugccuaaccuuaaagaugaaaccuuccgucacacggucucucggggccacuuaauaacugcaguuacacacagcuaaucgcugcugugcugccagcacauauaggaggcauuugcaccacggaaggaaguuguuggcacugaccuaaguucugauuuuaaaaaggaccucauaagauagacaaaaguguggcaucucuacguucucacuaagagaaccacugugggauucuuuuuauuuuggauguuugagacaagcacucaucaugugaccuaggcuagccuguuaacucaccauccuacugccucagccuuugggguuuaugggccuggucaccacauccauuuguguauaguuuaaauggccgcuuagauuuuuuuuuuucugggcaaaacuaauuuacuuaacuaauuuucaacuauuggacuuguaacaguuugcuagcgagaagaguacuuuaaauauaaauaugcagcuagacuaaaaguagucacagagccagguguggugacacacaccuggaaccccagcaccugaacuacaagcaauacugagccuuccacauaugguggcuuucucuguauguacagac

SEQ ID NO: 7330 - RNA, 1333 nt, Mus musculus
gucuguacauacagagaaagccaccauauguggaaggcucaguauugcuuguaguucaggugcugggguuccaggugugugucaccacaccuggcucugugacuacuuuuagucuagcugcauauuuauauuuaaaguacucuucucgcuagcaaacuguuacaaguccaauaguugaaaauuaguuaaguaaauuaguuuugcccagaaaaaaaaaaaucuaagcggccauuuaaacuauacacaaauggauguggugaccaggcccauaaaccccaaaggcugaggcaguaggauggugaguuaacaggcuagccuaggucacaugaugagugcuugucucaaacauccaaaauaaaaagaaucccacagugguucucuuagugagaacguagagaugccacacuuuugucuaucuuaugagguccuuuuuaaaaucagaacuuaggucagugccaacaacuuccuuccguggugcaaaugccuccuauaugugcuggcagcacagcagcgauuagcuguguguaacugcaguuauuaaguggccccgagagaccgugugacggaagguuucaucuuuaagguuaggcagacuuacgugugaggggcuaccauuuugguuacuccagcuguugcuagcauuuagcacaacguuugcuguggacggauggaagucuaccauuuugauguugccacucuuugucucacuuuguuugaacuuuuauucucuucucauacaauggauucuaaccaagccuucuucuccuuccacuccucccagucccuccuuaccucuucucucccccagaucaacuccuucuguuucucuuuuuuaaaaaaggcagcgaaaccuucccuuccauuuguaggcagucguaauguaugugcaggggaccuaggucaggcccauacagggucuguguuuguugcuuuggguuucuaugagccccugugagcccugcuuaguugauucuggggcagacccaggauagaaccaaauaugacaggcaagaaaguaaauuaaauuaaagucauugaaaugaugcccgaugggauucugcuauacucacagagugacaucuaacccaguggccaucagugggacaacauccagaagccgaugggagcagauacagggacccacagccaaacacucuuugucucuggucugucugucuuuugggugaccauguuaauuuuuauaauaccgugaagaaucuguaugaugauagcuggcuacccacugacagcacaaugagauuguuuacagccaacaauuaauagggagaaaacaggccaugucaggaaagaguuaauguagaagagaaaaaaa

SEQ ID NO: 7331 - RNA, 6769 nt, Mus musculus
aguauccacgccagcggaaguuacuugugugacugggcggaaccucuagucaggaguggucucccagcagccaaugggcucgacccaccucuagccugacuugggucugucaguggccugugacguacagggcggggcgggaggcuagguacggcgacaacaggggcguccggucuucucugucgcuaggaagcaggcaaccggagggaagaugguuuacaucucgaauggugagugagagccuuacccugggccgcuucuguccugacucgccggguccugagcuuggggcggccucccccacaccaguggccggaaggagugggaagcggaggcggugggagccgaggcgcagcccagaagguccccgggugccgcugggggacccugaagccuccugguacagccaauuuuccgauuguggguuugcgauagugaucccgggcgcggguguccuuaacccgggaaugacagagacgcuaacccgguccggauacaacgcgcuuuuguuugggccgcuagagccgcguucuuugccuagcaucucuuucauccuuguaacuguucuauucagaugguguauuucuaucccuguuuuucggaugcagacugagacauagauugacuagcucgcuaaagaucacaaaggcaauaugaaauuuagguuaaauugaacucagguuggcuccaguauuaccuaccauacugccucuauaaugcguacaauaaugauggcgaugguggugaugcaggacuagcaagaauaugaaaaaaauaaauaaaaucuggagacagggucucacuuuguaguuuuaucugcccuguaacucacuguguacgcuaagguggccacuaacucccaaagauccuccugccucugacuccggaguagugggauuaaauuaaaggcaagcaccaccacgccaggcaauacaaaaguugugacagauuuuucuccccuaaaaguguagcuaguccuaagcccaagacuuuacccaguuugaaagaacuugggaagcaagucuccaauuacuggaaaagaaaaaaauacagccugagaaggucguaucagugccagaaccaucugcccaccugugugacuuaggugagacuccuuggcgcauuucuacaagacucucuuggggcccuggaaauaggugugguuguaucagauucaucucuguaucucuagagaguagggcgauuagcagaagucuuagggcugagagcacuuugaauuucucggcuuuuuucaggauuucaccuccugauuacaaagcuuugggauagguggugugaugggcacuacaggaagcaucaucauuccaucuucaguuucgagcgcucgcagauucuguuauuugcaauuuaggucacuagcucauacagcuaugcacucaaaagugaucaguguucuucugcugcauccaucucgccacuaaaaugucaugugcauuuuaccagugagaaggagauggcaaagagaugccuagaaugaguucgccuccgagaauuacauacugaaaguagacaucuaucgaaggagugaacgcuagaucccagaguuugacugcacucacaguggaccucugauguugacuggcuugaagaagccaacaagucaaaagcugagcucauugguguugcuccgcugauuaaaggcagcgccgaguuguggacuuguggcacuuaccucaguuucuuucuuuaauucuguaggucagguguuggacagcaggaaucaguccccauggagagugucuuuccuaacagacuucuucuggggaauagcagaauucgugguuuucuuguaaguauaaaagcauuucuuuaauugagaccaaguguugcuauuuagucucauagcugguuuaguguuauagagagucuaagcuguucuggaagucauuguagucaccccgccuuagccuccuaaguguugaaauuacaagaaugugccaccacuccugguucugaacuuuuaaugaaggguuaguugauaauggggaaaaaaaaaugucgacuucucaggcauuuuaagcaguucuguauuagaugaggucucaggcauuuuaaguaguuguguauuagaugagggguggugucugaccauuacgugcugugcuaccuaaacugccagccaguuacuaccaggucuuacuuacccugaauugaguaaauauuugaaugucuccuguuuggaaagucaugaguagauagagaaggauacgucccccuuucauugaguauugggcuggcaaguuuuaugucaacuugacacaaguuagaauuacugaaaauaggaaccucaauugagaaaaugccuccauaagaucaggcuagaggcaagcccguaggacauuuuuacuuagugauugaugugggagggcccagcccauuguugauggggacaccccuggguucuguaagaaaacaugcuguggggagaaaggcaggaagcagcaccccuucagcaucagcuccugccuccagguuccugcccuaguugaguucuucuccuuacuuccuucagugauggacuaugacuguggaacugugagucaaguaaaccccuuuccucuccagcuugcuuuggguccugguguuucgucacagcacuaguaacccuaacuaaguauauuaguacugucaguuuucauagucaguguaauuuaguauauucaguauaauaucagccuucauauugcagggauaguggaugagugccauuguggaaagugcacuugaggaaguuacccaaggagggacaaggcccugacuucaaaguuaccagugcaaaauuuaauuacuuuugcaaauuuuaccuauauuguuuacuguuuugccuuaguuuaaccccuccaucuaagaaguuagaaaacuggacuaagaauggcauacacuguuaaucccaguauuuagaauucagucaggugggauuuaaggccagcuaggcgucacacauaguaaaaccuugucuuuagggggaaaaaaggaaauugcauuuucugacauucugaguaguucugugccucugacuauaauacccuuaucuauucccuccgcaaggugaugucagguaggcuauaggcagaggaauugcaggcauggugaauguaagacacuguuaaaaacagaauaaguuaguugggguggggcugaugacuguaugauacuguaaaaauagguaaugcugacaccuaagaggaagaaugacacugacgaggacucuggucucgugcugucuacaggugucacuagcagaggagaaaugcaggggcagguggcuugguauagaacacggcacgcccuguuuuagacauaugcguaugcuaaguuuguccagcuggcaucaggaacuggaggcuuaagcuaauaaguuggguuagucaccgucuugcagagauuagagaaccauggcaguaugcuugacacuggugucagaagugagacucuguuguuuucugccccuuuguuucaguuucaaaacucugcuucagcaagaugugaagaaaagaagaggcuacgggagcuccucugauuccagauacgacgauggaagaggguagggagagccuuuccuacugaugauguuucuccuuugucuucaucuuguuguuuuagauagaguugaaccuguaguaaugaaaaucucauuucacaaacuuaacagguugcuauaaacuaaaagucgaguugcuuuuucugauaaacagucaaacuagcagaacuauaacauuuuuaaauuuuaauuuuaaaauuuaccccaggaaagcuaaacuauaggcugaaaacuaaugcgcaccauucaaaucuagagacuucacagcucagucuggacucagccgccagcugagaugagaagcggcaccagcccugcacugggcuuggguuuacuuaagaggaggagcuacagcccacacgcugagcugaguguuugcagucuugauuccugacuagaguuugcuucucugcuguugugauccagcacugaucacaagcuacuugggcaaggaaagucuugucacagugcaucaccuagggaagucaaagcagggccugaagcagagaccauggaggacagcugguuuuggcuuccuucuccuggcuugcucagcuaccuuugucauacagccugggcuggcaccauccacagugggcucucagcagcuaguagucaaauugcaacacacacacacacacacacacacacacacacacacacgugcccuguuagccgcucugaugauggaggcaguugcucaguugagguucugucugaucaucuauuaggucucagaccugagacagauggcuaacugagguacucguuaaaauaucaaagcagacaccggccaccagguuuucccggcagccuucagucccauacuuguuacaggguauggcuagcauauaaugucauauaauccaaacauuuugguuacuuggccucuuugcucuacccuuuacgcucgugguccaggcugccccccuuggucagugacuucucucuccacccugcuguccucacauggccauggcccggcucagucugcccacauauguuuaaaacuucuccgugugcuuccuuuucuuuuuuuccauuugcuaaccugcaugguaguugcuguuuuaagacucuuaggguugcgugccuuguuuuguuuuguuuuuugagauaggguugacuuuguagcacuguuggcucaguccuggcuacauauccuaagcugaccuuaaacuugugauaaucuuucuuccuuggccucccuagagcugagauaaccauuguaggcuaccaugcucauuuuccuguguuuauugaaaaaggugugguugaaugcuuaauaaaaggaaccaauuggccaggaauggugguguauaccuuuaaaaccagcucuuaggauacagagauagacagaaucugaguucaaggucuggucuguauagagaauucaggcuaggcaacacuauauagcaagacacucaaagaagagagacccaacugaagcuggguuuacuaaacauuacaugcuaacuuccucuuuuauuaggccaccaggaaacccuccacgaagaauggguaggaucagucaccuucguggccccagcccuccuccaauggcugguggaugaggaagguaaguuaaaaucugaaaugacuuugccuccuuaggaauauuuuguuuagaaaaacagaagucauguuuuuggugagggguuuuucgagacuggauuuuccuguuaaucccugaacuagguuggccuaaacuuaagauuggccuacguaugccuccugaguacugggauuaaaagugucccccaccaccaccgacugacuuuguuuguuuguuuuauguguaugaguguuuugcuuacaugaacauaaauguacuguauauguuggagggguggaggcaaggaggagaccagaagagggcaguggaucugcaaguggcauuuuaagauuuuauuuugacuuaggugugugugugugugugugugugucugccugcuugugugugugugcguguguguauguguguaugugugucugcuugugaguaugggugcccauggaggucagaauaagucaaauccuccuggaacucuuguagucagcaguugugagccaucuaagauggguacuuagaaucuaacucuuguucucugcaagagcaggaaguguucuuagcugcugagucaucucuuuggaaauugcauauuuuauuauuuagagagauauaucuuuuuuuaagauuuauuuauuuauuuauuauauguaaguacacuguagccgucuucagacacucuggaagagggcaucauuacgaaugguugugauccaccaugugguugcugggauuugaacucaggaccucggggagagcagucagugcucuuaacugcugagccaucucuccagcccaagauauaucuuaauucuuggaaguuuauugacuuuauuauuaaaauaucaguugagaaaagauuuguuuuaccuccuuggaccuccuuggcuucauggccagcucucuucacuguuucuaccccucaagaauuuaaugcugauauacacaugccagagagagagaaagagaggggggagagagagagagagagagauccaguuuaauaagcaggagcuaauucuguuaaccucuuuuagguaaaugucugcucugagaagcagacaacuagacauacacacguguagaaggaagccaucaagcggugaagagcggcucgugcaggagaagaugguguauguccaaacaaggauugcucuguguccccacagaugaaugaggucaugcugggaauucccucugcaggaucuagccugacugauacgcaguucuauaaauguacauguuugucuccuuaucuuuuuuuuguauaguuuacuaaaguauuaauauaguuuuaagaaguaaauauuucuagguugcaaaacuuaauuguucgucuuuauaugaucauacccaaaaucuuugauccggaagaaauaaaggccauguauuuaguccuggaguuuuguuugguugguuuuguuugauugguuuuguuuuugucuggcuuuuccaagccaucacccccuucuccaguguauauaguucuguuaauuuugccuuuucucagcuuuugaaauacugcucacuguuacuuugcucucauuuauaaauaaaccaaaacauaauuauuucaguaguacauguaaauuugcuuuugaauuuuuaaucuuuaauauacuuacuuuguaaaugca

SEQ ID NO: 7332 - RNA, 28017 nt, Mus musculus
cgacgccgguggcggccauuuugacugugggcagccaggggacgccgcgccugcgcaaugguucuccucugacugcuguggcgucggugucccagagccccggggcugguggugguccacgguggcagagaugacccaagccgagaagggggacgcggagaacgggaaggagaagggcggggagaaggagaaggagcagcgcggcgugaagcggcccaucguacccgcguugguccccgagucgcugcaggaggugaggugcagggggcuggccuugguuagaccacugcuagccugggccucugcugcuggccggagcccaggguccgggcggagccggaagcauccggguccccucccauagguuccuugugcaaaguagcgcggugcagggcaaagccaaggccgcggugcacagccuccaggucucagcuauaagacgucacgauuuagcaacggccuggcucucagggacgccagcagauauucagggaugguuagggcucuaaccaguuucuuuguuugcaaaucucacagugcaagucauuucacguuuaaaagcaggaaaaagguagccuuuccuuaaauagacaugaauaauauggcaauaacagcacaaguuuaaguaaacaacuuggagcagcauggcucacacucucacucaccagggcuuacugauaaguaaaggaaauaaauuccuauagggaaaugggccacggcagugcacagcucccagaagaaauagggaaggaucggccguugaggauuuccuguggaccauuucagaaccuucuuccucucccauagguggguugaaauaucuaacugguagggcugcaguaaaaugcauaguguggugugugggauaggcuaguucagaggacccacaaugucucucuuccagccucgacaggagggcagaggucccaggaggcuagagauuuagggugagguuagaaugguuuuagagcuaugccagguuuaucugcauuucucaaccugugggucguaagcccuuuggggguugcauaucagagauuuauauuaugauucguaacaguagcagaauuacaguuacgaaguagcaacaaaauaauuuuaugguuggggguuaccacaacauuaggagcuguguuaaaagguugcagcguuaggaagguucuggggaagagagacuuggaucuggagaggaugugaaggauuggagacauagcuguuuagaauagagaaagacgguagagauuuucaguguccacacaagcucguaacccagcgucuucaucgaagcuaguggagaauuuuggagugggacgcuaacuugauggcguugugcuacaacguuuucguuugcagagcuuacacuugagagccacucagcugaguuaccaauaaaaaggaaaaaacaaaaccuuacuguuuuaagcacguccagguuuacaguuuuaugguggauuucagauugaacaguuagcguucucuaaggccgacaguucuacauccaggcugccugacuaacucuggcauccucacaagaacuugaugagguguagggggcugcaucagagcaaguggcaggcugaauuuauagcauaucuuccggucccuuuucuacacuccagugagucucgucacgugcuuugacuaucccauacccucuggggcacuugugcuucauggacguuucucagucuuggguuaaggaaugaauaauuuccaggaaaugaugaguggggcauacuacuagguuucuuuccuaacacauuaaaauacauaauuacuaaaauaaaaauuguccauacuuaacugcauuuucuauucuuucuuucuuguuuguuuguuuauuuguuuguuuguuuuuucgagacaggguuucucuguaucgcacuggcuguccuggaaacucacucuguagaccaggcuggccuggaacucagaaaucugccugccucugccucccaagugcugggauuaaaggcaugcgccaccacacccggcuucucuagauguucuucguucacguauauacugaagcccguggguuuuugauaacguccaggugucccucauguguuuugcccuuucgauuggcagauguccuccauagcacagugacacugacagcauguacugagacuggguaggaaacaagacagacacgcccucuucacuaggguuuguuguacguccuggaaaggaggaaggcucuacgaucauauaaugaagggaccaucacacuuacucugggugauguuuaauucauuccugaggggaggaguuagauggagcugaaggagagaaccuugccagcagagggagcugcguugcugaaugcuccagaguuguugaguuuugucaucagcagaagucuggauugaagcugugcagaguggcacauguguaaagcagaacuuggggucuggguugagaggguuugguagacugaaaggacaaccauucuagaacaagggcuggauggagcaguuuaagccuuuguauuugugagccacagaaauguugugagagaaacuuacgcggcgaggucagcguaaaggagguaccgaggacuugggcugggauuguggaucucaauuguggucuuguuuucuuuuaauagaaacucuguggggguggggguguguacacauguuagugcaguacccauggagcccagaagagggcaucagauucaugaaguuggaguaagugguagugcgcugccugaugucagugcugggaaccaguuuucugcaagagcaauguucuuuacucuugagcugucugccuguuccagauucccugcuuacagaggcauggccaaagucuccuucccauacucuugcugaaacuuugaaugccucaacaaguuugggggguggcgggcagaaguuuucccaaucgagcuugaauucuucccccaugaaaguuauagacuuaaaauagcuguucuguccaagccacagccauugccuuacuccuuuggauuuguucucgucaucaguuuuccuucacugugcugacguaccaggacaguugcgaacucugacuuugaaccccaggcucuugccagaucaggcagacagcaggcagagaaccuaggugacaagcccguguugaugaauauugcuuccagcauugugaagcaggacugugcugauguuauuuucucccuugaacuccucaagcaaacuugaaugaucguauuagucaucgcagaagcugucucagcuagccaaccccuaagcugccuggagcuucugggucuaaacaacuggaggaaaggcgagcccuuccacuucuccucaguccccugucuucucucucaucugaguguauuucuuuuuuuguuguuguuuuuuuguuuuucgagacaguuucucuguguagcucuggcuguccuggaacucacucuguagacgaggcuggccucgaacucaggaauccgccugccucugccucccaagugcugggacuaaaggcgugcccaccacgcccagagguaccgaguguauuucuuacuaaacagaaaguucucugauaguagagagucagccuuuacuaccauuccaccuacguuuucugccauacaaaaaugcccaauaauuauguauuaguuugcacuggaggacuuugguuucauccauauaaguaaggauuugugaagucugugccgugagucagcucaaaggaacauagagaauuugcauuagaagaacaacuguaaucggaugucucucagcuccuuacugaaugguuuucuggcuuuuccguccaguagucugugcugccuuaugucaacuugacaugagcugaagucaucagagaggagggaaccuuaaccaagaaaaugccucuagaagauugggcuauaggcaagccuguagggcauuuuucuuaacuagugauuaauguaggagggcccagcucauaaugguuggugccaacccugggcugguggucuuggguucuauaaaaaagcagguugggcaagccaugaggagcaagccaguaagcagcaucccuccauggccucugcaucaguucuguccuguuugaguuccuguccugacuuccuucaaugaugaacagugauguggcggugucagccaaauaaacccuuacucccaaaaugcuuuuguuguggguuucaucacggcuguuguaacccugaccagaacacuguguuugcaggaaacgucccaugaugucccuauguuggucaccuaucacugucauccuaauucacguuuaucucucugucugcagcaaauccagagcaacuucauuguugucauacacccagguucaacaacucuaagacuuggccgagccacagauacacuuccggucaguguuccucacgucauugcacgaagacacaaacaacaagggcagccccuguacaaggacaacuggcuccuaagggaaggacuaaauguaagucagagagugggagcuggggaucagccugggguuguuuccauuggaggggaggggaguugagauacccaagugucucugggaaucuugaauaaaaaucuucaggguucuauuuuauaaaaguaauaucacucgggggcuggagagauggcucagugguuaagagcaccagcugcucuuccagagguccugaguucaauucccagcaaccacaugguggcucacuguaaugggaucugaugcccucuucugaagacagccacaguguacucauauacauaaaauaaauuaauaaaucuuaaaguaauaucacugaggguugcagguauaauuuucauuuuagcuaguuucauugccuguuacugugauaaaauacccuaacaaaagcaauugagggagaaaggguuuguuuuguucacaaauucaugcuacagucuaccauccuggggaagucaagguggcaggaacuugaagcagcuggucacauucaagagaaacagaugugugugugugugucugcgugucuauggccgugcaugcgugcucagcucgcuuucucagcucuuaguucaggcauacugccuagggaaugguaccacccaaaaaauaauuuacaauaucaaaguaacuugaaauacuucuugauuuauuaaagauauguaaaggacugugauuuuucuuacagaaucagaaagauaagcauuauauggagauaugaaguuuguuggggauaccuuuuucuuugagacagggucucacaguguagccucagcuuaccugguacucaagagaccagucuggccuggaacucauagaagucugccagccucugccucacgugcaccacccugccuggcaguaauucgaaugguguugaaaauuuuuaucggucacaagacacuugagguuauaggcuuuuuagcaggguuccauuuugaauuuuuguuugcuugcuugauugguugauuaauugauugauugauuuuucgaauaaaauauguccuuauuguccaggcuggccuuuuuuuuuuuuacuccagauucccccuucucagccucucuaauacuuggaugcaggcguguagugccacauccagcucuggcaaccuuaagauuaccaugucuacacaaagauuaaagagaugcuacuugccgaugggagcuaucuauccauugauggaugcauuguagcaugccuuguugguuucucuuuucacuaaauaguuuguacuaaugaucucucauuucucucuccagaaaccugaaaguaaugaacaaagacaaaauggccuuaaaaugguggaccaggcaauauggucuaaaaagaugucaaacgguacaaggcggaucccugugucaccagaacagguucggucagcauuuccuucacguugaguauuuuuccacuucucucgauauagcuguguguugcgugaugaugggaugugucauacaucccuggaggaguuugugguccauacaguagugccuaugacagaagacaaacuacugcaucuucugcacaccugggcucuauggccuagcccuauugcuccagccuccacaaguaaacaguaugucacuaugcagaauucuguacccagcauugucacaaauauguucguauacguaacacuuaaaacaaaauagcguagggacugcagaguuaguucaguaugagagcuguggcugcccuugcagaggacccacauucaguucccagcauccacacggcagcucacagccaucuacagcuccaguuccaggggaccugaugccuucuucuggccucccagggcacugggcagguaugugguacacggacauacaugcaggaaaacacucauacacauaaaauaaaaauaaguaaauuuuuggggggaaaaaaaccagagcacaguguacagcucuaggguacuuguggaagcugcccucggugagucaggaggggagugguggguaauuguggaggccugggacgcuucugucucuuacuguagacuucagaaacaccauacaccaaguuuauuuucuuuaaugucuucaauaauaacuuacaaaccuuaaaauguuccagcuuguguggagaaggguuuuguugguuugauauguuggaaaacaaugcauguacagagaauugaaucgugaaaaagcaugaacucaagcaaaugacucugggagacaagauuugggcgcgguaaucccuguuaccuaaacgugggcacugcacccagaggggugugcugguugcugagaaugcaagacgugcuuucccggcagcaccaccguccacagugaugacuucaugcucagcgcaacggaggaguggguguccaccuccaguguuugcuguugaccugacucccccaggagagagggcgcaccugaccucaggaugcaggagacgcgccgcacgucauaacuuuucccgagcauuguggagcuauaaaaagucauuacagccacacucgauuuuuaaauuuuuuuuccacauuugagcuuguuaaaauucagacacacaccaucccaagcccacacaguuucaagaugacagauaucaccaucuuguccuaugggaaagucuucaugggcaauaaugcguguguaacaguccauuccuauauaauugcucuuuccugcauugccuccugaaggacuugccucagggcuggucuguuuaaaacuuuaaaaguggauagauauuaggaauacaccccccaccaauaaguagugaagacugaaacaugcacacucauuucagagucaugcguugagugugauugugugugcuguacuguugugugacugacagcuugcuuccguaagcaucaccacacagaugaagcugugugccaugaugggguaugccgucagaagguuucagcucugucaggauccuucagagccacugcuauguauguggccugucacuaagaugcuauaguaccuggcuguagcaggacuuacauauauuccuuaagucauuaugcaaauaugaguuagcauuuccaagaagaaagggacgaauagagggagggggaggaccaaucaguagcucaccaugugucucagauuuuugagaagagacaaggggacucucugcacugccccugccuggagaagucuagcucauuuuuugauuucuguuuccagacacgcuccuacaacaagcagaugcgaccugccauucuagaucacuguucuggaaacaaauggacaaacacaucucagcagccugaguauuugguaggagaagagguaagaaacauugacaauggacaaaacaggaagaaaacagccgaugguccugaaauucacucugcugcguccuaccauuuuaauccgggucuugaggaacagaaaugugcgcuggcccucugaauuguuggcugcuucaugcucagaaucuagagcaguuagaaaauccugacucucugggguuuugaguguaagaccagaaagcccuuagggacagcucuaacaaugcacuucuuccuuucccaggccuuguauguuaacccccuggacuguuacaacauucacuggccuaucagaaggggucagcugaacauccacccaggccccggaggcucccucacagcuguucuggcagacauugaagugaucuggucucaugcaauacaaaaguauuuggaaaucccacugaaagauuuaaaggugaggggaaauuccuguguugucacugagacuucugugaauacaguauuuguuacucgguuguguauauguaguauaguguccuggaaacacuugaaaacauggguagugaggagaccuuuucuuccuuacuaaauccuguccagugauuucucuccccugacugucauuggugucugggcacugcucugaagccagucagcuugaccgcguuugugacuuuucuuuguaccucacucagacacauuaccucccuaggugucacaaguuuacaaugauucuaaagagucagggaacguagguuaauccugguucuuucugaaaccgagaggccaggugcacaugaagguuugagcuuuuguucaaggccuguguccuaugcggggaagcuuccaugggguaggcauuaugggauuggacgugacuagacagguguugacacguucuucugguuuucacuguuguuuucaguauuacaggugcaucuuguuaauuccagauaucuauaacaagcagcaugugaaagagcugguccauaugauacugaugaagaugggcuucgcagguacgccugaggugccccugacaccccggaacugcucggcucacugaacgcacugacuuaguuacauguguguucugaaaggagugguaucccauagcugcuugcccagagauuucuaggcuccuaaguugaauugaucauuuguuccauggugucuacuggaugcaucugauugccgccacucugccucuuuuuaaugucagggauugugguccaucaggagucugugugcgcuacguuugggagcggcuugagcagcaccuguguuguagauguuggggaccagaaaacaagugugugcuguguagaggauggggugucucaucggaacacacgguaaggcucucagcaggugccauuuccuaagugcucuucccucacagucugucuaccggccagaaagcaccugcgaggugaagugcaccggaguccagagagacugggcugucaguucuggcaaggccuaguuuaugcagauggccuugucccuagggagcuuuccaaccuacauucgaccuuguauuucccaagagccuagguauguggugcaaguuagcuuugugucuucugccuggucauuuacuccaaaaagcuuucugaagcaggacuuguagaaaaaaccagguuuuucaggucuagauucuguaguuuugaauaucugauuuccuuaucauagcggugcgugaguugaguguugagugacuuaucgagucugucuccucgugacgucucuaaugcacaugugaauaaaacgagcacuggaacagaucugcuugucuaauucuguaguuuucaaacuacagaguaagugaacagucugucucccucaccguaguugugugccucccaggagcguccuuagugaacucugucacugagccucucucccauguuucuuguugucugccugauuccuuccuaugcgagugagugaaaagccagucugccagugguaagcucggugaccugagacgaacuggucuuaacuuuguucuuccaguccagaauacuucuuuucaaacagcugguguucuugucuagaacaucauuguggcuagaguucuagucucucgucuaacuggccuuucgguucuuacaaaagauauuuuuaaaaacaugcuguguaccuucuaaacugacagauuaaucgucuccccuuucucuuaacuuuaggcuuugucuggccuaugggggcucugacgugucgagguguuuuuacuggcucaugcagcgagcgggauucccuuacagagagugucagcugacaaauaaaauggauugccuccucuugcagcaccuuaaagaaaccuuuugucauuuagaucagguaggaacagaauuaauauuguugauuauuuuugguuccggacuucaaccuuaccagucucaugcugucuguucacuaaacugggaaagccaggguaccgaagcucuucugcugugcaagcucucagguggugucaggguugugcccaugcucugaccacugugccagaggacaaagggaagggaaaugaauacaacaugcaaggagauaggugcagauguucagugaacuguguacagugaauuaucugaaguuaaucauuucauuguguguguggauugcuuccguuuuaaacuuuauuugggugauacaguugucuuguaaaccuuagcaaacugccaagugucucaacucugcaagguacauaaggacauacucuuucugaguccucacguacacugaugucuaccaguaauggcaaaaccagaaaagugcaagugucagaaaucuugggaauuaaguagagaagugaggugcagcugagcuccuguuuuguggagcuuggaguaaaugguacagagcuggaggagagccaccuucugugugggcucauccaguggagaggcucgugcacgcuccuacugacagcagccucuuucccuggcaucaggauaucuccggacuucaggaccaugaguuucagauucggcauccggauuccccugcccugcuuuaccaguuucgauuaggagaugaaaagcuccagguaacccggcaguguauguguuccuggauagacagaaagucgucccugcugagugaaacaaggaaggggcauccucagagaggaugcaaaugccgaagucagaaugccggcuccuugggucguuauucuucaagccaaaguaaauuuggacagaucugcccccuucuuuucuaaauauugcuuuuaaacuguguguauaugugcacguaugugcauaggugccagaagcagguaucagauccuggggcucaaguuacagguggaugugagcugccagggugggugccgggaacagaacucagauccucugccgagaauucucuaaacugcugugccaucuccucauccccaucagaacaugguugauggccacuguucuugcuagggagucauaaaguagaugguaagcauuuacuugacauuugcuuugagagucucacauggugcccugcuacucauccugguggauuguggguuuuguagucuguugugcaaucccuuucccagaaggaaugcuggccaccgugacauggagcaccugccugauggccuuugucuggggaagacugaagcuccacccuuugccuaagcauucucccuuccaugcccaggcuccaauggcgcuuuuuuacccagcaaccuuugggaucgugggacagaagaugaccacucugcagcacaggucccagggagacccugaggauccccaugaugagcacuaccugcuggccacccagagcaagcaagaacagguacgccacagcucggcugggagaggggacuucuccucgccuuacccagaguuaacagguccuuacuuuuuuuguuuguuuguuuuguuuuguauuuugagacaggguuucucuguaucgcccuggcuguccuggaacucacuuuguagaccaggcuggccucaaacucagaaauccuccugcuucugccucccaagagcugggauuaaaagugugcaccaccucgccuggcuuacagguccuuacuuaauacagaaaauauugcuguaggcauaaagcugaauucuuuguuuguugggcccaguaaucagaugucugucggcuuaaacuauaguucgcaaaugcuaaucugguaccaguagcccguggcggagacuaggguugggaccuugcucagcuuugcucuguccuagagacaaaaaggagguagauuggaucugagguagaggauucuauaacaaucacuagccugugacucucauucacauacccaguagaaagucagcuuagagaguccgucucugucaacaucucaggguuuuuuuguuuugguuucucuguauagcccuggcuauccuggaacucacuuuguaaaccaggcuggccucgaacucagaaauccgccugccucugccucccgagugcugggauuaaaggcgugcgccaccacaccuggcuuaacaucucaguuuuaaagcgcacugacugacggauaguaagggucuagaaccugcccacauggccagaaccugccuuggccuuggcaggcauccucacuguaugcccagcucacgugagcauggguauagguugugugugcuguggugaucggugcuuaugcuguucugaagucauagaagaggggacaggaccagcaaugucgguuucucucuuaacuuacagucugcaaaagccacugcugaccgcaagucugcauccaaacccauuggauuugaaggggaucugcguggccaguccucugaucuuccagaaagacuccauucccaggagguggaccuggcuucuucucagggagacuguuugauggcgggcaaugaguccgaggaagcccucacugcacugauguccaggaaaacugcaaucucgcuguuugaggggaaagccuugggccuugauaaggccauccugcacagcguagacuguugcuguaagcucacccuggguaccgguagauggugugggugcagagacgugaccugggucagucuugcuugugaagugcagcauuuucucagaaaucaucaagccugcuucacccuuggcuugccagaggcuggggacccagcaaugcaguacagguggcuccuggccccauugcaguugcucugccaguuagucuagugcuggcgauggagacuaacacacaccaugaaguuacagcucugguccaugcuagagccaaacuaaagagucccaaccgguuucugaugaagaccuguaauaaggaauucuuccaucucugagucacgugagaaaugugagggauaacuggaggguuagcauucaggugcugugacaucugccuugagaaggccugcaaagccaacaugguuagccaggcaguccacagcacauggggucccccgugggccucuguaaacaaaguucgcuucuaauccuaggaggagugggaugggaaguggguggcugguccccgucugcaguguugaggguggaucuggggcagauccuagaggaugcuggguuguuuaagugacauuggacuggccuucuaaguggguaauuggcaggacggcacugucuuuccagcaucugaugauaccaaaaagaagauguauagcucuauccugguugugggaggcgguuugauguuucauaaggcucaagaguuucuccagcacagaauucucaacaaaaugccgccuucauucaggcgaauuauugaaaacguggaugugaucacaaggcccaaggugagucguuuggugauacccgugcgacgguacucacugagaccagugugguuacaucgaacuguaaugcgugaguggggcgagauccaggcaaggcccguggcugugagugucgaggaccuagagaaaugugaacaugacuuucagugggucacaagggaggugggagcucuggacuuauggcuagauugcuucugguuugguguuuuuguuuuuaaaagauugauuuuauguuauguguugcauguaugucugugcccgcauguguacauggugccuguagaggccagaagauacgagcagauccccauggaaguggaguugagguagucaugaucugacauguaggugcugggaacugaacccagcuccuuuggagggguguuuauuagcuccugcaccaucucucuagccccaauagggucuuuuugagauacacaaacucacugugugguuaaggcuggccuugaauuccugacccuccugcugcuaccucccaaguguggguguuuacugccaugccuggccagcguugaggcuggcuuuauuuuucuggugccuguucuccugauuuuagucugaugcagacucucggugcgucagggcagggcuggcucucucuugcccugaggaccagaacuucucccucuucuccucucuggucguggucaggaacugguuucagucuggggacuggagauccucaaggacuuuuuuuggcauuaauuccuuugaaaaggaacacaaagcagcgaguuuagaacuagaaucugucuguauugggaacccaugguguucugauaaguuuucuuuugagggaggugucuuggggguccccuucaucucauggcacuuccaagggccugugccugccuauggggcuugcuguggaguagugaagaauggcaucuucaguauuaaaacuugagacauucuccucagcugugucagagauuggcauguugggagguucugccuuuuguucugcuugugguaguucagggaauugaacccagagccucacacauguuaggcaggggcuaugugacuaagguacagcccagccaguuuucuacuguguuucacacagauguaaauccuggcuugguugcuguugacugagcaagggucucagccccacuugcagaaaaugguguugcaugucugucuucccugccuuggcugaacucucugucgcuguguaggacauggacccccggcugaucgcauggaaaggaggugcaguacuggcguguuuggacaccacucaggaacuguggauuuaucagcgagaguggcaacgcuuugguguccgaauguuacgggaacgagcugccuuuguguggugaaaaccacaaccgagucucaggacauaaaagacuuaaagaguguauguauuguaaguuauugaccacgaagcuuaauuuuccuagaauuaaauuaaugcaauuuuauguuaaaguaugacacugauuugagauaaucuacuuucagucgggcuuacccugucccugaugggaaaccuugcuguccagccuuccauccugaugaacgugucauguagcccugaggggugaccacuggaaccagcuguggcaucuucucuuuuuuucuagcaauaguuaggagcuaaagcggucaggcuggguucuguguacaucacacaagguccucuuggaguuaagcacugucuuuguaacacauacacacgucagggagcaggaggucagggagcacuccugggggccacagcacaaggcaggcaggguagguagagcagaauuguuuagcuggcuguuaggcaucugcuccuaccgugucugucaccaggcuuguccuggggaggacugggaggcagguaacagugggucagaugagccgcgggaucaccauggacuguagcagucucgggugcacagcccugcuggcgcuguaagaguaaccagcuaaagcagcuucgagcaagcggggcauacuauuuggagauguacuuccucauuugaaaauuaccugcuuuuuauguuuuggaucaaauguauaggauaugcuuuuauguuucugggcugauuggacaguugacacucaucccugcgcuccccgaagcacagugcgccuguugugaccauuccgcacaugaaggucacuuacagugguagguguugauguggaggaaguugguuugugguccaaguuuuggcacaagcuauauccaucuguuagcagcacuuuuacaagcuucuggcaacugucuucccaaauagccgagccuugccacgccugcacugccucugacaucauacacuggaugugacgcucgugugccacgccugcacugccuccaccuuaucagaguauuugcugaugaaguuggcugcaggguuuuuauuuuauuuguaagacuugugcuagagugaaugaaucccuuuuacauuggcucuuuagcacacuuuuuguauugcuguggauugaaaccaggaccuuguacaugauguacaaaugcucgaacaugaccuuuuuuuuuuuugaaacagagucuuuccccagaacccacggcucuguuugcuuccuuccagugcacugcaacuuaaaaugugugccccagggaacuggagaggcagcucagugaggaaggccacucgcugcucuucuggaagaucugggguucaggucccagcgcaggucaggccgcucccaaccaucuguagcuccagcccuaaggcaucugaggccuuuggccucuugugagucauacuucugaguggauagauacucuugugaguggauacucacaugcacauacccauugcagauacacacacacaccccuaagacauaauuaaaaauacauaguuuuuaaaaguguuugcuacuuaccggaucaauuacaaacuugcuuuuguuuuguuuuuuguuuuuuaaacaagguuucucaguuauguagcccuggcuguccuggaacuuacuguguagaccaggcuggccucgaacucaagagauuugccugcuucugccucggagcccuaggauuaaagggguguccaacaugccagaccuucagguacagauaucaaagcagucaacuaccugaaacagggucccauuucaaaauagauugaucgugcguuaugaagccauacuagacaaauacuuaugauaauauacauugcuguaguuucuacauuaagaaaaagcugcuuugagaacguaaggagcuagaagauucaagaccuagcaaggcuguauacuguuccugcuuguucugguuggggguuuauuuuagauuuaaauuaagauuuauuuacauugggguauagcuagauagcgaaucaguuaagagcauuuguucuugcaggagacugggauuggauucccagaguccacaugguggcucacaucuguuccuaauuccaguuccagggcauccggcacccucgccugaccucaggcaccaagcacaugugguacacagacauacaugcaagcaaaguccugcuguauauaaaaugucuuuguaaaaugcauggagaguggccugggaagccagagaggguuaucagaucccuuugacacuggaguuaagguggcuauaaacagcuaugugguugcuggaaaccgaaccaaguccucuggaagagcagccagcgcucuaagccucggagccaccucuccaguucuugguggguuuuuauuuacgcaauuaguuauagaaaaagauauauuacuuaaagagaguugaucucacuugaagaauuaguuuugacuugaauaggaaauguuauguaauaaccaagaacucugcgaacuucaauaguggacagguaacuggacaaaaguagacacuggauuuauagguagcaacuuguguuuguuugggacagagccucacucugucucuggcuggccucacacacccagagguccuccugccucuuccacuugagugcugggauuaaagguaugugccacgugccaccacauccagcuggugauguggggcuuugguugauugguuaguuuuuuugguuuuuccaagacaggguuucucuguguagcccuggcuguccuggaacucacucuguagaccaagcugaccuugaacucagaaauccgccugccucugccucccgagugcugggauuaaaggcgugugccaccaccgcccugcuggugauaugcuugcauauucacuuagagagucacccgugggagacugagguguaauucagugucagagcauuugucuagugugcauaauacccuggguucaguuccuagcccuucuaagauaaaagguaaagguuaccuguccaaaaguuuggcaagggaaagcacugucccaacagcaaacaguacagugguuacacauaaacuggaucaucuggucaggcagagugucugcuuguguguguaauaggcuucuucucuuaggaagcuacacauuagugagagccucccaaacggauuauucauuaacagauuaaaauguuacaaaacggucuacgugcagcauagagcaugggcagugcaagacagacccaaccugacagacagccugacagggaagugccguauuaccucauggccagagugcgugguucucagugauaaucauuacccagcuuuggguauaucccaaauguaggucccacucauuauugucuguaacuguguugucuucauaaauccagccaaugacuagccucaggcguguaugcucagguugacuuugcaaacuccaguuuuaaagcaaguuuguacauagcacuaccuccacacagccucucccacacauuucagagucgucacacagcauuugucacuggaagggagaguaggaaggcuucagagucucuauucccccggguggacuacaagggugaacagcuaucauggcaggcuugugagcguuucuucacugacaugcucugcguagccuugagaaguucuguguggaaagcuguggcguccuucaugagaugauauugggggcagacacucagggcauuauagucgccuuugaggucugcucccccaagauagaccaccagguauuugugcagaugcgucuggcugcugaaaucacuacaaaagagguuaaaggcaagagggaacagauccugagaguucucccuggcgcugcccucauuguggccacaggcacugucacaaagggucgggacgucacugggaagaaggaagaccacuuuaucugccgcuugcuucugaguggucagccacuguaccggccccaucucggcgauuuucuuuuucugccauuuuucaaggaugaccucacuucugcaguaguuuugaagaaagucagugaagcgacagacggugugauggaaacauaucucagaaggauaaaccaccaggaccuuaaugaggggcaggagcaugguggaaauaggaaaggacgucuucgugcuccuuccuggaggagaagggggggacuuuguuaacugugugacagauagcaggccuuuacaguagucuaaaacuacuaaaggcuccccaccagacugucagccagaucagggucagagcuuuguucccgacaggagaaaagguccuugauaguccuuuugaauaccugaaacacugaugcuugaaucuuaaaagcacuugaaaagauguauuuuuaaguccuuaucaacaaaucagccuucauagucaagcccuguucuuuucagauaaacucagcagcugcugagguuugaggucacuguguuuaaagcaagcugcugaaacuucuguacugugacacagaugugaccucuacuuaucauuuuaggaguugggucaacugugauuuguaccauuuucucccugcaggugguaggguucuucuaccccuaugaaguucagccacacccugugcaccacagcaagacuauguagaaagcuacuguaacccuguaguagcauggcaccaacagcauccucuagaugcagauauuccugaggugaaaguucauguggcuuucuuagcuuaaaaguacggaguuaaucuuuggccaugacauaggaauaacucccaggguacacuaagagcuucuuuuugguuuuuugagacagauccucauguagcucaagcuagccuugaacaguaauucauaacauccuuggaccccugaccccacuuccucuuccucucagggccucagagugcagguuuaugccagauuucuuuuucuacauaugcagauaggaucucauuagagggucuucagaaagugaccaccacccuuaccuugccuccaaguuagguagaucccagcugccagcacccacacagccaccagcagcaccaggaagagaggcagccagccucccagcaugcgucugucugcaggaaacagcucagucacccuuuguaaacagauucuuuuacucuccuuggaaguuuagaccuugcaaaccaagggcuggaaggucuuggggggagggagggaucugcugauuaaggguucuuugccaguauccagaucucuuccaaaaaauguauuauuguguaaugaaugaugguucagccaucacaggcuaggcucacaacacugacaacaaaaguaguagugugaugugugcaagcgcaggcccucgugccacagcguaugcgugguaggcagcuuuggauaugcgcucuuuccuuugaccauggguuccaggagagauccaacccagguuguaaaacguguguagcaagugacuguccccacugaguaacucaccagcguucucccuggauucucaacaggaacugggagcccuucucuaaacucaggcuucuaguccucaagcacacgaauuagcacuguggcaacuagaguuugaacacucgaguuuugucauuugaagaauuucugauccucgggaugaacuuauauacauaauacacauacacauauauauauacacauacacacacacacguguacccacauagaagucaggguccuaggguaauuaucaaaagcuuauuuggcugacucuugucuuucggccccacccaugggcuagguucagaacauucucuauguccauaaaaagaaccgaggcaucucuaaauccaaagacauuuuccagaacaggcucgcaggcaccagggcggugucuuuuggugccaguguuccugauuuguuaaccaaauaagauucagagagaaugucuugcagcacugcugacaccaguccuugguucccauucuguagccucguggcacuuagaacaacuccugugugcucuuccccacccccaccccacccccguguauacccugcuuuugaaaagagagggccuucauuucaaacaagccuuucuuacuuggccauuagcucucuggggcagcauagucugucagagcaguucccggcacacaggccgggaccucuuacugcuucucacagacagagcauaaccuguuacauaugaaaggggcugugugcuucaugagucucuguccauccugagguaaugacggguacuuacugucaucuggagggaugggagcacuugucucugagcaaagcacaacugucccuucgcgucggaugcagucauugccgcagguauguaaauauggggucagcugagaagaagggccaaucagaauguucucaggaaaugccucaggaaauguucuacagugucccacuugaaacacaccccccaccccuuuuuuucucuuuucuuuuccuuccuuuucuuucuuuuucucauaccucuuggcauggucaaguuucugcuugguuacauuucuguagcccaacaaauccagucuggugaccccaagaccaaaacuccugcaaugcccuugaacuuugugccaucacugacguaguauuuucccaaucuaaaagggcagcuccauccugauaaacauacagaucuugccacuggacaacaggaggugucucccuggcccucacuuccugaaacgagcaguugcuguggccccggggucugcuguccugcucacccugagugcuuggugcuccagggaguagagaguggcuugggugugguuguguuguacugugaccccuguauacccauguuguauucuacuggggaucugacuuccuguuuccaccugggccacccgaggcccccagaagacaaacaguggcucuccaaaguucaggcauugcucugcaccccagucuuucagccccaaaccuuugcagcuucaccucucacucggggggaaguaaaauggcuguccuaucucagcauuacuccugggauccaugauaguaaauagaagugaaaacacuuuggaaaggcaacagccaccaguccaaacaaaagacacuacagcugcagagucagcuuucuggucucaccauugugaagaccaguaaggagucccugauaacacugcuugacuggggagagacuugccauccuuaaaaagaagccucagaaggcuacuuuguaucagcuguugaauacccagaauucaagacauccuagauuuagucccuagcaucccaccacacaugcacauacagaaagcauccaugguggagcggugccccucccgugucccucccuucccagacuccgguuuaacucaccugaaccaccgcaccuucacucuccucagucaccgggauggcuacagacguccucaucaguuuauucuggugcagacaagugagacgcggacaagagcuuuaagucacaagcguguacagacuccgugaugaagccacuguuccugacuucugaugugugaacucugaaugacucacucgagaagccuagaacuucugccuuuaguugguuuuagacuccuuguccccagaugccuacagggacuuguuucugcuacucuaaucaagguagcccuagcacgcuuggacaacaguuagauacaguucucuugaaaggaaaccuuuucagaggauccuaaaaugucuauacuucccuucacuaccaaagcuagagguugggagugggguggugauacgggggagaguaccuccagcacucuagaaaaccccaaugucgugucccguugaaugagaaucguguaucuguuuccaaggggauugguugugaaauucacuucaaccaucuucucguucuuuuuacaagcagugaugucugggucccacaggcuuccugaaaguugagagaguacucggauaacuccucccuuaucugaguucccagggggacuuuacagaaacaaaucuaaagcuuugggcacacacccaagagacagggacucuaguauaucuucugacacuguucccagaauccaaaguaucuaaauguccaagaaaguuuagggacuacccccaaugccacuacuuugcuacaaauagcuuccuugaacugguagugguagguacagaucucagucaaugacugagugcuuacccuauauuuuugguuuuuuguuuuguguuuuguuuuguuggguuuuuuuuuuuuguuguuguuguuguuuuucaagacaggguuucuauguguagccuuggcuguuguccuggaacucacucuguagaccucaaacucagaaauccacccgccucugccucccaaguacugggauuaaaagcgugcgccaccacugcccgacuguucacccuacaccuugaggugaggagaggucuaggaccauuauuuucccuuucuaggcugggaggaagagccucuauuuaggagguaagaaguaugucccaaaauaugaagggacguacacccagacucgggacuuacaaggacacgcucccagccuuacugaauacaaaggaaggaagugcacauggcuuacagggauccguggcagaucaacuaucagaaagucuguugucucauaugacuugcaaauaagacuggacaaguuuccaggaacauguguauauauaauaacagguuaucuucccuaugggaggggaccauuuugggcucuggcugggaacugguucuaggagugaauuggagaguugauuccagguccuggacuucacacccccucaaagcuccauucuuuuacagugcccuuuuggugggaggaaagaucucccccagugucacuuacuucauuggcaccacaaggcuauacugcucugaaguuuauacucuuagaaccugggaugagggaaugacuauccaaaaaaaaaaaaaaaugcuucauguuugaaaggagguucuaagagagaguuuugagaaggcaacuggggccucacuuggacaaacucucacgcucuuuguuaauccaaacagaagguacccagagccuccacugaccacaggccaguugugauguacaaauauaaaggcuaaugggacucuucuccagccacugaacagcuccccaugggcacugcuuucaagugggauucgggauaaaguguuaguuuagcacagggacuggggugguuuccugcagcuguugcuguacuguguaaaccuaagagccugccccagacuggauagcuguucagcccagagccgcuccagcagcuccuucacugagugacuuagagaacgcccaucucuguaucucaguuacuucugucugaggauggaugaagcuucaugggcccagucaggagucucuccaagugacagaaucacaauacuacaucuacuuacccgccucagugcacugcuuuuuauauuucauuacgugguuuaggcagccugggaaugugaaugaaaguuguuacauuugaguaaaagguauaacccuuugcccaguacacacacacacacacacacacacacacacaaaacacacacacacacacuuacuucagauaugagagacaacagaucuaaauaggaaaccauucuuccacggaagcuuuaaguaaucuccuuuaaguacaaccuuuaucaaaaacagucuccaggaggugacacggaaacaaaagugagagcugacaauacauauagguucugccucuuccagacaugaagcuccaggugguagauacccagaugccuaguaggcacgacccucaccaacaaugucacacagcccagauaggccauagugagaagaauucagugcccucugugggauucauacccaaaccucauauccccggcuuacauacgaagcaagcaucagacaauuucagaauggaaacaagcuagguaaguuugacaaagucaugaaaaagcgaggccagaggcugggguggcagaaugacugagugccucuggcccaggaggaaauuguaaugggaaaggagcugaaauccggagagccugguguuuagcugcuggaaauacaccggacguuacuucuguguuuucacgagugcacccugaaaacaagaugccaaugaccagcggaacaggaacagagagcugcauggaaacgugcuacucuugcagguuuucaaaaaccaucuccaaauaaagcucacuuuaaagcgggggggcauuauccccccccccccacacacacacacagagauaccacaauaaacagugagcuuuggggccaucaggaagcuaacaaguaaagccacccugaauggcucaaggcaccaacuacgaaggaccagaguugaagcuuccccauugcuaugugcacugcccagggcaagugcucggauagaggaugcauucugccuccugccuggcacccaggaacaugguuucccaccuuuaccuaacuuaacacucccuacccugaguuaggaccgcuccgcacuguguccacagaggaggaagcugacagcuucgaaggguucccaaggcucgucgcaccaaaccaugugccguaacacaggugagacaguaagacagaagaaccaaggacaugagggaguuuaccuggcgaggugaaguucacagacaaagaagggcuguccucauucauauuagcauuggggauguuaugggcgcugaugagauagagagugcucagcuccacagggaagccuacauaggagaauguccacugcaaagcaaagcaagguaucuguacaauacaagggcagagcuacuuggggcgggagcuacuuacuuucauuuguaaguguuuucacaauuacguagugugugugugugugugugugugugugugugugugcgugcaagugcuagugagggaucaugccauagugcauguggaaagaucuggacaacuuggagaauuguucucucuaccauguagguccuauggacugaaccuagguugucagacuugagagccucagcccgcuuuucguuugucauuugauggagcaccgcuaugcuccagcugauacgggucaguaucuauagggaaugggcccagcccaaucuacugauguaucucagaauuuaaaaaguguggcauuuuagagucaggguauaaguucaacuccccucacugcguugggcauugagucucaaagaugcugccuucuccaguuacugaggagacaaguagaguuuggagccaggcaucuugcucugcucugcaucaucgggcuuuucugaaacaugcuaaucaugcuccucacacgaagggucugucugucaaggacagccuagaaguacuugcuuugccgccggaaggucuggucuggcuuuggaaggccucuguguaguugcaccucacacagcuguaugaauucauguuguuuuugccacucacgcagaucuugguggccuucaacaagcggaugcuggcugcagagacaguuaagugggagguugcuuucauuagugcuuauguggcucacacagguacucaacaauuuaaaugcuuugucacagcugguguguacugugguccccaggguacagacagagugaacgagguuuuaggagucugggggaugggagguaauucugccugaacuuccacagcucaucagcaggaagugcaaguuuggauucccaagcccaagaccccugcugcuccuaggcuggccucaguuguacaaagugccugugguuagugaugcaacugcccuggucuaagaugacugcuugggaucugcacauaaccuagggugugucuuucagugcaugcauauagguauuucuuucaggccuagggagggaacgaauggguccuauacagugcuuauuucugguuuaguggaugcuucaggcuuuagcuuugacuuuuuuuuuuuaaaacccuccaagcaucagcacccgacuaugccuguuuugacagcccuauguccauacagaccauacugucugucugcuccuccaucccuauauuuccaagcucccuuuaaaguccauaacaagaucgaccaaagaccucacccugcuugguguagggccuaagccuauuguagcaucucacaggaguguccuggggccaugcccugguccuuccagccccaccccacucacauagauccaaucaccccuuggggcaucccuggcugccucuccuacugcucugaagaacaugcugacgaagccugucagugacuuguuuucccaggucacugggacccuucuccuggcucuuuccacaaccuccuugaguuuuugagacaaggucucacccuguagcccaagcuguccuggaacuaguaaauagcccagaugggccucaaacuuguaacagucuccuaugucaguuucccaggugcugagcaaauguacucuugacuaaaccaaguuuaacuuuggcagauggaaaccacaagcguggucaucagggccccaggauuggcuugugcaaggaacucgcauguugcucuccaccuaaucuggaaaaaacaccaggacuuugaugauaucauuugagaaguaggaacguaaccuaagcagagcuuuuccuaaaaugaggggagucaucucugccaugaaguaugacugaggaaagccuuugcuugucagcgacuuugcacacuuacacacccagccaagaacugcccccagcccagugcugccugggcuuuaagucacuuccaagccagaguagcccccagaccccauccugaagucaaaccacuuguuuuguucuuucaugucccacgguaggcaugauuauagauauagcuguauagcucuuuguacucugacugcuuguguuugugacauccauauugucacacacacacacaauucucauagcuguacugaguuccaaaguuuccacauugugauuccuuuuugcucuugggcauuugcaugcuguuaugaauagugcuacuguacacauccuaagauaguauaugccuguguaugucugggguaugugccgaggaguagaauuaaugggcccuauguccuucccguuucuaguuuaguagacacuacgacugaugcaaacuuaccgucugcccggaguauccagcuuauguucaucaaaauugaaaacuccucugcugccacacuugucuugacgaguuccacuuggaggucccucaagucuccuggagugaguguguguuggaccauccacucuggagauggcccugggaggaggcaaggggacuucauuugauacuccuguuuccggcccagucagaaguuacuuccuccaagugaucucuccuguuccaucaccuguucacagcucacuucugcuaaggaaagcuaaacuccuggauccuggcagguuuaugcaccugaauaaauucucucugccuuauggucccaaacua

SEQ ID NO: 7333 - RNA, 47531 nt, Mus musculus
gaugagauuagcugaaguaccacgcucggcaaggcugggccgguaggcggaaguggagggcugacugagcugggggaacuuugccuggauggcacuuuccuguuccacaguccgcccccgccggaggggcucggcucugagauccaagauggaguuguugagucgagcugagcaagagaugagucuggcggccuugaaacaacacgaccccuauaucaccagcaucgcagaccucacgggccaggucgcccuguacacuuucugccccaaagccaaccagugggugagugaggcccggccggggacaaggccagccuggccgcugccgccucuuaaagggaccgcgcagacagcugaggauugggggugggggagagaagcaggagcccaggaccgcaaaggcgaggccgggaccucucccaaaaccggguccggagccaaagaggugaccggggcacgcggaauugaaagaauguagcggaaggaguagaccagagacagagcagggaaaucggauggaggagagaaacgaggcaggaucagucuuuuugggucgguucucggggcuugagguugcauugguaaaauaugagacaaguuaauuuuaacaagugagugaaagccuguguuugaagacuuugaggacucuuagauacauguacuugauggaagaguccgcuccucuuucccugccgaccuaaaugugaugguuuggauuugaagcuuuaaaaaucagcuucaggaguuagaccagcuuuagucgaacuacucuguaucucuggaauuugaggaaaauuuucaaggcuacuucaguaagaacuggauuccuuggagacguuugcaagaaaaagagaccagugcuaggaccuuugauggcucccuucuuuugggauugugugaguggcauagaguugcagaaguuacuuugucuacucgcagauucuaguuaaccucaacucgaagcaccuguguacacggccccuuuucuugugcuccguuuuuccucauucacucauugggcuauacagagguucgguuuuagaacauuaaagcucaacaccugcgcugaaaacccgaguuaacgcuguugcagcaaaagaaagaauacuaauguucgauuuucuuguuuauuucuuguaguacaggaacucaaacccaagacccccugauagcaggcaggcacuguuccucuaccacugggcuauauacccaccccgaguuacaauuucuuagucacauuuucaguuguuuauuuuaaaacccuaccaaauuugccuaaggcagagaaugguuucuauccaugauucuuaacaaaguucugaaaauaauaaauuguguuugguaaccgcaaaauguguaacuugugaaaauauuccuaaauccuccagaaaugaaacaaaggaucuuauaagaaaauuucccaaggguagggauuuagcucaauggugcacagcugugcaucaugagccccaggcucugaguucaacccugguaucaggguugaagaaaguucuauucuuuuucuauaaacuuccauagacugcuuaaguuuguuuuguuuuuuuauuuugguuugguuuuucuuuuuuuaaguugcaguacacaauaccuugacuguaaauauuaagauaccuaauugaaagguuuuuguguuuacaaagauaaaacuggggcuggagaaguggcucaguaguagcuacgagcauuugcugcucuuccugaggaccuggcucaguuuuccagcauccccaugcugguuuauauccaucuguaacucuaguccaaagagauccaaugcccucugcuguccucuguaagcuccacacacacauauguuacaaagacauauguaugcugacaaaacauuccugcaccuuuuuuaauugaaaaaaaaaacuuaauacauaaaaauaauaaguaaagcuaaguguguguguguguguguguguguguguguauguauguauguguguguuuuccuuuagcuguuccuuacugguggaaauagacauaggcuacagaugaagacauauuguuggauuagacauugcauacacuuauauaaacacaggguugaauggguacacaauuuguuuagaguuuuaaaaaguggcauggguuggggauuuagcucagugguagagcgcuugccuagcaagcccaaggcccuggguucgguccucagcuccggaaaaaggaaaauaaauaaauaaauaaauaaaaaguggcuugcuuuaccugcucaaaagugauuaauuuggagacuaaagagacagcucagcggaugaagugcuugccucccaagcaugagagccugaggcauucacauagaaagcugggcauagugcuugcacuuacaaucccacacugggauauggagccacuuaggauccaacacuggagcccgcugaccagcaaguguagcuuaauuguccaucuucuggccagugagacccccgacuggaaggaaugacaccugagagugaccacuaaccucuacacaguuauacacgagcgccggcaugcauucccgagagcacauacacagcugauuccaccguaaauaagacaaguuggccugaaagugugucugcuucagcugagaccauuuggcauuggauuauuuguggaaaacuaacagaguuauugucuguuacaggagaagacugauauagaagggacguuauuuguauaccgaagguaaguuucuuaaggguguuucuauuucacuucaauggugaugaucauugucguguagcauggucaguuucuauuguguaccuguguuuggaaccuuccugucuuucuccaguuuuccuucauccaagcagugcaauccuacaauagcugcuucuccucuccaagccugggaaaaguggcucagaauuuuuaaauuaaugcaucccaaagagaugccugccuaacgacuaucccauguuaaaaagaacacaugcauauaaaugucuaugaaaacaguauaauacaguggcuauaaaguaguugagacagcacucucgcuggucuguagugucugauaagaauuugcauucugugccugguucugccccugucugcuucuuucccaaaguucuaggcuauuccuaauucauauauauuuuacuuuaagcuuuucugaaaauuaauuuuuuaaacuguuggucuguaaaggauuacaacuuugccuuguuuggcaacauagaggccuaaagggcaacccacggaugagccaggucgugaaacccuuguauuccuagauaccuagagcauuugcucuuagaggcaagucucuuuccuuggguucuagaacuuagagcgguagcagcaagguuccugauacaugguucuuuuuguguagaguucuuuuuuggacagccuuccuccacuggugcuaauuuauaagaauugagugcucuucuaaauguuaguguagagcuuugugcucuaucuaaauacacuuuccccuuuaaaugaaaguauuuugauguuuguaugacaagcuucucuuucuuugauacucuguuuucucuacuuuauuuuccuucucuaaaauaaaaaaggucuaacucuaaccucuucauuagcaauauaagucucuaagaaccccuuacuauuagaacaguacugucugcacauuuggggauauuuacaggucuaacuuuaaaagacuaaaacagaucuauuagaggagaugugaaauguggugucguaacuucauuuaauacaauucguauaacuuauagcauuggcucuaagaaaaggaggcuuaagagccucucuuugggaacugaacauuuucuguaccuuggguaaaaguacacuagaaugucauaguauuacuuugcaggaaucaaaaaagaaaacuggauuuggaguuuuuaauugguguggcuuugggcaugggccuuaauucugcaaacuugauucuuagucgguagaacuggauugcauuuucucccccaugauacuacagaaacaaaugagaacuguaaaguguuaggugagaaucugcagugcauugugugguggacccccuugguaaggaaacugaaagcauucuuacuguaaaggucagguccaucuaacucaagaaaaaccuacaaagacuauuuaauguaagaagaguuacugcuguaaugaguggcaggcauagacuuguaccauaguuuuaaaaaccugguacugguagcacaugccuuuaaucccacacuugggagacagaggcagguagaucuccaaguucaaggcuagccuggucuacagagaguguuccagaacagcccagggccacacaaaaauccuaucucaagaauauucuucaagcaucaguuuauuacauguuuauaucaaucuugguuuacauguauuaaaaaaaaacaaaaaacaaaagucagaaauccucaauugcauggaguuuacauucugguaguggagggagacaguaguugagaauagguggguaucagggugagaaggugacgucugagcaaauacuugcuggagaggagaugcugcugccaguuuggaggccacaguucagacagaggucucgagguagaaacaaaccugcagguaguggcagggaccccaguguggcagaagugugacucacaggaggugaaguggggugggaaccuuggugacuugucuuuuacgcugaggaaauaaaucuuuuugaagacuuaggugcagagaaggaaaugucuuauuuaauuguuuuuuuaagaguugaggcguaaaccccagacuuucucaugcuaggcaaacauucugccacugagcuauauccccagccuuguauuuuugguuaugauuuuagcugcucaucguguuguaugaugcaauuaggaauuucuuuuuaaugagaauaaaggauaacauuuccucagagugaaagguaacguguguucucuuuguuuaaaucuaaggucagcuucgccuuaccauggcuuuaccauugucaaccgacugaacaugcacaaucugguugagccagugaauaaagauuuggaauuucagcuccaugaaccauuucuucuguauagaaaugcaaguugugaguauaucuguuugcauuuaacagagugacuuuaauuucagaacauuggguuucaaauuauacuaaauauggccuacauuauaaaugugugucuugguaaaagaucaaauucuuuuuaaauguauauguuuauguguaugaguguuuguguguaugugugcacagagaccccagcccauguguggagaugagaggacaacuuucaggcauucuaucuuucuaccauguggguuccagguaugacucggguugucaggcuugagggugugucccuucaccagcugugccauuucaccagccccaaaaagcaaacauuuuaaguuagcucuaaaauugaauaggccuuugcacauaacugacuuagguuauuuuagugaacugucccaucuaggccaguugcuagcaucauaguuguguauguuaugagcugucaugucauuuguuuugcuguagggcugagcugucugcugcugucccugagcaacaaaacuuagucugacagacacagugagcgcagacacucagcuuuccacagagaaagcccuucaccauggauggugacacuuucaacccacgagucuaauaguguccaguagguacaaauucugugccaaagccguugugcuuucaugauagagagcaaccuaugccggguacgcacgugguuuggggacaagacucgagguguauggcauacauuuaguuggagaauucuaggccaaggucuugucaggcauuuuuacaguuuguaauagcuguugaauuuagucaacaaagcucagaguagcccuuuccagaagaguguagauguuccucaccucaccaguggcauuacuugcugguagagcuaucauaaguugaaaguuuguuaauauacuuaagcuauugaaugccagagcuuagcaacacaguauacuauaaaguaucaguuguuccuccaccgugaucauaugggauugggaacugugacucguuguuacuguacaguacugagggaaguaucccacuguguuauuucuauuccuaucacaagggaaauguacaguccaaacuuuuuuuuacucaguacauacuacuuucauaacauuuauaagccaaaggggggggaaaaaacuuaagucagauuaucauaaguaugggaccaucuggacaagaaaguauaguugaagaucaaggcuuuagcucagugguagaacacuuaguguucaugugcuuuggguuggaucuccagccaacacgaacgugguguacguugcauucugauaguuaaguaugauguuagaagugugacugaggacaggacaguuugcuuauuguugacccaggagagauaccaaaacagaguggugauuuagaaagcuggaugccuugccuguccuggaacucuuuguaaaccagguugaccuugaacucacagagaucugccugacugccuccccaguacugggacuaaaggcaugugccgccgccacccagcauuucuugcucauuuuuaaguaucuacauaaaauaggaucucucucuugacuuuucaguaaacuaugucucaggauuuuaacucuuguauuuuaaauccuauaggcuuauuagagacacuuuugagccaggaauggcgguguacauuagaaaucccaguacuuuggaggcuggcagcuugugcuauauauaagcuccuaucucaaaaacuuuuaaaaaugaaaauaaaaauaguguguuauuuaauaccuguaaauucaggauuuaugugaacuaguaagaaagaggagaauguuagagauggcuguuucauguuaaauuuccauuauggggaaauucuucaaaagaauacuuauaaaauuuuuaauauaaaaucagaccgauauugcuuuuuacuguugugacaauucuguauugcuccuaaucauugggaaaaaucaagagacugaauacgcauuaccauguggcauaagccugagaccuucaaauccuucaaagccagaguccuguaaaacagacuuauacuggccgugcuggaaauggagcgcucuggaggcagaggcagguggaucucuguguucauggccagccugauccacagacccagccaaggcuacauagugaaacccuaucuuuaaaaaccgaacaaacaaaaaagcaagcagaaccuaacuuuccaggguuugaguuuuugaaagugacgcgcuaguacaugugcagaacaaauaaaggcaaauuuauaagcacaaacuaucaucugguuuuauuauaugaaaacuuaguggcuaucuagacuguaauagaaucaacauaaaauugucaguguucuguaaguugaacccauuacaguaucauagacuauucguaacacuaaaugacauacucuaguggagaaaauggaacuaaugcuuuuacaaaggauagagacaaagauuuccuuacuugaacagagaacucccuuaugcaggucuucccacuggagauggcauuuaaaggaggaguuuuaucagagaugguaggacagcauaagauaaccuggagucuuaggguucuggguguacauugucuaaugaguccugagcguagaacauggcuuugucagaucugggagcugguggguuguuuggggauuugucguuaaguauaaugucaggaucugauuaugcguauggguaauuauaccugauccuggagcuguucuuucaucauucucuugcgggagaugccaccaagucuguggcccauuuaacucaaacuaugcuuucgcauccagcuuucuuucccucgugucagguuuuagcauuaaugugggaggcagaaccaaacaugaacuguaacuuucuacuuguaaacuauuugauguacuugauugauugauguuuagcuuuucuuucugcagaauacuugcucaccuacucagcucccaaggagagguaaaaucuuaaagaagauacuuucguuggguuuagugcuucucaugaaucuuugagaaauacuguauuuucauccucucuaagagccuuuuggaagcaacccaaggcuuuaguuggacuuuagcaagaauugagggguugcagauucugcaguuacugaacagcagcaguguuccuguuuggaaacaccucucugguuccgaacuuaaaaaauaaacaagagcucagauguucaaaaacuuguugaggagcgaugaaggaaauagauguagucuagcauguugcucuccaaagccaggguuccaaccacugcugcagcaguaaagucgcauaaugcacucuagagcagagcuaucuacuaaagcucugcagggauggagggcuucugcgccagcacuguucaguauugaccacugccguaugugacugaccacugagccaagugugccucguguauguaaggaaugugcuuguuaaucugcuuagcccaucuggauuuacauucacucugcaauaguguuuggcauagugagcagugggaauugaagcaugaaucuguacuccggcaaccuuuuaauuguguccuguguaauaggacaugcuuuuaugccuccuguuuagucauucaaaugcugcagaguacuucccuaagaauggcuuuacuaugguaguacuuucuuagaauggaguuugguuugcagacaguuguagucuuugccaucuuacugacuguuaaccuuguaugaaccacuuaacccugaucuguuugucuggaaaggguauagagaacauaagguauuuugccaauuguuuagaaaugucacuuauauugaaauguaucuccagcuuagacucaagccagugaucuuauuagugaaacaacuaaggucuuaggagucccagacucucuuaugacacggcuuguagggucuccuuuaccacuucucacaggaaccucaagcaagcugcgucacaggaaguuuuuucuccacuccuucccccuauuuuuuacagugcuggcucucaaccccgguaccguacacaaauaaagggaagaaugagagaggcauacaggaagggagggagaagaaaaggaaacaagaaugaaggaaagaaagaaagguagcuagauugauaagcugugaacuuuaaacaagauuagcaaugauucauuguggagcuaaugaaauaacucggugguaaagcaguuaccugcugugcacaaagcccuggguuugauucucagcacaacaaaaaauaaacaucuaggauagccacugcaguuacccugucaaaguagaaagggagaaagcaacuagaaacuccaaaauaaaugggucacugaaggaacagauacguauggaauguguauauguugcuggaaauggaggguagaaugagauauuacagccgggcaugguggcgcacgccuuuaaucccagcacucgggaggcagaggcaggcggauuucugaguucaaggccagccuggucuagagugaguuccaggacagccagagcuauacagagaaaccuugucucgaaaaacaaacaaaaagggaaagggaaaaaaaaaaaaagaaugagauguuaccauccaaauuuuaaccaggaaaaguuaagguaacuauauuaagaauacaugacugacaaaaaaaaaauaguagguauauaaauaugaacaguuuugaaccagcuuguaccuaguacaugugaaauuuauaaaaugaauguuaaaaauccauaaucauugcaaauuucuguaaggcuaugggauaguaugcuuaggcucucuaggaaagaaaagagaaaucugaguggggaugaaggagaauggcagugagaggagacccugauggcagagagcggaagcugcgugcagcagagcaggcccacaaagcaaaggccucaucuguagguaacgggguaggccaccagcaauaaaacaaacuaaccagagggguacgguggccaugcugggaguacauagccaaaggcaucuuuuuaacaagcaguuuuuagaaacaaauagugaacguuuugccagugaguuuaaaacuuagagagggaguuuccucgaaaugucccauccaacagccguguccucaggccuaagcagaucugaacggacucaaacaguacaccagauugucugaugauuaaauaucuacccagcacggcuaaagaaauccccagaggcacguucuguuugguuaaugagacuacgacaguucucuguguagagaccagacucggaaacucgucuccucaggcugggcuucuguggugaggagcccaugcuucauuaucuacuucagcaagaugccucacuaauacuuguccuaggucacuuuuucccagugucgggaccguuggaacccaguuaauugcagauaguaagucuaugucaucugucuagcaccuuacaagauaccguaccauagcaauuuaaaaacuauuauuuacuuucaaagauuuuuguuguuagguugguugguuuuuguccuuuaguucucucuguuuucugggugaacuuuaaguuuacaggaauguacuugaguuuucagugacuuaaguucgucuuccacugaaggguuaaguuccccaaugcagcucaugccuguaauuccuagcucucuggaggcugagaugaaagcauuguccaagguugaagccagccugaaaccuacauagcaaguguuaggcaagccagccuccccuacccugcacacacacacacacacacacacacacagauucuuaauaaaguaaugcuacuucauuaagccuggagcuauauguacguaauucuuaaacagcuauagaagacuagcagacacucaugauuuaaggucuguaacuuaaaaagaguuaucaaugauaaacaugaaagauuauuagccuuauaguguuggaaaucugauaugucagaugggaugauauuuuccauguuuuuccuaguaauuuuaaugacaauauuugccuauuaauuagaaaaaauauguguuauagauuuucucauuucguuccuaaccuuauucuggacuggggaaguggagugguaguuuuagccaaaggaggagugaguaguuucgugcuuuuguuagacuuacaguuuuacuggaaggaauucucuaaaugaagacagccuucccauuugcccacuggccaccugccucauuuaagacguuuuuuguaaccccagaugaacaguccuuuucaggcuucccaagaacaccuggacguguccagguuuccuuccuaccugacacuuuuaagcaguagcagaucugugauuucuguaaagcacuaugaaaauaaucauauuuagauaaaacccaaucuggaauuuauccagaaaauguuaaugccauacagcuacagugucaucugcuacucuuuauccuuccuaacaacagucaauucccuguaaauauagccgcuaggaaagaauacaacuguuagacucaccugcaaaggccugggagaaguccuccgugcuuucuaccgcacuuacaacucugccuuuauaucgggcaucagucucuugggagagaacgcuuuuaauuaaaauuagaucacuagaaaaugucggaagguucauuuccacaguguugaaaauacagccaccgagcggaaaguuguagugaagaaaugcuguagcgcuguuguucuguguuucuccuuguccuuucgcaguucaagggcaagucaacaguagagaugguagguagguggcuguuggcauuggaacagaucuucagacuuaaaacacagugcaagaaguuuccuugcaagaugaguuuauaauuuaucaagucaaaaaaugugaguucuaccuccagacugaaaaaggaauuuauaaacaauuaaaaagagaguccagcaguuuguuaguugugcucuccuggcucagcgcagugcugcucacagccugagaaaagggagguggucucgcgcacccgccugaugcagcccggcuuuguaggacucuguaaucagaaagaagaaaggaccuguggcagcugcauuagccuggccuccaggaccaagauaaggaaggagccuccucacuccugccaccguuagagacugaagagguaaaacaccaugagaauacacaggacgcagacaggaguuggcugaggcugaggucagacggugggaaacuguugcugucuccugugcuggcagagccacuccagacacccuccuacuaagcuuuugaauccucgagauuucaaaauguucagaagggauuauuuuuauuaagauucauacuggcuuuuccucccgaagguauuuuuguugaguuaaagcaacuucugucuuugugcuccaguguuauuuucacuguaaguuagaucauuacaguuuaauaaauacuucugauguuuucuuuugugaauucauaaaaaaaaaguauagucacauaucuagaugauagaaauauaucagcauguauauagauuuacgguuguauuuauauaaaugaaauucauuacugcuauaaaaguugaagcacaagguaaccacuugcccaagaacuaaggcccuguggaauaagaagcacaaaccucaagacugagcucuguauguccagugccuagggguccaagcagauaucagcuacagaaaaagucacuauuuccagccaugaccaacuuugucuuuugaguuaaaggaaaacacaggauaagcauugcuaccaacauacaaaaauuauauauuugguucuuaaacacauagaucccuggguuaucaucaucauuauuauuauuauccauuauuguuguuguaaagacacauauaucagcugggcgugguggcacacgccuuuaauuccaacacuugggaggcagaggcaggcgaauuucugaguuugaggccagccuggucuacaaagugaguuccaggacagccagggcuacacagaaacccugucucggaaaaaaaaaaaaaaaaaaccucauacauccuagacugggcuugaaaucucuguguaacuaaggaugacucugaauuagugauucuccuaccuaaaccuucaaagugcuagcuuuccagacaugcacuaccaugcccuguuuuugcagcauuggaaauaaagcucagggcugaguguaugcuaggcacacgcucuaccagcugagccacaggcacauccccacauaccugauuucuaugaccauauaguacuaacaucacugcaguuacugaucucagccaaauucuggguaggacauguccacuaaucgcacaguacucuugaggucucuucuauccuauagguauuugugcuuauaacucugauuuggaugaucuaguaauaaacuaguaagaaaauguauggggaaguagaagucaagggagaaagaggcuugugucuuaaaccauaauuagagccgggugugguggugcacacuuuuuaaucccagcucucgggaggcagaggcaggcgcaggcggauuucugaguuucaggacagccagggcuacacagagaaacccugucuccaaaacaaaacaaaaaaccauaauuagaccuauaucccaacauucuaacuguggaucccuggaaguccuaaacggcaauuuggaucuauaguugccagaugccauuugcuacucucuaucuucccauccaauaugcuaaaaugguagacuggugaaacuuagaguaaguagauagcuagcaggugguggacaugcccagcauugggucacacccacagucaugccuagcuuacagaguggcauuuuuaagucacauggcucgagucuucuucucaguguucauuaaguagauauaaccccacuuagauuuuaggauuggggcucuuucucugccauguuagugugcauugauguucugaggugacuguccuuugacugaaaugguaagccacuguaccacuguugccagcagauacaaagcacccucucgucugagugcuugcagccugccaaguaucucuuguuagaaucaaaggccaaucugccuuggcuccauacaggggcugccugguuuauuccuaucugaaaggaaaugaucugucagcauagagacauucauuuucuuacuagcuggagcagacugcuguuuauauagcugcaguguucuauuucugacuauuaaagaguauuugacuauauugaaagcccauuuucuuguuuuuguacccuauuauaggaaauuuucauaucuucaagucucauugauguauaugucugugugugugugccugugugaguuugugugugugcauguuucuuuagaagucagaagcuguuggagccccuggagcuggagucaguugcaggcaggugugaaggucuuaggaacggaaugcaaguccucugcaaggcagugucuuuaucccugagucagucucuccagcccugcuuuacagcuguacaaccauuuccacuuugggcguugguugguucuuguuuucacaguacuaggaauugaacucaggaaauugauccaucucugucucucuuuuuuccccccucuuccccucuucccacuucuccaugcuaggcaagagcuguaccacugagcuccaucuccagcccagaaauucacaguucuuguucuuuucuuaauuccuccguguuguuuagugugugccaagggagaggggguuggggggacgugugggaaauauggcagucagcaaucaaaaaccaucuugcagggcaucaguucucuucuaccaugugagucagggauuggcauugagucaucaggcuuggggacaagugcccuugccuacugggccaccucuccaucccacagaaguuuauaacucuuaacacugccaccagaaguccuccuuuucuucuugucucuguaugaagaaaaguaccagccugcucagcuccuuugagaaacuaggccagguauaaugaucaauaagacaagacaacagagacacaggagagggucacagaggcucuagaacucugcagagucugagcagccuccauauuacuugaauccuccugauguuguauguacagcuuaaguaaagcuagauaaaauuaaugucaaauuuuuagcuuggcccucauacagggcuuuguugaaaaauagaacauuuuccccaucagcucuugugguuuucucaauuuuagauaauacggaugcuuuuaacagguuuuuucuguguguguguguguguauguguguguguguuuauuuuuuccaguuuccaaagaaaaggacccuuccccccaccccaguugaacaguaggaaaucacuuguuugaggauauuuugcacuuguuguuuuucauggaaguacaauauuuuauacucccuaccuuccuaccuuuucaguaacugcuuuuaugccugacugacuugggacuagcagucaaaaucuaugguggguauccaccaacuaguucccuuugaucuucagaaaaaccaucuaugaaacaggugcaaaucauuauuugcugugggagaauaauacugcauugccgaaagccugaaucuuuugugagauaguuaaucagaggagauuauuucagacgucacagcaggaauugcuggcaccguguuaggaccuuugaguguacuuucucuuaagaauacuuagcuuggguuuagagacagggucccugugucucggcuaucuggcagacuuaucuguuuuuccucgcuaguggcagugacaggcuuaguggcagcuccugagcuuucuugccaguugccugcacugagcuuugauauguuggcagacugcacugauucucggaugcgucucugaaccucuacaggucugcuucuggcagaauggagugugacucuuauccuuugcccauuaagcuaucauucuggcccccuuaucuaggcuucuucugcaaacaugccuuugaaaguguuugguucuuuuuuggcaguuuauuuugauaauggacaaguauagaagcaaaugucuuauuucuaaauuacaugggauuucuugaaagaggaagggugacuuagugaaaauuugccuuaaacuggcaucucuggugaaauuacuuuggauuucaauuugaaauucuuucuaguaguuuaguguggcaucccuggcucuuuaacccagaaagagcuuuauguuacucuccauaccugaugcauccauaaguacguugucagcacugccacucacgugaucggguccagcugcagauugucauauguggaaaguggaaucuucuguaucagagcuuuaguguuuuagguguucugagccaagcuuggaaagggggauauuuaaagaaaggcgauugccuguaauugccauauauggacacucuugaaagccuugguguaaucuacacuauguuggaguaagauuuaacuucuagacccaguaguagauauguggaaucauuuuguaacuaggcagcuucuguguuccuuccacugagaagucagauuuguucauuuauguuacauaaaacuuuucaagguuccuuguugauuggaagcacaugcaggauuuugaaauucugugaguagaauuuuaaaaacugggucccaggcaaccuuccauguucaguaccauaagagucugucgcuaccuagggucugaguuaaaggcagucuuagugucagugagguuucccaucccaaaacacggaaggcauucuuguucuuguucuucauucauuaaaaugaagccauuugcuuacucuguuuauucuuagcuuaauucacagcagcaacaguagaaaaauccagcuuaaaaucuuuaaagaauuaaacagcagauugucaaaugauuugacaugaagucuugcagaaguggucuuaauucaguaugcauuaauucaguaauuugccaucagaauaacuuuuauuaauugauuggccuuaugaauugauauauucuuuuuuuuaagauugauuuauguaauuuauaugaguacacuguugcucucuccagacacaccagaagagggcaucggaucccauugcagaugguugugaaccacugugugguugcugggaauugaacucgggaccucuggaagagcagccagugcucuuaacugcugagccaucucuccagccccuagguugauauauuucaauaauaucuuuacagguguuauuuaauauuuguuuaaaggggaauuuaaaaaaauaaauaaaaucuuuauuagaaauaagauuucuuuuuguggccuagguugguuucagacuugauucuccugccucagccucaugaauaaauuacuaggcacaggccuugaucacaccuagcuuuugauaacagguuucuaagaaaagaaaguuuggaacuggagagauggcucagcaguuuagagcacugauggcucuucaagagaucgaaaguucaauucccagcaaccacaugauggcucgcaaccgucuauaauggauucuggugugucugaagacagcuacaguguacuccuauacauuaaauaaaaucuucaaaagaaaggaauguuuuaggcuaucuuagguuaagaaccugucugaaaaaauaaaauucaccaccaucacccauuucuaguaauauaccauuuuucuguuuacaugcgugaacaaagggaaauuuuucauugucaaaaaaauaaaaguuagugaagccagguaugaugacucauguacucacuccucaggaaguagaggcagggggaucagaaguuugacacaaaaacaaauguaguaaguaaaaauacaaaauacuauuucucguguuuauauuuauauuuucugaguuuguuggcauaugugcgagccuuuggcucucuguguaacugaaaauggccuugaauucguaagcuuccugccuccaccaaccagugcugggaccacagguguucacuaucacgcuugguuguauguaguguuggagaccaaaccuaggauuuuccgaauacuggacuaggcaggccaaacacuuccccagcugagcuacaacccggcagcuucuuguuucuuugaagcauggucuugcugguguaguucagucuggccccaaauuugugaucccccucacuuuagccucccaagcgccaggauuaauuaugcacacugccauucccagcuucaugcuauggaaugaauaugcaguuuuaacguagcuuuuuuuuauuauuauuauuuuuuauuucucugucuuuaggaguaauugaaauucauacuacuuugucugggcagugguaaugaacaccuuuagucacagcacucaggaggcaaaggccagucgaucucugaguucaagaccagccuggucuacagagugaguuucagaaucgucagggcuacacagagaggcucuaucacuacuuuuauugcauuaaaaagcuuuauggugcuagcaggaugacucagcaugaaaaguuacugccaagccuaauggcccgagcuggauccccaggacccacauguagaaguagagaaccaacucccuggcaaguuguccuuugauauaugcaugcuuugacacagacauaaauaaguauaaauaugugcauguauauaauuuaguuuuaaguuacuuuuaaugcaacgagaucuagguacaagguguggggugacaaggcaggugcucuaggaauguucugguccuaaaauuauuuuuuccucugguuuauuaauaagccacauaguuguccucuuagacuccuguuuuccaaccacaaaaaugcauaacacagucugaacaguccagcaaaagauuugucucguaucaauaaacacaacuguaaaaccuggaaauguuagaaagcaauggagaacucugaaggcuagacagaggaagguggugggaugugugacaaacauacaagccaacccaacccagcaggaagcugucuuucacagucuuaacacgaugcaagccagccuagcaacagaagguagcccagguggacuuggcuucccauauaucacaugggacuugugccaacaaugcuaaggcaagccaaccaaaccuggcaagaauuggaagcucugcugauaagaagugaccaccagggaggugcucucccucccuccaggaaaaagucaggaugggaauggcaagagggguuuaugucuucagucuggccugggugauaguuuuuuguuguuuuggguuuuguuuuuuaauuuaaugauaguuuuuauuuuaagaagccucgggagccaugguaaaugccugccuuucuagguggcucugacugagaaccuacuaaauuccuacuccaagacauuagagacaaagugugcuggcacaugccuaugagcccagcacuugggaaacagagaugggaggauuagaaguucaaggccacccaagguuaaagaagaaggguggggaggaagaggaggaagaggauauaaaaucaacucauagaauacaaaaggaagaaauuuguaaagaugagaauacaaaucaaauuggaaaaagcuuguucuaugaaaaaaauacgauuaaaauguuuaacaaaacuaaggagugcagacacaaguuuagaguugggcuagugccaaaugugugugaguucugcagaggagauccugaguuccugauagcauaggcuacaaagugagggccaaucucaaagaacaaaagcagauuugucucuauaaggggggaaagaugagauauugcaaauccugcaacuguuaagcuaugugagauuuuuaugaacuuuacauucuuaaacuuuugauaacuuugaagaagugggauaacuccuuaaagcucacaaacaacucaaccaagauaaaacaaacagcgugaauacugcugaccuccaugaaagaaaugguauuuguaacuuacagguuccugagaaaacccaggcacaauuuaucuuacuagagaauucaaaagaauuacuacuaauguuagucucuucagagaguaggaaacaaaaaaauacuucuuaaauguuucuguaaggccacuauuacccuuucaggguuucuauuccugcacaaacaccaugaccaagaagcaagcuggggaggaaaggguuuauucagcuugcacuucugcauugcuggucaucaccaaaggaagucagcacgggaacucgcagaggacaggaacuuggaggcaggagccgaugcagaagccaugaaggggugcugcuuacuggcuugcucagcuuacuuucuuacagaacaaaguacugccagcccagggauggccccacccacaaugagcccucccacccucgaucacuaagaaaaugccuuacagcuggaucucauagaggcaucuccucaagggaggcuccuuucucugugauaacuccagcuugugugaaguugacacacagaaccaauacacccuacuaucaaagccaaaacaaaacaagaaaacuaaaaauaaaaagucuuguuuuuuaugaacauagacucaauagcucucuacuaaauucuaauauaccaagugccuuaauacauuuaaaaaaguacucagugcccaggaagcauaugccagauauggaaaguugacucuguugaaagucagcgaauggagacugccaagucaguaagcuaaagcaguaaauagcguauggcuuguguuacuguuuuguguuugaggcugggccuggcacaggauaggcaaguguucucgaguucagcaguguacccagcccucaggauuacaagacuguccucaaauccauuguccauucuugauaaaacugcaaauuagcaguagaagugaaguaguaccgugcugaagcaugccuacagaagcguccagcuaaugacuagugcuugugguacaggacugaaugcauuuccucugagaugacagacuguugcuggcacugggacuacuguaaugagucaagagaaaauacuaccuauaggacucaaacugucccuaaucaagugauaucauuguacauauacaacucuuagagcugacagaggauuuuaguaaagucucagaauauaagaacaagaccaaaaaaaucaguuguagggcgggggauuguguguaguuagagugcaaggcuuuccauguagucccucguaccacagaaaacacaucuaauuuauugcaauuuuauguacuaacaacaugguggaaacaaagcaaugcuauaaucugaguuuaguggcacacacuugcagaggaaggaggaucaagaguuugaggucagccugagcuacaucagaagaguaauucaaaaacgucgaaacaacagcaaaaacccuacuagauaaauagauaaauaaauaaaacuuuaggaaaaaaaaccuccccauauagauauuaggaauuaggcuuuaacauaaauuuuuacaugaaaagcucuagaaacagucuuugugauaguuugaaagaaaauggccaccauagacucacaggaagggguacuuuagggggucuggccuuacuugaguagauauggcuuuguuggaggaaaugucucacuggaggagggcuuugaagccucagaagcucaagccaaggccaauggcuuacaguuaucuuucugcugccugccaaucaaauguagaacuuuaagcuccuuccccagcaccugcaugcugccaugcuuccagccaugacgguaauggacuaaaccucugaacuaucccuaccuuacaagccagccccaauuaaaaauuuuuuauaagaguugccuugguaauggugucucuucacaguaaaagaacacugacuaugacugucuuaaaguacaggcaacucuacucauuauuaaggcuuauuucauaacuauucuaaugaagacaucacaggaauagacaaacaacgugaaaacauccagaaacagauagaaacaaaaaagccccacugcuacuuacagagagagucaagcuuccuggcucgacggaggcuguucugucuaagaagaagggaaaacagaacagaacgggugcaguagaugcugugauggcuacugcuuugucagccugacaggaucuggugucacccaggagucuagccucugaacaugcccaugagggguucaucuaaauuggguucauugguguggaaagacuugcucuaacuuccagacagacaaaguagcuccacaguagcacauagcauucugcuuccuggcugugggcguagugagcccagcuccuccagcuccuggccuggcccagugacuuaccuccagcugacagacuguaacccuuggagugcaucacagcacucuacugggccaugugcuuuguucauuuucccuuacaucgucaguguugcugcacacuauauccaaaaacggcuguaauggcuaauuuauauauugucaucuuuaugauaaaagugguuuaucuugcaacaauaauuuuuaagucuucaauuguguaaaaugccauacuaggaugugaaaaggugacaaaagaagugugaugggugaccgcagaggucaguuuuggucagcugacagcaugagcaaaguuacuucaaaacucuaaaagauuugucguuggaguuuaauuuuauucuauuuaagauucaagaaacucgagccgggcaugguggugcacaccuuuaaucccagcacuugggaggcagaggcaggcggauuucugaguucgaggccagccuggucuacaaagugagugccaggacagccagggcuacacagagaaacccugucucgaaaaaccaaaaaaagaaaagauucaagaaacucauaaauucugcuuuuugccuagccagugaacuuguuuuucaguaaucaagacauugguuuuacuuuguuaguuuguaauuaucauccauacugauugaaucagcagucuuucuugauaaauauguauguaauaguguauuugauauuuagugacaguuauaauguuuaaaacucugugugugggggucuggggagggagucugcgugugucugugguuugggguuuuuuguuguuuuuuguuuguuuguuuguuuguuuguuuuccacugggaugacccaagcaccacugaguuauguauaucaccaacagguuuuuuuuaaauuuauuuugugacagccuugcuuaguugccuaggcuggcccuaaaauagcaauccuccugccucagccuccagaguagcugggauuauaagcauaucuuacugagccucacuuggcuuuuguuauuaacaucuugagucuugccuguccugauucagagaacuuuggggaaaggcucuguguuuuguuuuauuccucuuucuuucuuucuuucuuucuuucuuucuuucuuucuuucuuucgagggauuacuaauaauuugagagucugguggugaauuacauuguccauguacucauacuugaaaacuguaugcuuaucucuuuuuccuuuguuuuucaagugucaauauacaguaucugguucuaugacaagaaugacugucaucgcauagcaaaacucauggcugaguaaguauuuauaguauuccauagacuaaugagaaaugaaacauuacucuaaucccagcuucucuucaguacuaacauccccgguuaaugccuuuuuauuaccaaaaguuuggcaaaggcaaauuuuauuuuucuaaaauuaccuguaaucaguccuauugguuccaauguauuuauaaucuguguaugcauuagaaugaugugagugauuguuacuucaaauguaagaauauuuaaugauuuaaugucaacagcauuuuuuuaaauuuuuagauuuuucuuuguugcacuuauccacuguauucaguccuacagacaguucaguuuaacaaguccagcugccagauugccuggcagagaauaugaggugcaucaggacauagccugacugccauguccagugauauaguaaucucuacuaggauuaguggugcuguuugguagccugaugcagauuacacacccuuuacaugaacuugguuugagcacaggcuggguuuaacaguuuccagucuauacaguuagucuuccagaagauauuuaagacucacaaucuugaacucuagaaaauaauuuccauugaguucaugaucuaaauaaaggauggcuuuuuacucuugugcuaaccuguugaaguuagcucuugaguaaccauaaugcaagauugcccauagugcuagguggggccugggaugauauaaaacuagagcaaaaugugcagugagcagucuguucugguguauguuggcuuccucuuuaguuuuugcucuaaucugcaaugaacucuuuacucuccugccaagucaaaauucuguuacucucuucaggguuuguaccuauguguuuggaggaaaauuuuaguuaaucaugcugaaaguauaauaguuuacucaguagccucaauucuagguaugcuuccacauacaaagggcaaguuauaacccaggucuacuggcauguccugacuguuaaccuccuugcugcucugucaucugcugagcuugcauggcagacuagguguguuuaccgccagcugcaccuccagggcuuugcugccuggaagcugacagucagucuuacgagagagaggguuggcuuuguaaaguuacacugcuucucaacauugguguuauuuaguuuacaaagauaaagauuuguccugcucacgguuguaggugugguauagcuagagguaguguagcucaggagcaugggcugacaucuacaaaggaccuugcuguauuuggaguggcgaaugucacacaagagaacaaacuugcugucucugagagucugucuuguagagagagcucucagugccauccugggccaccugccuuaugaccucaagcaaggcauuuauuugauacuugcuuuuuguguucuguuuguuuugaaaguggcagcugcucagaagagaaguauuuaaacuuaggaauguauauguucuucugccagauuagagcauguaggccugaguggagaaucugucugugugagccccgacaacaacugagggaaaauuguguuuucugggggccuugguggcacuccagauacuaaccugcagugguuauuggcugaagaaugaacaugugaacaagcuguacuaauccccaaaguagauauggaaguagaaaugggacgcaaggaaauuacuaaaagugaugacagaugucuguaaucccagugcuaaggugaaaggauugugaguucaaguucagccuagaugacauagcacaugucaucuauauaagaaaggaggguccuuucggaauaagcccucugcuccugaauuguuggguuagcugccugucgucauuguguaucacuucucaguuaacgcaauuaccaagugagccuuguaaccauaaaaucucauggcaggaaggaccuguuguucauuauaguuuguaacugaaaucugaaugcaucuuuuaaaauuagcugcauuauuaaaaucuacacaggcaauaaaauacccaugugguccccauccagcuuucaguuccuaacauuuacuagaauugcucaauuacuucaaaccuuuucuaugguaaggaacgaggauguuauuuaaaaauguaugccuguaaaaagagcuaaagauccccaccccgccagugacuuucuuucuuaacuugagacggccuuguaggguuugaaguguagaauuaaauaaugccaaugaaaauagaaugcguaccccuaaccacccugaguuuggucacguauuuagugcagaggcuuuuaucugcuuagagauucauccauauucauuugcaaggcuggucacagugugaugagucacacagcuucugagucuuagugauguuuguggaccacuuaguucuacugggguugaguuacuuguaggagaaaaggaaacauuugaaugcauuucuuaacguaccuacuucugcuaccuccagagagagguucugcuuuucuuucuaaagguaagggacuuugcuguugugaaugggauagugaugugguuaaguugugugugucuggaaugaaguaacugagguaguaggcucuuuaucuauugcaaggacagugucaugugacacucuuacaaagugaacaaaagagcacuugggaccgguuguguagagugaccuuucugaagccuguucuccuccuacagugugguagaagaggagacacggcgaucccagcaggcugcucgagauaaacagagucccagccaggccaauggcugcagcgaccagaggcccauagauauccuggagaugcugagccgggccaaggaugaguaugagaggguaagucucuggugcgggccagggaacaaugaacgagguggggaggccugcuggugucuuagacuggaaauucgcuccugcgcaggcugcagccacuaguuuagaaaagaacagucugugauuucauaugccuaccucagaggacuugguuaggaaggaaaugugaccaugcuuguuuuguucucuagcacuguagaguuacugugggagaaagugaucuuggcgggugggguuggccucagugcguguuucagggaaagcgucggcuccccuuuaucccugccguaauguucaagugagacauggccuggagaauuuauauagguuuugaaaaguagucugcuaguuuguaucccauacuaguaaauggcacaucuguguucuauaagugagcuuuucuuuuuccugguuugggggagaguaguuuggggaguauuuuguuucuugguuguuuuggggguuuugagacccacugauuuugauucuugcugugugguccugacugguuuggacuuuuuuuguaaaccaggcuggucuugaacucacagaacuccaucugccucagccuuggagugcuaugauuaaaggugugugccaccaugccugggcaucucuggaguuugcaauggauuuuauguugacugauaagauguccucuuaaaugauaaugaaaauggcaguuguggaacaauagcuaauuuauucagcucaugcauacaaauuguucacucugacaaacaguacacuuguuuucuuuucuuuguuacugugguaauggagugugugguuuccuugccguuuguuuauggauggggugucuuacaggccucaguggccuugaaccccugauuuuccuccugagaacuaggauggcagacacucacagccacccuugcaagcaagggacacuuguugacagugucucaauccugacugcuggggaaauguccuggcauuucucauaccaucaagcccuacacucccuguaggaagccucagucuuucugugcggaguugcagcuccucaccucccacugcuaacucagugcuuuccuuagugauaggucaucuccacucuucaaaucuucaugaagcagagugcagaaagggaccauugaaaauuaugauccugagcuggccgugacuguagaucauaccaaugaucucaacauaggacaccagggcaggagugcugggaauuugagggcagccugggcuacagaguaggaccaucucagaaaaauuaaaauguuucgguggguaaaaaucacuugccucauaagucucuggaacccacaguggaagggcaggacagauuuccagagguuguccuuagacuucuacauacccuucaauggcauguaugaagccacauguuauauauacacauacacaaccacaacaaauagaaauagaauaauaaaaauuugauaaauaaauccuguuuccacuggaauaaugguugauaccuguaaccucagcacuuaggagacaggcagaaagacuugauaagacugcaucuccccucccuucccccucccccuccccccuccacccuccgcaagaaaaaguauucagauuggcuaaaagaauucaauuaaugcugugagauaucugcuuccccucuucuucugucucccccuuucucugcccuccucuccuccagcggucuugggccucugugcuauguaguagacauaguggucucacauagcaucagcuucacuacugaaguauuucauauacugccuuuuaaugucuccagaaucuagaauucagggaacagagucuggcaaaaguauucuggagcuaaguuuucucuuuaaaaagcauucucaccuucuaguggagaaauauaguuuagggcccauaagagguuucaaguugcacuaaauuccucaguagcugauagauaaauaggaacaguuucuuuaucuauagaaauuaaauagugguggcuggugagagaauucagcaguucagaauacuugaagaggauccaagguuacuuucagugcuccuguggugacuuacacuguuaguaacuccaguuucagggacuauaacucccucuucuagccucugggcaccaggagugcacacagaguacauacauacacacagucagaauauucagacacauacaaacaaaucugggggcaggggagguugagggcuggaaagaugacucagcaguuaauagcacuuguugcucuugcagaggacccagguucaauuccuggcucccaccuagugguucacaacaauucuuaauaucaguuccaaagaaucugaugaccucuucugaccuccauggucacaagguaugcacacaguguacauacacacaugcagacaaaaucgucauauaaaaucuuaaagcauauauuucuaaagaagcuaacuguuggaaaagcagucaucuauaaucauaauuuuuuaaaucaaaauaaaaaucaaggaguuuguuucuuuuguuguuguuugguuugguuuaaaggcuguuucucauugccucucugugcucacuuggguacugauggccacuacccugagugagacaggaacuagauacugcucaguggaaccaguucugcaaggaauggccuuggcuucucugucugagaagcaaaaaacacaaaagagaagaaaacgucuuuuuuucuuuuaacacuuuccauguguaucuaccccuguaucaacccuuagacacuagaucucuagugucacgugggcaggcuauaaaaaucucauaagguuucuguuuucaauuacugcaaaagcaguuaguacagacagcaucuucuauuguaaagagcauucuaggggccggcaagauggcucagcagguaagaguaaugacugcucuuccaaagguccugaguucaaaucccagcaaucacuugguggcuuacaaccaccuguaaugagaucugaugccgucuucuggcaugucuaaagacagcuacagucuacuuauguauaauaauaaauaaaucuuuuuuuaaaaauucuaggauauauaagauguuauccaagguuagauucaaaugaaauguuugaagguuuauuaaaucuuuaacauuuugcuuauagggcuuucuuuuugucuuuaaaaacuauaagcagggcuucuuuauaaauaaaaguuugcuuucugccuugucugccuguuugaccacauggagcugguauuagaaguaacucugggccacaucguaguguuuggaaggagucuccccagcagcacauagagagucccucuguuucuuuuugguagacugggaaauugucagccaagggaagggaggguaagcaaggcuucagauuuaauaucaacucuaaauccucccucuucaguuuauagaagauaggcagccucacccucucuauccuucccucccucucucucuaccuugcccccuccccuccucuccccuucccuccccuccuuucuccucucuucuuuuuuguagucucacuguaacccaugcuggccucaaacaaaugauccuccuggcucagccuccugacuacugaaauuacaggcguacaccaccacacccaguacagguccagcauuuugcauaguauuuauaaaagccuguuugaaacuuaaagcuuugugaguauuuucucucuacaaucccuguaguuuauuuuuaccaacuuuuauauuucguguaaugaaagauagccaaaacuacagaccuuuacagcuagcccaguucgcauuguuuuuagccacaagacgaacuccuggauuuugaacaguauuuuuaauuguucuucaaaauguaggaauaucauuaguuuuccuugucaagcaguguauagugcuauagaaguuuuuauguucaacgauuaauaaacaaaaagaauaauuaauaaacaaaaaggcaguaauccugccuguuagaaauagcuguuaauaacacuuuguuccaaauguguaugggcauucauguguguucaauuuauuagccucccauuuauaauguguucuuuacaucuuuagaucugcguuuacaucagcaauaacugcucaucucacaggaagugcuugggagauuucaguugauaaaauagaaacaggguuucacuguggugguccugagugaccugggacucacuuugugaaccaggauggccuugaacuugcaugcccaguuacauaaauaauacccuagauuucucuuaauucuuucucuuaguagcuuagcacuacaguccuggagcuaaagcacuauauaucauacuaaucuccuaagauuaauuacuucaaauggaauuagaugaaagauuuuuacuuaggcuagccucaagacauguuauagagccaaggaugaccuugaacuuuugaguucccaaguaguauaacuauaggcguggaccaccgugcccagcuuguauaaugcuaggaauucagccuucuuaaagauuuuaccaaauaucaaaauuacccuccaaauguguaugugauuauacauaucuccuaaucuuacagcugccugccaucaucaacacacagaagauaaaccuucaacaaaggcccuguacaaguaccagcacugccccaagugcuucagaacuguuagcaaggugcccauagucacaacgcucaucucacaaguucuacuuaaggauugcagaguccaguaacucaagagucccuugggccauaguggaacugagaccuguuacugccuucccccagguggaaggguuauuggacuacagccccagccuguggucaccaggugaccugcugaguccaggucuucuagcucaucuaaagaacgacauguugggacuuccccucgcuuagggaaacucccaguuuuugauauuucugagcauuguaccuucugcuuuaagagcuucuuaggaacaguguugcguuucucucauuuucagcgccagucauuccuguagcgggguccuuagugauugaugaugacccuguucaaagagccuuaguuacauagugaguucaccaaucugaagggauccuguccuucaaaacaaaacaaaauuugauguccuaaaauaauauaagaauuaucauuuaaauggaaaaaugcagugcucuagccacucauuuacuauucgagccccuauuccuguguugagcagguuucugaacaguacaauauuaagaaaauuacuuuugagggaguuugugggauggagaggcuuguggagggguaaccgggaaacgggauaucacuugagauguaaacgaauggaaugauuaauuaaaaacaaaaaaauuuuuaaagaaauuuuuuuaaaaaguuacuuuuauuuuucuuguugaaauuguucuuucucugcguugaagauuggagacguuucuuauucuuguucauuuuuguuguuucgauaaacuuacaaaaucugcauuaaauauuucacauguaacauagguucccagagugccauaauugcaugucuguccagugaccguguaaggauucuuguguauguuacauuggcuguuuauuuugcaguauugggguuugaacccaguaccuugggcaugcucgacaagcucugccagauacccaaccaagguuucuuuuuauuaauaaaacuauuuuuauuugcaguaucacuuuuagcaaguuugaauuuaagugguauugaaaugauuggauguccguauguauacauaaacacacaaagugaaccuuuagcaagcuguggcgucuuaugcagguucagcucaaacgugcucauaaaucuaaauguaaacguuagacuauuuagccgaguacugaaaagauggucagccaguacagugcuguuggauaagccuaaguccgagcuugacucacaguacccaugguuuuuuuuuuuuuuuuuuuuuuuuugguucagggcagugcuggggaggcagagacuagaggaucucugggacuuggugaacugccaguauagcaaauccaugagcuccagguucagugugacagccugccucagagagugauugaggguauccuacgucggucacuggccuccccaacaccugcaugcaccuacaacugagucagaugugcucaucacaccuguaaucguaggagacugaggcaagaucauaaauucaaagucagccuggaauacauagcaagacugucucauaaaaaaucuuuuagaagaaaaauauauuuaccccuguauccugauuuaucuuugcuagguuucuccucuagugaaaugaaacuuuugucucuacaaaaguuauugaagcaauguucauaaucaaacacugaacuuaggggcugaggagaugacucaguuuauaaaagagcuugcuguacaagcaugaggaccagagguugguaccugucacccauguaagagcaucgcugugucagccagcucgagggauggagaguggggaacagaaggacuaaggacucgcuggccagucuguuuagcuaaaacagugagccugggcuccacacaggugcucauccucacauacacacauaauuacugcaaaaggacaaauaguuuuuuaagaaugaaaaugugcuggagagauggcucagugguuaagagcccugcuucuuuuccagaagacacuguucaguucccaguacccacgcuuacaacaucucuagcuccaggagauccaauacaccauucugaccuccucagcaacaggcacacacaugauacacauacuuacauacaggcaaaacccugguacacauaaaauaaacgucuuuaaaaguggaaacaauacaaauguucuaugcuccgcaguuaacaaggaaugggcugcugauacuauaguuugcaugaaucuucgcagcuuuaugccaaguggcagaagcuauuaccgugguuauauuccauuccgcuuuagcauuuuugaaaagacaaaaccaacaacugguuucuuggaaugcucaggggucaugaccuuagugagcuaacacgggagcacuugugcaguguggcacaguacagguagaccugccucucccaacuguuaaagacauccuguguaacuuaaguuaugggaaaaucugguagaauaacgguaucuucccuugaaaugagugauuaaagcgauaacgguuggagcuaccaugcauagaaauagauucucuacuuuauagaaaugcuauuguagaaguuaagaugaaaauugauagaaacaguuuuaggagauuuuuuguguauuuuuuuuaauuaaaguauuuucgauaacuucaaaugugaaccagacuuuagauagcaguccuuuuucagaugauagacuuuuucuuuuaauucuuuuccaagaaucagaugggcggcucaaauaucuccaguccugggcuacagccaagcacucagcucucuaaucugggaagcaccgagacucuagaagagacacccucugggucacaggauaagguucguacaguuaaagcccuagcuuugucaaaauagcagaacagcaccauuucauaaggauuugaaccacugugcaagcuugguuuaucacuugucugucagaucauaugugugacaucauaaugacauauacccagcucacuucccaggccaugaaacucugaugcggauuaugcaguagccuccucucugguccccuaguguugcucuugcuccugccuucccugugcucagccaggccagcagaaugauccugggaaacaacauucacccucugccuugagggccuccgugguguccugccucacucucaguaauggacccugcuuccggcccgccccucucccugagccaucaacuccuaacuucugccuggcucacuuagcuccugcucaaccaggacugugacucagugguuucccuuggcucucaguacuuuucuccugugacuguguccguuuucuucuucugcucucucauagcuucuuaguuagggccugcuaucaccccucugccuuccguccucugcuugccuuauuuucuuacugacuuucauuagcuaacgugcuuugguuugguuuuauccacugucccaugcuaaagggaccugcaguuccguuugcuugaggcuuuuuugguuuugguuuugguuuuuugagacgggccucacuguguaguccuugcuguccugaaacuagcuuguguagacaggcugcucccuacuccucagugcugggaggaaaagggugcacacacacacacacacacccccaagacaagcaguuuucucugcauguucaaggcugugucuugguuuuuuugguguuuuguuuuguuuuguuuuguuuuguuugagacaggguuucucugcauaguccuggcugcccuggaacucacuuuguaucaaugcugugucuuuagaauuauaaauauuuauugaauugauucauucucuuuauaacugguggucugauaaaacaacagauacacuaaacuucuguugacuauauguagagugguaaguaguugagcaggagccagaugugguagugcacaccuguaaucccagcaccucggagacuggacaggacagucaucuacuguccuguuugagaccaaucugcuguauuguauaacuucuaccaggccaccuuggauaacaaaagcagacagauucuaucccauaauacacauaauacagaaauauuccguguacucaucccuauuucuauugagaacaucuacuuguaguguguguguguguguguguguguguguguguguguguguguacaccaucuguaguucuguccuguggaugguacaugcccauaaucccagccuuugggagguagagaaugaccagaaguucaagguugacccuagauuauacagggaguuugaggccagccuggguuauuauaugagacacugucucauaacaaaugaaaaacaaggguggagagguaagggagacuuacugguauacguauauacacgauuguaauauaacaaccuugcuaacauguauauucaugcuaauaaagacaaauuuagauacucauacuuaauucauaauagccaaaaaccugcauacaacccagauauacuuuaauagggaaauguuucaaaaugguuagacuaaauuacacagguuguuccuaaucuaaaaacccacaaucuaaaauguuccccaccccagaaucuuuuaaaauccaaugugaggccacaaaugaaaaugaaugucaugucagaggucaaaguuaaaacagaagcagacagaaaaauauuuuguaauuuuaccgucgggccacaucuguaugaaacacaagugaauuucugguuuagaucugggauccacucuaagauaucucagagagagagagaaagagagagugugugcgcgugcgugcgugcgugcaugugcguguuuucuaaaauguauguuuuaaauauauucuauaauauauuucuaaaacccuaggaaacccucacauuuuaaaugcuucuagucucauguauuucaggucugggauacucaguaugaacugcucuaucaacuaauacaacuuagcaggaaggacaaaccugggcugggaugcugcuuguccggcaugcauggguuccaaccuucuaaaggagagugggaaggaaacaaacuggauauauacagcaacuuuaacaagucucuggcacuuaugcuaaaugagaaagacucaaaagacuacauauugugauucuauuugcuuagcauucacauucuugauuugagcugggcguggugguacacaacuuuaagaacucagaggcagaucucuucgagcuggggucaccuggucuauacaucgaguuccaggacagccagcgcuugagagaccuugucacaaaaagccaaaauucagcugggcguguugacacacgccuuuaaucccagcacuugggaggcagaggcagguggauuucugaguuugaggccagcuuggucuauagagugaguuccaggacagccagggcuacacagagaaacccugacuuggggaaaaaaaaauaauaauaaaguaacaaaauacaacaaaaaggaaaaagggagaaaugaaaaagauggugguaggagaagagggcaugcgucuuuauuagcauggaauauacauguuaacaagguuguuauauuacaaucguguauauacauauaccaguaagucucccuuaccucuccacccuuguuuuucauuuguuaugagacagugucucauauaauaacccaggcuggccucaaacucccuguauaaucuagggucaaccuugaacuucucaucauccucuccccaccucccaagagcugggauuacagacauauaccaccaugcccagcucaacaaauuuguuugcuuuagcagagugugggaagugugcacacgugcaugcagguacucucacacacgugugcauguggcaggcaggacuccucaagugccauuccuuacacucugucuaccauuuucucuuaucucauuuuuaagcagaguuugucguuagccugcagcuugcauggcuggcuagucuggccaguaaguccccguuaucaguccauccuuaccaacccagugcuggaauuacaaguaugcaaaugaguagaagaaccacuuguaugaagacuaugaaggcuauguugcaagacugucucaaaaacacaaaauaaaauaaaauugcaacuuuuuucagcuaaagccaaggaauuacaaagcauuguaauuauuaugauauguaaugauauauuaugaaaaggcuguguaauugucuaaaacuauugcaaaucccuaauccgcccuuacacagagaguugcucuauuuauuuagugaugcugccaucuagugcugaguggcaagcagaucaugcugccaggccucaguauuaaaguccauuuccuggggccacagagauggugcaacaguacugugcuuguggagagagcauauggcgggcuuuggaucccuagcagcacauaagaagccgggcuugcuggcauucgggcuugcuggcuucguguuguaguccagcacugggaaggcagaucgcugaguagacgcguucugguucauugagagaccuugucucuucacggugaagagugaggaauacaucugacauugacgccuggccuccacauacaugcacacauguguacauccacaugaacuuguauguauaccacaaauacaacucacgcagaaauagacuucacuuugauaauucaccauuaaguucucuugguucucuuuccccaguguguuuccuucuguuuuuauugaauugaauuguuccuacucucuaaaauagaaguauggcuucuuacccggaauuucuuuuuuuuuuucuuuuuccacguuucuuuuuuauuauuauuguuguuguuguuauuauuauuagguauuuucuucauuuacauuucaaaugcuaucccaaaagucccccauacccuccccccuuacccggaauuucugcaaaauaaccguagcaccuuuaguuuucaaaauaaaucuauguaaacaaauguugacauguauguggaacgguacguugcuuacgacucacaucaauugcacugaugaauguacugcgcucuaguacuuugcuuugguuuucuuugucuacauugggcuggguuggauugguucucgaggauggucucaucuaauagaguacggagcucaguauggagcugaaggugacucugaaccucugagccucugucuccgucuccugagucuacuauuacagugugcucuacucacagcuuagggggguugagauuauuuuguuuuguuuuuauuuucugggggcgggugaggagggagguaggauauuggucgguugguugucuaguuuggaaacaugcuuuguugccuuggauuaccuuauauucagacuaguccuccugccucagccuccccauccugggauuauagggaugaacuaccacaugcacguuuuaguucauuuuuugucacagaaucucuagccgucuuguuucagcauaaagaauagguuugguuuuuggcuuuugguuuuuuuuuaaacuacugggcauucaguaaucaggaagcugaaccagaauuguugaagcuucaaggccagccuggcuucauaguagagcugugaaauaauugucacaguuacauuugugauuauauuuuuuuauguuuacaguuauguaaauuuuccaguuaguacuugagaauagugggaucuggagaauguaagacuaugagggaaugagccuugugaauugauaggauacuauuguuguuacuccuguaauuuauaaagggauuuggauguagacucacuguaggaggaucucucugaguuuaaggccaauccagucuacauaguuccaggacagcccaagcaguguggaaagaccuugucucauaauaccaaacacacacacacacacacacacacacacacacacacacacgcgcgcgcgcgcgcgcuccagguucagaaucucacucuaaauauaaggccauagcaaaaagggauaaaaaauauauucuuuaugcaugugcauaugcuagguaagaguucuaccacuaaaccacuuccccaacuucuuuuuuuuauuauuauuaaaguuuuauuuacuuaauuuauaugaguacacugucgcugucuucagacauaccaaagagggcaucagauuccauuacagauggcugugagccaccaugugguugcugggaauugagcucaggaccucuagaagagcagccagugcucuuaacuaagcugagccaucgcuccagcucccacacacacaaacacaccucuaaauucaguguaaaugucuuccuuuuuccucaggauucuguaauuugaggguguaggggagucaugacugaguacugagugguuaaaguugccuuagguguuuaggaucugcagugcagugcuaacguucuaucaagaacaauaaaagugagccacuuagaguuugguccucucgcacuggcaucauuugccaguguguuacuaauguggacacucgguguggguaacuuuguuguguauagccccaaccuuagccacauucaccaggggaaacagaguaaaugcuaaaacuguucuccguacggaacuuugucacucuacagacuuugcuagaagguggucugagcccugcugcaccucagguugcuccaggcuguuuucauccgcuguccuugcuucuccauaugugcacaugauggaaaagaauccuaguuacauugguuucugcgccucucuuugauuuugucacuugcuuuuguuuuucagucugcuccgucuggucauaaacaucugacaguagaagaguuauuuggaaccuccuugccaaaggaacaaccaacagcuaugggucuagagucagaggacacagacaagcugcugggagaugcaucacagaaagagcccagcucauuccucccauuucccuuugagcagucagggggagccccucagucugaaaaccuggguauccauucugccgcucaccacacaguucagccugaagucagcaccccagugcugaucacucccgccuccauugcacagucgggugacaaacaucccccaagcuacacacucccacugagcccuguccucagccccacucugccagcugaagcuccuaccacacaaguuccccacuuaccucggaauagcaccaugauacaagcaguaaagaccacacccaggcagaaaucuccacuccugaaccagccagucccugagcuaagccacagcagucugguugcuagccagagccccuucagagccccggugagccuagcaaacccagcuggcacagcccucccaagcguugaucugcuucagaaacucagguugaccccacagcaugaccaaauacaagcacagccgcuuggaaaaggaaccauggcgcccagcuuuucuucggcagcuggccaacuggccaccccugagagcuucauagagccuucuucuaagacagcagcagcaagagcagcagucucagccucccugagcaacauggugcuugcuccaacccuccagguaagacaggagcaggagggcauagagaaacaagacuacagaggccucagcuuuaagugacaugagacuuuguguguguguguguguguguguguguguguguguguguguguguguguguguguguguauuuugugcagcagccauacccaacuaaagaugaugugugugucugucuugucugucuaucugucugucuccauggucuauaacuaaauuugcucuguggggugagggggcccugucugucuaucuguggucuguaacugaucuuggcauguagacuuguacgcagguguauaugcaugcguggguuuccagguucuguaguaacucagauuugcuguguaaacagaccuggaggaauuugcauuggaaggugacuacauuguaguuaaggagugugaguuauauuucagaccuuaggaaggcauugaaagguucugaacgaagagugacuuguugguaaugucagaaacaggaaucuggccaccuguuccaggacaagcugucaaucacuuugccugagcaguaggggccuggguugagcacuguggacaaggagauuuuuaaaguauccggucagggaggcuucguggucgauugguagagaggguaaaggagagguuugcccuucaauagcaaguuuaccagggagaaaacgagcagagugugaugaucacauggccacagcuggaagggaguggggugugcugcucugugacugcugccugccugucaguauuugggucugacacaagaaggaaggaaugaugugcgcgcgggcagggccugugcuguguguaggugucacgggccaggagugcucucgcuccucuuccuuugcucugauggacugacugcaggaagaaacauaugaagggaguuuguuuggguuucugguugugagggaaaggguugccccaccucucaguugaucuggaagcucagguaaugaucugcaccugccuucuccauacucagcacuagaagacagugacgcuccugcaugcugcuuggcagaaaccacuuacauauguguaaauacucauuuacauggcaauagcuaauuuuaagaucuucuugccugauauaguggcaaaugccuuuagucucaguaggcaaucugugauuucaagucuagccuggucuacauagcaagcuccaggcuagccaggacuauccuuucucaaaacaaaaaaacccuggucugcauggaguugucuuguguuuacugggcagcauuaauucuuucccaaagaccaugagcauucacaccuauaaaaacauagugaagaaagcugaggcagaggggucucaaguuagagaccagccugaacaacccaggucucaaaaccaaacaacaaaaggaccuucucugucucuuacaguauacuuaggaugaaggcuguuuagugccacuaaccagacucagagaaccuuugaagagcuuggggcugcggacauaguagucgagccacuugccuguuuuaugcgagguccugaguucagcuuucagugcugcaggagcaaauucuuaaucauuuauauuguacacauucugcuuguguaugauagcugcuugagaggacugaggcaggaagagugcaaauucaaggaacccuuaaccucuauacagaaacaaaucccaggacugaggauagggcucacuaguagaguugacccugaguucagucgcugucacacuuuucuuagagucaccuggcagguucuguccacacaugcucucaagaaccuccacaggagcugcugcuguccgaggcucauucacugggagcauuaccaacaaguuccucucggcucugaaccauuccuugauauugcucugucacaugcaacuaacugaagcuugcucuaucucuuucucuguuuuccccauuaaacauuucagucuaugcagcaaaaccaggauccugaaguauuuucccagccuaagguguuacccagugccaucccgguaaggaugcccccaccccaaauuguguguaccuguguggaggccagagcuggaacugaguguccacuuuauauauuaaauagucagggucucugcuugagccaagccaacuuacagucucuaccccccugugccugggccaccauacccauccagauguccucacaagacaacauagugcagauguagcaggcacucaacccacuuagccauuucccuagcccagggggccccccacccccagagaucacauugaacacuuuuggguucuauuguuguaagauggguucuuacuaccucagugaaaagcuguaacauuccagcucuguccugucucagaugccccuucugggacagaguugcucugcuucucggcaaaauuccuugcuguggcuuaagaccuuauguuaacucuguauagaugucuucuugacuguauagagggugucaggcacugggugggccauguggaucauuuguaaguggguaggugcuggggccuguaucaaccuggucucucuaaguaagagguacuccuugaccuagaaagugaagagucccaggagacaggcacuguccugccacaaucccucacuucugauagcagagcuccugagccugcauacuucacuccuucuuucucaagcauccgccuuguuauccaccacuccccuucaugcaccaaccuugacagacacaguucuccauggcacuugcucaccugcuuaugagccuguaccccucuccuggauuuucagagguuagccuucugucugcuuuagguuagccuguccuguuguguggccaucaguagaaguaacuagcccaguuuuauaccaaaaagcaagcuaagagggcuggagggcuggcucuguggcugcugagcggcaccgaugcucuugcuuggggauccaacacccucuucuggcuucuauggguaccacacacacacaccaugggcauacaugcuaccaaaccacccauacacauaaaauaaaaucuuaagggaagggggcaggguaagcuaagugucucagauaacaaaagugacuauuauucugugucccggcagauugcaggcucuccauugguuccugcaaccaccacagcaguaucuucaguccugcugucccccaguguguuccagcaaacgguucccagggccgcagaccuagagaggaaagccagcucccccucuccccucacuguugggacagcagagagucagagaaagccuuccauuauccucagcaagucucagcuccaggacacacugauacaccuaauaaagguaugcagggugucagcuuugucuuuaacuuuguaucuuaacaaggcuuaguguauauuggugcaaguucagaaaccugccuuggcaguagccucuuuccccaggcauagccuccugguggaauaauggcuguaaaccuggacugucauuguaacugccucugggggcagguuacuuggggaauuaguucccccaaucaguucuguguuuuccuaagggguuagcauggggugaguucugaggaaguaacaggcaauguuuccuugccuucucuuccagaaugacuccagcuuccucaguacgcuucaugcaguuuacuugcagguucugaccaagaacaaagacaaccacaaccuaugacugcagugaaggcaaugugaagggagaggguccgccucaagacacgcaggcuuccucauggaacagcuaagcagagcauggagcuugaggagccugagagccuuguccguaaggauguuuccuagagacguucucagugaugauggagguuucacugugcagcaucaccagcaaaccuuuguuugacaaaacaacaagagaccauuguguugagugacguggguguuuucaucagcuacaagccaguggguggaaugaggagccugacugccggcuugcuuuccaggccucgggaggagccaccagccuugcagcagagcucaguggagcccacgcccucccuccucuacuccuagaagaacuuaaugucagcucacagaguagcuucagguuuuaaggaucagaauuuaaguugacucuuuggaagguauuuguucaagugaaguauauuuucuaugagcaccccgcuugggccuuaagacuucugggaugucuuuguguuccgguaagugucccugguccugcccugugcaaacuccggugaagcacagcucuugggauaggccggcugggcucugauggaggaggcuucacacccuugaagcagaggccggggccacacagauccagauccuaccagaaggcuccauuuuagugaacucucagcaguuuaagugucaaguuugugugugaagcgcagccuuacuuuccuuuucugucuaaacacaguucaaguuauuguugauuguuuuccuuaacacuuuggcaaaaggaccaguggaccauucugacaaagccauucugguuccauuccucaaaugugcugagcaguuuaaagcuaugcagaaagggagcugugcucacacugccugccuuccuuccuuccuuaguuguagacucuggagucagaaagcaagugugagaccuagcaccucacaguauauccuaggcugcgagcucucuggccgcagucagaacuguaaagaugcuuugugaugcugcuauugaucugccaugguuucuauuuaugcuuuuauggcauguaaugguguuugguaauauuuuaauguagaauuugauuauuucagcaauaguaauuuugagauauucuuugaaugaaaagugucuucguuucuaugauacaggucauuuucuaguauuuaaccaauuaaugcacugcuuacuuuucugagcacuauuuaaugauggguaagaacccaguuggcucaaccagcuagcguaaggauucgcugugaauaaugcugacagacgcagcggucccgccgggacaguugcuuaagcuuuaaugggaacucaaucaaaggcucaucgauucauucuuucuagcugaaguuuuagaaaauuacuuauuaauuacuucuuuuacuuuggucuuaguuuuuuagccuaaagaacauuuugauuggcuugugcugaucucaccaugcuuccuggacaauguuucugcuucuaaguugagugucuucucuugucuaccuaguuaugugugaagugugcagaauucagggaagcuuagacuuuuucauacuaaguuagggauaguuucaugauaguguguaaauauagcaaccaaaaauuaauuguucacgugucaucuaagcaagguaaacucauagugaggugaugaauguugcugacaguaggaggugguggucagggagccacagggcuguucucauaaagugaacgugccugucggcuugaucacccccaaguguggucucaguggacaucaguaaacagaugauugaaagcgucuucuccauagguaugaaucucacugaugcuuuugaguguguguaguguuaugugagggugaagaguggguacccuaaagagcgucugcagucagaccugacacuuucacacuuuaauccuaggaaugacugugauaagcaggagaaccuccgagaaggaaggcuuccucaguguagauacaaacuucugggugccgaagggauggagacuugaaguggguaaaccuguuucagcucugagauuuauaugcuccaagcauuuacuuaaaauucagaagccagaaguuccagaucaugacuucuaggaagcuaggccagaaugaguccccagauagcugggccaagccugaccauaggugcgguuggaugagucuggccugagagucagcgcuguugccuuauuccucauucaggcauauuguccagacccgcugcuagcuagccuagcuugcauguuuacagugucuucuggaaccuuagugugacugaaagagacguuggagauacuucuugcuaaguuggcagaauccagaagaccuuaucaggccauuugguccaucuguauacacaccccacccccucaccccaguggucaaagggucugggaagagcagcccagaguuugucaugcagcguugucugggugucaccgaugagugacacugcucuuuuuguuguaguuaacauuaugucuuugaaugggugaacaccccagcugaucccccagucccucucaggcugccuuguucccuguuguuaccucucuggggccccgcuugaucuacuugacuuugagugcuaaaucucaaguggccaucaguaucaggaaaggcauacccugcaggcuccguccggacuguccacagcuagcccuggacagugauguucauuccaaacccgucaaggccuuagcccaggcuuggcuuagauaccuaggaccagaguuugcauaugcaaacauugguuauaucuguggccuggaucuucuugugggaauuaauuauaaaugccauugaauccacuaguaaauaaucuuuguaaaccaugcagcuuuauugcucucuucccccaaagaaugucguuugaaauuuucucauuucaguaguagaggccguaacugccauuguaacacugauaaugcaacaugaaacucaaggugccuaccugcucauacagcggagucggccaucauacugcaacucagagggaagagaaggaagggcacgggcacaggaggacccugcgagucaggcacugaggggucacagccugcgucguccuguguccucguggcacaccuacugaggaccaugugucucuuccugccugacuuuguuguucuucaguaccagcauugcccgcccuguucaagaauccagaaugcuccggucugagcagagcaccuuacagugggcuuugaaggccacucacgaggagaguuuccaugaggaccagggccuccaggagccugugggguuuagguuugggguuguuuuguuguuuuuuuauuucaaguuucagcaggagagaugugcaauguuucaauaggauuccgauuugacuucacucuuucaaacgcugcaaugcaauacagaucacuuugaaguggggaaaaaugcaaaguuguguuucccuuuuaucugugaaucuuuaagacacguguuguugcuguacgugcugaguggucuuauucucuacugcuucggcguggggcucccaugacgucauugcaccgggcucucagcccuuccggggaggcaagaagccccgcgccaccucgagcgaagcuuuuguuccgugagcgcaguaccaccucauuaaccuuuuuagugguguggauuuuauaccaucuguguauguuugcaaauauuaaguuauuacauguuucaaaaugagcauuuuucauccuaaauuuuauauguuugcaaauauauuuuuuuaauaaaauuucaaaaccaaguuuuagcaccuacuaaaaau

SEQ ID NO: 7334 - RNA, 25596 nt, Mus musculus
caugggcggguccuaaggagucuuaacgcgcccgcccgcagcacccguccucggucacugcuggucgcuuccugagccgcugcuggcucugugucucuguccucagcguucucguccucguccucguccucguccuaccacgccauggaagguuaccauaagccagaucagcagaagcuccaggcccugaaggacacagccaaucgccugcgcaucagcuccauccaggccaccaccgcggcaggcucagggugagcgcgcgcuucuggcggggcugggagccgggucccgcggccucccuggcuccgugucgcguagcacgaugucgccacgagggcgcggucagauggcggagccuuccgcugcuccggagcggccggguucgaccgcgugggccucaggucucgcgagcaccuccagccggcccgggcuucccgguucucgcugcgcccgggcgcgccuccucgcucugcggcugcaacccggaggccaccaugacugcuggcgggagaaaccugagcacgugugggcuccagcucuccaccagcauguugguuccacugguuugcagauggggaaacugagauuccggcuuuauaucaguuguccaaagucacagugagagcuggaauuucagcccuugcaauguaggcagagaauguguguagagcccaccauuuugcaguagacugggggcccacccuucucugcaucucuaaccacgcuccccuccucgacacuucuugccucuccugcuaugugugggcuggggucccggugcugcugaagacuccagggugggggcagggaggugacgaugcaacaccaagagaggcuuagacccgagcaaggagguuggagugcgagucuggggagaagggagcuuguagaaagaaggggcgaggcccacgcgaaauaggaaguucugggcuaacgguguuugcacacugggugguuucaagaaauucuaaggucuccauugggccugguaugagaccuugagacagagagaucugggcuucuuggaaugguuugggguucuggggagggagauuuuaggaacccagacaaacugugagcuuagaacaaagaccaggauucuggauuuuggccaguuccauacagaacauauuauuaaaggagugcauuucucuugccuuuuaccguggguuccuccuuacuuagcccuugugcuuuuaagacgggauguccucagaagguuugaacugggaacccuuugccacccaacuucccaugcauacuuuggaccuguuaucugucuuggcuuuagauugcugccuaugauagagggugcucccugcccaauuaagagaccugacuuccuuuucucuggauuuccucagugucuggcagagacacuguccucucuaccuagcacagaguaggucuucacauccacaucguuuauuacuuguucuuuacuggccccuacaucucccuccaggucugaagucuaaucagagggucaaaguaguugacuggcugguaccuaugcagcugaacauucuacaaugcuggauacgcauguagaccuuuccaggaucagggagaaacuaaguggguauuccugggccacacagcguccugggguagcauucugauaaucaguuuauacaugaagacacugaaguguaguacguugauuuccccagacugguaaucaguggcuauuuaguacugccugcugggggccuggccuaucagaaaguccucuugggcacaugggcggcaucaggcuggaggagcagggaaagccaaguucaguugaagagaaacuaaguaacauuuauggcucuuaggaacuuccaaagcagggguggucuccaggggaaaagguugaagguggcuacagaguuacacuguuuacauuguagccuuaggcagucauugaacucugaaagaauccguguacaaauggaagugguggguaucccaugcaaaggcuaaguguacggguugccaguucgguauauauauuucccuugcagaaaaauacuacuuggagaaaucuuguuuuucagaagggaguagcauuguuccucaaccccugucacaagaaugauuuugaaaugugugugcaaagagugugugcguguacagaaaguguuuggggaagacuugagaugugaauguauuuuggcugugaauguuucuuuggaugcucacuacagugagaguucauaacgugaaagcaggcucaguucugaaguucugacccagucaguugcagacagcugaacuggccaccuaaccagucuguuccaucuuuuugaacaauuuugggugaugguuucaggauggcaagaaguccugaaugaacagacuucccguagugccucaucagcacuguagacaauagacuuacuucaccaggccacaaaaaugaguccacuggcuucuguguggggagcuggguggacagugcguccacgggucagacuuucccgggucuuuuucugcauacagaggcggcuguggcagagguccaacucauccaagcuuuaucaaagaaacuccaauggcguugucagaaguggccagguugcuguggcugcuaaguguucucagcccucacuugcagggcuagguuguguuagccagauggaggccagugccaccugaggaugcaucagaguugggccugacuuaaaggggaaguagucugagcuuucagcuagucccuuagacuuugaggagagugaguaccugggaggauaggguagacccagcccuggcuugugagcacaggagacagaucuaaccuaaccugucucuguucugaacagcagauguauuugucaggaaguuucuuagaacuuccauuucuccaucuuuaagugaugggauauuacaaaagugguuagccuuuuuuuuuuuucauuauuaauuauuacaagauacaugaggcugucuaacuuuacagaaaaaaaagguuuuuguuguuguuucuugggguuuuuuuuggggggguugguuuuuuauuucuggaggcaugguuucuguguguaacagaaaccaggcuguaaaaaaaaaaaaaaaaaaaaaaagaaaccaggcugucccugaacuuuguagaccagggugaucuugagcucacagagaaagaucugccugccuuugucucccaagugcugggauuaaaggcaugugccaccgccccaucccccaaagaaacggguuuuauuuuauuuguuuauuuugguuggauuuuguuguuuguuuuuagauuguguguaugaguguuuuuccuacauguauguauguguacauguacaugccugguaccugugaaaguuagaagaggacauugaauccccuggagcuggaauucuggaugguugugagccaucaugugggugcuaggaauaggacuuaggucccugacaagagcaaaaaguaauuuuaaucccacaagucuacucuccagcccaaagacaagguuguuaaauuggauuuuaauccuuguuuguuuguuuguuuguuuguuuuggguuuguuauuguuuaaacauguuguuuuuagauggaggaaguucaaacagcauguguaggugaggcuucuggugggaauaugugagaggaaaaaacacagccaaagagggagauggagaccaaggaggggcaggucccacaaaccacaguaccuccagaaagcauagcccaaguucagcuaagggccuuccaggguuccacacuaccucuaugcucaggaccaaacuuccaaugggaaacacauaaauagcauccaaacugucgcuuuuuuuuuucuuucuuucuuuuuuuuuuuuuuuuuuuuuuuuugguuuuucgagacaggguuuuucuguguagcccuggcuguccuggaacucacucuguagaccaggcuggccucagaaauccgccagccucugccucccgagugcugggauuauaaaggcgugagccaccacgcccggcaaaaccgucgauuucaaaucaggucccuuaggggugaagcugaggguucagaguaaguaggcccugggucccaagcccugcugugaaagugguuaguucccuguuccccagcucuggcauucaggaacauucugaccaacugugcagagggcccucucaggacucuagccccuguguggaaucagcuucuucaagcagaagaggccuccaagggcuagcuccuuucaggcugccucaggccuucugacugaggcaagagcaaaaccuugcgguugagauugccccaauagcagcaacaguguuucucaacucagggugaagacaccuggcagcucuuggacuacugggcucuuugccuggguaaccucugagccagcagagugcuaacgaccauauuccuuaaagcuaggagcuagcggugggcacuacguuagggucugcuggagaugaccucauggcuuccccugaacucaaacuggcucuuagacuuggcccagcgucuccagagccuaguccuacagaauuaaaagcagggacaccccaaaggccagggaccugaacagagcugguuagggugcccuuagaccuaguggugagguagagcagagaucacgcugggaccucuugcuccgcauccguggacggugaagagcaugaccacuaaaggugguacaacuugucuaggagcacaaacuccugagaacuuccuucacugggcuuucugaacacuguucuccuucuacaaacagaucuguaacagcucuguggaggggggcuuugcagaaugaaagguuuuaaauguacacuucuguuuucgugguacuagagaauggacccagagccaagcaaguaccuaccacugaauuauauucucagcuaauuuuuguuuuuguuuuuuuuuuaaucuaaagucaucaaaguuaguggcuuuaucacaucuaacuuuaggacauuuuuccagccucugaaaggucucucuugcccaacugcaguuuccgucucaucccauacugggucugauuuccugucucuauaaauuuaauucaucuggauacuuuaucauaaugcaacuggacagaaugaggucuuuuggggcuggcuccuugcacgugauauaagaugucgauguguucaugugguggcaugauucuucuuucauuucuuucuauagcucacuaucauaacuaucauaucacuuguaugucgcacguucauucaccagucucucuuaccauccugcuuuguccuagcucugcugauggccgggacaggucgccuggcuucugagaacccagacagucccagccccaaauguaaaauccauuagacuugaucugugaugacaucagugcaacuauuaacuuagcugguucagaggagggaaagcagggugaagauccagagaaauggccugggguccaggguuagguucguucugggcaagaaucagcucagugucugagggacuucuaucugacacccugaauuuauucaggaacaaggucuuaucuuauaaaccuggccggccuggaacacacuauagagagcaagauguccuuggauucaugggaaaaccucuugccucugccucaaaagugcuaagauuacaaguguguaccaccacacccaauuuaccaaauauaaaguugggagggagaugggugcauuaaaaaaaaagcuguaugcaaguguggggaccugagguuggaucuccaaugcacaccuguagucccagcucuguuagagcaaccccggagcucacuggccacccugucuagccaguuagugacugcagguucaaugaaagauugucucacaaaauaagauggggagucgauagagaaggaggcgacuucuuugucaccuuaucuuuccuuaucuccugcuaucccacaaaacacccugaaugcgccuuuauucugucuucuuuauauaaugugcauaaauuacauguguauauauuuacaaacaauaccuucucuguauugucucugguguacaguuuucaugcuguguuagugaggugacguugauguugggucaugaauugcuacugcuauggugccccguuguauuucauucaucuauucuauugaugcaugcaaggcuugguuccagauuauuccuugcugugggaacauguagaguacauuuggagcauaugauugcacuccuguguauauaccuguacauuggcuugcugggucuuggggacuaggccucuccaacauguucauucuauacagccaagugccucagguuuucuccuuuuuuuuguuuuuuuguuuuuuuguuuuuuguuuuuguuuucuccuugaacaaguuuggguaaauuauauuuccccagaacguuuucuguuuucaaaucuauuuacauccaguagaucagaauauuuaccauauacuuggaccuuaaguucuacuuaaaacaacaacaaugcuucguggugguggcauuguuguuguuuuaaucccagcauucaggaggcagagacaggcagaucucugaguucaaggccagccuggucuacagaaugaauuucacagccagguuuauacagagaaacccugucuuaaaaucuagaagacagacagacagacaaaaguuggcuagcuugucagucucccaacugcuucauuccccguaugcacuagccuuugggcuagacgaguaguguguuauuagaggguuugccuugcucagcagccuuggcuccaauccucagcaccgcuccugcaaauaauaacuuagaaaggacuagcucuuagcucucauucuuucuauuaaauauucgcuuacuguuucaugaauuucuggggauucuauuucuuagguuauguguauggauguuguacaugcagugaugauagaagucagaagagggcauuggauccccuggugcuggaguugaagauugucaaccuccauugugggugcugggaauugaaccuggguccuucggaagagucgucagugcucuuaaccucugagccaucuguagcucuuguuuuauuuugaaucuuuuuucugggcuagaguguuagcucauaccuuaugagcauuaggaccugagagcccucagaacgcauaugaagaagcuggguaugguauccgcucauaauuccauacgcaugaggcaggggugggggcuucaugggguucagcaauuugacugguaagucccaggccaaggagauugucucagaaaucaacuaaggugcacagugccugaggaaagaccaccaaugcuaccugcaugcauguauguaccccuguacacguugucacacagaucuuuuuuucugcucuuuaaacucaguccacuugauccagauaguaaauggcuccuugggccaaggcagcauuuuuuaacgagcagccaagucuauuugaaacuucuguguagcacaaagagccaggugguaggguagauacccccaccucugcucagccaaugucuucaggugaacuacagauagcaccugcaggcaucggcucagguggccaggacugcaaggaggguucaguccuugaagccacaggucccuggguuucagaguggccgugucugucucccuggugcucagcacuuuacagcuuccagcaccuucucucaaucuuugguucauucucuucucuugcauggagugacucaggugaaccaggguccuggccuauagaugagucauugaaggcccuaaaagguuuggcaguggccaaucaacauuugcauuagcuuucacuggguuacccaagcaucucuucauagcauccccuucauaaacaaagacagccccggggagaugagugagucauaccucccauguauguggcagccugugcccaccccccccccccauucagaaggcacauaggguguacuuaguggauaugaagacuacaucugcagcuggccagauguguuacagguugccucuuuggggccuaguuaggagagcuuaaaucaaugguuuguucuauuuaucaaucaacaagaucucucccuccauguguccucuucgugagccuaggcauuccucugccacaaacaucacugugccauauaguuucucugagaguccuuaguuguggccaugcaagugucaccccgcggucaguaggcagaguccccacuccuauuuugcugggcacuuccuuccccacugaagcuuccucacaacagccgagacauuucgaaucucccccucccccucagauuuuuauugcauucacuuuuuuuuuaagauuuauuuuauuuucaguugugugucuguguguggguauaugcauacauguguagguacccaugggggccagagggugucagaaccccuggagcuggguuaaggguacugggagcggaccuuggaacuuguggaagagggguaugagcucuuaaccgcugagucaucuuggggaugaggcuggacucaggugggaaggguacuugguuugggguguucugcaacugagguuggugcugggagcuggggacuagggucccgugagacaggcaagacuuucucguucacuuguccucaccucccucuuuucagguguagugucuuucccccaugaccaggaguucucauagagaugguuaaguaugaggcuacuguguguugggaacuaaaccagcauggaccauucuggaccccuuuacuaacucgucuaugcugagagcgauuuacuccuaaccugauggggagccccagaggggaggaggccgcugcugugaccccccacccaaggcugcaugugcccuugggcuucguguuggcauguuuuagugugaagcgucuggaacaacgacagcagggccgagcugagcugcaugugggagaggcugaccuucauagagaauggcuaggcugacucuggccccauucccaggguaggggccagguuaaucaagcgauccugugagaccuaaacuaaucuggucucuaggauauaauccuugugcuuucuaaaaccauucagcuaucaaaacgagacucuaaaauagagacccuaccacuccagaacuggaagggcaaguucuugccagccccaccucuggcaggcagaagggauuuuaccuucaggauaggagcuuguguguugcaugguucugagugcuagcuuucagaguggccauucaaaacacaaccagaaaacuaauguccgauguuuuggguuuacaaaccaaccuucccuuaucccucugccuauaccgccagggcacccuggggugggcagaaugcuccucauaagcaggugagcucugggcagucucuuuggggugggccuccuuggucaguuguauuaucccuccccaguccuuagauucccucuaggaacuccuagguagagaguaagcucuacccucauacuggguacucucugaaaggcauggcagucccugggacccauuagcaacaccagauccuaagccaucaacaguggccuccuuuaaacccauaccguguuucuaaggagugggagcauguggcucucucugaugggccaggccuuugugagucuccucagaacaggcauccucaggccccugacacaugccagaauggauguuguaggucagggucuggggccacagugcucaugucugucuucucuccuuggccacagccaccccacaucaugcugcagcgcugccgagaucauggcuguccuguuuuuccauaccaugcguuacaaggcccuggauccccgaaacccucacaaugaucgauuugugcucucuaagguaagagcccugccgccugccacaccuaccugggguugggccggguaaggacccuggaauucagugugagcccuagcccaccugcugguccuacaucuccuuuaugucuugugccggucugguaaugaaccggagcuaaggaaccaauuccacucuucggguagccugguacaucagaaagacucuucaaagcaggguacagggcagcagcggaaccugugcuucugcugggugugugcucaguuuugauaccggcaggcagcacucaaauccaggucagaaggucuggauuccuucuuaucuucugccugaauccuguugugcuagcauccuggggaccaaggcuugcucuccuuaugagugacacuccacugcaguuugggaguacagauacccugccuuuccucuucuaguaaaaaucacagccacagaccauaccacaauugcccccaaauccaccuguccucuggccuggcucgacagccucucgcuucccagggcaggcuguagggcuuaaaacuccguccaaguauguuccaugccagaaacgaggauuaggguggcugcugccugcuggagugcuggacucccgcggcugcacagcugugacccugcaccugucugacauggcgucuacccacuuuugacugugggaacuuugggcuggaaaccaagaaucuggagaggaaugaaaggggagaagccuucucuucucuggcuuccucaucugaaauggauauccugguuggccugcucggccagaccccaagcuccacgcguggugggaaugaucccagcagcucugcccaugcgcuguaggaaugaacccagcggcccugcccaugcgcuguaggaaugaucccagcggcucugcccgugaccgccuccuugugcauccuccccacccccacagggccaugcagcucccauuuuauaugcagucugggcugaagcuggcuuccuacccgaggccgagcugcugaaccugaggaagaucagcucugacuuggacgggcauccugucccgguaaguccccugacgggcagccuccuggaccccggccucaucuuccuguccuaggcgcaagggagaggaaugaggcaggggagccaacuaugaugaggagggaaagugagggaugggagcacguugugugcuccccagcacggggcaaguucuuguacugaccaaggaugaaccccgagcuucccuuaccccccccuccccccacgagccccugagccaugaguagguacuaucacucaagaagagaggucccuagagagacuuaaagaggugguaccguggguacagaggcaccuaggcaaugaagccguuuguaccaaauugcucccagcacgugcuggcacaucgcuggcacacugcgaugucgguguucacuaaggccggaugcucucuaucaucuauuauauuuucucuaucgcugaccucuagcuucuguaugugguaagcugugcuuauacacaaggccauuaaaguucagagagguuuaguuuccagccugacgucacauaguucacuaggggacaggguuuggaacugaacccacucccauagugguuuugcugucugaauaagaagggccuucuucugcggagagggaugcacucacuggcucugggugcggaugcugcccugacugacauggugggggaggggaauguaaguuggaaacaaacagcucuuuacuggacccuugaauaacuccggaucucucuugugacagaaacaagccuucaccgauguggccacuggcucccugggccagggccugggagcugcuugcgggauggcauacacaggcaaauacuuugacaaagccagguaacccccgcucccuacuugguaacguugagaggggggccucaguggcucaggcugagccggcccacauugcccccuggcugcucuucuugccugacuggggcuaaguaagauaaauacguuccgucuucugcucucaaagccccgaagcuggugauacaggcagcaccuuuucagaugagagacuuacaggacagagggagccaccccagagucuggcuuccaggccagguuugcucugaguacaugagcuaccacacagacucaguccagugccuggacccuggcaguagcagaggagccugccucccacccccaugucugacuggcaccaagaagcuuggccuggacuccuugcccuugcauuugaagaggaucaaauuguguuccagaggucuccgggguccuugggucaccucccauuggcggguaaagagacugcaguguguggguacagccugguagguagguuuagcuauuccagcuaaaccugguggcgguuuguagaacucccagugcccucaggacagauuucagccaugugaucugccguggacagguugugucucggaagcacaguguacaggcugcuaggcguagccacuggucagaacaguaccuccgggccaccaugugggagcgaggcugagugcuaauuuucagcucgauaauuuucaucccugugaaugggagaggcgugaggaugaaguaacuagggagaauucucaccuagauccuccggucuugcucggaguguccagaaggcacacccauaguccccagguacccugugggcaaagagcuuccgaggaaaacuggaggggacuggcccauagccagggacaucccacuucccugaaggccaacgccacagaagaguggccacagccaggucccucugaggacaggcagcugcacgaagcuugacugcucucccuacacacuggagaguaccuacuguucgcaggaaguucuuugcggggacagggggggcuucaaaguuagucucugggagagccccaauccuuccaguacccagccuccaguccagggucacugggaugacagcuauugagcuuuagggcuggcguagccgcacccagaagugauucacucugaggugaugugucucagagaaugaggugcauguuuaagaacauuuuaucuggccuagaaccauagaugugaguuaauuauucccuacaguugcuugaaauaauuccccgugaaggaucauuuucugaccucaacauaauagaacaagccaguguagagagaagggcuuuaguucccagaggcuguguuggcguagagccaggcuuggcugagaccugggcccucagacaguacccagagggugggggggacucagaucgcuuagggcaccaagagauuaucaggcccagccaggcacccagcgguagcaccccgauagagcugcgugggcuacugccgugguaucccuguaaggucuuuuaaaaguuuuguuuuuaagaucauuuauucaucaaugauaauuuuuuuaaaaaaauuucucaguguuuucaaauuccuaguauguuacucuuugaaauucaaggacaauaaaacauuguuccaggguuuucaaaacuacaauacuuuacacacacgucuaauagucuuugugaccuaucauuugcauagcuaaaauucuuauuuacaaggauaaaauacucuaaguuuaguagcacuuccaaaaagaccugcauccuagagagcuguucaaugaaaaacauaauuuaaaauucagaucucccagaagacaacagccccucauggaaugacauguugauauugccaguucagcacugagcagucaugagagagagagagagagagagagagggagagagagagagagagagagagagagcaugcauauaccuuagcucuucauuuuauuauuuaucuauauuuugcuaaguugcuguggcuaaccuugaauuucugaucauccugcuucaguuucuuuucuuaaccccuugcccuaauuuaaaucuaauaauauauuucuugcccucaaagucuucauaaaaaggcuuacaaauuuguaauccuaauauaaguucacaucuugcuuuuuuuuuuuuuuuuuuuuuuuuuuaaagauuuauuuauuuauuauauguaaguacacuguagcugucuucagauacaccagaagagggagucagaucucguuauggaugguugugagccaccaugugguugcugggauuugaacucuggaccuucggaagagcagucgggugcucuaacccacugagccaucucaccagcccauuuuuuuuuauuuuuuuugauuuuucgagacaggguuucucuguauagcccuggcuguccuggaacucacuuuguagaccaggcuggccucgaacucagagauccaccugccucugccucccgagugcugggauuaaaggcgugcgccaccacgcccggcucucacaucuugcuuuuuaacacagucucccuccccuccccggccccauuugcgcauagcauccauggcgagguguggaagccagagguuuacuggagaauaauaaggcaucaggugccauuaccugcugagcccuaaaacaucuaaacagucuuucaugggcauuuucucaguguuuaaugagcaaaggaaguuuuuuguuuuuuguuuuuuguuuuccuuugguuuuucgagacaggguuucucuguauagcccuggcuguccuggaauucacuuuguagaccaggcugcccucgaacucagaaaucuggcugccucugccucccgagugcugggauuacaggcgugcgccaccaugcccagugagccagggcuguuuuaguggcuguauaauguccuguagacauacuauauuucguuuagccgugccuucuaugcgaagugguuuccagauagcucuacugugugaacacuggcuuuaucuuuauccgagcucaugaauucaucuuugcagcuccugacccuuauuuauuuuuuaguuucuccucuaaucuaguagagcuuuuauuucugcuaucuaaagaguagaguagauggaauuuaucacaauuaacauuaagccugccugcugccuuuaaucccuccauucaggcugcagagcagagucaaggcuacauagugagacucugucuucacaacaaaaaaaggaaucacacacauuaggcaggcaccucaaccugaaacuguuguugguuuuggacuggccuaaguuuuuaagcacaucuuauaucuuugauuuuuugggggagggggcgcagggaagcuaaggccuugauuauaguaagcuagcaacucuucuacugacuuguuccccaagccccaacaucuuugaauuuuuugaacccugagcaagucuaguauuaagaauucugucauuggcuggguaucucuagagagcgauacugauaccuguauucaaauggacaggacaggcaucuccagcuaggguuucucuagacccccacaucuauucagacuagcaucucaggaccuuagggucccccccucacguuagucuucugacccucuggggccagccuugucccuaaucuugacauacaagacuaugcuguaaccccgcuuggugccugucugacuuuccggauauguguugagcaugugacacaaccauucauauauccccccccccccaagaagcucuuuguggaggucaggaucccuacauggcugccucuuuggcuucuaucauggggagcugcugugucaggccagagcucccuugggguuuuggggccccugguaaccugcagggagagaaaaggcaacuugggaaaaccaaguuauagucccuccuagccaggguaaccagugaucccaucuaacaaacaccuuacaagagaagccccaagcaggaagcaugaagggaguucuggcugcggaagugcugagucaugcugacagcucugacugccuggcccugggccugcagucacuuugagggccuuucucaggaacagcuagggaguaucuauguccucugugagccuggccagccggagccacaugguuggacaccaggcaagauguagggguaccccacccccauccuaucaccccuccugcauguauuuuaauauagcaaggagaugccaguccaggaugcaguaaccuucagacaaguccuuugacuguggaauguuuucuuggucucuggauuuggagaauucaucucaagaaugucacugaguucagggcccugcaccagcuauggcgcugcuaccucaccuccagacccucaccucuucugggacucucagaaccaguccccuggcucuagccccacccuuccaugacaaaacuuguguucucugagugccguguccugauuucaugcucguaccucgccgcuaugcuuugagaagaccacacuugccuguauugagaggaagccccacgggagaaaggccuaggacaaaguccugggcuucaaaggagccugccucugagacaccuaguuccuaugccaagcaauugugccuguucuuccccuagguggacugagccuggcucccaaguuccccuccugcuagaggacuugccucucaaguccuuccgaccaugucuccuuaguuuccucuuguccccgucaucucuugugggccagccauuaggauccuagugauacugaugacccuuccagaucccuguugcccgcucuccauaggcugccugauagguuuucugggaagggugguauugagagcuucacacucccaggggagagggaccagcccuacaaccugccuuuuguucacagcuaccgagucuauugcaugcugggagacggggaggucuccgagggcuccgucugggaggccauggccuuugcuggaauuuacaagcuggacaaccucguugccauuuuugacaucaaccgccugggccagagcgacccagccccgcugcagcaccagguggacaucuaccagaagcgcugugaggccuuuggguacguacggauggccugagaggggcuccuuuaaagcaagggcucuuuuacaugguuguacagccuaccaccuagacacaguuguauacaggcuccguaaguugaccgugaggaugggacaggaaacccauguguuuggggacccaagccagccuggggguuagggacaggcuuccuccccuagagaccugaugucagggcuuuccuaccugagauuucauugcagugaauuccaaaccaagugcugcaaagcagggaagcaugcgccagccugaaggcuccucaccucagcauggcuccucagccccaaagacgagauacucuggauggagcugguggcucugaggggccacacugccugagggggauuuaaaggacaggguuugaggacuugggugagcaucauggcugcccuuuguaaugaaucuuguugugacuguugggggguacagccaucaagguaucuugaccuuacgaagggaagagguggggguuaggaauauucuuucgguuguguagauaaggaaaugacuacaacaagccugcagggucuuuucaagaucauauguggcuggaaacuugaguauaauccucuagggccuauguaaacuugacccaugaccuuggacaaauuauaguuucuguguguguuucugaggaugggacuggggccucauguguuuggcaagugcuacuaccacugagcuacauacauacaaucuucauuaauaugcccaaaggugauggcgagggccuagcucaaugguaaaguucuuuccuagcauguccaaguccuuggcuucgcuccccagcuaggugcacagaguugucccaguuccuugacaugugguggauaacgugauugaguguagaagaguuggcagcaucugcggaggucagguguguccuccaaauaaacacugagccaagcguuuugugaaucuaauaacaaguggcuuccaaacucagugcauugccugcaauauggcuuaggaggaaaugaguggaucaggagaaaaaaggcagcgcauaagcuaagcuuuggguuguuuggaaagagggaaauuaaaacucagcaaaggaagcagaguguagauuggaaacaguagugacuuagacuuagcagcuggaguuuggcagugaaaugguaugcaugugguaugguauggagcucccagaugccgggccacaucuuuccugggggcuuuccaggguucucuggcaccuggcugccccuuacccugugcugccucuguccccagcuggcacaccaucaucguggacggacacagcguggaggagcugugcaaggccuuuggucaggccaagcaccaaccaacagccaucauugccaagaccuucaagggccgagggaucacaggucuguaugugagcuuccccagccccacagccaccacccuugagcuggaaaaaugccugcucuuggcugcuccuuaaagugacaggucucaacugagccaaauggacggacagaaguuuccugaaggaaaaaccccuguacccuaccuuaguguagggugucacuuaauggacugucccugccugcucuggccaucugcccugggcugcaguauagcauagcacuguacagcccaggagcuccuggaaagaccugaauucucaccaaggaggcagugcaauggaguagcguguggcagaggccuucgacagucccuagaugaggguuuccugcuugggggugaagcaggcauagucccuaugcaacaccaggggugaaugccggaucccaaggccuccucauuuaacccuugccuacuuuaaagauggaaaaaucagaguauacaugaucagagacagugagaacucucaccuaguucaaauaguuauuuaaaaaaaaaaaaagacagaagauaggaccaggaauaugugguauauuuuugucugugucccaauacuuuggugguggaacagaagagaguuuuaggcuaaccugggcuaugugagacugugucucauaaaggaaaaacgagcugguacaaugauguggugggucagggugucugcuucuaagccugacaguuuugaguuagucccugcaacccgugcagguuuggagguagcucagcagccuggaaggguuggucuguucuuggaucuacuugggcagcaguggcauuaaguguccucagauagauaagccucacugguccucgcaugguaaagcucugagaggacccgacucugcucacaaaugugucagauaaacuuggcaguacuuucucucucccugugucuucugacaaggauguggagccuggggucagggccugcagggacaguggcaaaggggacccacaucugccuccacaugguuccuccucuuccuguuuaucugagccguuucccugagugguggccagaaguccuuugcugugacaccacuguugcccugauuuuccucugugggcauucuuaccugaccuccugucuccuguccuacagggauugaagacaaggaggcguggcacgggaagccccuccccaaaaacauggccgagcagauuauccaggagauuuacagccagguucagagcaaaaagaagauccuggccacgcccccucaggaggaugccccauccguggacauugcuaacauccgaaugccuacgccacccagcuacaaagugggggacaagguaccuggauggcucuuuugugaauggacuggaaccggggugggccuacuugcuuccuuggcuucccacggucuucgccaagaugugccuucugggggcugugaggaugaguguggccuaagagcucgggcuccuugucugcucccugaugggggaguuaugaagccuguagaggcucagagaggccaggggacuuaccuaaggcugcacaguaagcuucuaguugaaaugauuguagagaucaggacuuuuucauagucuggcaaaagcuaggcaaagcugucuugaucgagguuuuucauugcauaaacccauccaugcagccuacagcugagccuucuggcucuugggcccuugugcuccugugugugugcaguuccuggccucguuuucuguuucucucuuuguguuguuguuuuucaguucccugacgccuuaaguucagcaugcucuugccuucgccucccuagugcuagaguuacaagcgugcacuacuccuggguucccauuuuucucauccuucggaagcuucaaaaccccauagagucagacaagacucuagaccccauccucgcacaugccucagugguccucagagccuuugcuccugcccacagauagccacccggaaggccuauggacuggcccucgcuaagcugggccacgccagugaccguaucauugcccuggauggagacaccaagaauuccaccuucucggagcucuucaaaaaggagcacccagaccgguucauugagugcuacauugccgagcaaaacauggugggugccuggguagggugaaggacacacagccacagcugcagggcuauccugacagguagcagcaggcggaagcccucuuucucccucgggcagccguauugacagugcugagugacagccgugggucagcugaaagaaaaccacagaguaacuagaacccacauugaccuuugaccuuggguagccaauuuuggggaugauuauucccaagggaggagcuuguauauaggacagauaauggagguaaaggggaccugcuggucuauagagccuuuaaaaaaagggaggaggaggcuccuauguagcccaggacacccuagauuucaguauguagcuaaggcuaguuugaauucccgauccuccuaugccccaaguugcugggauuauagauugcaaccauccuggugucaaaggaaacuuguugauuuuuggucuuuuuuuuuuuuuuuuuuuuuuuuuuuguuugguuuuuccgagacaggguuucucuguauagcccuggcuguccuggaacucacuuuguagaccaggcuggccucgaacucagaaauccgcgccugccucugccuccagagugcugggauuaaaggcgugcgccaccaugcccaggaaacugaguuuaagaguuuugaaauaaucauuucaagucaaaggaguuuggggcugggaaacagaugacagagccacggguacccaggcaacucucgaggguuagcauacuaggaucgcagccucuucugccucccacauguggccucgggaggguucugggcucccuguucuucagggcuaaucuggcccuccugcccucaggugagcauugccgugggcugugccacacgugaccggacagugcccuucugcaguacuuucgcggccuucuucacacgggccuucgaccagauucgcauggccgccaucucugagagcaacaucaaccucuguggcucccacugugguguguccauuggugaguucagaccuguugcuaagcaccagugcgugugggagggcacgcuggaagcuggagccaaucaucagccucuuuucaauacuccaggggaagacgggcccucucagauggcccucgaagaccuggccauguuccggucaguccccauguccaccgucuuuuacccaagcgauggaguugcaacagagaaggcaguggaguuagcagccaacacaaagguuagucguguggcuguucuuuuggaagcuagcucuuccacagaggcagaagaggaggccagcgcaagguagagcuggucacuugcugccuagggaggcauuuccuggccaugucccucguguguguauaccuuaaagaaacaagacugagaaaaucaaagcauaccauucgucaugcaucauggcagacacugccagcugaugggcacucugccagcuugaccacugguguuugccuuccuuggguugaaggacaguaacccgagucucugguccaggacaauaacugacuugccucagacuggcauacagaguuucccgugucccacccgagagccggggccagccuuaccgaggcauucuggggaguagccccacugagaagccaagccaguuuaccuuuuagaaguugcuuccagucugagauuagccaggcugugggugcuucuucuccuguguucagagguaccagcuacagggaaccagccccaucucuuugccauagcgccaggacacaaugacugugcccagguuauaauugacugacuaaaugaggcuuguaucuaggaaggguggcccucuagaagaccaagcugucguguuucucaguuuaucuguuccaaucccagggcauuugcuucauccggaccagccgcccagagaaugccauuauuuauagcaacaaugaggauuuccaggucggccaagccaaggucagugcccuucguguaugagaacccgagggagccacccacccugcugcugcuucuacucucagacccugcucuggccccucacuguccccaugucacccgcaggugguccugaagagcaaggaugaccaagugacagugaucggggcugguguaacucugcaugaggccuuggcugcugcagagagucuaaagaaagguaagaagaaagggaccagggaggucacaggcuggucacacagaaucucuaguuaagucaugaugacaauaacugaagccacccuuugagccauuacgccauguccaugcuauguucuaggacuggugacuauccucaccuaugaucccuuuguaucagaucggaggccauggagccugccaggaaaacugaagucacagcucagccggucacuaguuaaaugacuuauucaccgucuuugugucuccgauuccccacguguaaacuggcacuuagccuuuaugacugucccaaggccuuaggugugccuuggcauucauacuguuauuauuacuauaaguauaauguuguuagcuagugauaccguagggacagagcgucagccucguccucucagugagaucgccagacacgucacaucucaagcuugugagcaccaggaagcaaaagguggucccuugguugggugaccugaguggccugugcaaugugggggugaacaggacugaggcuguagcaagcugggccugagaggucaagaaagcuccacccagacagggugucuaggcagcuggguguggugagguggcuuuuauucugagaaagucacucuggcuacagcucuucuccccacuaucccaaaaaccuuuauguuagaucagauaucugaagucuuccuuuuaucuucaaaggcauaggaggauaagagccccauagucugcucuaacagucgguccacagggcacccagcugaccacuaucucucccaaacaggagagaauagggagaagagcuauucucaauggugagaguaaguggacagacagcuagccaccaaagaguaguucuucuuaggcccaagacgccccauucgggauaaggggccauuggaguucuguucuaacacaggggaagcucagugccagccuuucucuuagccgcacucuggucuucccuugcagauaagaucagcauccgggugcuggaucccuucacuaucaagccccuggacaggaaacucauccuagacucugcccgagcaaccaaaggcaggauccucaccguggaggaccacuacuacgaagguaacuggggcugcaccagccuggcgagggaaggccagagagagcaguaggggaggcaagagguagacaccacuuuaaguuccucugaggacaguccgccuuugccacucacggccuggcaggggcucggggaguagagccagccggcaaauggguuagcuggaucccuauaccaaagccuaaagccucagaagaggccaggucucagcuauacugaugaaggcucuggguuuucuggccacagcugaacuccugggccucguaucaaggagguaagauggcuggacaggaacaaacaggaaagacaguaccgagugucuucuugaguccucuauaagugcaugccuguucuuacaggagccucugaggagagacgagcugagacucuaaggucaaaugcacaacuugugggagucaagcugacccccagcuguaccauaugugugcacacacauacuagauaaagaaguguuuaaaguauuaacucaaggagcagggaagacccggcagucacauagccuucgaaagcaucuauagguccccaguguccucuccuggccucugagggcguggagcaagcauguggcucacagacaugcaggaaaaacacucgguacacguuuaaaaacaauuuuuuuuuaauuacauaaagcuaaauguugaggcuaaaucccaggacucagaaggugaagacaggugaaucucugaauucaagaccaccuugagcuacauagggaguucuaggccagucaaagcuacaaacaaauagauguagggcucugaugguagaguccuugccuugugugcaugaagcccuagguucaauccccagcacuguguaaaaucaggcaaguggcaaagaaaaagugacaaaaagaaagugcacaucuggacuuagaauaaaucaugggaacccugguggauuagugaugucugcuccggcaagggcugugucuuugucaucucuggcucaggacuaagaccucucugacuuuccucugcacagguggcauaggagaggcagugucugcugccguagugggugaaccuggagugacggucacucgccuggcugucagccaaguaccacgaaguggcaagccagcugagcuacugaagauguucgguauugacaaggacgccauugugcaagcugugaaaggccuugucaccaagggcuagggagggcaugggaugcugggugggugaacuacacauuccagggagguucuggcagagguggcgaagguguacugaguggggagguaaauauauguuuugagaaaaaaauuaauccucagacucuuuuuuuuuuccugugauauaaacauauccagugccaguaugagaaggagacuggggagagagggagagagcuggcucucuaggcuuggggucaggaucuagguguccccuggaucuagguguccccuggaauccccuucuccaguucagccucugcaaagccacaacugcucccaccaagucauaacuggggacacucauugcagccugccuuuuagccaaacuaggauccagccccuuccuuugccaguguacccuaaaugacaccauggaguucccuccugccuuauaaaaccuuccugggcccuccauagcugcaccauggcccccaaggucccacaacuccuccuuuuauggguggucacugcuguuuccuaggaauuccgcagugcccuuagggaggauggggcccauuuguugagcuaugugcauguuugcccuuugucgacaaacugcucagcuagcgaguugccuggcccgauccuuccaugccagggaacuguaugguaccaacuccagaaacagcagagcagguagguugucucagggagaugacagagacuccucagugggugaucuuagggcacacccugggaggccuugagcuccgcaugucaggaacucuccuucacugagaaaagaaggcaagccaucucccugucaggacaauugaggaacuucucagccacgaguuuugagucuggacauaacuacaauauguuauguaguucugaacaaaaacaguaaagcuugggugcuuggucaccaccugguggccauuuaugguacuacagugcuaagcacaccccuacagaggaaucugaggaaggagacuagggaugguguuuucugaacucuguaaagcucacagcagguggaggugacagugacauuacugaacuuuguaugcauuuuacuuaauccuuacuacaagaaaccacuuuagaaggcauuccacuuggcugagugcuaaggauuggucuauguauugcaaugcuaaauucuguacccaaaagucuacaggcuuuuauugugcaaaccuucuuccuuaauuuaaaacuauuguuuaaauaaaauggcuacagucaau

SEQ ID NO: 7335 - RNA, 3848 nt, Mus musculus
ugagaagagagacucucaauugagaaaaugucuucuauaggcaagucuguagggcauuuuccugauugguguggggggcuccguucaccguagacacuguggacagugccacuccugggcagguagcccugggagguguaagagaggacuccagcagcugcaaaauaaaccaguaagcaacucggucucuggucagguccugcaaccggguuccuguaagcuacgagaugaaauaaauuuguccccucgccaugcucuguucaugggguuucucacagccauagagagcaaaccaggacagucuuauucuuacagauguguugcccccccuugcccagcaccacacaggcaugcucuaggccaggaggagcccacagcuucuccuuuuguacccugcagauugucgugggcacugggcugguggucagcauuggcucaccugcugguuccaggccugggaugugggcacaggccagccucacacaccuaccugcucucacuuuuacugaguccgagccagaccaggguaggagucggugggacuggccucucuacuuugucugcucuagucuggugugggcucugagcucuggcuggacacucugggcuggaccgcaggcugaagucaguguuuccugugagcucaucuggacuggaagcuccaggcagaccuggcugcuguucugguugccuugcugaggagcuggagggagcugcuucagacuggauggcuguuuuauuggugguggugauggugguggugagggugguggacagcaacuguggugugugugugugucugugugcuugugagggugcccugaauccagcuuuguauauuacacucaacauuaaaauacuuuuauauuuagggaagaauaagaaacugcaucaccuucucacaucuccuauuguguccucucacccucucucccugcguuaaccacugcuuccauucucaguuugaaagggcaggaaaucuaaagaggcaggaggcaugugacccugaggcaggaggcaugugacccugaggggcucuuggucagaagugugggguauguugacaaguuggggcagaguuauauaacucuagcuuucgguucuggcuccuucugagucucaguuuccccaucuacaggauggggaccuuuagcugauaaaacaggacucaguuuggccaugccucucugccuggguguguaucagcaaaaucaacaaagauucaagaggugcuucaugggccuagugagacaagagggcagcugcuaacacugagugcagaggucccuggcauguacagcuguucuguaauugccuaaggaucacaggcucaaaugcuuccagggccccauucaggaauggggacaguggccuggcuugguagacugacagaaaagcagcuaccauguugcucuauugccucggcuucaugcucacuguacaaucucacuccaggcuccaucauggcacccuuccugcgcaucuccuucaauuccuaugagcugggcucccugcaaguugaggacgaagcaagccagccuuucugugcugugaagaugaaggaggcacucagcacagguaggguuggaagggucccuagaggggcauggggcucagggugaagggaggcuucccuucuucucuagauccucuugccuuccugaacgacccagcugaggaugcaggaagacagaagcacccaguuccugacacuccacggugcuuaaauugaaccucccacaucuugaguuucacccuacugugauuuccaugucugccugggccuggcccugugcuggacacuaaggcuauuguagugcuccaggacugacucggccuuguccucaccccuagaaggccuggacaggucacaggagauaagucccuugcuaagggagccuagggaagacccugucccagccuagggucaggguugcuuccuggaggaggaacccuuugcugucuucucaccugauggcuucugccuacacagcuguuagguucugacuaagcugcccacuccuccagggucaggccacgugauggcuggaagguucagagccaccgucuuuguccucuucgaucccaucacagcuguuacuuaguggcuuccugaggagugcagggguucaugucucugucugggacuugacuuggccauguuccuugccaucaggucauggcuaaccuguggcagcucucccaugugaucacugggugaaugcagacagaaagggaaguuguauuggagcuggagcagaaauguuauaggaacgggaacagcaaggccaaaggauuuaggugggaccugccagaguacccgaaaggcacuagaggcugcuggagagcuguagcacauccuuggggcuggagagaaagaagacuguguggcacugagggauaaggagguccagggaagcagggacuagucccagucugacuucucugcccggcacugucgcagagcgagggaagacacugguacagaagaagcccaccauguauccugaguggaagacaacguucgacgcccacaucuaugaaggccguguuauccagauugugcugaugcgggcagcugaagaccccgugucugaggucacggugggcgugucaguacuggcugagcgcugcaagaagaacaacggcaaggcugaguucugggugagaggccugugagccacggucuugcaugugcuugugugcuagugggcugggacuuggcaagugagugagcccaacucuguagcugcugugacugagcuugaauccuggccugauuuaccagguccuuggccccucugagcucucuuucuacuuccauaagaaggaguaaaaaugucuacuccaaggaacccaucagauaaaaugagcaccaaugcccagugcuuauugccagccaauuguggugcccuggguuucuaauccuguguccucgggacucucaagcagcaagguuacaaguucaugaccugcuggguaacuuaacaacaagacccugccucaaacuuuaaaaauguaaagguagaauuggggaugcagcgcagugacaguuuguccagcauuucuccaguacacaaaguauggagacaccgaagucugauaccucgucagucccgaaggcaguuaucugacucuugcagcuaacucuccccaccgauuaguguugaaaaggcaggguaugcaucccaaagugcugugcuccuaccccagccccaggcuccuucccucuuagaggcaccuguuguuccuauuugggggagcguguugaggauauuacaggucuagccagauauggaccgaacaucauguuauuuagcagaaaagagguaagagaaggaagcuggcagucugcccacucaccugcagaaacuaggacugcacaugccuggggccacgugcaucuguggugauauucuuggcggcacaugccugggaccaggugcaucugugguaguguucuuguuggcaguagaaugccagagccaauacaguccuguggucuucugcagccaaaaugccuuucuaaaaagacgcagugaccauuggaagcacuggucagccuuaaugagaagugaaggagccgagauagaagaggggaccacauaggacugcuccaacucuuagccaguuaggcagggacacgggagccuccuggccagugcucucccugaggaaauaucacugggucuagguccugacagaggcuuaggccuuucccucuugagacuguagugaagaaucugccucugcgagcaguguucugugucuaucagguguagugguguggugucugcaugugcagauggggaggggggaguuccccuguacacugcuccuggaccaug

SEQ ID NO: 7336 - RNA, 2413 nt, Mus musculus
ccucccucuccucagagacuuccccucccaccccugccacugggauggguucuugcagucagccugggcaggcugucucacacauuccaggguucacauucauaaacacagucugugaacaacagugccaacaccucccaccgucgaguaagcagcuguccccagagaugcgggguccccgcggccaucuccucucaccagggcagcugcccaucaucgccaagaauaaacuccagcuagucgcugcguggaucugaaucaucugagagcuuccaaaggaggggagugacuacccaggacgcacaagcagacuauauaaguucccaaggguugggccucacgcagauccuuuccuguggcuacugccugccagagagcuaccaacagcgagcuugcuuggcauccaacauguccgagguaaggaggcccagaagggacuaguuggugccaaggaaguugcgagggcaaggcuggacacuaaguaguagugccugcucugaaguaaaagccaaagcuaaacagaagcaccguggcccuuccaggcuggccucuggacacccugggucucaccaggcucuggugaaaggccuugacacuucaggcgugugagggguuggagguggggagugccuauauagaacugugcgccuuuguauggagaugagggagcuagccuugcuggcuuaguguguccugauguguacacauuuguaaucuggaggaaggaugaggggcggagacuguaccuauagaucugucugucucccugugagggugugucugcaggccugcguuucccugggagcucagcccaggcugagugagggaauccuugcaccugccugcagggcuuaagaaggaaucaggugucagccucacaggcgcccgcccgggugguagagaagggugagcacuaaaucuggcuuucccggcucuacugggcaagaacaacaaggucauccuugcuccuuucuccauggcugucuaccccgaucccuccccaaacacaguaaacaucagugguuuuguuuuagggaaaggggggaggggcagucuuacggacuucaccaccucugugaacagaucuuagaauuccugagauuaccaagggcuccucagucuuagaguucaucuuuuugcucuccgcccuuguguccaguccugaacucggccugacaaacaggccagugugaggaugcaguggucaccacccccaggaguucccucccugucuguggggaaaggucagauguccaagucaggcuaagaaggcagggagguggcggggaacuugcaguugggagaggagugagcuuugaaucggcuuaauucggaagccugggaaggaggagcccccgccaaaguuggggggucuucaucucaaggcauugaauuguaaggcucucgacuuuuccaaggcuggcacuccugaaggccccaucaagaagaagcggcccccugugaaggaagaagaccugaagggggcccgagggacccuggccaagaaccaggacaucaagucuaagacauaccaggucaugcgggacuacggugagugucccccgggcaugugguagaauuggagacacaagcaucccccggugguagcuaagagguguugagggucucugggcauaggaggggcugcacacagcauagggagcccugccucugagaagaccaguuuaggucccugaugucaccuccuccaucucuugccuccagagcaagccggcucagcugccccaucuguauucagccgcaaccgcacaggcaccgagacagucuuugagaagcccaaagagggaccagccaagagcguguuuggcugagacaugcacauugcaccauccacccggacacaggagccuccccacgaacuuuuuuuuuuuuguaaugcuggaagaugccuuuccucugcugucucuugaaccaucaugacucccacaacccuagcccuuggaaacaccaauaaagaguaugcccaauguccccaaccuugggacguugccauggccgcuaccugcagaagagagggaaguguggggacauagcauaucuggugcccuuccuggacucugaggugggacagggaauaaugugugugcucucagaaccacugagguguuccaggcagagccuuagccguggaguccuggugcggacuuucugaugcguguaggagacaguucuuccuaaaucucuguuuuaggcugggaagauggugccauagcuaaaaguacuugccauuucuuuagaggacucugguucaguucccaaauauccucaugguagcucauaaccauugaacucugccacccucuucuggccccugcgggcauugcauuacgugugguaugccuguagucaaaauacucacguaccuaaaauaaaaaugaaauggaaaaguaac

SEQ ID NO: 7337 - RNA, 2547 nt, Mus musculus
auguaguacaaguuaugaaguguuuauucauuauacacacgggaaagaagcauugcauacuuguaucuccuguucuccauaacaagcuuaugaagagaugguauaaaauagucauaacuuaaaauacauuuggauuagaaaugaagccaugacaauuagaucucgacacagcugugcuauaagaacauaggcgguuuaagcucauguuuugcuuaugaaagcaauucagcucaucucacaggaaacaaaagcaggugcugaaucaugaaagucccaaucaguuauuuuuagcaugccucuuaauuuuucuguccccugauuucuugucuucugugccuaagucuugaacagguaaccacuuuaggggauggcggcgguagauaggccauggaggaagugucagcuagaucagaacagagaaaagguagcauuuauuuccauucaaggucuaaaugaucauuuaguaugucugauccccaaauaaccaccaugcuaaagauuaacaaacuaaugagacaaaauaugucagggagugagaacaagccuuaaguguuuacacauacaaguuuuaagaacuaaaagaaauaugaaggcugcgugagcaaagcgaagccccuggcauauucauuuuacugccuagaggagaugcaaaagacaauuagaaagcucuacaccuuuauguagcgcaggccaucggacacaacuuaacauucuacuuuucaaauaauagagaacagaaacauuaaugggaaagacgaacaaagaggugauucugguucucacugguagguccaaccaagucuccugagucagaaaacuuacgcuacugcuaauacgcaaauaccacaaauagcuuaccaaacaggagaaagcaaauccggccauaacuauguagacaguccacccaaacuguucagccacguacccguagauaaacccaacuaucugaaaagaaacaaaguauauaaaaugcacucaaaccaagagaggcgggguuaagaauuaaaaguaaugcaauacuuacugcagaaaaaagaaugauccccugaaacaucuguucagcuaguuucugccccuuguaauccuagggacgaaaaagaagaggacgaguugguccuacugccaaaggacugcaauucucguagggaacucagcguuggcauaaggcagcauucaacaccaggagggcccgagaguaaggaagcaaacauguaauuucccagggaaacuugggcaucuuaacagaccacgggaaaggggaucuauucuggggaagagaagggaaagugaagccaaucuuaggaguggcuccggugagggugaggggcuuagaagucgcuaggcuccaaagagaagugcgggggaucggggacgcgcgcccucaccaucugggugggcagcgaacucagguguuccagcaugguugcugaagaccgauaccgacaacgaaacggacguagccgauuauuaaggaguaaaguuugcgggggucgauaucgagagcaaggccgaccagccgagcguuucacuucggccguggccccggaagcggaugucuccgaggggcacggacaaccccuggccccgccccgcgccaucgacaagggagguacgucucuuagcuuuccuagaacccuguacacugcucacgagggcuggggcagcgaccuggccggagcaucgugcaccggucagcgcuccuggccgcccggagcuguaauugcggcaggaaucacuugcgggcugcgccuccccaguuuaacggccgccggcgcgcuccacgucuccauagcgacggccuuuacucggggaggacccgggcgacggggcugccccguggcgccugcugcgccuggcuuucuggcagagggaggcacagucaaacuagggguuguggcccuacguggcugcugcagagcucgccggccagugggccacggccagagagcagcggacgcggacggcccggcggugggccggggccuggggccugcggagcgagcgcugagcuggcggggcgggcuggggcgugggcggcggccacuccucccagcgcagguaagggcgacugcgcccagccucggaaggcgacgauucgucugacgcggcucuaaccugaccugucagugcguggcgggauccccggagcgccucaccacguccccaucacuccuaagcguaaggaggcuacuaaugaucucuagaguuagggaagauaacgaagccacauucuccagggaaaggagacugccucggagaagagcugcgaggcccaagucgccccacaucucguggauugagcuuccgugccccuauguagagggucccaaauucggccuaacuuuuugguugccgguuuccauggcucauucccaggccagucccucuugguaaagaccagccaagggccgggcgugguggcgcacgccuuuaaucccagcacucgggaggcagaggcagguggauuucugaguucgaggccagccuggucuacaaagugagcuccaggacagccagggcuauacagagaaaacccgucucgaaaaa

SEQ ID NO: 7338 - RNA, 10670 nt, Mus musculus
caaccccuggccccgccccgcgccaucgacaagggagguacgucucuuagcuuuccuagaacccuguacacugcucacgagggcuggggcagcgaccuggccggagcaucgugcaccggucagcgcuccuggccgcccggagcuguaauugcggcaggaaucacuugcgggcugcgccuccccaguuuaacggccgccggcgcgcuccacgucuccauagcgacggccuuuacucggggaggacccgggcgacggggcugccccguggcgccugcugcgccuggcuuucuggcagagggaggcacagucaaacuagggguuguggcccuacguggcugcugcagagcucgccggccagugggccacggccagagagcagcggacgcggacggcccggcggugggccggggccuggggccugcggagcgagcgcugagcuggcggggcgggcuggggcgugggcggcggccacuccucccagcgcagguaagggcgacugcgcccagccucggaaggcgacgauucgucugacgcggcucuaaccugaccugucagugcguggcgggauccccggagcgccucaccacguccccaucacuccuaagcguaaggaggcuacuaaugaucucuagaguuagggaagauaacgaagccacauucuccagggaaaggagacugccucggagaagagcugcgaggcccaagucgccccacaucucguggauugagcuuccgugccccuauguagagggucccaaauucggccuaacuuuuugguugccgguuuccauggcucauucccaggccagucccucuugguaaagaccagccaagggccgggcgugguggcgcacgccuuuaaucccagcacucgggaggcagaggcagguggauuucugaguucgaggccagccuggucuacaaagugagcuccaggacagccagggcuauacagagaaaacccgucucgaaaaaccaaaaaaaaaaaaaaaaaaagaccagccaagggguucccuuaacccugucuuucaaggguuguguauuucaaagcgugagcccuucccucaugacugagcuagauggggugccgaauucagacagaccauucuggggaucccauccucuggggcccgcugccucuguggacucugcugugcaugcagucaggcacagauggcgagaugcuagacacucuagacugggaggugaguagccgaugccagcaucuacacauccauggagcuaccaacccauuaguuaguuaguuaauuuugauuagcacaguugugacuuagaacuuggaaacuuggagugugucaaggaagauguccacaucacuccaguaaugugacuauugaauuagcugcggggggaaagcaccuaugugauagagcucuggaaaguguaaccugggcuuuggggacguuuccugaucgugaaagacaaguggggcauagccaguuaagugugugaaaauguccaaguguucuugugcuuugacaccauucagaaaaguacagacccccuugacacuucggaccuuagagccaguacaaugaaagacuacaacaaucuucaagggucuuuuuucuuuucuccuucccuacacuuuccuuaguacauaugaauaggcucucauuccucaggguuguaucucuaccagugcacuucauaggacgggaguuuguuuuacagaccauauaguauuugaacuauaaaaagauggaaaaacaaaaugguuuugccuuguuccuuuugacccaacagcuccauaggaaucucaugcuuuuccauauucuggaauuuaauguuagugaugauuaagauugcaguaagagcucuucuuuauuggagaucuggacuccuccuggauuagcaaauccaggacuguuccacaaaugucacaugcuugcugcauuucuggaagggauggccuuaggugacaggauacagcaguagaauuacauuuucauuuaacuccuuguuucuguggaacuuagauucacagcucacagaugcacacaugcgaucauuccauaacugggaaggaagaguaagauugucgguguaaggagagcacagaaagaugcgauuggugaccuccgcaagagcaguuugaaaauaagaccaaacaucugagaacagaggaaggaaacacacagagagaagaguauuucagcucauuugagacauuuagugugagggaggcagagacauggaccugugggucaguccucuggaagugcuccaucuucuccacccuccucuaccucuacugcuuuaacuggaagacaccagaacaugcuagugugcggaugggugugauccaccaggaauggcgagaaguuggugcuacacgagaacaguuguaggauaggguacagagcaccagugggaauccuuccauggauaucugugcuccauauuguauguaauaggaggggaaaguuuuuuuaaaaaguugagacugaauauaaacagagguauuuagcuuuagcuuuuuuuuuuuuuuaaaguggcgguaugcuagacagauagugaguaaaguacucaccucacaagugugaggacccgaguacuuauguaaaugugggugaguguggcagcucaccuauagugccagcacucaggagguggagaugagaugcugagaacaaguugacuaaaagacugucaaguuguggaucuaauugaaacuuugaaacuuguaaggugaaagaaacacaagcaaggaaaacaccugacagaacucacuucuccccauacacacuugcgcacacacacacacacacacacaccagaaagaaaaggcugaaacaauaaacagaauacauuuuucuuaagauucuuuuauauuaauggguaauauauguccuggguuuccuguauguguguuugugaggaguuuguauacaggugguuugggaauguaaagguuuugcaauuucugagcaaaagaaccaugaauuuucugcugcugcuucuccuucuccuucauuuuuccuucuccuuucucccuccucuuaauccucccgccucuaguccucccuccuccucccuccucuucuucuuucuccauacacacaguauauaugaaauuuugagaacuucuuucuucuccucuuccuucuuucuucuucuuuaauguauauggguacacuguagcugucuucagauagaccagaaaagggcaucaggucucauuacagaugguugugagcaaccaugugguugcugggaauugaacucaggacccuggaagacagccaguucucuuaacugcugagcuaucuaucuccccagcccugagaguuucuucuaaacagaccaaggaacccggaaagacaugccaggaaagacagcaugaugagacuuauucugaaauccgguccuuuucaugugaguagcuggaagccuuuaucaucaagugcuuccugucaccucucuacuuacagaaagugaauacuugcuugaagcuuguuuuuuguguccugcuaacuagagcaguucaaauacauguggcuuccaauccauauacaguacaguguauaacuaucacugaaacuuaacaagauaaaacauugauuuuuguaccagcaauuagcugggguuuauugcauuguuugcauuauugcaaugggauuguuuuauucagucuugguggaauuuaacucaaagcagggagauguuaaagcuuucuugaguagcucccaaucugccaacuucuguagggaagacccuggcuaugguaugagaaagagaaauaccauaggguguguguauauauauauauauauauauauauauauauaauauuguuuguuuugguuuugguuuugguuuuuucaagacaggguuucucuguauagcccuggcuguccuggaacucacucugaggaccaggcuguccucagaaaucugccugccucugccucccaagugcugggauuaaaggcgugcgccaccaugcccagcugcuacaguguacuuacauauaauaauaaauaaaucuuaaaaaaaaaagaaagugaugucuaauugaguggcagacggagugacaaaucgagaaagauuugacagaauagaccaugccugacucucacaaggacagagaggaaagggaagcugcuuaagagaagcagcacacagaagaggaggagaaggcagcuuagcugggacgguuguacagaggcagguugcagagagaacaagccagacacacgugaagacagacggagccagagaacgagaaggagcaagaagauuggaacagauugucagaguuagcuagaggucgagagagaagccagauugucugagugagaagagcuuuagccagaacagcugaguuuaaccagccagccagaguucagaaagaacuaggaagggugagcuuagucagaucucagaggcuggaaacauucuaggcgucgauuagauuguacagcggccagacgcuuccaggacuaguccuaggguagcagacggaggcagcaaaacuuggagaugacaauuauuacaggagaauaaaaguuacuuuuuaguccauggccagucuaacuagguuuuuugggcuugguugguugguuaguuuuuuuuagacuuuugagcuuucucuguguagcccugccuguccuguaacucgcucugugggccaggucaagcucagugacccaccugccucugccucccgagcgagcgagcacugugacuaaaggugugcaccaccauauccagcuuaacuagguguuccaaacagaaaucaauccagaaauguuuguuuaguugcuagacuugagauauuucuccugauagauuuuuuucuuguaguaugcaguguuaacaaggcuaaaguuaugugcuucuccauauacuauaaaaguguucuauaugaucaucaaacauuuuucaguuccccuauugggugcuuggaaguuauuaauuuaaaaccaaguaucuggcacaguaucacacguuccuuucuuuucugucugaguaagagugcagaggcauuuugaugaccauucucaugugcucacugacuuugggggcuuuuauuuuuuauaggguuaauuucuaauguuuguguaagacagaagaaaaggaugucauuccguaaagguaugcgauccccuccccucuccuuccccucuucccucucucccccucucucuaaguucucuuguuuuuauauuggccaaggccaaacaaaagcuguaacacggguuuugucuguuucagugaacaucaucaucuggguccuggcuguuguucucuucuuacugguuuugcaccauaacuuccucagcuugagcaguuuguuaaagaaugacauuucagguauggcagggagccuuuaccuuacuaacucuguacugcugucuguuguuaaggaccuggagguccccgggccaaacacacacacacacacacacacacacaagagcaguuugaccucagcaggugggacagugggacagcguggaaaggguuaucugcaaaaaggaggaagggagcacuuggaguuuuauuagagcagggcugcagugcgaaguuaaugcaaagucagggccugaguuugggagcugauuguccagauguggcuguuuaucuuuagaaaccgccuugcucaggcugucugaagaagguggagaggggguaacugagcuaggcaauggcagugauggagaaggagcuggagcuucaacagagggccaggagguuuccacaagccuuggucagggucuagcagaguuuguucaaaguguauucugauagccugcgcacugggcacucaucggccaucuggugcucccacuccucucuguacugaagucucugcuaagggcuugaucugagagaauaugccuuucuaucaagucagaggcccuaaagaacggcuguaggcugccgucugcuugcguuucaucaggucagagcuuuaaaagauggcuacaggcaagugucccugauauuugaugcuugccuuugucauuacagggugucaauaugaugacuuuguuuuaacugcuacuuucuuuuaacuuagcaaucacaucaguaggacuuuuguaauacaacagaaaucauaaagucuuaucagcugaucaaaaaacuuuuuuuuuuaagauuuauuuauuuauuauauguaaguacacuguagcuguccucagacacuccagaagagggagucagaucucauuaugggugguugugagccaccaugugguugcugggauuugaacuucggaccuucggaaaagcagucgggugcucuuacccacugagccaucucaccagcccccaaaaaaacuuuuuauuguauauaacauugcaauuauuuaguucaugugaaucuacucugguaaugagggauaucugagacugcagagccugcaggguguuuguuaaauaucuuaucuugagaccagaucuuauggcucaggcuggcuucaaagccacucuaaguuaggccguccuugaauucccaauccucauggcucagccuccauagugauggcauuacagugugagccacaaugcccuuguuguaaaaaaucauuuuugaggauagauaugaauacaccauagaaauccuagcaauugggaaacugaggcaaggcaagaggaucaugaaucugaggccaguacagacuauagcugcacccagggccuuauacacgcagagugcauacauacccuuacugcugagcuaucuucagcuuuacauuuugacucuucucuaguucaguuucuguccuuaagaaagaauaauuaagauaauagaccauguaccccuuuaaggcuguuuauaagcugucggaauacauucuagacauguucuguaacuucccuacuaauggggugccaagaguguugccagauuauuuuuucaaauucuuccacuuguguaaaagugguuauauauaggaaaacacaauuuccaauuguauguuuccaaguuacugggcaagaaugaauaaguaguugcuguaauucucauguuaucuccuuccaugucuugggcucugcaaaacacuugcagggugugguagugcacaccuuuacuuccagcacucuggagucagagacaaagagaucucugaguuugaaguugaccuugucuacauaguguguuucaggccagccaggacuacauaacaaaacccuguuucaaagcaaaaacaaacaaaaacaacccaaaacaagaacaaaauuucaugagauuguguccuggugcuuuuauuguguguucuuuucagauucgggaauuguggggcuucagcccauagacuuugucgccagugcucaucagcauccagugagugagaggcaagaggagauucccgugguuauugcugccucugaagacaggcugggugggaccauugcagccauaaacagcguucaucaaaacacgcgcuccaaugugauguuuuacauuguuacauucaacagcacagcagaccaucuccggugagcacugcuuuccuaacugaugcugccucugcuccauacucuucauagucacacugcuaggccaggagccacuuuacaacacacacacacacacacacacacacacacacagauacauaguacaaacaguuuuccauaugacugugucaugccucugugguaggagaaaugauaauuuaucaggaaguaaagcagcugucauagccacacuguuaauuccgcaguuccuuuaguaauaggucuaauguuuagcaaccugacuuucugaauaagggaagcaguguaugauucacuagucauagccucuuucagaugcaugcacaaagcacuggguucaguuccuaccauuacagaacugggcaugauggcucagaccugucacccuagcauccaagagguagaaguaggaggauuagaaucuacaaguagccaggcagugguggcucacgccuuuaauuccagcacuugggaggcagaggcaggcagauuucugaguuugagggcagccuggucuacacagugaguuccaggacagcuagggcuauacagagaaacccugucucgaaaaaccaaaaaaaaaaaaaaaaaaaaaaaaaaaguuacaaguaguccauguuugaguauucucaagucuauuuucugcaguaguuugguuaugggagaagagauugucccaucgauucuugguugagaaggagcuuugguggaaauaccuucaucuuagucuuaaagggauauagaacuugaaacaucuauuuaguuccuaggucucucuuacauuccauuacgccacuauagaaaagcauagaaauauacggcuauauacauuagaaacaugaccaaauguguuuuuuucuucaucagguccuggcuuaacagugguuccuugaaaagcaucagguacaaaauuguaaauuuugacacuaaacuuuuggaagggaaaguaaagcaggauccugaccagggggaguccaugaaaccagugaguuccaugucuguguucuguugggaguguauuugguuagaauaccuggaugacucuggcuauacagugcaaguacuucccuagggaccaaacuuggggacuccaagaguccacugacuauuuuuuuuaccuggguucuuguacaaauaaaagcccagcuauuguauccuaugcugauauuccuccccucccccccccccccccccgcccuuuuucuuuugucaguuaaccuuugcaagguucuacuugccaauucugguucccagugcaaagaaagccauauacauggaugaugaugucauuguacaagguaucaaagugacuucuguccuucaucuggauucugggcuguaauggauugucuguggucuacuauuaacuccgccaccauuucuuagaagaggagcagaaucuccagacagcugcacuuauccauuucaggugacauacuugccuuguacaauacaccacugaagccaggacaugcugcugcguuuucagaagauugugacucagccuccacuaaagucaucauccggggagcagggaaccaggugaugacuuacugcagaucucacuccgggaaagcuuaaugagaaauguuaaagccagggcuccaucguacauuaacuagucauugcucuccagaccucacaccuaccuguuuauagauucuguggauucauggacuuuacaaccaaauuguccuugaaugcuaagacaaacucuagaucucaacuguuaauucuguaggaucugucacuuuugcuaauaauuuaggaagccaagcucaaauauugcccugugacacaccuuuaauccuagcacuugagaggcagaggcaggcagaucugaguuggaggccagccuggucuacaaaguuccuggacagcuggggcuucacagagaaacccugucucagaaauaaaaaaaaguccaacuacugacuuuuuucuuuacuugcuuuaaaaacucaucuugcagcaaauauuucauuuauguuuucaguacaauuacauugguuaucuugacuauaaaaaggaaagaauucguaaacuuuccaugaaagccagcaccuguuccuuuaauccuggaguuuuuguugcaaacuugacugaauggaaaagacagaauguaacuaaccaguuggaaaaauggaugaagcucaauguagaguaaguauguaacuggcuuagcuauuaagacgaacaaaagcccauugaacacuguuugguacuccucacuaacaucuuuguuuccccaagagagggauuauacagcagaacucuggcaggcagcaucaccacaccuccucugcuuaucguauuuuaucagcagcauuccaccauugacccuauguggaauguccgccaucuugguaaguauaaaacuaucuagcuggguauagugguucaugcuaguaauccuaccacuuggaauagauacaaaggcagcaagaguacagcaaguuuuaagguuagccagagccauguauccacugacuuacacuaaccaggaauuaguaucuaagaacaaacaccuccuccaagauggacuaugaucaguauuucccuuuagguuucuacagcuuagcauggcauuguuuuaauuuggcacuuuuuauuuaagguuccagugcuggaaaacgguacucaccccaguuuguaaaagcugccaaguuacuucacuggaauggucacuucaagccuuggggaagaacugcuucauaugcugauguuugggaaaagugguauauuccagacccaacaggaaaauucaguuuaauccgaagacauauggauaccucaaacauaaagugaacuacaauuuaagcuaauugcgucacucaggaaacucuggaagacacacuaugugggaagguaacaguuguagggcuugaguuucucuauaccaaccacagaaaacacuucagcuggguagaagucauagauauccagaugacuaccacggcuccaucugccuuaccaaauguuugcuuuacuauacugcugacuugaaggacagagaacuccagcauuuaacugcaucuagcugcuguagguaggaacugcuguuugguuuuaguuuuguaccuuguggccugguuuguaaauaaaaucuacauuuuccaauagaccuauuugcuuccccauuuuucuuuguaccuuguggccugguuuguaaauaaaaucuacauuuuccaaua

SEQ ID NO: 7339 - RNA, 10670 nt, Mus musculus
uauuggaaaauguagauuuuauuuacaaaccaggccacaagguacaaagaaaaauggggaagcaaauaggucuauuggaaaauguagauuuuauuuacaaaccaggccacaagguacaaaacuaaaaccaaacagcaguuccuaccuacagcagcuagaugcaguuaaaugcuggaguucucuguccuucaagucagcaguauaguaaagcaaacauuugguaaggcagauggagccgugguagucaucuggauaucuaugacuucuacccagcugaaguguuuucugugguugguauagagaaacucaagcccuacaacuguuaccuucccacauagugugucuuccagaguuuccugagugacgcaauuagcuuaaauuguaguucacuuuauguuugagguauccauaugucuucggauuaaacugaauuuuccuguugggucuggaauauaccacuuuucccaaacaucagcauaugaagcaguucuuccccaaggcuugaagugaccauuccagugaaguaacuuggcagcuuuuacaaacuggggugaguaccguuuuccagcacuggaaccuuaaauaaaaagugccaaauuaaaacaaugccaugcuaagcuguagaaaccuaaagggaaauacugaucauaguccaucuuggaggagguguuuguucuuagauacuaauuccugguuaguguaagucaguggauacauggcucuggcuaaccuuaaaacuugcuguacucuugcugccuuuguaucuauuccaagugguaggauuacuagcaugaaccacuauacccagcuagauaguuuuauacuuaccaagauggcggacauuccacauagggucaaugguggaaugcugcugauaaaauacgauaagcagaggagguguggugaugcugccugccagaguucugcuguauaaucccucucuuggggaaacaaagauguuagugaggaguaccaaacaguguucaaugggcuuuuguucgucuuaauagcuaagccaguuacauacuuacucuacauugagcuucauccauuuuuccaacugguuaguuacauucugucuuuuccauucagucaaguuugcaacaaaaacuccaggauuaaaggaacaggugcuggcuuucauggaaaguuuacgaauucuuuccuuuuuauagucaagauaaccaauguaauuguacugaaaacauaaaugaaauauuugcugcaagaugaguuuuuaaagcaaguaaagaaaaaagucaguaguuggacuuuuuuuuauuucugagacaggguuucucugugaagccccagcuguccaggaacuuuguagaccaggcuggccuccaacucagaucugccugccucugccucucaagugcuaggauuaaaggugugucacagggcaauauuugagcuuggcuuccuaaauuauuagcaaaagugacagauccuacagaauuaacaguugagaucuagaguuugucuuagcauucaaggacaauuugguuguaaaguccaugaauccacagaaucuauaaacagguaggugugaggucuggagagcaaugacuaguuaauguacgauggagcccuggcuuuaacauuucucauuaagcuuucccggagugagaucugcaguaagucaucaccugguucccugcuccccggaugaugacuuuaguggaggcugagucacaaucuucugaaaacgcagcagcauguccuggcuucagugguguauuguacaaggcaaguaugucaccugaaauggauaagugcagcugucuggagauucugcuccucuucuaagaaaugguggcggaguuaauaguagaccacagacaauccauuacagcccagaauccagaugaaggacagaagucacuuugauaccuuguacaaugacaucaucauccauguauauggcuuucuuugcacugggaaccagaauuggcaaguagaaccuugcaaagguuaacugacaaaagaaaaagggcgggggggggggggggggaggggaggaauaucagcauaggauacaauagcugggcuuuuauuuguacaagaacccagguaaaaaaaauagucaguggacucuuggaguccccaaguuuggucccuagggaaguacuugcacuguauagccagagucauccagguauucuaaccaaauacacucccaacagaacacagacauggaacucacugguuucauggacucccccuggucaggauccugcuuuacuuucccuuccaaaaguuuagugucaaaauuuacaauuuuguaccugaugcuuuucaaggaaccacuguuaagccaggaccugaugaagaaaaaaacacauuuggucauguuucuaauguauauagccguauauuucuaugcuuuucuauaguggcguaauggaauguaagagagaccuaggaacuaaauagauguuucaaguucuauaucccuuuaagacuaagaugaagguauuuccaccaaagcuccuucucaaccaagaaucgaugggacaaucucuucucccauaaccaaacuacugcagaaaauagacuugagaauacucaaacauggacuacuuguaacuuuuuuuuuuuuuuuuuuuuuuuuuuugguuuuucgagacaggguuucucuguauagcccuagcuguccuggaacucacuguguagaccaggcugcccucaaacucagaaaucugccugccucugccucccaagugcuggaauuaaaggcgugagccaccacugccuggcuacuuguagauucuaauccuccuacuucuaccucuuggaugcuagggugacaggucugagccaucaugcccaguucuguaaugguaggaacugaacccagugcuuugugcaugcaucugaaagaggcuaugacuagugaaucauacacugcuucccuuauucagaaagucagguugcuaaacauuagaccuauuacuaaaggaacugcggaauuaacaguguggcuaugacagcugcuuuacuuccugauaaauuaucauuucuccuaccacagaggcaugacacagucauauggaaaacuguuuguacuauguaucuguguguguguguguguguguguguguguguguuguaaaguggcuccuggccuagcagugugacuaugaagaguauggagcagaggcagcaucaguuaggaaagcagugcucaccggagauggucugcugugcuguugaauguaacaauguaaaacaucacauuggagcgcguguuuugaugaacgcuguuuauggcugcaauggucccacccagccugucuucagaggcagcaauaaccacgggaaucuccucuugccucucacucacuggaugcugaugagcacuggcgacaaagucuaugggcugaagccccacaauucccgaaucugaaaagaacacacaauaaaagcaccaggacacaaucucaugaaauuuuguucuuguuuuggguuguuuuuguuuguuuuugcuuugaaacaggguuuuguuauguaguccuggcuggccugaaacacacuauguagacaaggucaacuucaaacucagagaucucuuugucucugacuccagagugcuggaaguaaaggugugcacuaccacacccugcaaguguuuugcagagcccaagacauggaaggagauaacaugagaauuacagcaacuacuuauucauucuugcccaguaacuuggaaacauacaauuggaaauuguguuuuccuauauauaaccacuuuuacacaaguggaagaauuugaaaaaauaaucuggcaacacucuuggcaccccauuaguagggaaguuacagaacaugucuagaauguauuccgacagcuuauaaacagccuuaaagggguacauggucuauuaucuuaauuauucuuucuuaaggacagaaacugaacuagagaagagucaaaauguaaagcugaagauagcucagcaguaaggguauguaugcacucugcguguauaaggcccugggugcagcuauagucuguacuggccucagauucaugauccucuugccuugccucaguuucccaauugcuaggauuucuaugguguauucauaucuauccucaaaaaugauuuuuuacaacaagggcauuguggcucacacuguaaugccaucacuauggaggcugagccaugaggauugggaauucaaggacggccuaacuuagaguggcuuugaagccagccugagccauaagaucuggucucaagauaagauauuuaacaaacacccugcaggcucugcagucucagauaucccucauuaccagaguagauucacaugaacuaaauaauugcaauguuauauacaauaaaaaguuuuuuugggggcuggugagauggcucaguggguaagagcacccgacugcuuuuccgaagguccgaaguucaaaucccagcaaccacaugguggcucacaaccacccauaaugagaucugacucccucuucuggagugucugaggacagcuacaguguacuuacauauaauaaauaaauaaaucuuaaaaaaaaaaguuuuuugaucagcugauaagacuuuaugauuucuguuguauuacaaaaguccuacugaugugauugcuaaguuaaaagaaaguagcaguuaaaacaaagucaucauauugacacccuguaaugacaaaggcaagcaucaaauaucagggacacuugccuguagccaucuuuuaaagcucugaccugaugaaacgcaagcagacggcagccuacagccguucuuuagggccucugacuugauagaaaggcauauucucucagaucaagcccuuagcagagacuucaguacagagaggagugggagcaccagauggccgaugagugcccagugcgcaggcuaucagaauacacuuugaacaaacucugcuagacccugaccaaggcuuguggaaaccuccuggcccucuguugaagcuccagcuccuucuccaucacugccauugccuagcucaguuacccccucuccaccuucuucagacagccugagcaaggcgguuucuaaagauaaacagccacaucuggacaaucagcucccaaacucaggcccugacuuugcauuaacuucgcacugcagcccugcucuaauaaaacuccaagugcucccuuccuccuuuuugcagauaacccuuuccacgcugucccacugucccaccugcugaggucaaacugcucuuguguguguguguguguguguguguguuuggcccggggaccuccagguccuuaacaacagacagcaguacagaguuaguaagguaaaggcucccugccauaccugaaaugucauucuuuaacaaacugcucaagcugaggaaguuauggugcaaaaccaguaagaagagaacaacagccaggacccagaugaugauguucacugaaacagacaaaacccguguuacagcuuuuguuuggccuuggccaauauaaaaacaagagaacuuagagagagggggagagagggaagaggggaaggagaggggaggggaucgcauaccuuuacggaaugacauccuuuucuucugucuuacacaaacauuagaaauuaacccuauaaaaaauaaaagcccccaaagucagugagcacaugagaauggucaucaaaaugccucugcacucuuacucagacagaaaagaaaggaacgugugauacugugccagauacuugguuuuaaauuaauaacuuccaagcacccaauaggggaacugaaaaauguuugaugaucauauagaacacuuuuauaguauauggagaagcacauaacuuuagccuuguuaacacugcauacuacaagaaaaaaaucuaucaggagaaauaucucaagucuagcaacuaaacaaacauuucuggauugauuucuguuuggaacaccuaguuaagcuggauaugguggugcacaccuuuagucacagugcucgcucgcucgggaggcagaggcaggugggucacugagcuugaccuggcccacagagcgaguuacaggacaggcagggcuacacagagaaagcucaaaagucuaaaaaaaacuaaccaaccaaccaagcccaaaaaaccuaguuagacuggccauggacuaaaaaguaacuuuuauucuccuguaauaauugucaucuccaaguuuugcugccuccgucugcuacccuaggacuaguccuggaagcgucuggccgcuguacaaucuaaucgacgccuagaauguuuccagccucugagaucugacuaagcucacccuuccuaguucuuucugaacucuggcuggcugguuaaacucagcuguucuggcuaaagcucuucucacucagacaaucuggcuucucucucgaccucuagcuaacucugacaaucuguuccaaucuucuugcuccuucucguucucuggcuccgucugucuucacgugugucuggcuuguucucucugcaaccugccucuguacaaccgucccagcuaagcugccuucuccuccucuucugugugcugcuucucuuaagcagcuucccuuuccucucuguccuugugagagucaggcauggucuauucugucaaaucuuucucgauuugucacuccgucugccacucaauuagacaucacuuucuuuuuuuuuuaagauuuauuuauuauuauauguaaguacacuguagcagcugggcaugguggcgcacgccuuuaaucccagcacuugggaggcagaggcaggcagauuucugaggacagccugguccucagagugaguuccaggacagccagggcuauacagagaaacccugucuugaaaaaaccaaaaccaaaaccaaaacaaacaauauuauauauauauauauauauauauauauauauacacacacccuaugguauuucucuuucucauaccauagccagggucuucccuacagaaguuggcagauugggagcuacucaagaaagcuuuaacaucucccugcuuugaguuaaauuccaccaagacugaauaaaacaaucccauugcaauaaugcaaacaaugcaauaaaccccagcuaauugcugguacaaaaaucaauguuuuaucuuguuaaguuucagugauaguuauacacuguacuguauauggauuggaagccacauguauuugaacugcucuaguuagcaggacacaaaaaacaagcuucaagcaaguauucacuuucuguaaguagagaggugacaggaagcacuugaugauaaaggcuuccagcuacucacaugaaaaggaccggauuucagaauaagucucaucaugcugucuuuccuggcaugucuuuccggguuccuuggucuguuuagaagaaacucucagggcuggggagauagauagcucagcaguuaagagaacuggcugucuuccaggguccugaguucaauucccagcaaccacaugguugcucacaaccaucuguaaugagaccugaugcccuuuucuggucuaucugaagacagcuacaguguacccauauacauuaaagaagaagaaagaaggaagaggagaagaaagaaguucucaaaauuucauauauacuguguguauggagaaagaagaagaggagggaggaggagggaggacuagaggcgggaggauuaagaggagggagaaaggagaaggaaaaaugaaggagaaggagaagcagcagcagaaaauucaugguucuuuugcucagaaauugcaaaaccuuuacauucccaaaccaccuguauacaaacuccucacaaacacacauacaggaaacccaggacauauauuacccauuaauauaaaagaaucuuaagaaaaauguauucuguuuauuguuucagccuuuucuuucuggugugugugugugugugugugugcgcaaguguguauggggagaagugaguucugucagguguuuuccuugcuuguguuucuuucaccuuacaaguuucaaaguuucaauuagauccacaacuugacagucuuuuagucaacuuguucucagcaucucaucuccaccuccugagugcuggcacuauaggugagcugccacacucacccacauuuacauaaguacucggguccucacacuugugaggugaguacuuuacucacuaucugucuagcauaccgccacuuuaaaaaaaaaaaaaagcuaaagcuaaauaccucuguuuauauucagucucaacuuuuuaaaaaaacuuuccccuccuauuacauacaauauggagcacagauauccauggaaggauucccacuggugcucuguacccuauccuacaacuguucucguguagcaccaacuucucgccauuccugguggaucacacccauccgcacacuagcauguucuggugucuuccaguuaaagcaguagagguagaggaggguggagaagauggagcacuuccagaggacugacccacagguccaugucucugccucccucacacuaaaugucucaaaugagcugaaauacucuucucucuguguguuuccuuccucuguucucagauguuuggucuuauuuucaaacugcucuugcggaggucaccaaucgcaucuuucugugcucuccuuacaccgacaaucuuacucuuccuucccaguuauggaaugaucgcaugugugcaucugugagcugugaaucuaaguuccacagaaacaaggaguuaaaugaaaauguaauucuacugcuguauccugucaccuaaggccaucccuuccagaaaugcagcaagcaugugacauuuguggaacaguccuggauuugcuaauccaggaggaguccagaucuccaauaaagaagagcucuuacugcaaucuuaaucaucacuaacauuaaauuccagaauauggaaaagcaugagauuccuauggagcuguugggucaaaaggaacaaggcaaaaccauuuuguuuuuccaucuuuuuauaguucaaauacuauauggucuguaaaacaaacucccguccuaugaagugcacugguagagauacaacccugaggaaugagagccuauucauauguacuaaggaaaguguagggaaggagaaaagaaaaaagacccuugaagauuguuguagucuuucauuguacuggcucuaagguccgaagugucaagggggucuguacuuuucugaauggugucaaagcacaagaacacuuggacauuuucacacacuuaacuggcuaugccccacuugucuuucacgaucaggaaacguccccaaagcccagguuacacuuuccagagcucuaucacauaggugcuuuccccccgcagcuaauucaauagucacauuacuggagugauguggacaucuuccuugacacacuccaaguuuccaaguucuaagucacaacugugcuaaucaaaauuaacuaacuaacuaauggguugguagcuccauggauguguagaugcuggcaucggcuacucaccucccagucuagagugucuagcaucucgccaucugugccugacugcaugcacagcagaguccacagaggcagcgggccccagaggaugggauccccagaauggucugucugaauucggcaccccaucuagcucagucaugagggaagggcucacgcuuugaaauacacaacccuugaaagacaggguuaagggaaccccuuggcuggucuuuuuuuuuuuuuuuuuuugguuuuucgagacggguuuucucuguauagcccuggcuguccuggagcucacuuuguagaccaggcuggccucgaacucagaaauccaccugccucugccucccgagugcugggauuaaaggcgugcgccaccacgcccggcccuuggcuggucuuuaccaagagggacuggccugggaaugagccauggaaaccggcaaccaaaaaguuaggccgaauuugggacccucuacauaggggcacggaagcucaauccacgagauguggggcgacuugggccucgcagcucuucuccgaggcagucuccuuucccuggagaauguggcuucguuaucuucccuaacucuagagaucauuaguagccuccuuacgcuuaggagugauggggacguggugaggcgcuccggggaucccgccacgcacugacaggucagguuagagccgcgucagacgaaucgucgccuuccgaggcugggcgcagucgcccuuaccugcgcugggaggaguggccgccgcccacgccccagcccgccccgccagcucagcgcucgcuccgcaggccccaggccccggcccaccgccgggccguccgcguccgcugcucucuggccguggcccacuggccggcgagcucugcagcagccacguagggccacaaccccuaguuugacugugccucccucugccagaaagccaggcgcagcaggcgccacggggcagccccgucgcccggguccuccccgaguaaaggccgucgcuauggagacguggagcgcgccggcggccguuaaacuggggaggcgcagcccgcaagugauuccugccgcaauuacagcuccgggcggccaggagcgcugaccggugcacgaugcuccggccaggucgcugccccagcccucgugagcaguguacaggguucuaggaaagcuaagagacguaccucccuugucgauggcgcggggcggggccagggguug

SEQ ID NO: 7340 - RNA, 7064 nt, Mus musculus
uugcucccccccccccuuuuuuugagacaggguuucucuguguagcccuggcuguccuggaacucacuuuguagaccaggcuggccuugaacucagaaauccaucugccucugccuccugagugcugggauuaaaggcaugcaccaucacgcccagcaacuuccccauauuuuuaagaauguaaacaccgcuguucuuccggaguucaauucccccacaucaggucacaacuauaucauucuauuuccaggagacccaauguuuuccuaaucuuuuuuucccccccagauuuuuuguuuacucaaagagguccuucugagugcuggguaccaccauaccuggcuauaaauaaaucuuaaacacaugcaagcaaauacuuguauuuuauuuugaauuuauaacaugauacauauuuacaagauguacaguuuauaucauacacuaaacuacacagcguacagagagcacguuaguguguggcgguuauauauaaucuguggugaagucauagguuucauccucuugacucgcucuauccaaggcagacgacccgucagauggcuuaccugcagcagaggaaaagugacauuuuacauaagaaauuaagggcaauuguguucaagcugcuuuuuuauaagucuuucccagacucaccugcuguugauugcucaggugacagcucccuggucucuucuacaggggccacaucugagaucucugccuguggaccaagaaauugauaugaaauagcacauaacuucucauuacuccuauguagguaggauagaucagucuugguggcaccccuaacuaagcacuuguaaaauguuaacaguagccaggcauaguggcgcacaccuuuaaucccagcacuugggaggcagaggcagggggauuucugaguuugaggccagucuggucuacagagugaguuccaggacagccaggccuacacagagaaacccugucucgaaaaaccaaaaguuaacaguucaggggucccuucuuauuaaaauguuucuaccuuugacccucauucuuucuacacuguaaugcuagaaauuuuauuucagcuuuaacccgagaaacaaaacuuacauuucuuucaccacuaccauuuucuugaucgucagcauccuguuugucuucugucugucuuggugauucuucgacuauguccuucucgucuaguauuccauuugucaggcccgaagaccgaaaaaggauucuauuaguuaaaugagggcccuugaggacuagaggaaauaaacucagguuaacagauaagaccucuagcauucugucgucauucacuauuauguuauauccauuuguguaacagaaaaaaacagaauuucaccuuguaugcugugugcauuauucuuuucuaguucuucuagauuaaagcccuucuucaugacugcugcaauauucucauuaaaaugcagagaaugauuccaggaugcagggggauggcaauaguaaccuaaugaggcacuaacauuaaagacaagaugugucaaacacaggccaaucucuucauucuaaguugucuuccaaaaugcccauaaaaagacaccuuacccuguccacucagaccacaccagcuuagcagcacuuuccacauuugggcuuccaccuuuuuggugcagaccucuucuuugagcaaguuuaguaaaaaaaugcagagaauccuuauacucagggacaguauauuuuaacaccaccuuaaaaauaaaagaugggggcuggugagauggcucaguggguaagagcaccugacugcucuugugaagguccagaguucaaaucccagcaaccauaugguggcucacaaccaucuguaacaagaucugacucccucuucuggagugucugaagacagcuacaguguacuuauauuaauaaauaaaucuuuaaaaaaauaaauaaaauaaaagaugaccugucccuaaucuauacagauaaagagcaguucuuuuaccuguucauuaucagccugagacagaauggcacuggcagccuccagcggucuuaguuccucaaugcuugcuggacuccgaagggcaagugcagugggggaguuacaaggugagauaauuaggcauggacugucuaugauugugaucugcuugucuaaagggacaaucugcaugcuccuuaaaaaaaaaaaaaagccauggaauuaacaaugacacuguccaucugaggacaagacaacaugaagcucaggguuggauugaacaaacucagcacagcaguuaagucagauccaaucugucaucacugcuucauguuuaugugaaaccuuacacacuguaagauacugugcacuacauauccaaacauauucauguuugcauauauggcacaguaagguuauuaacuuauuuuuccaagacuagguccaacacuauuugucugagggagcuuuccucagccuuucugggccuuuccaaggaaugcucuuagcccagcaccagcuacugauuucuuucugaucacugacaguuccauuuaccuuguaagucccauggaaaucccaacauugcaaauccauucuuguuuuaagcuauuaaugacacugcuuuuccccacauuugggaaaccuacaaauaaacauaaacucggauuaugcucagaaacacauuuucuaauaguugccuugcccacaccaggcaaguguuuccacugaacucucagaaggccauguuuuggcaaggcgagccagaguuaacauuugagaaacccugucaguuuuaacaaagcuauucacacucacaaugucaagacccugacuaaguacuuaugugguaaagaagcugaaugaaacgcaccaaucacuccaacuugaauauccuuuccacaggacugcugaaaaucuccaagaagcuuccaaagggcuuccuugccacagcagauuuugcuuuggaauggaacaacuuucuucuuuuuuaucuuuaaacauaaaauauagcaauuuuaauucugguaaacaucaccagguggaauacaaaaaguaugacagcagagagaguccagcuuucagaaaaacugcuggccuccacuaccuuugcaauuuuuaaugaaaucagaguuggaucuucauguuuuucacuuucaucaacauuuguguacucaucacauuucaaucaucacagaucugaagaaaccaguauuuccccccaccacuaacaacagcauaccuugaaugucuuucuguucuuuaaguuuguugaggcuuugaacaccacgguuggcaauucuuuauucaaauaauuuagccaguucuccaaauucuccuuugguacuagaucugaauugggaaagacacuucaauucagugguuuuaagacuaguguuaacuacugaucuuacuaaucuguacuuccccaauguuuugagagaaauuuaagagaaagaaaauaaacuuccuaccgcgcggccugugucuugaggugucccaucuccaccucucaguccccacagucccauggcguccaggccggaacugaggaugcccuucagcucuggaaccuccccucgccccucagcgaugggaucacagagggguacuagcacgcuugguuuuauguggugaugaggaacaaaccaccuuuccugaguaccaggcaggcacuggaccaacugagccacgugugaaccucagcaucuccaggauugcucacucagccuaggcacgaagucaagucacgccuguucccagaauuacuuguuacuguggcaccaguuuucuaagcccaaggcacauucuuacauucuucucuccaguaucuuucccuugucccuuauauuuauugaggcuugaacauauuuauugaggcuggcaauuuagcuaguugcccaaauuuuucuuucuucugggcucucuuccuggugcuuaaacccacccagauaucuaauaauuuuauuuaauauuuuaucccacauaguaacuuuucuuguaccccaguuuaaauggcaaacgcucacaucaguuccuauaugaaauaaagugguuauggaaacucacauugaagcuaaauauuaaaaagcagaacagaaaaagccaagugaauaaucacuugcagaaacuaccuccccccaggucuuuggccaccagagugcacauucauuggcuuuguugaggucagaguuggaucuuaucagucuucagugguaaucagacuguccgauauuuuccucauaccucauagugcacaaaauagauaaaggggaguguuuguacucaccagacuuauuuaauacaaguaucagcuucuuacucccacucuggauaacagcuucuucuaucugaggacaccugcaaccaagaggaucucuggcauccaaaacuucuaacacaaugucugaggcuucaaucaccugucaaguaagaaaccaucagagcagcaguccuuacugaguagcacccucaacacugacagugaauccagaagauaggaucuccuguaugcauuucacuaucaaguauguugacuguuaagucuggacauauaaucuacccaauugaguccuuagguuaacaggccuuuuuagaaggcagguaggugagcuugggaaaugcaugccugaaauggggagcucuagcaagcaagcacauugggaauccacugcccacccuuuagacucugacuucaacagcguucuaagaauucccucuuuacaaagcagcugucaaggacuaaguuuucaaaaaucuuagaucauuuuugacacuaaccuauacuaagguaccuuuuuaaguuccuggcaauguaacuucuuuggauucuguuugccugcuuuggcuuucuuucuuuugggcucgucagauuccuaaaaggaagaaaaauuagaaacagcaguuguuaccaguauaucaacauuucccacagaucacuacaggcaauauauuuuaaauggaugagaaagccuacguuuuguuacucccaaggaacgcaaguuuuaaggaaagauaaccuuaccucccuaguuuccacauuagacugcucaucaccagggcuaacuucaaguuuucuuuuccuuucuugcucuuuuugccuaucaaguuucugcugcuguuuuaguucuucaagcugugucagagacgugaaagagaggaaugagcgagugacugguggcaguguauugcuuuggaaaccacauauaucauucuacuggagcuuucagccagcaaaaauuaccugcuguuuccuuaguucagcuucacgaagaagagccucuuuaaagggagcacuauuuggaacaccuggguccuuccuaggcuucuugugaccccguuuuuuagcuuccuuccuuaauuuucgaugauguucucggaccuauuaaaaacagcucuaugaggucggaaggcacuugccuugguucaauccucaguauuaauacaaaagaaacaacucgcccuacaaaaauacauaagcacugagaacuuagggaacaagccagccuauccgcaauuuauaauggaugugaagcacccuagaaaagcagaacuucaacuggaacuauacagggaauuaacauguacacaaaaaacagaaaaguguugcagcucucuguaaagaugccagugugcuagcuugaggcuuucguuuacccuguacuuucccacagcugcagucuguccaauccuauaccaugacaagagccuuccccacagagaugaagaaagccauguuagcaccccacuugcuaugggccucacagaacacuuaccuuuuuuugaauuuuauaucgcuuauggcaggucauacguuuacucgcuuucuuuaacucugccaaaacaaagaaagagaaagacugcacacaugagcagugaguguuuuaaauuucucacaucaccuauauggauguuuugcccucucuugucagcagaccaaccacgugcauguaguguucuugcaaaggaagccacaagagggcuucaucacuuguccuucuacagacagcauggagcugccacgugggcugggacaacccugggucuucacuccauacccaaaauguuucauuuacuuauuuuguguguaggucugaaagcaauuuccaggagucaguucuaccuaucauaugaguuugaacucuugacaguaaggcuuaguggcaaguguuuauagccauauuccuggcccucaagagauuguuuuaucaggccaugggggccuacaacaauaaggcuaucccgggcaacauagaucuugccucaaccgucccugcaaaguuaugcaggguauuuaauggaaaucacaccacaacgccagucaauucgacucgguggacccacaauggaagcagcuucuagaggaaagcacuacaaauaucaagguuucuuucuuuauuuuuauuuuuucgagacaggguuucucuguguagcccuggcuguccugguagaccaggcuggccucgaucucagaaauucgccugccucugccucccaagugcugggauuaaaggcgugcgccaacacggccaggcucuuuuuuuaauuuuuaagccaugguuucaguauacagcccaggcuggcugcaaacuuucuaucuuacugcgucauccuucguguacaugauuagggcgcgugccaccaaggccgaaagaccaugguucugaauaguucuaggaaaacggcaggcucgaaaagaggcucaaacacguuaaucacagaaaucuggcucgguuuuccucucaagggcuuagcucuccugcuauacaacaggccaaauuugggucugggccuucuaagcaucagaucuacgcggaacucaucaauggccuauggagaguccucucccuccagccacaaagcaccacccgcgcguuucgcucccgaccccacucacuaggccucuucauccuggccgcggacgcuucaggagcagaggaggucucgggaucaccacgacuucucgggcgccacgugcgaacuggaacugcgguucaacgucacgcgcuccaggaccugccggaaagugugucggggccgggccgagugcgcgcgcacacacauacacugucgcgccgagccgggcucgccuggcggccac

SEQ ID NO: 7341 - RNA, 40815 nt, Mus musculus
auuuuacuucaguagagcuuuauucaaaugggguacauauaauauucagauguguguaccaaacaugauacauacuguugaaauugugaggugcucagaacagagagaaugguuugaauagauuucacaaagaauguggcaguuggguuacugugaagaaauguaagaauugugacuaucagggaaagcauuccaggcagaauuaauaaccagaauaaaggccugagagauaaguacaucacucuuaaccuguaauucacuuaucagcauagugagcccuauaaaaggugguagaugggguaaugggcagaucauguaagguuucagaaaccaugugagcccuugaacuauuacagaguuacaaaaagugucuuuguuauuguuucaagcagagaaguaacauuugacuucugguuuaauaggguugcucugcuuucuccuuauugagaugagacuguaaaggggccaagaguagaagcaaggagaucugcuagaaggcuauugugauaagccaagcaagaaugauggccucuuuagugugacuaauuacaaacaguaguauucaggagggcaggcuaacagcagucuuaguaaauacaauguggaguuccaggguagagcuuucaaggaugacucacuccugugaguaguuaggaaacuggaagauuggaguuauuauucacugaaaugaaaauguugcucuaugucuagaacccugcaaaugugggacaauaauacugauuuuaaguugauaaauaggacaguacaacaucgcaacgggaaaguacuuuagugcuggaucuugcacaaagaucugugauccucuguuuugaaggaauguuugccaaauccaaugacaaauguuuaguuguuuucaucuugaacaucucaggaagaaaaccuggaauuaaauaaaaugaucuaauuacauacuuugauacuauguuaaaguuuuuguuuuuguuuuuuuuuucccagaguggccaaauguccuuuucucuuuuucagaguaucuucucugaaaggucucuuaaagggugaggagaauccaugaaauuucucuuaaugcuauaugcugcuacauuuuaggggucuggagagauagcucagugauuaacagcacuggcugcucuucuagagguucugaguucaguuccuagcacccacaugguggcucacaacuguuuauagaggagcugauucccacuucuaauggagggaauuagcaacagagcacucauuuaaacaaggaaacauuuuaguuagugggguuuuaauuagauaaucauucaaaauugaaauuauuauaacuuaauuucucuaucccccuacccccaagaauugagaaaguauggguccgagauggagcugcauauuuuuauggcccuaucuucauucauccagaagaaacagaacaugagcccacaaaaauguucuacaaaaaagaaguguuucugaguaaucuggaagagaccugcccuaugaguuguauucuggguagguauuuguccuuuuucaucacaguuguucuguaaaacuuggauuaaguacugcugcuaugcagggcaugcuucuagauagugggucuauagcagcauaaaaauauuaaaagucuuugcuuucauaaagacauuggggugaagguugggagauaguaaauaaauagcagagaacaccagguaguaauuagaguuuuaaaugaaaauaaaacaaagaagauugacaauaaauguuuagaugaggucacaugaucagccaaaaugaacccuugaagaaguuuucaaauaaacaaaagaaaauuauuugaggcucucuucuaggaacagcaaaagaguugucuuagauuaucuguucuuguuuggaaucucagaggguuggagaacuagagcaagggaagggauguguuguaaagaaugagcccuuugaacuuuauggagacucagacauaguagaucuuguagauagugauugggcuugaaaggaaaucauagugggguugagcagagcugugaagugagucaucauggcugcugugugaacaguguaauacgaguaagguaggaaguagagagaauagccucauuuuucaguuucuguuagacuuuuuuugaggauuauuuacuuauuuuauuauaugaauacaguguagcuguuuucagacacaccagaagaagggaucagaucccauuacagaugguugugagccaccaugugguugcugggaauugaacucaggaccucuagaauagcagucagugcucuuaagggcugagcccucucuccagcccucuguuagauucuuaaaacuugaucauuuuauugucuccauuaucgugguuucucuuuggucaucuaucaaguauuuccagugguauuuuguuucuaagaucuaauuguaugcaucaucauauacuaacaauauugcuagcuguuauguuucuccaagcccugagagccacuagaucauacacuagccacacuauaucccuugagauggcauccuaaaagauuacuagaucauacacuagccacuagaucauacacuagccacacuauaucccuugagauggcauccuaaaagauuacuagaucauacacuagaucauacacuagccacuagaucauacacuagccacacucuaucccuugagauggcauccuaaaagauuacuagaucauacacuagaucauacacuagaucauacacuagccacuagaucauacacuagccacacuaucccuugagauggcauccuaaaagauuacuagcuauaggcuuuacaucggugcuuggaguuuugugggucccccaccaacacaccaauucagagauugaacccagggccuuguauaugccaagugcacacucuaccauuaaccugcauagcuaaaucuaguccccacagauuguugaugguuuuaaagaagccaccauagaucacaaccaaagaaaaauuugcagauucaaacauauguuagucuuuauucgaugcugcugcucauaauuauuuucaggauuagauauggcaaacugcuuaguaauucagcacauuuucaacuuucuaccacaggggaagugaacuaagcaguaaagucauuaaacucuugccuuucuguagcagaaaauaucuuccuuuuaaauucugauccagacuaaaguaauacccaaaguuacuuccuaguguaaauccagcaaggagauuaaaauggagcaugaugaaagugagacugaaguuugcuuguguuagggcagcuauaugauuuguuggguuaauuucuauuuuauuaggguuuguuuguuuuuugggggggggguugggguuuuuugggggggugucuuuuuguuuuuuuaucaagacaggguuucucuauguagcccuggcuguccuggaacucacuuugcagaccagucuggccucaaacucagaaauccgccugccucugccucccgaguacugggauuaaaggcgugugccaccacacccggcuaauuuuagguuuuaugcaacuuuucaaaugacuuuuuuaccuuuuauucuuuaacaguagaaaaucauggccacucaguagaauccaaagaacauugcuucuagcccuauauuuauaggaccuuagaagacucaagaagcauaacucaucacaaaauaauauauacugcuucaggaacuguauugagugauaucaaaagaauuucagaaaaaaauaacugugacauaacugucccaguguuuugaguuuguuuguuuuugguuuugaauaguuauaguuaugaauguccuagaacucacuaaauagaccaggcuggccucaaacucauagagaucugccucccaaguguacaccauaaugccuggcucuggcucuuuuuaagguguguguguguauuuuccuugcauauaugucuguguaccacguguguuucccauggaggcaagaagagggcauuggaucuucuggaacuguagucacagauacgccaucuuguaggugcugggaaucaaaccugggucuucugcgggacagcagccaaugcuuuuauugcugggcuaucaccaccaccaccacuccaaacgaguucuugauucagaaaaaaaaaaaaaaaguguagagaagcuauauucugagcaacaauagucaucuaugucuccacaauauagacuggaucaugguucagaugaaacuaguacacaaacauauauacaccucucuccauaauauuccugucagcccuugaagugauacuagaaaugacacuuaagcauuugcuuguagaaucuacuuguaauuuggaagaaggcauguuucaauauguaguuuuaaugucaacacaauaacuaagguagaaauuuacaucccuuauuuggggcugggcacgcaguaguagaauccuuaacaugaaacccugggcuccauccccaggguugcagagacacagaacaguucuuaaagcaucucaguccccacuuuuucuccccacauuuuaaaugugugucauuugauaacuuaagcccaaaugacaauacaugguuaauuugccuuuuaaugugcuaaggcuucaauauauguguuccuccaggacucauaagucuaaacuuaaugccagugggaucuugugggaggugcugagguccaaagagccaugcacugaguagauagacacuguuucaggcagggaucauacaaguugguuuacucuccugucuuugucuuugugcuucugcuguccaucaugcaucagacaccuagaauuuuccugugcaguaaacaggaauaugucagauacuggcaccuucauuuuuaggacuuccuaucucccagaacuggaaaauuuucuguucuuuagaaauugcccaguccacaguaguauugcuauaguagcaauauaguaggacuuuuuuuuuuuuaaguaugaucaugccaucuuucugagagaauuucauauuugacaaaaacagguaaauucuuugcaagggucauccuucaggaagcuccccacaagucaagcagucagcuaaaauguauuugagaaguuaggaaggaaggggaauguuccacucuacucugcccuuggcaucagaaacuucauaccaggaucccaggcugucuuuuucaaaacuguugcugaagccaagaaaaaaaaguguguguguauguguggggagagcuggagugauggcucagcaguuaagagcacucccuguucuucaauuuccagcacccacauggcaacucacaacugucuaugacuccaguuucaggcuauucaacacccuuuucuggccuccaugggcaccaggcaugcauguaaugucacauacguguauacaagcaaaauacagauaaaccuuuuuuuuuuuuuuuuuuuuuuuuuuuuuuacaaucuagccagugcccugccuccuggucccacuccugaaguuccucaucucauuacucuuucccccuaagccauucucugcuacauaugcagcuggagccaugagucgcaccauguguacucuuugguuggugguuuagucccugagagcucuggggguauugguugguucauacugcuguuccuccuauagggcugcaaaccccuucagcuccuuggguccuuucucuagcuccuccauugggcacccugugcucaguccagugguuggcugacagcauccaccucuguauuugucaggcacuggcagagccucucagaagacagccauauuaggcuccugucagcaagcacuuguuagcauccacaauagugucugggauuggugacuguauaugggauggauccccagguggggcagucucuggauggucuuuccuucagucucugcuccacacuuugucucuguaucuccucccauggguauuuuguucccccuucuaagaaggacugaaguauccacacuuuggucuuccuucuucuugagcuucauguggucugugaauuguaucuugguuauucugagcuucugggcuaauauccacuuaucagugagugcauaccacguguguucuuuugugauuggguuaccucacucacgaugauaauuucauguuccauucauuugccuaagaauuucauaaauucauuguuuuuaauagcugaguaguauuccauuguguaaauauaccacauuuucuauauccauuccucuauugaaggacaucuagguucuuuguagcuucuggcuauuuuaaguaaggcugcuaugaacauaguagagcauguguccuuauuacauguuggagcaucuucuggguauaugcccaggagugguauugcuggcuauguccaguuuucugaggaacugccaaacugauuuccagaguaguuguaccagcuugcaaucccaccagcaguggaagaauguccucuuucuccacauccucgccagcauaucugcugucaccugaguuuuugaucuuagccauucugacuguugugagguagacucucaggguuguuuugauucgcauuuuccugaugacugaggauguugaacauugcuuuaagugcuucucaaccauuagguauuccucaguugaaaaucuuuuguuuaacucuguacccaauuuuuaguaggguuauuugguucuccggagucuaauuucuugaguucauuauauauauuggcuauuagcccucuuucagauguagaguuaguaaagaucuuuucccaaucuguuggucgccguuuuguccuauugacaguguccuuugccuuacagaagcuuuguaauuuuaugagguccuauuuguugauucuugaucuuauagcauaaaccauugauguucuguucaggaacuuuuucccugugcucaugugcucaaggcucuuccccacuuucucuucuaugaguuucauuguaucugguuuuaugugggcguccuugauccacuuggacuugaacuuuguacaaggagauaagaaugggucgauuuguauucuucuacaugcuaaccugguucaaccagcaccauuuguugaaaaugcugucuuuuuucuacuggauguuuuuagcuccuuugucaaagaucaagugaccauugguuuguugguucauuucugggucuucaauucuauuccauugaucuaccugcuugucacuguaccaauaccaugcaguuuuuaucacaauugugauaauacaguuugaggucagagaugaugauucccccagaaauucuuuuauuguuuagaacaguuuuugcucuccugguuuuuuguuauuccagaucaauuugcaaauugcucuuucuaacucuacaaagaauugauuuggaauuuugauggggauugcauugaaucuauaaauuguuuuugacaagauggccauuuuuacuauauuaauucugccaguccaugagcaugggagaucuuuccaucuucugagaucuucuuugauuucugucuucagagacuuaaaguucuugucauacaaaucuuucacuugcuuagagucacaccaagguauuuuguauuauuugugacuauugugaaggguguuguuucccuaauuucuuucucagccuguuuauccuuugaguagaggaagggcacugauuuguuugaguuaauuuuauauccagccucuuugcugaaguuguuuaucagguuuaggaguucucugauggaauuuuuggggucacuugaguauacuaucauaucaucugcaaagagugauauuuugacuccuuccuuuccaauuugaaucccuuugaccuccuuuuguugucuuaauugcucuggguaggacuucaaguacuauauuggauagguagggaaagagugggcagccuugucuagucccugauuuuaguggcauugcuucaaguuucuuuccauuuaguuugauguuggcuacugguuugcuguauauugcuuuuaucauguuuagguaugggccuugaauuccuggccuuuccaagacuuuuaucaugaaaggguguuggauuucaucaaaugcuuucucagcaucugaugaaaugaucaugugguuuuuugguuuuuugguuuuuuuuuuaguuuguuuauauaauggauuaccuugauggaucuucguauauugaaccauuccugcaucccuaggaugaaggcuacucgaucaugauggaugaucaguuugauguguucuuagauuugauuugugaggauuuuauuaaauauuuuugcaucgaaauucacaagggaaauuggucuaaaauucucuuucuuuguugggucuuugugugguuuagggaucagaguaauugugacuucauagaacgaauuggguaguguuccuucuguuucuauuuuguggaauauuuugaagaguucugguauuaagucuucuuugaaggucugauagaacucuacaccaaacccaucugauccugggcuuuuuuugguugggagaauauuaaugacuacuucuuuuucauuagggguucugggacuauuuagaugguuuaucugauccuguuuuaacuuugguaccuggaaucugucuagaaaauugucuauuucauccagauuuuccaguuuuauugaguauaggcuuuugaaguaggacuugaugauuuuuuggauuuccuuguuuucuguuguuaugucucgcuuuucauuucuuauuuuguuaaucuggauacugugucugugcccucugguuagucuggguaagggcuuaucuaucuuguugauuuucuugaagaaccagcuccugguuuuguugauucuuuauauaguucuuuuuguuucuauuugguugauuucagcccugaguuugauuauuuccugucgucuacuccucuuggguguauuugcuucuuuuuguucuagaacuuucauauauacuguuaaguugcuaguguaugcucuguccaguuucuuuuugggcacucagagcuaugaguuuuccucuuagcacuguuuucauuguguucauuucaguuuuggguauguuuuggcuucauuuucauugaacucuaaaaaagucuuuaauuucuuuauuucuuccuugaccaaguuaucauugauuguagaguguuguucagcuuccacguguaugugggcuuucuauuguuuauguuguuauuuaagaccagccuuaguccauggugaucugauaggaugcauggaauuguguaaaucuuuuuguaucuguugaggccuaugaccgauuauauggucaguuuuggagaugguaccgugaggugcugaagaaggugguauuuuuuuguuuguuuguuuuaggaugauguguucuauagauaucuguuaaauacauuugguucacugugccucuguuuaguuuccauuuccauggucugucaauuggugagaguuaggugaugaagucucccacuauuauugugugagguucaaugugugcuuugagcuuuuguaaaguuucuuuuaugaauguggguacccaugcauuaggaguguagauguucagaauugagaguucuucuugguauauuuuucuuuugaugaguaugaagcguccuucuuuaucuuuuuagauaacuuuagguugaacgucuauuuuauuagauauuagaauggcuacuccagcuuguuucuugguaccauuuacuuggagaauuguuuuuccaccuuuuacucugagguagugucugucuuugucacugagguggguuuccuauaugcagcaaaauguugggcccuguuuacauauccagucuguuaguccaugucuuuuauuggggaauuggcuccauugauauuaagagauauuaaggaaaauugaguguugcuuccuguuauuuuuguuguuagagguggaauuauguguauguggccaucuucauuuugguuuguugaaauuacuuucuugcuuuucuagggaguaguuucccuccuuguguuggaguuuuucauuauccuuugaagggcuggauuuguggaaagauacuguguaaauuugguuuuaucauggaauaccuugguuucuccggcuauggaaguugacaguuuugcuggguauaguagccuggcauuuguguuccuguuugucuguaucacaucuguccaggaucuucuggcuuucauagucucuggcgagaugucugauguaauucugauaagucugccucuauauguuauuugaccuuuuucccuuacuucuuuuaauacucuaucuuuguuuugugcauuugguguuuugacuauuaugugacagaaggaauuucuuuucugguccaaucuauuuggaguucuguaggcuucuuguauguuuaugggcaucucuuucuuuagguuagggaaguauucuucuuuaauuuuguugaggauauuuacuggccuuuuaaguugggaaccuucucucucuucuauaccuauuuuccuuagucuucuauuuuccuuggucuucucauuguguccuggauuuccuguauauuuggguuaggaacuuuuugcauuuucuuugacuguugugucaauguugucuaugguaucuucugcaccugagauucucucuucuauuucuuauauucuguugcugaugcuugcaucuauaacuccuaaucucuuuccuagguguucuaucuccagaguugacuuccuuugugauuucucuauuguuucugcucccauuuuuagauccuagaugguuuucuuaaauuccuucacuuguuugguuguguuuuccuguaauucuguuaagugauuuuuuguguuuccucuuuaagggcuucuaccugguuaccaguguucuccuguguuucuuuuuucuuuuuuucuuuuucuuuuuuuaguuuuucaagacaggguuucucuguguagcccuggcuguccuggaacucacuuuguagaccagacuggccucgaacucagaaauccaccugccucugccuuccaagugcuggcauuaaaggcaugugccaccacugcucggccucuccuguauuuaaggaaauuauuuaugauguucuuaaaauccucuaccagcaucauuagaugugauuuuaaauccaaaucuugcuuuucugguauguugggauauccaggacuugcuguggugggagaacuggguucugauguugccaaguaaccuugguuucugaugguaagguucuugagcuugucuuucgccaucugguugucucugguguuaguuggucuuguugucucugccuggagcuugucccuccuguaggccuguaagcuugugucagcacuccugggagaccaguucucuaccaccagaaccugugcacagaaggcuuuauaaaaguccuagcucugggugcagauggugacugguaccccgcccccccccccgcccccccccgcucccacuuuuuuuuaauagaggguaaguugaggcuaaguuacaaagucaccugucagauuucagcuacauuuucauaauuaaacauuauaugguugugaaccuuuggcuuuugauuuaaaaaagaauuguugauucuagucaaaugagguaacugaguagguaaucugaauucuaugccucuguccuaggugaugaaaugaaggagucacaaguauucucugacauacaugugccacuacacauguguuauggcauguacauaaacacauaauaaaugaaauaauauuuagaauauauaugugauguguuuguccgucaguauauccauguguucccacagaggcccaaagaggacacuagaccaagcuggggauauugugggugcuggguauugaacauggucuucuggaagagcaguaaacccucuuaaccacugagaugugucuguccaaucccucaaaagacauguuuauucuaacaguuuuugccagcuuuucuucugugaagaaaugacuguugauguacucccuauacuacuguuuccacuaauauaacuuggauaaaucuuuucucuagaguuucuguuaaaaugcauugccuccuacaauauuuaagccauuuuuauaucuggaaucaacaugauuauauaagauaguauuuuccggaaagguaaaauaacugcccaagaaugggucagaacuaaagccuggguccucugucucacuucuguguuggucucauuaagugauugauagccaguugggauacauguguauguacugaugagccugcaguauugagcaggaugagagaugcacagugagacaugguuguuuuguuuuauaaaccccacuuagugcucacaaaguaagauccaggggcuggagagaugauucagcaguuaagagcacugacugcucuuccagagguacugaguucaguucccagcaaccaugugguaggucacaaccaucuguaaugggaucucaugcccuuuucacaguguacucauauaaauaaauaaaauaaguaaaucuuagccgggcggugguggcccaugccuuuaaucccaacacuugggaggcagaagcagucagauuucugaguucgaggccagccuggucuacaaagugaguuccaggacagccagggcuauacagagaaacccugucucgaaaaacaaacaaaaaaguaaaucuuuaaaaaaaaaaaaaaaaaagcuccauuuuuacaguuugguaugcaccaacuaccaaagggccuuauucuauaaauuucaaaggacuuauaauuccaugauguuaacuuuguucaguguugaauguaaaucuuacuuuuguacuuuuuuuuucugucucaaacaaguuuuaaaaauauuaaguacacugauuuuugggguucccugguagaauuggaaggcuuauuuagaagaaaagucuuagaacugucuuagaagacccaccgagaagacaguuuugacaccuuuauagggaauaucacuucugggaagaaugauccaagugaccagauaugguagcacacgccuuugaucccaacacuugggagccagaggcaagugaaucucugaguuugagggcagccugguccacauaaacaguucaaagucagccaaggcaacaacaauaauaguaaugguagugauccgauagacacagaggaauuacuugagaaugagcaugggcuuaccugccagagaguauaccucuacuguugaccacuaagauuauaauaauuucaguaauggagccugggcauuccuuuuuuaauauaauuauagguuguuuuccuucuuuauaaauuuauuuaaugcuuuaucauuuuuaucagcaaagcaaaaaaaauaaauaauucaagaauaaaugcuuuaaauuuuugaaagggaaaacaggccaggguauuuuguuuguuuuuaaaucauacagagaaaaucuaagagauggucucauauaucauuuccuuuuugccucaguggagacuuaucacaggauuauugcccagggcucccucaccaggucagaucuugauacagccaccuguuggaaauagagguucaggacccugugguguccauucuuuaccagaagcucccucuucugaaaagcucuggggcacccccuaggaacugagggcuacuuuccugaucugcacccaguuccuuaugcucagacuaugagcaagcagccuucauuaaaccuuggcuuccugaaggcacuagagcagaaacaggccucaauaagcagaaugccaagagaagcagacugccucuucccucgaacggccauaccagagaggccaaagacagaacuaagaauagccacgguguuggagcuaaagagugaagaaaaggugcuugguggcacccuggaggggaagaacaggauugaggcauucaugcaaaggacaggauugaaugauuugaauggcuauggauuggccugguauagguguccaagauuuuuccaaccuggacuuagagaaggaagagagcuagcaucauaauuccccuuaccucucaggaguucugaagagagaaaggccauuuauccaaacauugcauuaguuuauguguuuugauuuccuuccuagaaacaggguugauguccacugggugcaauaaaacaauaacuauugggugacuuuggugguguuugucuaaaaucccagcauuuggaagguagagacugaggaucacugcaaguuccaggcuagccaggacugcaucacaaaacugucuuguaaugcauuaauuaauuaugaagcaaaaauaaaagauaccuacauacacaccacuuuaagaaauuuuaauggcaaauaaugccuguaagcucucagaacuuaacaauauaagagaaaucauuuuaaacauacuccucaaauguacacuuaauccuucaauuaacaaacagggauugcauagccaguauuggggaaagggggaaaggacuggaaacagaauaaugaaguuaccuuacugaucacacacaaccuauuaggcagauaauagguagacaaaugcauuaaaauauuuuguugaggcuacuauaauauuguauacuuaucuacuauauuauaaacauguaaguaucugggcagugauggcgcauaccuuuaaucccagcacuugggaggcagaggcaggaggauuucugaguuugaggacagccuagucuacagagugaguuccaggacagcaagggcgauacagagaaacccugucuugaaaagccaaaaaaacagaacaaaacaaagcaaaacaaaacaaaaaaguaaguauuuaucucuacugccuuuuaaaaggaucaggaaauguaugaaaucuaaagagcaaaaaggugacagaaggauaacaaaaaacuucauauuaaaaagauaauaggaacuuaauaugacuuagcauaccagagaaagcugauaccuaauccccuacaagcaaacccagcagagaacucuagaagagacaggaauugucaacaacaggaaguuuuuucuacaugguuuuccuuguuguugacuuguaugaauuguuuguauauuguaaaaacaaauccuuugccaguuauauggcucauaaauauuuccucguggaggaggacuuauauuuuuauuuucuuaauuaugucuuuugaaaaacaggaaauuauuuugcugaggcccaauuugcauaugcuaauuuuuucuucuauguauuacuuaaaucuuaaugucucaugguugcacaaauuuuuaucuuguuuucuaugggaaguuuuccuuuuacuucacaccuguuauaauuuauccauugcaguagccacuagccacuguaauucuuguuuuguuuuguuuuguuuuccaaacaggguuucucuguguagcccuggccauccuggaacucacucuguagaccaggcuggccuugaacucagaaauccaccugcuucugccucccaagugcugggauuaaaggcaugcgccaccacugcucagccacauguaauucuuaagcaaauaaaaugggacuagucuagauuaaguuauauauauuauaaauaugaaauauaugaaaaagaaugauuaauauguuaaucuuuauuauauaauaaauguuauguggauauauggagcugaacaaaauauguugguaaguuuaaaaguauauaaauaaaauuuuuacacaaauuauaaaagacccaaauaaauaaaaaugaccuauuauaaaggaagaacucaauauuuuaaauauguccauucucccaaaguugaucuaucaagaucauuuuuauguguaugggcaaauccacauguauaucuguguggcuuguguaugguguaugccuuggaggccaaaagauuugcuucagcucacaaaucuaauagcuuauaaagaaaaauguuacuauuaagugaaaucaaggcuuucuuuuaccaguguuuaagagcccagcacagaaucaccacauuuauuucaggacuaccagucacuuggcuuuuguuuugaaaugggaauuucauauuguccaggcuggcuuggaacucaauuugugucugagaaugaacuugaacucuucuccugccuccaccucugcugggguuaugggcacauguugauaaugcuuuguacgcacuaggcaaguauucagccagcugagccacaccccaucuccaacuaauaauuugacuccuuaacuguggagagaauuuuuaccauuuuugcaucuccauuuuuuccuucuuuaagcaugaagaauggcuauuccuaacuguugaguuagguaaauaaauacuauguauuucuaagguagugaaagcacuuuggaacuucugaaauguuucugaccuguuuugaauguacauauucaagaaguucuugaccaugagcauuucuaguauguucaguagcaaauagcaaaaauaaguguucuaaguguuguuaguguucuuuuuuguuuuuucagauugaaccuagggcuugcucgcucccccucccaggugcaugcaugugugaguguguuuguuugccugucugucugacuauaugggaguccauguaacauguaacacucaguauaugaguggaggauaggacaacuuguagaacuuaguucgccuucuaccauguaggucccaggaauugaacucagcuugucaagcuuguaggcagacacccuccccacccgcccuccccugagacaggguuucucuguguagcccuagcuguccuggaacucacucuguagaccaggcuggccucgaacucagaaauccaccugccucugccucccaagugcgccaccauugcccggcagcagacaccuuuuauccacugauccauccaucuugccaguccaugaacccaggguuuugugcaugcuaggugaccauuacuuuagcauucauuauuacauggguggugguauuguuguuugguuggugugguuugguuuaguuuuuaauuauguauauaugggaagguaugugcaugcaugagugcagaugucaguggauccaggagacaaagucccuguaaguuggagccacaggcaauugugagccaccuagugucagugcuaagagcugaguuugaguucucuguaacucuguauacuccuagcugcugagccaucucucuaucugagccccuucucuaucacucuuacuuaacugugaacuaaaauauaauaauauaaaauuugggacgggggaaaaagaguucugcugguaaaguauuuuucuugcaaguucagucucuagaaccacacuuuaaaaagccaaguuuggugguacacacuuguaaucccggcacuggagagguagagacagaucccaggggcucacuagcugccagccuagccuguuuggcaaguuccaggcuguuaacaugacaggaguuaacuccuuuauuucuauauuacucuuucagggaaaugugcagugcugucauucaaggacuuccucuccugcaggccaacugaaauaccagaaaaugacauucugcuuugugagagccgcuauaaugagagugacaagcagaugaagaaguucaaggguuugaagagguuuucacucucugcuaaaguuguagaugaugaaaucuacuacuucagguaaagcuuguaaaacuaaggaagaaagggcacugggcuaacuuaccagucauguuacccaguguucugaguuguuuuacuaggucuugucauaucacauaauuccaauagaaaauaucaguucagugagaugggguaauuccuagacuugggaggcugaggcaguagauaguauuauguuugagucaacuuuuuuuguuuugguuuguuuuguuacagagagaaaaaguauugaguuaaaaaaaaguuagcaauuguuuuaauaguaccuuggauuagacacaagcaguuguagaaugaagacagcacuugguucuauuggcagccucucugugggaagauuuucucaguuucauagauuaugacaauuccuuuuuaacauauaguccacuagaccugacccgcaccucuguggguauuaaucagaauuguuaauaaguagaagugacaucacaaauacccacugaagcuaauuuguuagccuuauagaguguuuguggcagguuauaauaauacaucauuuguaaauauuuucaggucugcccucugaccaguccuggaagugguuggcaacuuuucacuuacuuguuuugucacuguuuuucagaaaaccaaucauuccucagaaggaacccucaccuuuguuagaaaagaagauacaauugcuagaagcuaaauuugcagaguuagaaggaggagaugaugauauugaggagaugggagaagaggauagugaagucauugaagcuccaucucuaccucaacugcagacaccccuggccaaugaguuggaccucaugcccuauacacccccacagguacagugauacgcccaugacuugccuuuuuaguucuagcccuuagcagacuuaaaccagaguaguagacauuuuuuguuugagauaucaguuagccuaggcuggcuucagacuucuuguguauuuaaggugggccuugaacucuuagucuucuugccuccauuucccaaacaagcacuucgaguacagggguacacuaccacacuugaugugugaauuuuugccuaauuauuuuuaauuagcaaaaagcauacuuauaucauuaagccaauaauaauuucuuuuacauuucauagugaugguuuaauaggaguuuagaagauucuugccuuguagacaagaagcaauaaggaauguuauuaugcucuuacaccuuagcuuucagcgcccacacacaagaucuugucuccacuucagccuccugagcaauaggacuauagauacagucugccacaccuggaugccuauaucuuuaauuuccccuuccuuaggacuucaucuuuuuguugaggugauccuucuuauauuuauuuuccucauucagaauuuucuugagauuuaauugugaggucaccauuguagacuguagucauggaauucagugaaauuuuuacuuacuuugcacaagacaagguagagguauauuuuggccaagaaaaugucagcuacaagcugaauaugucuauaaaacuucauuguaucauauaugucuggcuucuagaaacuguaagguaaccuauaauagcuuucugucuuacagucuaccccaaagucugccaaaggcagugcaaagaaggaaaguucuaaacgaaaaaucaacaugaguggcuacauuuuguucagcagugaaaugagagcugugauuaaagcccagcacccagacuacucuuuuggggagcucagcagacugguggggacagaauggagaaaccuugaaacagccaagaaagcagaauaugaagguaaauaaagacuaggcacaacucucucuacuuuguaagcaagggguguuuucaggaaugcacaugcauauacaggcuuuacucuguuguucuuaccacaugcacaugaaucugguguuguggacuguccgagcuggcauuagaugccaguaccuggaguguugccucugacuuggccucauauccuuguggcguugccccuccuggcaaauuucucaaacaaaaauauguugcuguuaaaaauugcaugauuuuauuuuauuuaucccuauaggcacauacauguugagcuggggaaugauuguucaauaauaauguuaauuauaauuuuuauuaaaauucaccugaaugcggccuuuuaaaauaagugauuguauugcucuugauaagccaaagcuguaaguuaaaguauagguggagucaugguaugccugguuuucuaggccagcccugaccuguguacugugucuguguucauagcugcucuuaagauacuuggauggcuuuggcugagcucagacgccuucauuucccccuuccucuaugauagaucacuuuaaacccugagcuguuuuacucaaggauuugcugauucauaguuguaaaaaauuaauuccuuagagauuuuuggugguugggauuuuuauuguucuaguuaauauuagguacagcuuuaauaagugagaguacgcauuacuuuaggcaauacuuucaaauuucguauguuagauaauuuuccaauauagucuuccucucuaacuugacuaaguccaaauucauuauuuuccagcaagcauacauuaugaaagcugcuccuuuuauugaagcuuaugaagucuccaaaguaacucuuuuguaaaaaaacuuacauuccuuucauuuguuacuauuuauuauuaugaaauuaucugacagacuuccuuaaggaucuucugcugaagccuaauccuacaagacccucagcccagaaagauuuuguggcagaaucaguuucagaagcauuucaaacucugggcauaguccuaaguuaaagucacuaaggccuacaguaaagaaccugguuuuuuauuaucugguauuuccugaaaauugcccagguauuuauguggcaucuauuaauacccuagaacauucuuugagaaagucuaguccaaucccauaagaaccuagaacucugggacacuuugauauuucagggcuuacugcaaguuaagaccaaauguacuacuaaguuggaggacuguugucuaagaagcucggcuaacauagugucucaaggcaaacaaagcuaggacuguguggcugguuauuuaggguacaaauaggacaaagagaucuagaucuagaucugaagucagaaaaucuagagcauggcugagggaagaagagaugauauuugaacaauucucucauuuaauggggugucugaaauuaggaagagccuagugagaggugaguuauaugucucagucaccugaaauucaaacucugaacuuuagauguuucugcccacugaauucaaaacacaaaguugggaguuuggcugguguaauuuuaguaauucugaauuccaaagcagccuaguucagcuucuuucaggaagaacuaauauuuuauccacaugccugaacuuuucuuuuuuuccaacuuuaauuuuucuuuuucccuccaguuuauuguuucauuuguguaaugaaaaaacuagcauuuaauauugggguaucuagaccacagauaguuuuuuuuuuuaaguacuagagaauagguuguuagaauggcuuugcuucucguacugugcagaagguaucaggcugagacaguccuagugagugaugcuaagugucuacaagcaacuucaucacagccucaggagcuuugaauugcacaauuuucacauucuuaccauaaaggaguggagcuguugcuucuugagucuuuaaauccauguaccucaaacuguuuuccccaaauagcuguagucuuugaauuucauguuggagagauaacuguggaaggugaagugugacaccaggcgucggggccaugaguugccguuucuccuguauucuuggacaagucacugccuguaccccagcuucugugugcccaucugaagagugggaaggacuuccugcuuagaaugugaagcugaauaagcccuguauagugggagcuuugggaauaugcccucacagaagguccggcgugcugagagcaugacuguugagggugcuggcucuagaggugcagcauagccuaaggaaguaaagaggcuaucgguuaauagcgagaggcuccagaagcguuccucuugcauuucaagugcuugaauucuugcugauuuaggauucauggucgguuuugaacucagcucagggaaccugguucuuucagaguauuguccauugcuacauacacguauguauuaguuccccucuucugaugacuauaguguagcuaaucacguauuuuccucccucggaguuaguuaaugaugaacucuuucuuugcuucauuacaauauagaaacuggcuguuuacuuuuccuaaagucuuaaggcagaggcaguaagcuacuuuucccuuacagaguuaauuuucuucagcugcuaaacuugugauauuaaugaugaguccucaaauuuuaguaaaauuggauacaaggaaucagaaaauuagaguaaguacaauuauuccaaaaauuauaaugggccauggaauugcuucauguugaaauuauaaucuguaaugcuauuaauacuagaaugaugguagcgcuucucaucuucagagugccucgugagauuaaccacguugguuaccuggugauguguuucgauaaaaucugugcuuucugaauguguguugcagucuuaacauucuugaaaucuuugcagaccaguucucaagaugggauaggaaagcugaauucuagguuaccaagugaaaucggcccgacuccuguguugagacuagucaucuaccguuccuuccauugagacagaacuguugccuguguuuuuacuaguccuguugaaugcaauggaugguauuuugaauuccuggguuaaaaacagaauugaaaaugugaaaugccuuuacagagcgggcagcuaaaguugcugagcagcaggagagagagcgagcagcacagcaacagcagccgagugcuucuccccgagcaggcaccccugugggggcucucauggggguggugccaccaccaacaccaauggggaugcucaaucagcaguugacaccuguugcagguaaaaacaggagcuaagaccauuuuuuuccacuuuaagaaauuccuucauuuuuuuuucuccaaaaggaguaggccacagucuguagccuuuucucaugacagauuccaaguuugaagucauccauguuguccuguauugcuuuucccauacaggcaaggccucuucucuaucccauagcaggcccuaggcccgacccuggcaauugguagauagcagcucuuccuuugcugugggcguggucuggcaauguucuuacuccagacugcucuuugauaaagcacuacagcaggaaauacaaguagaucuugaguucuguucugaggaacuccaaggaaaauauaacagcagucguuaggugguauugauucucugucucaugccaguucaguuugcccuauucugcugcagccauccuuaaaagacugaccacuuaaaaggauuuuugacagugaauuaauaaauccuuucuuggucaccagugugcaugacugcuaaauagggggaaguccuuguucaauucauugugcccacucuguaaugcuuuucuauuuaauuacauuaaacugcauuuucuguuaguaucccagucacauauuuaaauaaaugaauaagaugaaagaaagaaaaggaaaaagaaaugaugaaugugguuugcuuguguguguugucucugguucugguagccauagcaaauuugacuacuguugaauugaaaucuugucugacaugucuccacaaaaagccuguggaccaccucucaggccuuuccuuuguugccucuccacaucuggugagcucuguacaagccaccugggauucuucuuacacaagcagucucaccucuuuugcacagaguccaagacagcuuuguggggacacuguuuuuguuuuugcuguuuuuuguuguugccauuuucggauuuuuuuuguuguuguuuugguuuugguuuugguuugguuugguuuuuuuguuuuuuguuuuugccuuuuuuguuuuugcuuuuagaggaaagcuugcacagaauaacuuucccauuguugcuccuaacuuuugugauggcaaguucucaaaugcacugucgcugaccucagcagcugcacucgccaaagcauaccugagucauggcucucagugcuuucagugugacugacguugaucuaacaaaucucauaaccgccugcucuauuccauggcccauucugguuaaugggguuccagagguuuccagaaaucaggucuugaucauggggacuuugaaaguuaggauucccucauugacaauucuguuuuguucuauuugauguacaauacuguggcacucuguccuugacugcaaaacccaagaacauauauuaacaaaaugaauacauauagcuaaaaugaaacaaaaauuagcagcugcagcauuuuagcucccuguuggggaauagcaucugugguugaggaaggugguccucuagaagaccacugcucuguuacuaaaggugugcugcccaggcuucugggccacaggagugaagggcagagauucucuacaguaaaaagccuuugguccaaaaugagaacuuugcagcagaaaggguaauuuuucauggaauuauagguuguuuaggaccugagucuuagccuucuuguugucugaaaccagcuuugcuuacaagcauugaagcucauuugaacacaugugacugggauaauaaaugccaaaguacaguuuaaugaagacaaguguugugucuuucaguucuuaauaauuuaaucuucaaccacagccuaugacggcugcguucagaugggcuuuuguaauugaaagcaaagccuccuaacauuuguucaaccucucaccuacuuacccuuaaaagcugguccuggcgguguguugaaagggcaguuuggcagcaauggauuucaucguguuuuaagaugaugcuaucuacuuaaagucguuuuuaccucaaacucuuaaaaaacugaaaugcauccuauuucauguauagaaauccuuuuucauguuuuguguaguuguaaguuuuuguagccaguuuagaugugacuagggaggcaaggugagucagucuaggguucucugugugccauagcuuuagaagacuaaacuugugcaaacaaauguuucaaauaccuccucaaagaaaguaagacugaacuuucuucaaagaguauuuuggugcuaugccuuugcccuuccuaggugagaaacugccuaaaagugaccguacuccagagggggcuuuacauuauuuauucagacuugugcagauuccgagucauauuuuguuuuuauguuuuugauaggugaguccucacugaaauuauucuuauuaccacccguuuuccaaaaauacuuguuugccauaacauuucccuagccagauuuuauaugaugguaugcuuggaaaacaaagggacaaaagccucuguccauaggaauucugugccucguuaaugcuccuaucaguugaaggguuacaugacacagugugagccugcagacagaggugacaacgggcauuuucucuuguaguagcagagcugcucuuccuucgggccugcugcauguagguuucugaauuaucuggacuuuaguuggcuugagaaaauuuagauuccuccuuaacauauuuugaaaucuaaagaugaaauauuauuuguugugauagcuguuaguuguucuccagcucaaaccuuaacauaauccauucuuaacagcagugguggagauagaagggaggaguauaugaagaagucuugaaacuuuuuugcucccaaacuggagaaccaugccuugugaucaggacugugcaccucauuuuccccccauucugauuucccuucaugugcacccacgauagggaugugacugugggcagaguggcguaaugggguauguacugaucacuuggaguugcagguggcagaacuggucacugguugaacaguuugcaauaguccuguccuugaggaaacuguuacuagaacucuuuuauuaaaugaaaacauuauguuuagcuuauugaaaauaauuauaagcaauaauuuacuaaauacuaauucauccaaaaguguuggauuucauauuuguaacuuuauuuuguucauuacugcaacaaaauaauugcacuaauugcuguuauaucaugcaguacuaagggugcuuauucauugguagugcauggaggggguuguuauuacuuagcucauguugcauguuaaugaugcaugucugaaauuuguuguguccuucaaggcaugauggguggcuauccgccaggccuuccaccuuugcagggcccaguugauggccuuguuagcaugggcagcaugcagccacuucacccuggggggccuccaccucaccaucuuccgccaggugugccuggccucccaggcaucccaccaccggguaagaacuucauccucauucacucauuaaucucauuuuuuuuuaaaaauucuuuuuccugucucagccaguucuuccaggaggcacguucuacccaugaggccaggcuuuccucacacagaaucccagagcugucaguaguagggacuguccuauguguuaaucaggugaccuaccaccagcagcagaggauguacugcagagaccagauccuuagaucaaggagcuggaggcaugguccauuaucagauaggacguuugaaaagccuuaagggccacagccucuuaucagagaauugccaguucagagucauauguaaaaguacuuuuuacucccagagcauuucuuuaccuagugaaauucuuaucucauagggucuucauuauagagucccuguucuaacgcuuccuccucaguagcccuuuugaaguaaucagaacugcauaugugaagcucucgagcaauccuucacuuuguaacacaguguaggaaggcaaggagcuuuauauugaauuagucuugaguccccuaacaagcauaacaugaccuuguuagcuauggacauauuuguaugucaauagaagccaaaaauucuucuauguaaaaauauauaaauggaacucagaauuuacuacauuauuucacuuuauaaugaaaguuaaaagaugggaaaaucacaaguuuccauaauuuucaucauaugcaaaagaacuuacuuuuggcuauaaucuaguuagggggaaauggacuuuuaaaugacuuggagcagcagucaauccauuacugaaaugucaucgaagagagcccaaacucaugugaaaacucauguggguggagcagggcaggcuuacuuucauuaugcuuggacccauugcccauagaguucuacauggguucaaauaauagugaacccaauaguguguagggaaaacaaauguuaacuccaccauacuuuuuuaaaaauugugacaggaucaggcaggcuggcuuggaacucaacauucaacugccucaccaucccaagucagggaugacaugcaugcauuccacuccugcagugcagccacacucuguguuccuuagaggacggccauaauuccaaccaugcuucuauuuuauuuuuccaauguuuccagaggaagaaauguuggugguauuuguacuucauucaggauguggugacuuauguaaaaugcuguggcaccagaagucaaucagaaaauaaguuuucucauguggcaaaugaacuugguccuaaaucugugcccucauaccuuggcauaagguuucucugugucaguccgugaaaccuuguuggaguugacacuuucuaaauguauauagcacuugauaggauuccuguuuaaggccaguacacaccccaauuuagcagcugcguuuugaugguugugggggcaacacuagccucucuucucuugacuguagaaucuaaacugcuucggaaggaagcacagcacaccugauaauagucagggagacaggaacaacuuguuguaagcccaugcacagcugaucuggcuuugagcaucaaggggcucauauguugucucagcuccuguuuucaguggcuuaccgaaggcauguuauuuguaaacaggaagugggagagguugcugauuugugcugcccugcaaaucugugauacagccaguuuugggagccucccagucgguaggaucuaaggucaaugagugaccugcagggaucaggggccauagguuauaauguguugcugaaacagcagcuuaucuaccuugacuucuuuguucaauucuuaaaucaccaggacauggcugugaugacuggguuacaauuccaaguacuuggcauauuccuuuuuaagcagaaacuuguuucacuuuuuuuccuucuaccucucuaacaaauaaaagaugccuuguauuuccuggaagugacacuuaagaacucuaaaccuucaaaagaccaauuuucugcccauccaaaugggagagagauguauuuaguaacccaggccggccucagauuuacagcaauauuccuguuucagcuucgcaagugcugggauaacaggugugagcuaaaauacacagcaaaacaugagcauuuuuauacaaaggaacagaagacuaggaagcugguuccgccuagucccucuauacagaacaggacuuaugcuucaaggaacagcuuaaaaugauuugcugaugguuuguuaguuuuaauaaacugagucccuuggcuauuuuguuuuauuacaauagcaaacagauagcccugagaugaaaauugacuuaaagacuaaauuugggcuauucuguuguuaucaacuagugccugugagacagcaguugcucaugaacauuuacccaaggaaguuuacucagugauuaccagagagaauagggccacaaagucuuucucuauuccuucgucauuuggaaucugagguaauggcaacaaggcuacacugccuccacaucauccacugaaguaccuucucucugccaacauuagugccugagguaaagccagcuggugacuguaaagacacauuaagguagugacuccagccuccacaggguucaguuaacugcucuuccucagcccuguuuccugucccaguguaauaguuacuacgcagccugaucccacaggcuccaacuacagaagacuauaugauaagaagaaaagcacuuugaaaacagaaguguauucuaacuauagcucacucacucaggguaacccuagaauuuuaugcaggguuuaaaacagucuacgccuagaauguaccucuaacaaaguauacuacuacugugcuuuaaguaaccagaaacaaaagaauauaaauuuccuaauuagauucuuuuuagggugcuuaaagcuccuauccacacucaagggcaaagguacauagguuggcauuuaaaauggcaccagcucuuaucaguuuuucagucaacaaaacccagagacucuaauugugccauugcauucugaauuauaggugugaugaaucaaggaguagcccccaugguagggacuccagcaccagguggaaguccguauggacaacagguaagccuccuaguuuaauuuuccuuggacuugagauuuuuuuuuagccaucuaccuccucagagcaugugcccauuaucuuuuugacauaaucaucugaucccaugcucuuucagguaggaguuuugggaccuccagggcagcaggcaccaccuccauauccugguccucauccagcuggccccccugucauacagcagccaacaacgcccauguuuguggcucccccaccaaagacccaaaggcuucuccacucagaggccuaccugaaauacauugaaggacucagugcugaauccaacagcauuagcaagugggaccaaacuuuggcagguaaggagaguacuguugaaauacacauuuccucccaguccucacuacuucaagcucuuauacaacauccuuguaaagggaaauaaauuauguauuucacagaauaaaacuggguucuuugcauauugacccaguaaaaauaggcuaaaaaaaaaaaaaacaaagcucagucauaucauacuaccaucuucucaaauacauucuaauuuucuuuuucaauuuuucuuuuuuucagauauuuaagcauuagaauacaugucagauuuuaaaaaggggggaauggaaagcuuauuucuuuagucugccaagcuguucacuuaguugaaugggauguaucuacaguauaguaagaugguauuaccuauuuucucgagagaaaauugaaagauucugcuuuuucauuuuaaaaaauaaauuuguguguuuguguuaaagcucacaugugcuuuggucacauggaagauagaggacaacucucagaagucaguuuucaccuucuaccuuauugguacagggucucucuuauguaugcugcugcaguauuuacuauaggauaacugccccuugaacuugugggcauuucucaugucucagacucccaucuugccuuagaagauauuaggauuccugauacccagcaccacaucugccuuuuugucuggaauaagagaugguuauagucugacuuguacaacaaguacuucuaugcacugagccaucucccugauccuuggauuuuugguuuuuguuguuuggcuuauguugagaacuagcucuuaacauguauccuugaaucaguugccuuccucccucucccuucuaagagcugggaguacaggugcaugcaugugcgugugugauauauaaaaugugccacacgcaugccugguguccaccgucagagggaagaaaaagacaucagaucacuuggaacuguaguuauggacaguugugaguguccuguggauacugggaacugaaguccagcccucuacaagagcaacaaaugcucuuagccacugagccagccccuuauuucuaaacccagcuaggaaauguuaucucuuuuaagaauauuaaauaugauuucccuuuaggcaucuuuuauaacacugaagaaauuguuacuaguagggguguccuaaguggucagauaucaaugccuaauaaaccuugcuaugauuauaauuuauaucacauauucguaacauuaauaaauaguuuuguuuuaguauaaauacaucaacccuuaaaacuggggucauuuuaucauccuaaaauguuaacgucuguuuauacuuaaauuuuucagcucgaagacgggauguccauuuguccaaagaacaggagagccgccuaccuucucacuggcucaaaaguaaaggggcacacaccaccauggcagaugcccucuggcgccuacgggauuuaaugcuucgagacacucucaacauccgacaggcauacaaccuagaaaauguuuaaucacaucacuguuucuucuguggaagcaaagaguuguggagcgguagccauuuuaguuacuggggugggagggaggaacaaaggaugauaauuuuuauugcauuuuauuguacaucacacagccauuuuuauauaaggacacuuuuaauaagcuauuucaaauuugguuuuguuacauuaaguugacuaucaaauacacaaaagauuuuuuuugcauauguuuccuuuguuuaaaaccaguuucauaauugguuauauauaguaauaguuuuaucuuuacuuguuaaaggacuuaaaucaucaaagguuuuggcuuggcuuaggguuuucguuuucuuuuuuauaaauauauauuauauauauauacacauauaaaagaaaaaaugaaaaaaaaguuuacaaauuuaaguugacaaugaaaugugaaguugguccuaguuuacaucuuagaggaauguauauguauguuuuacaugccuaaauaucugcagguuuucuuacagguaaagcgaagugcuuugaaaaguuuagauuauacaugugugacagaugcggcauauuugcucuauuaacacagaggcuuacuauagaaaucuaaagucaaugcuguacauccauccaguuaguguaacugaagggaaauguaacuuugugcugaguuagacaucuguauugucagugauucuuguagaauaugugcucagaucugaguuauauuuaguuuuggaagguaaguugaagaguacuuuugaucaguuuaugauucaguuuaugauuuuaguuuuugccuucauguuauacauuuaugauuugaaacuguacaucuguuaccuugaaaaacauugaagaaaguacugaagugugcauggaggugguuuaagcauaauacuuaacccaagaaagaguguaaguggacacaagcugugccugcacauagcugugcaggguagacugccuacauacacauggccgggauucuuuauuuccuuguuaucaauuauagugcuuuguuuguuucaggguuggaauucucaaccagaaauaauacuuucuaaaauauuuuaaaauucagcuugugcuuuggauuauagaaggaaauuauacuuuaagaaaauguucacaaaaaaaaaaaaaaaaaaaggacuauuacagaucccaauacuuggauuuggugaccuugucuuucuuucuuuucuugagacaugguccuacuaccaacccuggcuggacuggagcucaguguauagaccaggcuagucucaaacucugccucuuccucccaagugcugggauuaagggcagguaccauagugcucagcaaccacaacccugucuuuccaacacggcccuagcguaagcacugaggcagugugcagugcucaggcagcagcaaacauuucccgggggugguuuugaaccugcuugggugguuguguggugcugacgcugccacugcccuguuguucauugagaaugauuguuaaaugacacucuuccuuuagaauauaacggaucaguacucauguuuaauugccaugcuuaauaaaucaugagaacaaaagaguauagaauggaaagcauucccugguagcuacuuuaaauacaggagcccuguaacuuaauaccaguagucaaccacuggaucucaguuuucaucaaguauuuuaaauaaauaaucuuaaauuuuaaaauacguacugcagaguaugccaguaucuuauuguuaaaacugaaucaaauaaaucuucgauuccugguuauuuggaccauugacucaucauggacuauauaauguaauaagauucuuuucucuuaagguauccuugaauuacaccaaagaaccagaaacuuaauuuugguuaaauuauuuauuuauuucaugcauuaauuuucuuuuucuuuuuaaagguuuagaugaggcuccuuagggagucucuaaaaccgcuucacuaucagcaaccaggaguacuagaagccagagcacucuuccuccuggcuccuccccagugcucuagugcuguaggaaccaagagccagccccagguuccccgaggcaguaaaaauccagcacagggggcugugucccuaaggcaagcccugauuaccuuuaaaaaaaaccaaaaaaacaaacaaaaaaaaaaaaccuaauuaacuaaagcauuuaaggcacuauuuauuuuagaaucaugcuuuugaagagcaucagugauuacuuaggguguaauauguaaagaucagacaucuccaaaaacagaaaaaguacaaguaaacaacacacuuucucaugacuuuuaagaacuguaguaauguggcuuaggaaauauaauggccuaauuguuuucaaaauguaaguuccugugaagaauuuuguuuauauuggguuggggaccuauagguuuaaaauagaaugucagucagcugacuuaaaaaacauugguuuuacuaagucugccuuccccuucuaaggaagaacugaguggguaagggacagguguguaaaaucuccaaauggauguuacagcuuucagcuugaacguuuguuuccagaccugauuaaaauuugguuuauucuaauuucuguacuauaucaucugagguuuuaagugguaacugguucuauaccauguauguaucauauguuuguucaucaaagcuuuuuaauccaaauaaaaacaacaguuugcaaagugauuuggaucagccagguuuggugguucuguuuaaagugugucaaauguuuggagcagacugaagacaauuccuacaagcccugauuucaucacgcugaggcugcuaguuuauguaagaauacacuucuggucaaggugagcuccaacauggagaccccaugcagccugacauccccaggacucucaggaugagcagcaugagcaggaacaaaacaaggguuucaaaaaggaaggacacauuacugcggguaggaagggagugucuagaagcagaaacugugaccauaagacaagugguccagguaaaccuuuaguuuuacaaguucuuaaaaugugucauaauuucaguagaaaaugaugguaaaaucagcaagcuguuuucuucuaacaccacuuugcaaagcccugugaauucuguccugagacugcagggagggauacacggccaccuaugcccaugagugaaggguuucugauaccuaacauuccacccaagcccuacacaaacaaauacugguaaugguuuugugccuuuuuaauuugaaaguauguaugcugggucagcuggcugaaagcuuaauacugaauaaauuaacgggcuauuacauuccccuucaaugggacguuauguauucaugucuugguggugguucauaaauguggcaagguguuuugauguuccuuuacaaggagaaaaauuacuuuggaaaacucuaugguccaagaauacacuuuucuuuagagaaaacucauuaugaaaaauucagacauuaaaagaaaaacuaaugugauuaagaaaacaauaggaauuuaaguuguccaagacagaacggcaugagaaaacuauuguuguucauugcuuacuauaugccuaaaguaggugcuguccccagcaguucauaugauagucuuuuucccaguaucacaauggagguaaguuacaguaaaugcuaaguuuuuaucuuucuggccuaguagcugacacuucuaguucagauacuuggggggugguggggaaauaaggcagaaagauugcagguucacagccagccuggauaauuaguaagacccugucauuaauaaaaaaaaaaauaaaaaaaggaaaaaggauggagauuccugucugguauauguaaagccuacgauuauuuuagggaguuaaaaacuuauacccugaggcuugagagaaggcucccagguugagugcuugcuguucuggaagauccacauuugauugccaguacacacuggggggcuuaugauuauugacaacucuagcuccacagguggccucugggcaccugcaggcauguguacauacacacauaucauuuuacuuuuuuuuuuuuuuuuuuuuuuuuuuuugguuuuucgagacaggguuucucuguguagcccuggcuguccuggaacucacucuguagacccggcugaccuggaacucagaaauccgccugccucugccucccaagugcugggauuaaagucgugcaccaccacacccagccagcuaaaacucuuuacgcugaguugauccuaacauuagcagcagauaaacucaaaauagggaaaaguugcuauagagaaaaaauuaagagacugucuauuuuuucaagacagggucucauccuaguccauccuagccuugaguuacugauccuccugccuccaccucuacugcaccccacacccaucuagaaguguuggugacauggggugacuagcuugauguuacccugucugugaccuuuaaccaucagcugcuuauuuuaaaacuuacuuuuuuuucaaacucacagagaccaccugccucugccucccaaguacugggauuacgccgcgccaccaugccuggcuaaaacuuacuuuuucuuuaaaaugcaggucacuuucuuguuugaaagcauagacauuccuuuuucuacuagugauccaaacucauacugggguccaacugcccaguugccuuuaguagacccugccugauuugacuggacuguauguuaacuuucuugcuugugugcagacugcacuagcagagcaguauguagucacuaaggaaacgacacacacacauacagcaaaaacuuacaaauuggaaaaggacagaaagaugaccuguguaguuacccuaguuaaggugaucuugaaaaggaggucuuuuacugccaugguguuggaauucugucaaaaaaaaaaaaaaaaaaaaaaaccaaggcuggggcuagagagauacuauucugcucuuccaagaaaaccaagcuuaauucccaauauugacacgagguaguucacaaccuucccagcuucagggaacccagugcuucuguccuccacaugcaucugcucucucacucaugcucaaauagacacagccgcaugcaugcauacauauauacuuacauacguacauacauaccuacgauuaauuuuuuuuucuuuuaaagggcuucacaaauaauccagacugcacugcaaaacauccugguugauuuuugaauagcuuaugaaaugucuugugagugagacacugugugaguuuuaggaagauaguauccaauagugacuucagauauaaucaaguagagacuagaacuaugaaaauucuuuguaaaggcaauuuuuggacuaauaaacaauugcuaaaggauuaggauucagaaaagaaugaauguguguggguguuuugccugcauguauauauguacaccguaggaguucaguguccacaaaggccagaagaugcuguuggagauagaaauguuugucagcugucgcguggguccugggagucccuugaaagaguaugaucuuaguggcgcuaaggaaacagagguagggauuuccuugaguuuaaggccagcccaguggagaguaagacuuauaaaaacacaaaauggcugaaaucaacacugaaaauucauauuuacuuuauuagcuuaugaagauugguuucugauguaucuuccagccuucucugauacugucuuucugaagcuuuucuacgguagacaucaucuguaucaaacaaaaguguugcuuagauuuuuaagaaacaagauuuuuuuuaaaauauuuuuauuuuauguuauaugcauuguuauuuugacuguggguagguggguggguguggaacccccuggagcuggaguuacagacaguugugagcugccaugugggugcugggaauucaaccuggauccagugcacuuaacugcugagccaucucaccagcccugaaacugaggaauuuaaaaacagaaacuggggaucaguggcagagugcuugucuagcauaaggaaggccccaagugccaccucccacaccgaaacuaacagucagaaagguuuauguugagucugagauaacaggguaaauagcgaugucuucaaagagagacuugugucccagaauccuguccugguauaucuuucuguucucaaagauuuccuuugcccaaggcucucugcugcucccuuuccuaaacccaaaaccugaggaaggagcgaaguaauguuccuuguucucagcagcuguuuuuccaaacuacucauuuucugcccucauguauaaaagaaaacaucuuccuuucuuuaaaaaaacaaauccucuuauuucaggguucauuugauggucauccucucagggauuuuaccaccgacugccagcucagguuucuugccugugaugguuucugugccuuuuuugccacccauauucuuaggggugaaggaccaaccccuuggccucccuuaugucuccgguuacaguguuccgagggaagaaugcugcuccgaugacaacugcuuuuccaguccuggcuuuccuggccuuggaguuuacucccuuccucuggcccuuuggcuuuucucuucccucucuugugccaaaacagcugaagaaguuacuucacacucuacuuacuaccuuaacuccuuggccccccucuaagacuccaaccagagauugcuccaacugccucacuucucaauucauguugccugaggcaacucuaacuggcucuguuaacauggcugcaagaguuuccucagcccugaaugacaacacucccuucauagagaaaggccacuguaaagaacucuaauuuuuaugguugaucccacugggcacuggggcuugugaagguggagucucacaguuccccacagccucccccgaccccuaccccccacuuuuucucagcagauugaauccaagaauuccugcaugcugaaacaagugcugcaccaagugagugacagccccagcuccaaccccgccuuucucaucagcauuugcauauccuucagucucuccucccuggucacagucacuuuuccuuaucacuugugaugguuuguaugugcuuggcucagagaguggcacuauuaggauuuguggccguguuggagugggugugucaccggagaugugggcuuaagacccucacccuagcugccuggaagucaagucgucuucuagcagccuucagauguagauguagaacucucagcuccccugcaccaugccugucuggaugcugccauguucucaccuugaugauaaugaacugaaccucugaaccuguaugucagcccaauuaaauguccuuuauaagacuugccuugguaaugauuguucucagcaguaaaacccuaagacaccugucuuuaagaauauccuuccagccgcacacuggaggcagaggcaggcagauuucugaauuugagaccagccuggucuacaaagugaguuccaggacagccagggcuauacagagaaacccugucucgaaaaacuaaaaaaaaaaaaacaaaccuuccugguguuccuucugaccacucuaagucaccuuaaacaugcugaagucugaugcuuccauuacagguuagcugaauggccuguaaacccagaugucuggcccaaacuguccuccugaacuugggaucuuuaacccauuucaucauguccuaccuuauacccagaaucacccugcccauggauuuaaaaauaaauaauuuuuaaaaaagauuuucuacuauuauauauaugaguacacacacuagaagagggcaucagaucccauuacagaugguugugagccaccauggguugcugggaauugaacucaggaccucuagaagagcgguuagugcuccuaacugcugagccaucucuccagcccccugccuguguucuguaccuucaguggaaguaucagcccugcccuucuguccccugagaaguucccaugcccaucucaauuaccagacuuaucaacacuacucuaagcugucucaggucuacccacuucuuggcauuccuucugccagccugacuaggccaucagcucaagucuggccaaccacacagugccuaugucucuaucaaaauaggcuagagcuggguguggugucgcacgccuuuagucccagcacucgggaggcaggcggauuucugaguucggccagacuggucuacagagugaguuccaggacagccagggcuauacagagaaacccugucucgaaaaaccaaaccaaaccaaaucaauaggcuugauucuucuuguccaguacuuuuauggcccugcacagggacccuucuauccgugccaccuuucacgcugugcaucagcugcagucccucggaacagcauacacauaagccuccagguuuccagguucaccacugccaugaagugagcuucaucgaucuuccccgauuuaccuggguaacaguccuaaaugucuaucuuuccccaaaggccuuccccauaccaucugauccaaugaaguggccaccuaggauucuuagacuacucacaaacccuuauggcaugcuuaaugguaggggaagggguuaaaauggaguuugggaucaugugaggcaauuauucuccuaccaaacuacaccaugagcucuucugaaacuugccuucuucgcuagauauucucauaguuauuaaacauuaaguggaggcccaugccuguaaacccagaggaugacucuaaguuuugaagauucaaggccagcauagucgggcuccgcgucaaaguauagaaagaguaaucaggggcuggagagauggcucagugguuaggagcacugacugcucuuccagagguccugaguucaauucccagcaaccacauggugguucacaaccaucuguaaugggauccaaugcucucuucuggugugucugaagacagcuacagcguacucaaaauaaaucuuagaaagaaagaaagaaagaaagaaagaaagaaagaaagaaagaaagaaagaaagaaagaaaggaaggaaggaaggaaggaaggaaggaaggaaggaaggaaggaaggaaggaaggaaggaaggaaggaaggaaggaaggaaggaaggaagaaagaaagaaagaaagaaagaaagaaagaaagaaagaaagaaagaaaugaauggagguuuugaaagaacaaccuaaaauucucaaaugguaaguuacaugagaggcagacaaagggcccaaagguugggagaaagccugaaaggaacuggcaguuccagaggccguucucagaaaugccagacauucuuuucacaguucuaggucaaagacauaaccuaaggagagcgagugaccaguaguaauuagcuaggacagccgggauaacuuccucaggaguuugggcuaaagcucucaaagggcaagggccuuaaccugaauuucugagcuauaucucugaauuucccucaggacugguuccucuuccacaugcgauuaauccuguuccuuaggcccaaagucaccagcagggccaaggacaggcuacaaagaccugcacggccugacuagaggcacgugcccucuucaaaugccggaagaggaggagggcuggaugccaaugugaacaaaauacaagagcccuaagggccuccugccucgcugcacgagaacugucaaaacacuguuccuaacgcccaaagugaaaggaacucugcaacugaauggaucgcauacccacgggagaaacggaggcugcugcacccucacuuacagaaggucuccuggcccacgcgcacuuuaaucaugauccacuccaucgcaccucccaggacaaaaaagaagggcaggaaucuguagaugccgaaucgcugcuugccgggcacucgcugaagagcucgccucaccugggcccuggagaacaugaccgaggccucccagugggguagggacggaaccaggcagacugguguucccggaggcaguacaaauaacccugcggaccccugcguguccgcggagucccguggacugagcaccaagacucgacugcagcgccacagcccggccgcaagaguuagg

SEQ ID NO: 7342 - RNA, 46024 nt, Mus musculus
cagagcacaauagguccguggugaguuccucccaagcccaugggcucuacagggaucacaguucugcccuaaacucugguguggagugcauuaaaaggagccaaggggaagaugcaccaaggcccugaaucuggguaagugggacaccccccccacacacacacacacuuucagagcaguuucuggaccugcugaccccaccucucaccucacccugcccugaacucuccuuucagcucccaggguucuagaaacacccauaggguaggccucccagauggaauggccugagaccucagaaggggggaagcaggaugcuccccaccaaccuuucagagagagucauggcucagaccacagacggcugagaacagguucagcuccgcccuggaacccuccucugcuucugggccuccuggagggcuaguguucugggaccuuaccuccccucccuaucucuucucuagaaagaaaacagauuauuccuuggcucagcucaagaaggaccuauggcucguaacuucaccucccugugccccuggacccuagaacacuaauauggugguggugguggugguggugguggugguggugguggugguggugguguucuuacuuggaagcagaucaggcgcugcucagagacaccaguaacuggcuccuucccaccucugccucugagucugcugaaggaugcaagccuuuauuuccuggaucugccuucuccugaggcaaggaccagccauccuguguaggaacuuacaaaacugaagaacgacgccuguacagcagaggccgcuacaguagugguucuguccuggggucucaguaggguggagacauucugcaucuaccucccuggggaaacguggugguaucuagcccaggcugaggccuucugucuugcuugagauugagcugaacacccaguccuuuggccagcauguggccccaagcagagcgugugagcagaggaccaaaccacuccuccauccaccaucgugggggucucuacucagccagaccuucagcugcggcugugucuacccggacaggcuuguggggcaggcaggcuacuucacagcacagaaggaagccuagaaacccaaacucaaguguguggauccugucagaugucucacucuuccgccccccuccccaucccucccuuccuccguuucccaggcuagagaacaggaucgagggcuuuccuaaaagacccuuccugccagcugcagauggcauccggaaaggcacccugaaggcacaggucagccagccuagcacagacaccccaugccaccuaauggacaaagguggaacuucaugagagagcaaaggugccagucuauuuucgugcggaaacccucuccugagaaauccagcgcuuaccugggcaccacaauacaaagacacagacacaacaaaagaugcaccagugguuucuucuaaagggaaaaaucuuaaggaggcuucauggagaaagcacuaccugggcaaaggaugacguaauucagcgguggggaggacaggauuaggugaugcacacaaguggccuuagcuucagggagcuggggcuccuggguugauucauaugugaugugcgugucccuacagcaggugccaccagguggauacacacagggucauauagcccagccauuccuggguaaaaugcugaggcaauaaugccggaagaauggacuccccuccugccuuuaauccacauggucuuuuauagaauucccuucagcagaugggucaugaucuccuucaugucucccagaacuguucccgccucugucagcugcugaggagagagccagggugggcagaggcauucucucuuucccuaacguuucuucugggcaguucucacuucuaaaccccaggaguauggcugcugggggcugcacuagaggcagacucacccaucuucuuccucccaucacagugggcuugacucuguucccuucccaucagcucucacugcccaucacccugccuccuucacauaccucagccgcucuucaaguggucgcccaggccacaccguccuuccucuggguucuaccacuacacucaguagccacacccacacugccaucuggaccacaaucuuucaagcauugaggccacuugucuacccccucaccacugugucaagccucacucuuccuugcccaguucaaacugugggccuagcacuaugacccaaccuuguggacaauggugacugagguguccugcuuuuguuuguuuguuuguuuggguuuuuuguuuuguugcuguuguuuuuugagacaggguuucucuguguagcccuggcuauccuggaacucucuguagaccagcuggccucgaacucagaaaucugccugccucuaccucccaagugcugggaugaaaguugugcgccaccacugcucagcagugcccugcuuuuuuaucaucugugacgcguuguucuugccagcaugccagucaccccccacccauccucagacaccccucuucuuccuuuuucccucuucuuccuuuagccccugccccuuucccugugcccccgccccuuccucuguguccccaccacuuccuaugugcccauuccuccauccucaacaccucugaucuaaaccaguacuugccuaggcuuccauaccucaagaaaugucacugugaccaaaacucagagagucagccucgagucccugguccucuaaaguccgagccuucaacaauucccuuuacgaguuucauauuauuccccaaacccaggaucuucugugcccucuccuugggcauccacaguaagccacccugccuucucucccggccacuggcaggccuccuggcucucucacaacccuucccccuuccgcagccccgagugccucacuucuuauguaagcugagcugcucaggagugugcaauguauaguguauuggcaaaccauccugugcuguuuaagcuuguugagaguggacucugggagcaaagggcggcucuucugucccagaucccagcaugguuauuucaacuauuuuccaaaauauuuccuguggcaaacucgcccccuagcucugcaacaggagacagauuaagucuaagaguaaaaaaaaaaaaaguuguguccuugagaauagccagaaggucaaccauuuccaacugauauuccuacuauuuaauccuauaauguaaaaaaugccugcaguggggcugaagccauggagaagaaggcuccacccaagaacaucuggcuguuucaccuugucccguuggacucuggauguugggaggaccugauuugauauugucuaaucugcugcucuguguucuuuuacuuggaagccuuacuagccucaccgagaagacggucuccuccacccaagacucucuagauggggaacuccaggcgguugcccaaauagggcuuccccaguugauuuuagcuggauggcuccgaucuccuuuugaugguauuuucuguuugcacugucaauggagcugugagggcgucucacucugcugaguaccuggcuugaucaugucagcuacuguuccuucucgcuaucuaggacucacuauuuauucuuuuaccuuagcuuucuacaugccuacuaaacucauuuguaaaccaaaggcagacuaccauagaucacuuccuaagcacgacagaacaggaggccugguacugcccaccucucccugaggcagcuggggccaggcuuucgucauguuugagacccauuccaagucuuuccccucacgcaccccacaguuguuucacugguguucauugggguucagcucaaaaccaccucuucuaggaaucauuccaagacgacuuuaugucaggccagcacaccguucuguuuuuuucucugaauuccuuugucuucccaucucccaguguuggcuagacaugcuuugggauuaggaaugaggccucgcucugauguaccccagcaucuaacccuguaauugcagacaggguaugucgacgggucacugaaugauguacuagcaggcuaccccacccacuguggcuccucuuccucugggacaucagccuugcugggucacucuggauaucuucauaggaccccaagcucugcaguucccaaucccgaaggcauggcuuugcagggacugggaacuccuggcaucucuugccuggcagaggcaugucuagaauuccaagacuaucucuggaaugugcagccugucuggagacugcuuaggcuggggcacaggugcggaggcaauacagucacagggcggagcaaggacagcugcuggcauucuggcuggagccugguugucauuaucagcugucucuccugaagguauugcuacaaauaccuccacuuccuugaaagcccccaacuuccccucccuagucacuguucuagcugcagcucugaccugcugcacccaccucccccucauaccacuuguaagcuggggaugucaccagaccuuaggccuuuauuuccugucaggaagaaagaccagguaggugacuggaggccagccucagagggucaaaggaacuagacaguagguccauuugaaccaggucugucagaguccuugguuggcugcaagguaaugggguucuccugcaaauuugccaggugaccuuggcugucugagacaugggguccucgucuguagaaugaaugcuagaggguagagcaaacuacaaguucuccauaggccgggagucaauauuccuguaaaaagccacaagguagagggacgacagugcuguaagccugcuggguuucaggagguuuagcuucauuccaaacaggauggagagguugcugugccaaggagcacccagugcccucugaacuagcuguucccauccugagagaguaucugucggcugacuacuggcugagccuggcaguucaccaccccuuaccuccccagugaggaagugggaauggacaacucugaaugccggucaaaugucuacucuacaccuuucaugaguuccaggagcuucuuagaauacaggcucuggggcuacagcagggccuaguuaucagggguacagagcacgaugucucggaccugaugaaagucucuggcagaagguggguugagcagucagaauacagacucugcagccaaccugacagggauggugucaucaggcaagagggaaccccgagaaaagacugugaccccaggaaaaccagagcaagauaccaggccucuggggagcaaggauuuauuugcguuccccaggacaggaauggggagagaaaguccggaagggccaagguucaaggacacaggcaggcucagagucuagagagcccagcugcacuccuaccacggggucuggguggagggggagaacaggcgcaggcaaccgugcaagaccagcaucuacuccacacccuucaugaauuccaggaacucuguggaaagagggccaugauguaugugucagugguaggagcccugugaaagaugaacaagagggcaccugguccucccacccacucaccgucauagucaauucggccaucguuguucuugucaccguccuucaugagcucuucaaugucaucuuccguaauggucucaccuguggccugcagcaucaucuucagcucaucuaagucaauguagccaucagcguuucuacagggagggagcccaggaggaugcggaggagggggaggggagaggagagggggaggagggagggagaggguaggggaggauguggagggggggggagacggaaggggaggagggaaggagccaaacccacauauacaaccccaggaggcagggcaggggcauuaggagaugcacauucuaugucucaccucucauuggaugcaaagacugcagggugucuacccgaaacuacucuuucuuucuuucuuucuuucuuccuuccuuccuuucuuucuuucuuucuuucuuucuuucuuucuuucuuucuuucuuccuuccuuccuucucucucucucucucucucucucucucucucucuuucuuucuuucuaucuuucuuguuuguuuuugcuuuuguucuuuucaagacaggguuuuucuaugcagcccuagcuguccuggaacucacucuguagacuagguugaccucaaacucagagauucacuugccucuaucucccgagugcugggauuaaaggugugcgccaccacugcccagcugaaaccaccccuucuccucucugcuugggccagggucagaagccaagcaaguccucacuugucaaacaugcggaagagauccgacagcuccuccucagacuucccuuugcugucguccuucaugcaccgaaccaucaugacaagaaacucaucgaaguccacugugccacugccuguggguaggcagcagggccggagagagaacaguuagcauuccagcaauccacgccccccccccuccuccccacacuauagggcuaguguguuccuuugcccacuccucuuguuugagauagaaccuugcucugcaguccaagauggacuggaccauagagagcuaugugacccaaucagacugacuucaaacucacagcagaucuacuaccucagccuucuuggaaucacaguaugagcuacuugccaaguuucuggaugagauggugaagauauggaggggagguagcuccugggccagugaacccagggugcuacauacacguguggagacuggagugggugaagggacucaccauccucgucuacuucgucaaucaucuccugcagcuccucaggugugggguucuggcccagcauccucaucaccuugcccagcuccuuggugcugaugcagccauccuccgcgcccaggacaaagauaucaaaggcagccuugaacucuggguccaacagagggugagaagauuggaucagcagccaggaggacacuaggaauccaggucccuggggccaccaggaaauuguccaccucccuucgagaguucuuugaggucacagcaaggagaacccucagauuauagccucuaaucugggguucauuccuggaaaggcguccccccucuacgcccccccagcccugcuguccccucaaugggagacacuuaccauucuucugcuccucugucaacuguucuaccuagagagaagaggggaacucaggaccucaggacccaagcucaggccuuagcagacuuagagacugaccccauucuacaggugggaagaaugauaacagaaggagaauauauucccagguuacaaaguccuccuucccugcccuaaggugacccagaugguuucucagaggcugggcuagggccaaggugacaggcaggcaccccucccaggaccaagguguccugagugacaauagucauugaccauugcauguccuuuaugucauccuaaugaaacuuaagcugcauggccugagagacagcugucccucagguugagacaauaaaacgaaugugggggcgagcaaagccacccacuguaaccugaccaggguggccacugagcuauuuuuaaagggggacaaaguuaaaccuggugauuguucuggggacuuugguaugcagggggugggguaguguuaucugccccccuggccuacuggugcugccucaggagccaaaauuaguccccagccccgccaggccuuguaugggcacuggguggagggccaccccccuacuccagcuccacagacuccuacaagauagccaaggauaccauaggaaccagcugcagcccuucccugcucacaaguggggccauauuccggggguugggagagaauuuccugagaacagcuguuugcuaggauuuucuugucucugaagcagguauaucaaaagucccucagcguccccaggaaaucgaacagucuuagggucacuguucucuaacccugacucuuaucacucucaacuccuaccuaaccccugagccugccagggacugagguuccaacaagccauuccuucuucccucccucuccucaggccuguaccuucaaagcaucuuucccaucccaggacucaaguucuccagcccucucacaauucccucccaccuucuagagccuccucauccagcucaggggcuagaggagagaggcagaucugaguauguaagaagcagauugugagaaauggaagcuugggagggggugcggggcgcagaccuggagacacacagagagacaaagacucagagacaucgugaggaaggaacagagauggaaagaccuugugaaagaccaacagaugucuaaagaauaaaaacacaaauacacucaagacagugacagguuagaaacagagggagacacaggaugcugaaagcugagaccauaccccuagccacauugacaaaccccugaauugcuacccuuucugcaucccccaaaugucagcucaaggggcuggguuacagguguguggggacccuuuugagucccccaucacuucccuaguguaccccuguccuccauccuuagcuaagggaaccccaauggaccuacccacccuaaccccuuaaagauucaucucucaccgcagcuuuguagaugucauccauucuggcgacagcucacaggacaggcuacugggguugccagccagccagcccucugcuugggcuuauauagcccugccucccuccaccuccugcuacauucccagcccagcccaccacugccuggaauauccuccacccccucccuggucccuguaaucucaggcuggccaaagucccuguaucaucugccuagggccaggagcuaugaaggacugcaaggaccaggucucuugccaucuguuccccagaccccaccccacccccagggaagucucaagaaaaaaaaaagaauguauugcuuuuauuuaugagugcauguggaagucaaaggacaacuugcaggagucaucuaucucucucugcuaccuagguucccaggaacccaggacugaacucaaguuuucagguuugggagcaagcaccuaaaugcaauacacacacacacacacacacacacacacacacacauccucaacaaccucaggaaaaaguuuccugaaugaaugaaaauaugagcacacaggaaaugugaaguaaacaguucggucuucuauggaaucacagugacuugccugaggucaagcugaccggagaaucccuaccuuauauuacacccccugagagaugguagcaugccaacagaggcuggcaguguaaguccugccaagaaacacuuccuaugcaagguucagaguauaauaugacacugguaauggaagaagucacuggcccacaaagaauaggcuggccugaagcccuucagcgggaucuaccacgccgcaaccuuccaucuuucaaggacaacaaucaguguucacuucggguuugagucagcugcauucugugagucaacaagugucccuaaagaacccuaugucuaucaggauucucucuuuuccuccuccgguugggucaucucuucuccagcuaagucuucccuaugguuguucccuauggauguuucuucagccacgcucuuguguccaaggccuagucugucuccuccucaccuugagcucuugcaggaugucaucugggaaaccagauggacagcgcauaucucuuccauccaccugcacgucugcugcauauaagcucucccugaacacaccagugugccgccuagcacacugccaggggaaagcccgugggguacugagcacugcagaaucaccacaaucaauucuccaccaguacuuuuaacaacaaaccccccaagugucggagagucccucugguccuuguuccaucucuaagucuagucuuauucauuuugcucuugcuacacagggaaugaacccaacagccaggcgagacccuauuaauguccccucuggaaacugaggccaagcgaagcagagugacuucggagaguuccgaaggcccauggccucugcccuucccugcugugagcccagcggacaaugaccacaacugcccgaggggacagaacgccgcacagguauacagaaagcaaauugggcaagcccgcaggagcugcgcaugcgugccacugguugugcugucaauuacgggcaaggggcggggcgaggacgcaagcaggccgaggggccaagauggcgucgcgggcgcgggcggggggcagcgggggcuggggggcggugggacgcugaccccgcccccugcugcugccacucugcgccgggcgucggcagcgguggagccggcaacauggcggcugcgacacucagcuucggcccugagcgggaggccgagccugccaaggaggcgcgcgucguggguucugagcucguggacacguacacggugugcuggggggccgcgagcguccagagcgggcuuagcgccuggaacccggaguucucgacccaggggcuuugagaagugggggguggggggggccuggguagcacauucgaugagugcguggaagguucugcgagguagcgacgagggagcccgaaaaaaaugggggauucggaggaagggccgggucgcauagguucuggaggaggaucuaggcggggcgcgggaaggggggcuggggaaagggugcgcgaccagaaaaggagacuuguguuggagcaaucagagggugggggaggaggggauggugagauggaggcccucuggauccuccaggcaaggaagaaugccagccuaagagaccuucaugggaagucugggaggaaggggacgcggaagggguggucucuggucgaugggaccaagggccagggcuagagaucaucagguggugaaggagagacagcagaucccgaucuccacccccaccaaccaaacacuagucgcaguccagaucagcccugcgaagugugugugugugcgugcgugcgugcgugugugugugugugggggggggugguggauggaaaaaugagcccucggggucuggggagaaaggaauggaucccagccgugcagaacacagaaguuaccucgaggccgaaguacagggccugcaaaccuuaggggacgucacggcuuaggggagagggacacgagcuucuaauguauccuuguaggcuacaagggaaagccaacaaaaaaggaggguaguuucugugauggcguuagacgcccuuugggccugcauaggguuggaugcuaggcccgagagccucgugggcagccugccaggugaaaacuugcacuguggugggggcccacugagcaccucccgucuccuuguccuuuguucccuggaggguggacagagguaagggccucgggccugccuuugccccaccccacuggcucccacccuaauaccggauccugagggcgauuccucuaucuaguucuuucuccccgcugcaaggaagagaagccgcuagcggcuccuuuuagagcaacaggcuggcucuggagaaauggcugcuccuggggucaggaaucagccucguucacuguucccacuaaccucuccgugcuccaggccgaggaagggaagcuaggaccguggggcuugaucuaguuaaggaaugaggucacucaccuaggacuagcugcagucaguagaggcucuuuguccuuccccuuagugucaggagcaaggugaugauccaaacugaccauccucauuugucacugggugugaugcacggaaugugacuaacauaucuaucuucuguuccguguuaggccuuuacacuuaauugcuuuacuuggcccaccagguuuuaaaauggaggaauugaggcccagagagagcuuagguucccagucacuuacauaaguggcacauaagccacacccaggaaaugggauagccagauuuugaacccagguuuugguggacgauuaaccaccagagcuauaucgccuucuguugaggcugauugagccaccgcugccccuggaagccuggugaugccuugccuccugguucagcugccaaagucaaaaccacagcuaguggaagagguugacugaaggccuugcuucuaggauggaguuagggcuccuggaaagauguauagcagagacacuggugcugccucacugggcucugcucugccucccuuggaaggggcagccuugccuauagcacaaguuggguuuugaguuauacagagacaggagguaaaaaaaaaaaaucuaaggagguguguggagcuagucacccauaccauuccuuccugauaaugggagccagagcucuucuccagaccuuacagggcugucaaggaggcugaggaaagcugggugcacagugggugugcaaggaugccugacucuggcuuuuuggggaguggggacugaguaccuugcagcuauugugaguugggguucucuugucacaaaaaaucauuuuucccuuuagguuuaugucauccagguuaccgauggcaaccaugaguggacgaucaaacaccguuacagugauuuucaugaccuacaugaaaagguaaucugaagaccuuggcaccuguaucucaagggguggggcuugugggccaagucuccauugugccacauguuaauuuuagggcaaaacugccuccacaucuauugcuuguaaguuuuaaaaacauuuauucauggccaggguuauaccacacauaccuuuaauucuagcagcacuugggaggcaaaggcaugugaguuuaaggccugccucaucuacagagcgaguuccagggcuacacagaaccugucuuauaaaacaaaacaaaaaaacaagugugugugugugucugugugugucuguguguguucuagugagaggaagaugcacacgugccacagcucauguguagaggucaguuugugagagcaggguucucuuuccaccauagaggccccagggauugaacuuaggucauuagacuuggcagcuccuuuacccggugagcccucucaugagcucugugacuugcuguaguaaaccaguuccuugaugcagcacaaagaacugguuggugcuaggaaugcaaccuagugugagacagucuaaggauagaauauguaaauuuuaauuuuaaauuuuaaaauugccaugcaccuccaauauaagacagucuccugaagaggguacagguuugaacuugucccacaaaauauauuuuuauucucuaauaacagauugaaauuguauuuucccuuugcuuuuagaaagagcugcuuucuguggggcauuuguagugagcaugucuuaaagauacaaacuccuuuuauuuccaaacuuuagggaccguaagcacuacuuuucugaauauccccaaagacuaaagauggcaauuucucacuuggaauuguauuaguauuuccaguacuacuuggauccgaggccggauuccagaugcauuaguuggagcacuaaucccggcccugcucccagcagugguugcagaagauacgacugacgacugccugccuggaucugacacagacgcagggcuucuuggucuguguuugaugugcuuguguucucuuacagcuuguggcagagagaaaaauugacaaaucucuacuuccacccaaaaagauaauugggaagaacucgagaagcuugguagagaagagggagagagaccuggagguguaccuccagacgcuccucacaaccuucccugauguggcucccagaguucuggcccacuuccugcauuuucaccucuauguaaguuccuuuggggcucucugcuuugccuaugaacccacagccaccaaagcuguaggccuuggcuuugaggagacacagacuggacccuggcccugagguuaccugacagaggguuagaggcagaugguacacagucacauuuguguugguggguuuauauuaaauuggacuggccauguauuuucuucuacuucaugacauuuuacuuugcagaaauagcccaugguuugguuuuuuguuuuuguuuguuuuguuagauuuauuuauuuuauguauaugaguacauuguagcggucuucagacacaccagaagagggcaucagaucccauuacagaugguugugagccaccaugugguuggaauugaacucgggaccuccggcagagcagucagugcucuuaaucgcugagccaccucuccagccauaggccaugguuuuuaagguagauuucccucaauugggugagcauggaggagaacuguguaaugccuggcauacacuuaggguugccaugugggcucagacucaguaccaacaauggagcuguucauucuuuucuacuuuuaagauuauguuauuuaugcguagggugcgugcaugccagguaaaugcgugcaauccagaagagaguguuggguuuccugagguuggaguuacagguggcacaggccaggccaccugcugaacuggauucggacauguacucuuggguuuuuuuguuuuuuuguuuuuguuuuuguuuuuuugguuuuucgagacaggguuucgaaacccugguagcccuggcuguccuggaacucacucuguagaccaggcuggccucgaacucauccuccugccucugccucccaagugcugggauuaaaggcgugcgccaccacugcccggcuggacauguacucuuaacuaaagaauugccaucaugggacucauggucgacacccccacuggcaguguacugaagcugaggggacacacuucuuuuguaugggacaaggcagcauagaucagcucugugcucccugcuggguagagaauggugugccacugcugacagaguaaaucacccugagcagacgcuucgucaguuuguaacuguccagagacacagagugggaccaugucucaaaaaugguaaguaaguaaaaaguaauuuaguugucagaccuuggggaggguaguuuagcaagcagugugaaaugaaaauuucaaaagcuacuagcaguuuacuucugagaguuuauucucaggaaagauaggguaacucuaaagggacacgugaagaaaggcagucaugucaggauucagagcaagauacugaagacaagaugagaacacugggaagaacuuucauuuaaaaaaaaaaaaaaucaagccaagccagguaugacgggacacaccugcaguucuagcacuuuccagacuauaguucaaagccagccugggcuacauaucaagacuugucuugagaauccaaacaaggcuggguauaguggcacauaccuucuaucccagcaggcagaagcaggcaaaucucuuaaggccacacaaugagaauuuugucuccagugaaacaacaaaacaacaaaaacguggucagccaugcaacuggagauucuguugugguauggcugaggccccacugccaugggaagauaaacaugcaagagcaaguccuaccgugcaggcgcacaccuuugucccagcgcucaggaggcagaggcugggggaucuuuguucuaggccaaucaaggauacacacugacacucugucucaccccccuucucacccuaaagacccacaaaaggacagguuguaaaacgguauguagacuaggguucugguuuuauaagaaaaagggucacauagaaaucauuaucuaugaaaaacuacauguagaaguuuucuuucagagguuuucugauaacauuuaauauuuaauuauuuuccccuuaaaugaugaagguagcuuugccuuauuggaaguaccuucuuuaaaaauuuuuugaaauugcaaaguaagacuugugggcauuauuagccugagauugggguuugcugauguggcuaguguccugccacugagcugggagguacuguacacaguuagacaugguuauauaccagauccuguuguaaaugguuugguuuuguuguuguuguuguuuuuaauuucuuuauguuagaaaaaaauucucccuugcuaugugagucuguuaaauaaacgucacaaaacuuccaaucuccacugaagaaugaaaccugauaaacaucucuuugaaggucugguuuauugcuuaagucugugucuuuggggagagauuuuccuggcugccucagguuugcccaacucugaucugggaaaggucuagaauguucuuuucaguuggacuuuccugcgauagucuggggccagccuaacucuugugguucugguuugacgcauggccucggagcuguuuggacauacuugacuuuguuaauaucaaacauauacguuggucguauaaaucuaaggcuuuuaaaaguaacgagccugucauuggaugagcacagggguucucagccauggcacugcugucacucugagcugugagggacaguagcaccccuggccuccguccacccgaaaccauuuuccuucccaguuccaucagguacaacuccacucucuagaggagccgacgcccaucuuccaggggugggggagcguagugggggcaaaaaucacccaguugagaaccacuggguuagcucuccauuuaaauuugaucccacgcagggugauagcacuguuagcuuuuuugugggggugggguggggaggcucucuggggaaucuuuucuucuuagccaucaucuuccucagaguuguuccugacgugugucaugugcagacacuggaggaggcagauggacauggagaucucuauuuggccaugguguggacuguuuacauuuuacuuuguuaggacaggcucucacuauauagacauaguuggcguaagauuggcucuguagcccaggguggccuugagcuugcagugacuuccugccuuccuccugcgaacugcaguuacaguauauguccacauagcuggccuuuugagggggcuuguuuguaucaagaaggguuucuuuguguagcccuggcuuucuuggaaacucacuuuuuagauuaggcuggccucaaacucaagagaucugcccgccugccuuugcccuucaagugcugggauuaaagacauggcgccaccacaucuagcuucguacccggcuuuuugucguuuucucuuuguuuaagaggaggauuacuuuuagaucgggauaucauucacguacuauaaaguuuaguaaguauacaauucaguaguuucuaguugacucacggagaauugugaaaugaacaccacuguccaaauuccagaacacuuagcccuagcugugucuaggggcaguaaguauuugucccccuccuucccacccugacagucacugccuugcuuucugucccuaaguuugcuuguucucaguguuucagauaagugguucauacaacagguagcaacuuuggcauuaaacuuuuaguccuuuuaugauuaauauggucuucaguuacuacauucagaaaucccuuuuugucugugacuuaaucccaugguuucuguugcauauuggcaaccaugcuuugaaaauguuaaauguagacuccagaaguuucauuuuucaugaauuuuaaaguacaucccguucugagugguguggugguuccgucgcucacaggauuuggcaucuuuucugguguuuccacacugugcauacaucacuuaguagccaucucaguugucagaucauguguuccaguaucacagugccguguccagguaacugacuaugugacaguaacccgaagcaccugagccauggugcuggccauucagaugugccaaaaugugccacgaaucacguccugugagugcaauggucaaagaaaaagauacuuugaaagaccacacugcaucauuuuuuuuaaagauuuauuuauuuuauguauaugaguacacuguagcuguacaagaugguugugagccuucaugugguuauugguaauugaacuuucuuaggaccucugcucgcuccagucaacuccacucgcucagucccugcucccuccggcuaaaagauuuaauauuauacauaaguacacuguagcugucuucagacacaccagaagagggcgucagaucucauuauggguaaccacccguaauaaaugagauuuauuuauuuuguauauaugaguacacuguagcuguacaaugcaguauaugaacuguuuugagcaucuguggguuuuagagcaugcccccuguagguaaggagggacugccacaccauauuguguuuuuccuucaccauccccuuauguaaggugauaaauauauugcaaggcccccaguaaagagcuaaaagcagggcuaacgacccuacccaugcauacacaaaucuuugcuacauccgcaagucuguuguuuuucuaucuuaggaugguacuuauuauguauucuaaccagagcuuuuacaguuugaaauaucacagcaaaacuagcaggaaucuccucuucauaauuuccugggcugaagauuuauuuuuaguguagaucauaacucauuuaucuucuuaucagauuagaaacuuuucauuguuucucuucuggagacacuuuaagacgugucuuuggcacaucugaaucucugcaucacuacucuugcauguacagacgauccuaaaaucaagaaagaguuacgcacacacauuucaauacugugguagccaagguggcugugagugacuaguccgugaugauagauuaaguaaaugugccggacaaggguggcucggguuccaggggacagagugggacagcuggaggcuuccugcuacucagaaugaugugugcuugaaaacuuaugaacuguucauuccuggcauuuuccauugaauaauuuuggacuguaguugaccaugauuaccacagaaacugaaacuggcugggggagguuacagccuaagguuuuaugugaguguguguuucauaccuacuucaugugugcccaggaggggaaggugagcuggaggagccaccagacugcugcuccguacauucucagucacaguguguaggcugcagccuccccagccugccuuacaccagcacgugugccgucuuagcccauaccccgcgggagggguggaguagugucaucgugagcuuggcuugcacuugcaccaugacuaaugcuguugagaauuuuuuauaugcuuauuugccauuuguauuuuuggagaaauggauuuaaaucccuuguccuuuuauuuaguaucggggcuugcugcuguuguuuuguuuguguugaguuguaagaguucuuuaugaauucugggugcuaaacccuuaucagaagugugauaugcaaauaacucaucuuguuccgugaagguuuuuuuacccuuuguucuuuuuuuuuuucuucucuuuuuuugcgggaggugggggccugcagaucaaauucagggcuuuuacucuccacauguggagccccacagagcugugcucacggccucuugcuuuauucuuuuguuguuucucaggacauggucucuauagagcauaggcuggcuuagaacuauguggaacaagcuggccucaaacucaccauccuccugccucagccucccaagugcugggauuauaacauguaucacuacaccuggcuuuugugacuugauaguacccuuuaaaauguuuuaucuauuuucauuucauccuuugaagcauccaugcuuucgguuuugaccaaguccaucuuuugcguguuuuggccacauguuuugggaaccauaucugagaaaccaucccccccccccccagugucacaggaauuuauauuuucucuuaugaauuuuguuucacauuuaggauguugacccauuuugaguucauuuuuguguaugguaugaagugagggggagguccuagcuugauucuuucaaaguauggauuuuaaugacuaggggauucuuucauccaacucuaaaaugggaauccaggggcuggagcaaccuuugcuuccuacuccuggauagcugcacucuuagcuuccuagacccacagucauagaucccaucucagaaccucuagagaugguucugacucuguagaaaccaauccauggauuaucacaaccauaaccguucuuacagugaacuuggaaaauagacagagccaaguuuguccuccagaccugcucauuucauguuaauuccaagucauucauucaacuuuucugcacccugaacuguucugagagugaugaucugggacucuuugaaggcugcaugagauugcacagugaaugucugaggcuuagaagaggcaugggucaggcacaccacgugucgucauacugggcuguucugguagggaaggagacucaggucucuucaaaaggaaaguuuauaucauuuccuuauauuaaagcuacuugacacuugacuguaaacaaaaaaaauuuuuuaauuugaaauguaacugucaacuguuaguacuggcuuuagauccauuuuauuaucauuuguuuuaguugaaaggacugugggugauaacaggccugcuugguguguuugguuuucaagguuauaguccuggagcucuuuuaaaguuuuaugugaauccuuaagugaggaaucuuugcugaaaguugaaccacauauauuauggcugacuucuacuagcacaaaauagaagcuagccgagcucccucaauccuuacucuguguaucuaggucacaucugagugauggccucuguggcuugucauuaaugccuggcuaguguccacugacaggcacagugcuuuagcacaggccaagagauaucagggccuggcuagguguuuguuuguuuguuugaauuuuacuuauuuuguguauuuuauguaugagugcucuauccucauguacaccugugugccacaagggggcaucaaaccccaucauagaugcuugugagccacugugugcugguuggaaauugaacucagugcucuuaauugcugaacucacucuccagccccuggcuagggguuuuuaauugagcacuggcauauguauuuggggguacacuugaugcuaggcucuaaguccacauagugguuacaugaagcccaaaguggagguguagcuuaucuagaauggaaaaggccccggguuccaucccagcacaacagacuuuuaaaaguucuugggaggcggggggcguaagcaugugccuuuucccccaagagugcacacugacacaugguccucuuccuggcauggcugaucaagucuguagcacauguuauuuuacaguuguguuaccucaaagcacuucaggucccuucagcacaaauauagcacgcuauguaaagaaccaccugucuccacaggugacacaacacgggaguccauagcugggcucaggggcuacugagcccccugcccugccucuuacugucccagagagaggccugacuguauugcuucacccacaggugcagugugaccagaggaggcugguguucuagguuugcagucugagggauuucagagucccuugguuuuggcucucuccuaagaugaagaucagucugaggaagccaaguaggaagggcaacaggaugcucuuccugugcccugagugggagagugguacaguuugcuuucgauauucuucagaaauuaaagcucuuggcuccucauaucaacucucuguguuuucuggaaacuccagcccugucuccuucgcagggcggauaugcagcaugauucugucucugcucugucucaaucaacaccaguuguccaaagaaauacacaaggagggggagggccggaccgcguugacgacagggcagaaagucggacuuccugugccaguacagugccugcacugccugggagcugagggaaguguaggcuggcagccccugggacuuaagcaguugguggucugacugcaggaggauaggaaguagagggcaucguuuuuugaaguacgugggagacaugucugugguuaguccaggcguuuuccuggcugggcucagagccucacgucugccaggggaacugaugggcgugggagguggagacugagguugagcuuucuacaaccugcagccucugccagcuggcacccugcuucucugcuggccuucuacauugugaccuguagcccuaacucucuaacacagcugugauggcuuucuguacaccgagggaugaagugacagaggaacaguucuuacguuauauauaaacugaauaaacacaacuuuuaaagaucauaaaaggucaagaaaauaaaacaggaaaauauucuuacauucuuggaauaaaagauccuugcaguuacaaaggaaaagaauuagagguuaaacauaaaagugaaaaaccucacuauguuaagaaaaccaccuugaucaaaggacaaccaggccagaggaaaugcuuccuguauaaacaaccauuaaaagugcugucagggggcuggcaagauggcucagugguuaagagcacugacugcucuucugaagguccugaguccaaaucugagcaaccacaugguggcucgcaaccaccaaugaugcuaucugaugugucugaagucagcuacaguguacuuauuuauaaugauaaauaaaucuuugggccggagcaagcagggacugagggagcaggauugaccagagugagcagagguccuaaaaauuaaauuuccaacaaccacaugaaggcucacaaccaucuguacagcuacaguguacucacauacauaaaauuaauaaauaaaucuuuuuuaaaaaagugcugucaggagcuaggugaacagcuccuaucuaucccagcuacuugggagguugcaggaagaggauucugaauuugaacccagccagguaacuuggugagagagauucuguccaaaacacaaaaggggugauugccauagcucagugauagaggcccuagguucaguuuccaguauucgacggggguagcuaugauuuguaagguuaugaagaagagacaaguacuaagaaaaacaggaacacccccccccuucccuacagccuggugcuuuguaaguucuauaaauacguguguauccuagcuaugcucuagcagcgguagcagcagcguccuaugagugcugagggguuauuugcaccgccaucugggcuuguuuacaaaaagaccuguguacuaccaucugccaauuuaaucucuugccugugggaggugggguggaagguuuugauggggucugcaaaaaacacgauuguuuuuagauuuuuagaauuuuauguguaugaguguuuuuuugacauauauauauacacacacacacauacaccaugcuugugucuguaucugagguuagaagagauuccuaaaguuggaauuugagccuaaaauuagcucaaaaucaaugguugugagccaccacguggguccaaaccagaguucccuagaagaguggccaacgcugauaaccacugagcugucucucggcccacgauuguuuugagugcagaggcaguugguuauguauagggggaaccaagauugcgugcuggaggguagcuuuacugguuuauagccauauaaaauugggaugucccuaaagcucuccaccuguguuugcuuaucuguguuacaugguacaagguagcagguccucuuguagggcagugggagaagucagccagccagaaccuaccgaguacucaggcauuguacuagagccuagcaugacugcuguuaauguaagagaacaugguucuugccaugucuccuuaaggcauugcauuauuugaaaaaccuuugccacaucuuccuagugacccaggggcuuugugggacugcucugacucuggaagggaugcacacaggacaaagguguguccacucuuuucaagaaacauuugacaagagagaagguggcaauuccuuucuccagagucaguuuagggauaugcuggcuccccagccaauccuuaccauuggucaaucuuugcugacuaugggcuguagcacgauccgccauguugugcagaccauuccgacauccagagauccgaaaauacuugguucuguuucuaagcuccuugcuuuguucuaugguucuguuucuaagcuccuugcuuuguucuagcuuuucuuccaccuccagcuuuuuucccaucucacagcuguguccugcuagcugcuugcaggccaugcagcuggaggauaggcaugauacaacccaguacagaacacucacuuagaacaucaucagauguuuguugugacuauauuguuacuugauugugcaguucucaaguguggguuuugaaagugacagugucuuauugcagugucaaagauuggacacuccugagaucuagacuuggcccuccacaagcagacugaguagcuagcggggugugugcaauuccagggauggacagguaggugucuaacuacagggcuuguuucuccacaggaaguaaauggugucacugcagcacuggcugaagaacucuuugaaaaagguacauacauagcacuugguccuugaaaugcugggccauuugccuaaucuaguagguagcagaaggcucaggcuagcaugagcucaccuguaaggucuucuccagggcccaccuucuugaaggugucaggucccggcuacccaccuacuugcccugcaggugaagaucuauaccccuucauucuuaagauuccuuguuagcauuaguugucugucuuauuauuauuauggaggggggcgagacaugugucacagcacacauagggagaucagaggacaacuugguagagucaguucucucauuccaccuuuauguagguucugggaaucaaacucagguagccaggcuugugcauggugagugucugggucucacccaagucucaggaucgaguuccaagccacaugggauguugaaagauggcuggcaugcugccaucuugcaccugauuuguccuugcuuggaaguguucaaaucgcaaguaggagucagucuugcaucauggucuugccagagaacauauuaacaauagcugacauguagugagcagccccugccagcaugcuuacauuuaguauuuacuaccuucccugaaguagaggaaggaugcuaguggucagaggcccagagaccugauagaagaagcaauuuaaggacuaaaugcuggcaucuuauuugaccuuagucucuacauauuagagggugcaguguaguugugauacccagagcacugccuuucuuagccuuguccugucucagucagugccuuaaaucucuacucuucuggauggcuccccacucccgcaacacaucccuccuuucucaucacguguccaggacugcccuaugcccagugugagcuccaaaaggcugcuccuauguacuuaagaccagcuuuacauggugggcgggugcaugucauaggugcuugcugcaugcuuauugacuguuggcuuggugcuuauaaugcccuggcuguacaacaggcugggacugagucuagacacuuaccuuuggguuuggcuguuacaggagagcaacuucuaggagccggugaggucuuugccaucaggcccuugcagcucuaugcuaucacagaacagcugcaacagggaaagccuacuugugccaguggugaugccaagacugaccuuggacacauccuagacuucaccugucgccuuaaguaucuuaagguaaagaugcagcagcuuaguugugcagucacucacuuggcucuaguucugacagcuuauuagcugccagugugugaagaggaccagggcuugggguguucgguauaugaaaaggacauaguguccuugauaccgugcuucugccugugagcagcagaggccagcagggcccacugucucaauacuguagaaguggucagaacuuuugaguuugacagcuacugccacagugacccaaacgugcagauggggaagguauuagcaucucuaauuuaaaucuauuuuggucuuagguuucaggcacagaaggaccuuuugggaccagcaauauuaaggagcagcucuugcccuuugaucuuucaauauucaagucucuucaccagguggagguaagaccgagucugcuggugaacaggcagggcugggcccugcacagcagcaucuugcaccuaaugucuguguguaggaaugguugcuuucauauuugucaauagauuggcagguucuauccaaguaagucaagccccucuaaagacagaaagggagccuuuucugaccucagcugguugcaggccuccaucccugcaauaggaaguauuagauaugcagagcuccagagccuggucccucuggucucucgaggagccaaggacaagcauuauucagguagaagucacagaaaccaucccaaaggccagagagaggcaguucaaauucuuuguuuuccaagucaaaggccuguguuuccugagcuuggcuuguaugcucagccuuguacccugcguccauguauacuccaucaagucucccagcuguucugugacguauagaagcuuuccuucuguuuacagccgaggaaacuaggcuuagggcgaggaggaggcuugguugaacuccagaagccugcucccacugaccugcucuuacuugaggacguggggcaguugagaaggcagaagagacgcccccuguacuguggagggaaccccuuuguucccugcucugauuccuguguccuccuuuucuguuuacuuggcaaacccagauaucccuuaaccaaagaaguggaauuugugucucauaacaugagaguccauuuuugagacagggucucacuguguagcucuggcuguccuggaacucacuguguaggugagauuggccuugaacucacagagauccaccugccucugcuccugaguacugagaucagagguguuugaaacuaugccuagcuaaaugccuuucuuacuagaugcuuaaaaccguuaaucugcuaaguagcacuggggaauaaaaaagaccaagguuguuuguuuauuuguuugagacaggguuucucuguguagcccuggcugaccuggaacucaugcuguagaccaggcuggccucaaacucagaaauccgccugccucugccuccugaguucuggaaguaaaggugugccacugcugucaccaggcugaaagagucaccuuuugucaaaggaaugccuaauuccugggguuucugaggcuucaagaugccauuucugagacacagcuguuuuuuguuccagauaagucauugugaugccaagcauauccgagggcuggucaccuccaagcccacuuuagccacaaugaguguuagauucucagcaaccucaaugaaggugagaucugccuuuguguuucugccuggggccuggccugugggcacagccuuugugagugaaccugacugaauuuccucugagcccagcagcccuggcuuagcacuuauuugucucucuuccuccauggacuugaagaggaagaugaggcuuagaaggguugggccuugucuggacaugaguaacagaaacagccagcugccaaugucggaaguuccuuuuaugguuuuguggauaucaucaucacaagguuaaaauccucccuuagcauagagaccauauguaguagcaaauuuuaugacuuaggcgucugaucagaauuuggguuuauugaaacuucuuucgccuaaggcaccuggcugaaaggaagaagcuguagggagaacaaaguguagcugccuuaucccuuggaagguguuccuugccguguggcuaaagcaacccaggcugauccuaagaagaugucuuguagaagaagucaaaccagggagaacugccucccucuccuuuggugauugaugcucugggcuguuacucuccucuuaucgaugauucgcucccugugaagucauggcuaagggauuugcugcccacaguagagaccauucugaaagcaugguugccuggcaacaccagagcccuucagucucuucugguuaagccgggaaagauaucacucuauagcagaggcccgagaggcuugacuagaauuuauucuugaagucacagggccagaacuuacucaagcugcugguaugcuaagccuuucaguuauuucacaaccgcuuagacacaugacccaaagccccuuuaaugcaagcucauuuccacaugcuagauaugccccagcucuuccuuaaauuuugcaacuguggcauguuccacucagugucgcgugaggcccaaguguggugcucaacagauguucuuaugcaggaagugcuugcuccugaagccucagaauuugaugagugggagccugaaggcacugcuacccucggaggcccugugacugcuaucaucccaacauggcaagcacugacuacucuagaccugagccacaacagcaucugugagaucgacgaaucugugguaugauuguagcagccucucaggcucucagaccacccagacccuaggauugccuguuagaauugaucuuuuucugaaggcuuccccaaaauucuauauucaguauucuauacauuguucguaguuuuaaaauuaaauuucaagcuggagagauggcucagugguuaaaggcauuggcucuucuuccagagguccugaguucaguucccagcaaccacaugguggcucacaaccaucuguagugggauccaauguccuccuuuggugugucuaagaagaaccacaauguacucacauaaauaaaaugaaucuuaaaaaaauuaaauugcaaagugagaauacuuuaaaauagcugauucauaaaaccaagugaagcauuaugaacuauguguacguuuaauacagccaugguaagugaaauauucaguccuaaaaacagcagaaaacucauuuccuagaauacaggcgugccuguguuagagugacauuccaaaggccuuuaagcgugugguucuuagguggugucggugcgugccuuuaaucccaacacucaggagccagaggcagaaggaucucugugaguuugaggcuagcuuggucuacacagagaguucuaggacagagaaacccugccuugaaaaaccaauaauaauaauagugugauucuuuuugugcuuugugguagugggcaggguuaaaaaagaauaugcucccuuaucucucuggcaauuaccauucauauuacuuaagccacuuguucuauccaaauuguggguucuuuuggauuucugcugaugggacagugggaggggucagggagaaagugugccggcuggaaaugcauguucagccaccacguacgugaacugugucugggccagccuccuugauuaaugauaaacauucuuuucuuucauaagaaacugaucccaaagauagaguaccuggaccugagucacaauggacugcgaguuguggauaaccugcagguaaugucugcccacagcucuccaggacuugcucucuaggugggcccagaggcuggagaagcacugugccccuggggguggugagccacuagagcguggugagcaugggcuuccaaggaugcauugacugcugcucuagcccccaagugucaguaaagcugagugcaugcaaaccgagcgugaugaugacagaaaggcagaucuucagugcucaccccuaaccugucugcaggggaugccagcagguuauaucaugggaaagagggaagagggccuuccuuucucagccuugucagagcacuuacagagcugccucauagacuggucucuaacugcucuaaagggcacagugaccucccuggaggacuaaccucugcugccacccuguuucuccugcugcuacagcaccuauacaaccucgugcaccuugaccuguccuacaacaagcucuccucccuggaaggcgugcacacuaaacugggcaaugucaaaacccuaaaccuggcaggcaacuucuuagagagucugagcggucugcacaaacucuacuccuugguuaauguggaccuacgagacaaccggauugagcagguaagccccaauccugagggccucaggaucuaggguugcuagaccuuguuguuuauuauuuuaaagaaaagaaaacuaguagaauuguguucacucaaaagcagccauuaaauguguagucuguugcugagguguuagaaggcagggccaaauggcacucaugucuugcaguuggaugaggucaagagcauuggcagccugccaugucuggagcguuugaccuugcugaacaacccuuugagcaucaucccugacuaccggaccaaggugcuuucccaguuuggagaacgagccucugagguaagccccagaagcaguagcagagcccagagagacuggcaaggaaaacccagucugucugcaaaggcagaucgagguaaggcuguccacucuguccuugucuucuucugagggacgucugcucuucagggcugcaguccccugcuccccgugggaguaccccugcagaccccaccucucuccuggcgcucuuuauucccuggcaggcuucaugggugccaggacuucaagcuuggaggguuucaggaacacaugggcacagaaagauuguuuccaacuuuuaaaaacuacauuggaagcugagcaguggugguucacaccuuuaaucucagaacucaggaggcagagacaagcagaucucugugaguucaaggccagucuaaucuacagagcaaguucuaggacagguagggcuacacagagaaauccuaugucaaaaaacaacagauaaaacaaugauaaaaauuacauuggauauuuuagguaaggggccuagacuaagaugucuaaaauuauauguaggcuuuuuauuuaauuuaugugagaugccuaaaauuaucaguugcuuggguccugacuacacuggucacuggugcaugacuacaagucuugagauuuuuuuuuucuuuacuggaucaguccagucugucugcuccuacuggcucugacuggacaggcgccaccaugcuaaccaaguagguccuuacccaggugugcuccuuccccucagccuccagugggccucguuuccauucccauucucucacaguccuuagaacccauuuucuucagaucccaggccagaagacaccaagagucuguuugccucucucuccagacuucucuguccccaccaggugucauuuuguccacauugucccuagacaguuauuauaagauggcaucucuugcuggagaugauugcuuauaccuguaauucaggaacucaggguccgaggcaagaggguugcccaugaguucaaggccagccugcugacaaagugagacccuaucucgaaugaaugaaugaaugaaugaaagaaagaaagaaagaaagaaagaaagaaagaaagaaagaaagaaagaaaagaaaaaggagggaaaaagagaaagcaggagauggggggaggggagacgacaaaaagcuguuuuuccuuuugugacuccagagcuggaaagccuucccagcuccauagugucuguaccugucuugugcuuugggguguccuucauguggccauucugccugcaugccagccuacagcucucccugcuuacccagaaugggacuccugccuucuccauacuguaagcuacuuucuggacucuauagauuugucuagaugaugucgcaaccacagagaaagagcuggacacuguggaagugcugaaggcaauucagaaagccaaagaugucaaguccaaacugagcaacacagaaaagaaggugagaauuuuaaggauucagcuaaggauggcgcuuuucuuggggaaacugagccaugggaucccucggggaucucugagcauuagugcccgugcccggcccuaccccugccuguggaaccuuagacugggagugcuaugguguaguaauaauggugcuuucuaugugagaccggugagcucuuccugggcaucccuggcugaggcgggucuguucuucccgcucuuuccccuccugggcuaacuccauacucuuccucaggcuggugaggacuuccggcucccgccugcacccugcaucagacccggcggcuccccuccugcagcucccgccucagccucccugccucagccgauccucuccaaccaagguaaucacaagcaggucuugcucccaguggaguugcucagcucugccuggaucguaggcagggcugugagugagagaaaugcuggcaccugcuuccugcaggcucaggcacggggaggguggcacuuuuugcaggcuggcuccuuggguggcacguggcagggaggugccuggccugauuucagcaccguuguuugcuuagugaggacccccgucccuuaugucacgucaguuccuauaggauaucggguguuggagagaacuaagcagacucagcuguugacucagagggaucuauuccccuguggccaucaugggcaggucagcuucuagaaagacaggccuuauuuagagcccuugaccccuguauacagagcuuuaguguugugaugccucuguggcacucagguauggccaaaccccaaaguacugcauuuaugggaccaaggugggcugccuguccccauggaccuguggacgaacaguccuuuucaccugcccauugucugcgagaauuuucaaagggcuuucaccucugaacccaggcauccucggagaugagugagugaaccagguggcaugagcguggcugccggccuggccccgacggaagaggggcagguaugccgucccaaguggagcugaggcucgggacacaggaaagaacgccacccgcccaggcuccuggagacgcagaacuuggugugaggucuugggaaacuaguuuggcccuagguuuuaagagccagaaauauauuucuacuccuuaaucuggugaccccacuggaggaaacuucucuagagagggcuaagauacugaggaaagggaaguucuccccacuagcagcaccaaacugugguaugcacaccagaagggcagugaaaggcagcuacgucccagaacccucuacaacaguccugugagggagagaggacugagcugcaaaaaacacagcgcuuggcuuauguugcggcaaaagcccagagcaccacagccugaagucacagcugugauguacagaagagaaaucaugaaagcagaacgguagagcuaggugacagcacauuuacccauuagcuuugucaaacuuuugacgaaaguuuugauuuuuuuuuuuccauaaaagaggaagaaaguuugagucugugaggaaguuucccugaccucucuucagcuccccacaguauugauaccacauagaaagcaugcagccauagacuucuggggacagggcagucgguccaggacgaagccuguucuaccauuuguuaaaucagugcgugugugugugugugugagugcaugggugcugugugcaugcauggaugcaugggugcugugugcaugcaugaacaagcaagugaagagcaaguuggccaagagcagguccuggcuaggcaggaggaaugggugucuccuccaggccacagcugccagcagccacuguaccuugugguauugaagucucugcagcagccuggggcaagccucaucuaccccuuccuugcugcccuuuuaccccugggugcuuuguagucugcccuuccccugcccccaagucauugggcacugagagauguugucccauaucuacaccucuuguaaauaaaacuacaguggaugucugugugugcacaucuuuuuccuuugggcgagaaaugacaaaggucagaccccugucugaggacuccugguguccccuaucccaucugcugaguggcccuuucuaaccacuuguuuguacaggccaugguccaggaaggaaguggacagauuguccugucugcauuuccucaugcccaaacaaggcugggggugggggauggggguaguggcaagaaaauacugauuuuuuuuucuucccucacaaaugugaggcacccacauguauguguguuuggccauguguuacuggagcuggccugggugcacagggauuuuucugugugagaacaguguuacucaccuacccuggccacucaaggccugccugaggugggugcugcuggggaaccccaguccucuggucaucucagcugugagagcaguggaagauugacagggucaguguccaaagugccaaaguucauugcccagcccugucugggggcugagagaaggcugugcuguagacgugauuagacacaggcagcugaguuccuggcccugagauccuaagcaacuuguagccucuuggaagcuguuuucucaaccacagaguggauacauccuaacuucaucgauucuaagaugcacacauuccacccugugacuucucugaaauugagaugcgucuuucagucaguggcguccccuaguugcugucagccagcugguaaucgugauggagccgugggaauaccuucuguggacaucggcuaugaccaggauggcaccuuauccacacaccuuagauuugaugaaaugugguaaauaacgagaggugcgcgugagcugaugguggggaagcgcuuggcacugccgaggcuaagcaggauuagucgguaggggcugcuuccuguagccugaguugggguuucaggacagucccuccaagaacauggagcuacuuggggacauaaggcuuugugccuauggaagaacgagguagaacaguuugggaauacuuuuaggacugcagcagagugguaucaaagaugaaucuugaaagcuggguuggguuaagacauuucagcagcaagggcgagugacauccgcagagccugggacgcuucaugcaugucugugcuuaccgccuuccugccccgcagccucugccgcuucgugggguaucugggcuugagcagagaaccugcaccuugggaguuguccuguuguagguagcaguccagcugaaugggauaucuggggggcucuugggaguacagucauuuaauugggccaugguggcuguugaguaacaaagccagucuguggagggauggcucuucuagaccagcuagcagcaauuugaaacgcguugguuguuguuuuugcuguuuguuguuguuuuuaaagucagggguugggguuggggaagagcuuccccuuuaaccaguggcaaacuggaaugcaguaauggcuccagacgggcuauucauaaaaucccuuaguguagcguaaauaaccagugcauuuuaaggaaaguaggcaguaguacagggcagccagcagggcacccugggaaagcagcccuguggauucaauacuagcugugcucagcacugaaggaaucaaaucugcaaagccaggcuuccuggcgaaggggccuguacuuggaacuugugagcccugcagagauaccagaugagaacacagggucacuuguagcccuuucuuuggacaguguuccaauaugcccaaagcuaucgauaaauaaaucaccacagugcuuuucugacagguagaccagccuguccccaguacccaccucuuccuaguuaggcugggccaggcuguguggucuaaccuugccacaguaagagaaaaaguagucuccuguuucaguuugucuuucuuugugcaagcguuguuuucuguguuaucccuguugguccuucuucuguggaaugucuguucacagucuuuacauucucuuacaguucucaagcagcuugcuuugagaacuauaagagcuuguaaucuguaagagcuccuuauagauuggcauauagaucuuuguuuauauugcagacacuuuguucucugugcauuuuccugucuuuggaauguaccucuggagguuuggucuuuauggcucccucccugcuuguagccucucccuaccgcacacuagagagcagccacugggcccauccaagggcaaagcaucuuacugaggaguuacucaauuacugccucuccuuuuugugacccauaugaugauuuggggucuggcuagugccuggccguacccugagcccaaggccuagccucuucuugaacagcugcucucccugcccaccccaucucugcccaccccgucucugcagguaucauguuuguacaggaagaggcccuggccagcagccucucauccacggauagucugccacccgaggaccaccggcccauugcccgagccugcucugacuccuuggaaucuaucccugcaggacagguaaugcccucacgugcuccuggggacucuuuccucggucaugcugcugcugucugacuuugugcacacugagauauguggcacauguggcgaggauuucuggguacuuuguguguaauguagucuuucucuugguugugucucuaguugggucauagaccaagugcuuaaggguuugaguuuggcugccucuaccccacgggagcaggcaguacuuucucuugggcccugagggcaagggaaggugggcauucuuuggguaaacauaagcuggauguccaaggggaaucuucccuaaugccuagccccacagaggccacucagucccuucccacaugucaccaugguggucugaacagugugacucuagcucuucuuuguaguuguugucuagguuuuugggacucauuucugugucccuugaaaagagagauggaaacugagugccuggugcugugugcuugaugccugggccuuucugcuccaugauucugcacagcuagggucauggucauguggugcuaagacgguuugcagaggcuuugccugucuuaccuccuaaggacuggcaccuuaaggagaguaagguccuugaccuagucuuaaccugguaugcaggaagcgcuggggccuugccagaaacaguuuccaucaugugcacugcugccugccuggggccagacccaaacaaagcaccugauuccuuggguggcacaaaggucccccagaugccagacaugcauggaaacaggcucugguccaugguugugcauguaagucaggucagacaggugggaaggcagcaauucccugagcucgcccagaguggaguauggcggugacaaggcagcuuuacaggcagcugagggcuagcacccagugagugcugaggaacagccgcagcggcggugggcucaugcuucucuccucuggcagguggccucugaugaucugagggaugugccaggagcuguuggcggcgugagguaaggaagaggggagagccagcagggccagcugcacagcuguguucacggcugcagaccgagcagacaguguagccuggucacagaagucucucuaucaggggcaguugagaugagcuccgucugguucuccucagcugccuaauugacauuaucuuacacuagaaguugccaagucaaagccagggugggucuugucugguuuguacuggaagcuaaugauacagaguucucucuuuguuuguggaguuauuuuguuuuuugaaacagggucucauuuagcccggacuggccuggaucuuacccugcgucuuaggcuggccucaaauucauggcaucccuccucccucagccuccuuagagacaggcuuacagcagucagccaccccaccugcuuuuauuauuacaguuuguuuguuuguuuuugucuuugagacagggccuuuguguagaccugacuguccuggaacuuguuuuauagaccaggauggcuuugaacucgaaagauuguccugccucugccuccuauuggcagugauuaaagguguaagccauuaugccuggcuccugcuacuuuuuguuguuauuagauuuguuucuuuuucugggugugguggugcacuucuuuaaucccagcccucaagaggcaaaagcaaacacaucuuuauaaguucgaggauagccucguauacacuggaaguuccagagcagcuagcacuacauaaagagauccugucucaaaacaaaacaagcaaaauucuguuuauuucauuuuaaguguaugaguguuugccuacauguauauauguguguaccacauguaugcuuggcaccucuggaggccaagacagggcaucucaacuccugucacuggaguuacagaugguuguuagguacuguguggguuugggagacaaaccgagauucucugcaagaacucugaguacccuuagcugcugagccaucuguuaagccuuugguuauuauaugccuaaaugauuguuuauacagaauuacaggguagggucagcacacacaucaugaaauauuagcuccuuggcccuuugcagaagucuauuuuuauuuauuuguuuauuuguaugcuuaauuuuuuuuuguuuuguuuuuuguggguuuuuuguuguugagacaggguuucuccauguagcucuagcuguccuggaacucacucuguagaccaggcuggccucgaucucagagaucugcuuccuucccuccccugagugcuggaauuaaaguuagcaugcaccgucaccgccuggcuugauugauugaugagugacuuuugaggccagaucucuauauagcccuggcuggcgcaggacccacuauguagacaggcuggcuucaaaacugagagagggcuggugagauggcucaguggguaagagcacccgacugcucuuccgaaggucuggaguucaaaucccagcaaccauaugguggcucacaaccaucuguaacaagaucugacucccucuucuggaaugucugaagacaguuacaguguacuuacauauaauaaauaaauaaaucuuuaaaaaaaaaaagcaugaauugcuuugcauggugauacuggccuauaauuuaaaaaaaaaaaaaaaaaaaaccgagagagauccaccugccucugccucccuguucugaaauuaaaggcuuguucuaccuuguucuggcuacaaaagcauauuucuaauucuuguucaugggaggguuguagaggccaagaggggcugaaauuuaaaugaaaagguccuaggacccauccaacuugauuuacugcccuggaaaaccaggcugucaguagaaguagccuuuuucaacaaugugauucacacccuguagcacuugauugccucugacaccuggcagcaucugaaugacagaaguuugguuguggcagccagcgugguuugggcagggugugcuucgcaguauguggacguguggacucauccugauggcagccacuugacaggcucagcuguaugagaggcucaggagacacaaggaucgccucccuaggguuaggggacuacauacgacagcagacuaggggauagaaugucccugugucucugacccagucucuucuugcacagcccagaucaugcagagccagagguucagguggugccuggguccggccagaucaucuuccugcccuucacuugcauuggcuacacagccaccaaccaggacuuuauccagcgccucagcacacugauccgccaggccauugaacggcaacucccugccuggauugaggcugccaaccagcgcgaggaagcccauggugagcagggcgaggaggaagaagaggaagaggaagaggaggauguugcugagaaccgcuacuuugaaaugggacccccagacgcagaggaagaggaggggaguggccagggagaagaggaugaggaagacgaggacgaggaggcggaggaggagcgccuggcucuggagugggcccugggcgccgaugaggacuuccugcuggagcacauccgcauccucaaggugcucuggugcuuccugauccacgugcaaggcagcauccgccaguucgcugccugccuugugcucacugacuucggcaucgcagucuuugagaucccacaccaagagucaagaggcagcagccagcacauccucucaucccugcguuuugucuucugcuucccacauggcgaccucacggaguuuggcuuccucaugcccgagcugugucuggugcucaaggugcggcacagugagaacacgcucuucaucaucucggaugcugccaacuuacacgaguuccaugcugaucuacgcuccugcuuugcaccgcagcacauggccaugcugugcagccccauccucuacggcagccacaccacccugcaggaguucuugcgccagcugcucaccuucuacaagguggccgggggcucucaggagcgcagccagggcugcuucccugucuaccuggucuacagugacaagcgcaugguccagaccccugccggggacuauucaggcaauaucgaaugggccagcugcacgcugugcucggcggugcggcgcuccugcugcgcgcccucggaggccgucaaguccgcugccauccccuacuggcugcugcucacaucccagcaucucaacgucaucaaggccgacuucaaccccaugcccaaucgaggcacccacaacugccgcaaccgcaacagcuucaagcuuagccgcgucccgcucucuaccgugcugcuagaccccacucgcagcugcacccagccacggggugccuucgcugauggccaugugcucgagcugcucgugggcuaccgcuucguuaccgccaucuuugugcugccccacgagaaauuccacuuccugcgagucuacaaucagcuacgcgccucacugcaggaccugaagacuguggucaucuccaagaauccuucagcuaagccaagaaaucagccugccaagagcagggccaggugagacgagugcaggcuguugggaccuagggugugggguuggcuuagguauggucucugggccuucgugcucuguaggacucucucuuuaccuucccucucccacuucucugagccuuugccuccaugaacuuagugcuaagugcuccagaucucuagagccuuaaaagcagcccaggcaaguuguuccaugcaggacggguuaagggagccagcccugucuugcccguggaggacaucaccuuguccccuggcccucccacuguccucucauguguacaagugugguuucugggugucaucuuucuccuccaccaggcgacucauccaguggcuggcucugucagcucgggaguguuccauggccccuauuccuaagacucccucucaggcuuuuuuuuucuuuucuuccuaucacaaaguuuuugucaggaaggacugaguuauaucuagcuuggaauucccucacaaagaaccuucugaagaccagaguguauggguaggucauccuuuuuucagcagagacugagguagcaggaagggacuggcagcuuuagccuguucucacucccccuccucuugugagggccccugcucucucuugcuggauuucccaccuguggaggagaggaucgaacaguucagauucucuaugcuggcaaagugcugagacccuauccuccccccugggucucuccucuccucuccucuccucuccucuccucuccucucagucaguccccugcugaugacucaaagggcuuucaacucuuacacuugaauccagugccccucuuaaaccugcacagaggaggcugcccccuaccuccccucgccaugugagguuuagguaccuuguccuucuuccaagcuaccacaaaccuagcuugcuccugggacugcugcagaaaccaggcccgaaaagauguaucaacacaccugugacagcaggagaguaaccuggcagcuucaugggauauuuggacaaaugcaggguuacagcccuagggaguccagcaguuggacuggaucugauggagagagcagcauccagaggaccccaccccuucauucaguguggccccgugggcugaaugcugggaacucccagcucccaugagauuuagcuuuugaacauuaauuaugacugagauagagcaggacaccccagcagggccgugugcagugguggcugaguaggugaagugccagggccaccuaaagguaccccaaaacaaacugaagaccauguugagucgugguucuugccacugcuugcauauacacacccagacccuuucccuguucugugugguagaucgcccagugacuccaagaguagcauggacuguacagguguccaccacacucugauguugugcaaauaacuuucuaugggcgcacauguucacuuggcauuucuugggucucugggagauguagugcugagcagcggcuacaggagaccccagcagacgcuccggcuccagcugcagucccaccaacagcuucagcuccagcccccgcagaggccuuggcuccagaucuggcuccuguacaggccccaggagaggaccgaggucuaacuucagcagaggcuccagccgcagcagaggcuccagccgcagcagaggcuccagccgcagcagaggcuccagccgcagcagaggcuccagccgcagcagaggcuccagccgcagcagaggcuccggccccagcagaggcuccagccgcagcagaggcuccggccgcagcagaggcuccagcugcagcagaggcuccagccgcagcagaggcuccagcuucagcagaggcuccagcuccaaaccaggcuccugcuccagcaaggggucccgcuccagcaaggggucccgcuccagcagggggucccgcuccagcagaggcccuggcacaagcagaagucccugcccaguacccaagugagcgccuaauccaguccacaucugaagagaaucagaucccuucucacuugccaguaugcccaucacuccagcacauugcccgucuucgggggagagccaucauugaccucuuccacaacagcauugcugagguauuggcccaggugcuggucucccugacuggcacuuguguggugggaggugugggcccugcugugguaccagucaguccugaggguggguauaguuuguguuggggcauccucauggcccagauuccucuugacauaaugugguuuugagcuccaucugcucacaggauggaggaucugggucaagaggucugccacuuagcuagccagaugugccuucagucauaucugacuguggaucccugguccagguauagauccccuuguguacccccuuuuguccccucuucucugcucugaguucauuugaaaaaugagaugaacuuugucucuccucauccaaggccaugagcaguucuggaacacaggaaucaccacauuagccagacucagaaagggagggagggaugugcugccuggagccugcacucaagugugguccaggaggaaggggguguggccugccccacucuccucgccugcaggcucccacauaaccccucugugcccagguugaaaaugaggagcugaggcaccuccuguggucaucagugguguucuaccagaccccggggcuagaagugaccgccugugugcugcucucuagcaaggcuguguacuucauacugcaugauggucuccgccgcuacuucucugaaccacugcaggguaggucguccuccagccugacuguucucgggucaggggcagguuaagagccaacuguggacuuggguagaagcucugggcucagagucccugaucugagaaaaggguaacagcagcccuucccucuuagaacucacggagaccuaaggcaugugccaugccagggaaugcuugggaauugacugguacaugcagggauuuggcagccucugcccuuuggaucucaguaggaaccucauccagugaccuggugacuccaccgagcuaagcaagaugagacucauccccacacccaguguccuacaguccuccaugugugcagguggugcuggcuccuugccaggcaacauuccugccggacauguuuaaccuuagccucuucucuccaucacagauuucuggcaccagaaaaacaccgacuauaacaacaguccuuuccacgucucucagugcuuuguguugaaacucagugaccugcagucagucaacgucggccuuuucgaccaguacuuccggcugacgggugagugacgugauguguuuugucccaguuugggugaaggccagugucaccaguggccuuccaccucgcacauguagguacacuaucacgugacacauauaucuccacuuacaagccagccacucggguaggaggaagcggcuucgggaagugcugagaugacaggacucccgccccacgguuuguagcaggagcuggguauacagggaccagcagagugggcccugaacuuaggggcaggauguuucugacucauacuuccugaaaggagaaagcuaagcccuuucccuaaugccucuauccccuuccagaaaaauguuucagcccuuccugccugagauagggucaucuccccaggccccaugaugcccucccacauagacccuguggguccugguuuucugugggggccuugcagggacgggaaugguggccugugccugugaccagccccuucuugugcaggcuccuccccgacgcagguggucacgugcuugacucgcgacagcuaccugacgcacugcuuccuccagcaucugaugcuugugcuguccucccuggagcgcacacccucgccugagccuguugacaaggacuucuacucagaauuuggggacaagaauacagguacccuguccacccccagaacccucacugccucuguccccaccuuucccuugucucugccuaacugaccaggcuuuauggaucauuuuccauggcagagguuccaucccagcaauccccaggcagccagcagaccucucucaguccugggcucuagcuugaagcacccucgacuacucucauuauguggggcugcuguuucuuuugacugcaccacaggccagcucaggccacacccugguguuucucuuccugcagggaaaauggagaacuaugagcugauccauuccagccgcgucaaguucaccuaccccagugaggaagagguuggggaccugaccuauauugucgcacagaagauggcugauccugcaaagaauccagcccucagcaucuuacuguacauccaggccuuccagguggucacaccacaccuugggcggggcaggggcccacugcgcccuaagacgcugcuccugaccagcgccgagaucuuccuccuggaugaggacuacauccacuauccauugccugaauuugccaaagagccaccgcagagggacagauaccggcuagacgauggccgccggguccgggauuuggaccgggugcucaugggcuacuaucccuacccacaggcccucacucuuguuuuugaugacacacagggucacgaccucauggggagugucacccuggaccacuuuggggagaugccaggugguccuggcaggguuggccagggccgagagguacaguggcagguguuuguccccagugccgagagccgagaaaagcucaucucacugcucgcacgacagugggaagcucuuuguggcagggagcugccuguggagcucacuggcuagugcacgccauagcagcccuggccuccugccaugcccagccuagccuggugcccgugaaggcagggaagcggccuucugcguucuuuuuaaggucuuucuccucucccuugguuccuacauugauugcccguggcccccacacaugugaccagcucccacagagacugugaacaugugugaucaguuaauccuaacgcugggaagacauaugccagccccaccagagcguccuugugcuguuagcgucccuugugucgccugccucugaaguggcauggucagacgcgccagcauuguuuugucugugauugaugcuguuguuagcguggcgcuguggaccugauaacccccacguccuuuucugaaguguuaaguccaguccuucguugcuguuugcugucauugugggcgugccgcugcuaauuacaaagcugguagcagaguacacaggcaagcucccacguugugggcuuuuccaaaauggaggccuccucaaguccagagcagaggaggcccuauggggaguucccaggucauggguccaagaggagccaguacaggggaccuagagcugccagcaccaaguauaauuccuguugccuacguucucuauucuaauaaaauggaguuugacacaacaugag

SEQ ID NO: 7343 - RNA, 8502 nt, Mus musculus
gcucgucgugugaugaugacguuguacguccggcgcgggcgagugacgcggcgcggcccguugucugugcggggcugagaagcccuaagggcggugggcgcucccgguugggggcggcgcggguuuagcagggccuggacauggcgcugagaggccgcuccgcgggaagaugaauaagggcuggcuggagcuggagagugacccagguacggaggggccucggcgggccgggggcuggggaggccggaugggccccggacgcaccugcaugacaaaucccucuucuugucgucccacccaggccucuucacccuccugguggaagauuucgguaagaaccccguuacccacgaccuucggucccuggcugguguggauguggggguugguccuugaguucucgcagcagagccugggacugcccugccgaccucuccuuuccugaucguaggugucaaaggggugcaaguggaggagaucuaugaccuucagaguaaaugccaggggugaguggcugggacgcccccuuaccuccggagggccgagaaagggcaggggaauaguaccccauucaagggaggcaguacuagaaaaccugagcuauauaaaauaucacauaagaaagugucacucuuugugggugcccucuuggacuuuucuuuucuucucagucuuuccucaguguuucuccuuagaaagcuguagcccuccuuuuaacccuaagcacucguggaguacaguugagcugccuuucugguuuugcagccggaacccuccguugcauaguguugcaccuuuuuuguaaguguacaguccauuaauuacaucaccacaugugcugugccuuuaaucaccacacaacauuuguccugaccauuaguggcgcucuccucuagucccaaugcuugggaggcagaggcaggcagaucucugaguuugaguccaaccuacgcuacuuagugagaccaugugucaacaaaacugaacacaguuguccuguauugauugguuagugugagaaggccuuuuuuagguaccuaaacucagagucuuguuuuggaaaucuauagaauagaggcauagagaaccuaacugcuuccaagggaaggaacugguuugggaguucacgcacuauacucauuuuacuaggacuggaggccgagguccaccagugaguugguacuuaauucuucaucaacguuuuugugccuuuuauugugucccuaccuugcuccauccugggccagcaguuccagauuuccuucuucucuugccuagaccucauagaccgagugggguuugagagcuucaggcucauacuugacugccugugauaggcuucugggguuugaggucucagagccauguuggauacaguuugguuaagagugagggacucagugcaagagcauuucagugcaaaggauuagggagagaaagaaggggaugcugauugucaucugccucuugcuucucuaggccuguguauggauuuaucuuccuguucaaauggaucgaagagcgcaggucccgccgcaagguuucuacguugguggaugacacgucugugauugaugaugauauugugaauaacauguucuuugcucaccaggucugcugaguucugcgcuuguuucgggccaggaugcuauuuuugucuuuguuuguuucugguauuguguggaagguggcagugggggagcaggaagaagcgcuagacuggaaccaagagaaacuguugcagaaacccuguggcagacagaccuaacucuuuuucauuagagggaauaccucuguaguuggugguguuuuaguacauucuccaugucccuagauaggagguauuuuaguugguucauguuaaaugaauaaagacuggguaagacaaaggaaacuaaaggauguugacaucuuucuuuuuagucuucauucucaauaagugugggcauggggaugucugggguaaagaguauaugagguauaugagugauuguuuuugauuuauagcugauucccaacucuugugccacucacgccuugcuaagcgugcuucugaacugcagcaauguggaucuggggcccacgcugagccgaaugaaggauuucaccaaaggcuucaguccugagguacgcugcaguaccuuagaucaugcuuacagauggcugggcacaucugauccucagagcuauugguaaugccacugcaugguaucugguauuuuuuggucauuucuuuuucaaauguuuacuaacaucuauuugacucauaaguaauguggaagguaguugauuuuaggcuuugcugcuaaaugagaugauagaaggaaaagacuuaagugaucugggucagaccuuuucuguuguguugcuccccaguagucacugauggcugugcacggccaauauggcccaucucuguaggaaauccuaagcaaggucucauuugccaccacugcccuuucagaacggucaucugugcugcuugggauuccuggaaugccucuaagccugcuuuauggaacucuuccccuauucagaggcucagcugagaaucuguauuuauguagucuucuuuuauuuuuagagcaaaggauaugcaauuggcaaugccccugaacuggccaaggcacauaauagccaugccagguaugugagagcuaugguugcugauguggggucggggugguggaggaugucucugauuuuguccuuuuccaggccagaaccacgucaccuuccugagaaacagaauggccucagugcagugcggaccauggaggcguuucauuuugucagcuaugugccuaucacagggaggcucuuugaauuggauggauugaaagucuacccaauugaucaugguaggccuucugaggaaggggccuguuggguuuuucaugcuuccuucugauuuucugggucucagggacuuuagauccuugagauguaggagcgugaguggauaccagggacaucuaacucuugccaugguuucaucuuauacuguuuaugugucuagcuuguagcuucucaaccacacgaaucuguuaacccuggccuaccccaucucaggguuucccaccugcugauuccucaucuuggucuucccuagggcccuggggagaggacgaggaguggacagauaaagcucgaagggucaucauggagcgaaucggucuugcuacugcaggguaagaacccuugguuguguccuucuggagcuauguccccuuuggggggaaagagagaagcguaaugaucuguagauuguaaggccccaugguaucuggcaagaucaggcuugggguuugggauuuaaauuuuagguugccuguggccugcucugggcugggcuggaggagggacaagccuugugugugugugugugugcggggggcguguuaagaagcacaggugugcuggcuuacuuccugacaagccucuaucagagcucaugggaagguguagcuggguuucagaugugugucuggcugcucgcugccuauuggaguggagccuauacuuagagcuacagaugugacugugagaggagcucuggcaagacacuugccucagucuuaacagcaggucaggucuggggugggaacuccucucaugguugccacugugauugcagggagcccuaucaugacauucgcuucaaccugauggcaguggugccugaccgcaggauuaaguaugagaccaggcuacauguacugaaggugaaccgacaaacaguccuggaggcccugcagcagguaaguugccuggcuuugccaacccagugcucccugucucuccuacauuuuauuuaguaucugucucuaauucccaaaucagugucuuguagauugaggcuuuaacuaaccauuucuuuccuuugcuuccuuuguaagggugguagaacuuaacuucuaaaacgauguuguggcuuggccuuuuuauuuuccaauaaauaaauaaauaaauaaauaagcaggcaggcagggucaaggcccuuagcuaucuaugguggaaaccuggcucuauccuucucuccuaagcuugaguuuuguuuuaagcugauuagaguaacccagccggagcugauucagacccacaaaucucaagagucacagcugccugaggagagcaagccagccagcagcaaguccccccuuggacuggaggcaggcagaaccccaguggccucugagugcacucagacagguacuagagggacuugggcaucagccauccaucguagcuugacauaggaagcacaagcacuucaagaagguacuugguacaggggcucuagcaggaggccugaaaucccaguaccugaagcuuucccauuaaaacagggagaguagagugagauuuuccuaaaggauacgugaaaaggacuaucaugacccuagacccacaccucucuguauugggugguccaucccaucccauaccucccaccccuauuauuuuaucuauaggcugccuucuuguugugucuuguuuuguuuuuuguuuuuuuuuuuuuuuuucauugugugacuuagagcuuaccugccuaugcuguuugcugucuucacugggggaaacaacugucacaggauuauggacuguagcuuuucuuaaggacacagcugaauguccuauuuauacuuugccuugucucagauggugcagaggagguggcugguucgugcccacaaacuacaacccauaguccucccagcaaauguaagcugguggugaagccuccagggagcagccucaaugggguucccccaaacccugccccuauuguccagcggcugccagccuuccuagacaaucacaauuaugccaaauccccuaugcagguaagauggaaguacccucaacugagaggccacaauguugguucccaguguuauucuuugacucucugauugguucuugaugaccaggcuccucuaguacucauaggccccaacagagcgcauggccuuaagguggcuaagagagcugcuucucugacuuuuaaguccaguugccugccacacaguuggguauacuccuuggcacaugggaaaguuucuccugguaacucaaaaguauguggcaaggcauucuguuucuuuuagaagcacuucgcacagcuaagagccuaguuaucuuccucccuagcugcgauaccaugccuggcuugggugagcucucucauuaccgcucuugccugccccaggaggaggaagaccuggcggcaggagugggucgcagccgcguucccguccgagcgccccagcaguacucugaagacgaggaugacuacgaggaugaggacgaggacgugcagaacaccaacccugccaucaggucaguccugacucggagacggugucaaacucuggguaccucagauccuguucucaauauuccacccugcgucugagagaacaguagacagaaugcaggcccuggaggaggcuggcuugaggggcuaacccauaaguuuagggggagguaaacaucuuaccauguaugugucaguacauuuuguugaggugaucuuucagcccgaccucaaagaauuaggguaggagaagagguuggagagaugauuugcugaguaggauggcacuuuuguuggaggauagagcacuagaagguuagaagugagauagcuagaguagaggaggccaccugccuauacucuggcacuuaggaagcucuugcuaagagauuguuuagaccaaguguaagagcuuccauuugggcuugggaagaagauacuauauuugagccauucuggacacugcuggguguggucaccuggcccauucccuguuuuuaccucuuauuggaccccacagauacaagcggaaggggacagggaagccaggaucguugagcaauucuucagaugggcagcugucagugcugcagcccaacaccaucaaugucuuaacugagaagcuucaagagucucagaaagaccuuucaguuccucuguccaucaagacuagcaguggggcugggaguccagcuguggcugugcccacacacucgcaaccuucacccaccccuagcaaugagagcacggacacagccucugagauuggcagugcuuucaacucacccuugcgcucgcccauccgcucggccaacccaacacggcccucuagcccugucaccucucacaucuccaaggugcuuuuuggagaagaugacagccuacuucguguugacugcauacgcuacaaccgugcuguccgugaccuggguccugucauuagcacgggccugcugcaccuugcugaagaugguguacugaguccccuggcacucacaggugggccuuggacucccucacuggucacuugguguacccaaggaggaggagggagguggcccggugacuacagaguaucauguacucugaugcacccuuuuauuccucucuagagggugggaaggguuccucaccuucuaccagaucaagccaaggcagccagggguccaguggccuagaggagaaggaggugguggaagucacagagagcagagacaagccugggcugaacagguccagugagcccuugaguggagagaaguacucacccaaggugagugucuuucagccuucuccuagcaggggaaggaccugggccccuacucccagguuuuggguacuugauuggaauuuuggagugaaaguugguggcuaaagccagggagcucuuugggauuggauggcauugguagcccccuggacuguggcuguucacccuuguuucuaguugcuucuuaguaauggagcuuuggugccagucaggccccuaagguauacaauguuggguuguggcaggagcugcuagcacugcuaaaguguguagaagccgagauugcaaacuaugaggccugucucaaggaggagguggagaaaaggaagaaguucaaggugggugaccccucuacugcccaaggacagcugcucugagaagaugggcugggaugcccucaugugccuucuuuuucacagauugaugaccagcgaaggacccacaacuaugacgaguuuaucuguaccuucauauccaugcuggcucaggaaggugaggaggugccuacuaugucuuaauuguccuacccucuugagggucauguaccucaaacuccucccccucccucccccaagacuucaccuuuggccgaugagacucaagcucagggagggcugugagagccugggagacagccaccuacuaaggaguuuccugcuuuacacaggaaugcuggccaaccuaguggaacagaacaucucagugcgccggcgccaaggggucagcauugggcggcuucacaagcagcggaagccugaccggcggaaacgcucucgccccuacaaggccaaacgccagugagaaccucuggcccugacucugcagccucucuugccgcaaggcccucaucagggcccuucacugucccucuuuuccaaguauuacugaguaguucaacgagagcccagguccugggagugggagugacauguauucugcacugugcucuggggucuggcagggacaaggcagcuccucaaugcucaggaagcagcagcuggaacuggagggcauccaccauggccuccacagccaucugaggagcagcaggaccuggccuuucugccugggcagcaggauguacauucuaccuauuggagauguuuagguuuugggcuuuuguccaucuugccacuguauuaacauggcagcuuccugacucugcugucucucccagcagcugucauucugcugggccaggucucuuagaauacaucacagucccagcugagaaacacaccaccacuagccuguccucguugggaagaagcuuggccuacacuucauuccucugggagagcaccaaacucagggaccuggcugcugagcuggaaugggcaugggguauccuaauaggauguacagccuaucagggucccacggcuauaguggagacaaguguuugaacugucccaguggcaugcagacuguccuguuagugagucagagcaaggcucuggggcucuuugccuucaguguuguggcccuggccaugggucugccuuaggcuccuaaucucugucucuggggcccaggggagccucgaccuagccccucaguauuaccaugucuucucuuaggaauaucagaggcagggcugcuugaauggagcugguacuauucaauucucccgacugugccagcuuccuuguccucuugcaagguacucaggguagggacaggguugagaggaguuagaacuucuguauccccauagggcuugguaguaaguacagcacugcuucaaaauccagcccccaaaagcccuguacccucugcuagauacaggcgauccaagcaggccccuuaucuguacauagugacuguaggggaccccucuaguuucuguaaauauugaaucagugagugaauaaaaaugugcuaauaaaugaucuucugguugcuaucucga

SEQ ID NO: 7344 - RNA, 3097 nt, Mus musculus
ucagguucaaggucagccugggcugcacggggagacucuaccucaaaaaccaguagcagcaagacccaugguaauguagagauccuugaccgucuucugaaucagugaucaggugagagaggaucaucucugagccagcuggcugcucuugaguuggggaggucauuuuauuuugggcauucauaguugggcauucauuuuaaauuuuccugagguggagcugaagggaggcauucccuccucucugccuuccagagcagcuccuuucuugcugaagauuuuaauuaaugcaccuauuaacccuagggaaaauaguaugugaacaagcaaaauacaaaacaacaacaaaaguuccuuuuaaagcugaggcuuuaaauuagugucuuaggguuuuacuauuuuuauguuaaaacaucaugaccaaagcauuuuagggaggaaaaguuuauucagcuaaaguguuuauucaacuaugcuuucauaucacugcugaucauuaaaggaagucaggaaaggaaugcagacaaggcaggaaccuggaugcagaugaugcagaggccaagggagugcuguugcuuccuggcuugcuccucauggcuugcucagccugcuuucuuauagaaugcagaaccacgaggcuaggcauggcaccaucuacagugggcugaacucuaccucaucagcuacuaguuaagaagaugucccacaggcuugccaaucuuagggagccuuuuccucaacugaggcuagccagaacagugaaaauucaucauuuugucuacuuaguaucuguauacuacuuuuauacauaccacuuuguccauauucccauagccaaaauauagaaagaccacauuuuuuuagaguugugguauguuuuuaaauuccuaaauaaccaaguuacugcuuuguuucuuugggauuaggauagacuuggcuuuauagccuugcauuggacacaaaggccaauuuuaagacuacaguauuucuguaguggaugucagguggucuucccccuccccugcuguugcuacuuuagcuaauuaaauauuugugcugaaguuugaaucuuacacaugauagcaaaagagcuacaucccaaacccaggauuuuaaucuuaaaagaacguucuuauuaaacugaacugaauuauaacagugaucaucuguuguuguuguuuuuuuacucaaaacuguccuaauaaagccccgaauaccacgaagcugucgauuuaauacaguaccacacuuugucucugaaguuugaccuuugguguuagcuaaaaggcugggaagcuauugucauuuaaauuuaggauuuaaguaagauuggugauuaauauagacuugaaaacagauuguuuuuucuugugccuuguaggacaacaucaaaaauaaaugguguagaauauguuccuuucaugaguguugaucuaagggaacgcuuugcuuauccaaugccuuuuugguaaguaagcgcuuuuaacuuuuacuuccaggaucauuuaaaguguuuuucaguacucugaaguccaguuugcuucauaaccuuaaaauuaaauuuuauguauaacgguugggaaagaguuuuuaugggaaagaggugggaaauuguccaauaaagaucugagugaguaacaugaaguugucacuuuaggacagugccaugcuauccugccacacgcucacauuuguucuaauuggccuggucacgggcucaugaggauugaucuuaacacuauagacauagugcuuagcauaaugccuggcucagagcgagcaguaaggaggcgcugguugaugauuggaucucaaaggaagaaagcccagagaguaacuagcuaagugucuagagacggacugaacgccugcacaaacacacugcccucacgauuauaagagaaacuacuuuacuaugaauauauguaaagagauguaaauguacacaaaggccuuuacauuuaagacuuaaaucauaucaugcaugucacagggggauguuuucuuucacuccuuuucuuuuuuuguguguaauuauuugcuuacuucuuguguauaauucuugcugagaauuacaagcuucgucaggacagaggccaugucuguuuaaccaugucccaucccauaucuagcacgacgucucuuuuauaguaaguacucaagcuguacucaauaaauuaaauuuggagaagaauagaugaauacuaaaaugaauuaggugacaauauuuuuccauuuuugucaucuaaauuuuacauagagaauacugaaaagaaaaauaauuauacacauuuuaaguucauuuaacagugagaggaaaagggcuccacaaugugauuucauuuagagcaguggcucucagccaucuaaugcgcaacccuuuaauacauuucucaugcuggggugaccccagucguaacauuauugcuguuacugauuuuaauguaacuaucugauauguagaauaucugauaugugaccccugugggguuauucaaauccccuaagggggucaugacccacauguugagaaucagguguagagagugaaagauuaaaaaggauuuuuuuugggggucuggugauauguuaaccuuuaagucauaagcauuguauuuuauaaaauacuuuuuuuuuauuacguauuuuccucaauuacauuuccaaugcuaucccaaaagucccccacacccuccccccccaacuccccuacccacccauucccauuuuuuggcccuggcguuccccuguacuggggcauauaaaguuugccugaccaaugggccucucuuuccagugauggccgacuaggccaucuuuugauacauaugcagcuagagucaagagcucugggguacugguuaguucauaauguuguuccaccuauaggguugcagaucucuuuuauaaaauacuuuuaauaaccuuaugaguugaagagaagaaauguguucaaauuacugacuuuaauuacucaguaguuugggagaacaaauacuauggagucauacauuuauucuguagggugagcauaggucaagaacaugacucagaauuuuaaaaauguuuugagcaguguuguagguaaacuuuuaua

SEQ ID NO: 7345 - RNA, 15464 nt, Mus musculus
uaaugguuuuagagcuuuauuguagaauggcagggagaaaaagagagguagaaagagggagagagagaaggagggcuagagaugggaguaagaaaggcgaaagcuuaaagagccacauaaaggauucuuaacucuauuucacauagaugucaguuuaaaauaaaacaagacauuaaauauauugcugaccuucauuuuuauuuaaauauauucaucuugaaagagaguaaacuauacagaaaauauuuuauauaaauguaaacaugcaugucuacaucagaauuaagcaaaauaaauuuuuaggcacaagauuuuaaauaucauuaaaggacacaaagaaucuaagacagaaauaacaggaaacaaaaacacacaguuccuaacacuugaguuggucuuccaagcuacugguuaaggccugaguuucaaaaaguuucuguuccuugccaaguggaaagauccaguuuggcuguucuuaauacauaucuaucuacaaaacaauucucucuuaaaauaauuaauaaauaucacacacacaaccagucucucaaaagagggaaggacuuuggaauuuucaaguuucccucucacuccagcacgucaccgcagagaguuauucugcuacagaaacaagcuaacacguggcauuauacgaaucucuaguuuaucuguauugcauuuucccaaugguuuucaaagauugccauggcaucucuguagaauuaguccuuccaccuugcccaagugaacauugcauagagcaaauuaaaaaaaggucauugacagauucgguagagaccugcaugggcacugcguacagauuuccagcuuugucucaaugccuggaauguuucaguuuacccuccacccuucacuaguaguugucuccaucucuuucccaaccagaguaggagcaccugcaugucuaguuccgugaugacagccccugcuuuugaggcacuaauacuaaccaagaccagguagaaugguaguuuguauauauaccagggcuuacccauagguugaaagaaaugaagagcuugugaaauaggcgcucuggagagagguuuagagugggugaagaggaggggacagcaaaggcacagcgacaggaaggaguccuuugguuggcacaaggauaccccugagaagccaucugggaggcuacauucuggauuuccaaaaauagcuuucuuacucuagugggggaagcagaaagaaucaccggaggauuugugcagagagcaaaaccuggagccaucuacagaaggaccuguggugcuggguaagccgggugacuagaucgucugaggcacagaaagcucaauuuaucaagcccagugccacaugcaaguacuuccuauggcaacaguccccaacuggaaugccaacaccacagcucugucuacacaaaccaaggcuuuuggagaaaagcggggcaaggggagacuuaaauaggcauuuuuaguucaaguuccuggagccugccacagucugaacagcgaagagcaguaaaaacaguucaaugcccacaucuggugacaacucaagucacccagucacaacccucaccuucccugagcugucauuaccaaagaggguugguugguuuguuuguuuuuugguuuuucgaggcaggguuucucuguauggcccuggcuguccuggaacucagaaauccaccugccucugccucccgagugcugggauuaaaggcgugcggcaccacacccagcauuaccaaagaauuauaaagcaauuaucaguuugcuuuaaauagguuccaccugccauggauccauagagcaucucccagugggcugagacugagcagaggguaugggugcacacucugcaucugagcuugugcugagacguguaggugugcugcugggcaauggccccacccaucucaguucacuucagucucugaguggaucagcugaucuguauggugugucgaccauaaagcuaaucuauaugaccuacggccccaccagguccagaccaccuuccuccacuaugcaggaggaaagaacagcauuguuaaugucuuaaagcagaaagacagggauuuccuaggauauauucauucagaccacagagaugggcagacacauaagucaccacauacuuccucaaugugcaacccugacuagugaccaguuuccagcaagaacauuuauuuggaaauggcacacagcaaaaggcaaucuugugauucucuucuauaaaaauaacccacgagacugggagucaggcaccaacagcagcacaaagcaaacagcuucuaaagacuguuccauacugcccaacuccugucuggauucucaccuguggagccuugcugcuggcuaaugugcucagaaguucuucaccacaucccucugauuucuacccucugcuaacauccugggaaugaagaaccuagggauggaucugcacaaaagcaaacaccucagaugagcugaacgcgcacacacagcuggaacugcccgagucugaacccaagcugaaugccagcaaugcuuuuguuuuuucagaauccaauagaaaguuccaggccagagaaucugaagccagcaaguguaauucaaaaagaggaauucgugagcaagcuugcccagggacagugacuggcaguucccugcugugugcguccauuuuccuagcugugcuggacugagcuauuggaucucgagcacacacacacacaacugacccaaagacucugccaaggucaacuucuauggucuggucaaacuaggucacaaacuuccuuaccacuuaguaucaacacuguaaaguggucuuaauguauuucuaugacacaauuugaagaucucuuuucuuuccaugcccuuaaaagacuuguauuuuacugauagagaccacccaggcaagcugagcugcucaaucacugaccuaugaagauauggauuuugaguauccuagaccaggguacacuggucugcuuuucauuaacaauguuaaccaaauaaaagagauuucuguuaguucuccuauagauauacuuaaacugugaaucaagagauuguucaaaaauuacaugagaaaaucacccaccaccaccaaguuaaagacugaguaucugagugcuucuaggccuuaacuccuauuggcucugaucugcaacauccuccugugacaugugguccuggcagauggagcugggucuuguagcauguuugaguuccagaaagcagauuugaaaagccuggugcuagucaucacugucacugccagacucacuuagcugcaggucauuuccuaggaaagaaaacaaaaucaaaaugaaagcacggcacuggucauuagcgacuuccguggcuccgcugccucuccacuuccucgugcguuaccugcagcauagcucacuguacuuuaauaugcuuuauuuugccuucacuuaaaauaccaagacuuccuuaagauucuuuggcuggcucagcuaccacaucacaguaagagaugguacuugcugcucuugcagaggaucgagguucgauuccuagcacagacaucuguaacuccaguuccaggggguucagugcccuuccuggccuccucaggcauaagugcauguggagcaacacauacaggcggcaaaacacauaaaagauaaaaagaauaaauauaauuuaaaaauuaaaaaggaaacaaaaauaaaaaaaccuuugcuaauccaauuuauuaggcaggaaaaucuauuuggcucacagaaaaggcuggugcagucgcacuuuugaaagaaacacuauuuuuaucaugugcaaaauacaguuugguauugcuuguuaguacugaagaggagcaacaaaacauguuuaaauauguuaauaaauaacaaaaaauacaaguaacauacagcacuugucagacugguuuacauuaaguugauuuuauaauuagauuauuuuauuuuauguauaucagaguuuggcuuggaugcaugucuguccacuaugugggugucugguacccuuggagguaagaagaggaaguuggauccccuggaacuggagugguugugagcugccaugugugugcugggaacugaacccaggucuucaggaaggacaagugcuuguaaccccuaauccaucucugcagcuucauuaaguucuuuuuaaaaaaagcuaagcaccaaggaggcugaggcaggaggaucacaaacucaaggccagccugguccuacacuaccaucccaaacaccaaaagagcuaagaggcuuccauuauggaagcugagugcuaguuacaucugccguacacuagucuaauguccgcucugcccaucucuguccaaggcauuuauauuacuuuaaaucucaaguuugaaccugucagcucucaggaaacucuaguuucuuauuugguauguagguaccuaggauuuaagaggacucgacacuaagcucacaaaacagaaauguguacaaaagagccucagcugguaucagcuggaugaaagugaaagucuguauuucuaacuucuagccuagcuuuucuguuccuggaacccuuccagaggucccauccccaucccaaggacuuacuuugugacugugaggacagacuuucuacccgggccucacuuguaucucagauagggcacaccaggcacaaugccgaggugccugaggucagcagcuggaggggucggcaguggcccgaguggguggagcucagacacggccuacacauacaccaaggcacugcauggcaggaaggaacuacccagccuggaauguccauggugcugagacuauuaaugacugucugggcaauaaugcaggguuaaccaggucugcauucccacuucugcugccaggccuuccaaguucuucaaaggaagauuaccaggagggagacuauucaccauguaagaguccagggagagagcagagcuuccccacucugaaacaaagccaacucuacucuggcuuuccuguuuuauaucaauuggaggaacagcuaccuaaauaugacaacacuccuucucuucucuugccaaagccuaggagguguccaaagaagguaauuaacuuuuaaaggccaggaggaaggcaauggaggcauaucuuaaaccugguauauggaaaaccaaagagccuacacaauuaaauuuaagcauuuugcagaagucauagccacaaguaagaggaaaaaggaaaggcugggaguuuugggcuuccccaguuugucuucaucaagaccuuucuugugccccacugccuauaguugauagguucuggcacaaggcaaagaaagcugcauaugcccucccugucucagcccccaaaggagggcacacucacugagcguguucaugagcugagagcuuccuuggggccggcugguuccauuggccaccgcaggccugcuguuguagggcugcuggugugagggcuggggaggcgaggcugggccauugucuucgccugcgcugcuggagcugucgucgucacuucccgaggagcucucagagucggaggagcugcucccacugcugcugcucaucugcucaauaauguccaccucggcccucagcucugcaaggacacagcugagaugacccaacugccgcaggggacuucuauccucccugcuucccaaggaagcacaaugaacccccaaaccaauaagaaugccuacucugucuccagaauugaugguaauacugaauucaccaaaauaaacaaaacgccuguuuuagaaugacucuucuguguaagaaacacaucaggguuauucauuauuauuaaucccuuaaauaaauacuuugaucuggguguggugugugcuauaaccuagcaguugggcacuggaguuaggaagauuuugaguucaagaccagacugggcuacagagcaagaucuugucacagacaaaaaacaaaaugugaauuauuguguaaaaccccaagagaaaaagaauagaaaagcauucaucuagccauugcaagucugaggauccuccugucuuuguuucucucucuggcagaagaaaggauuuauucuggcucacgguuacagguccagccuauaagggacgucaccgaggcaggagcuugacgcugagcagaggcagcugaagcuucugcucgugccagggacucaaucccagggacuggugcugcgugcuugugugcaucuuccucagucuaauuuagacaaucccucagagcaugcccaaaggcuaacugagccuucacaggagugccaagaggcgcgucccuaagggcuucagauccugcaaguugacagcacugaacaccacagcugcucaacaacgagaucaaugucaacgauggacucuacgccaaggcugggcagccagagucaccccgaguccuuuccgacuuccaaagaagacuguaaauagccccggcacaggagacaaauggugagaugccacacccucuauuugacucucacacauuugaucauggcuucgcuuguccugcauucuuugugaaugucuacuagaggugaaaaaaacauguuuucccuaaucaauccaaugucccugaauacauguaggacuaacaauacagccauacauuuuuucuguccaaacaucaucauggccuuacauggcuucagcccacucuuggccuaacucccguuauacuacaguggaaacuuacacaauagcguucuagaaucagagagggaaaauagucaagaggugccacagcuguuuaaaacucagggugacugugccuaugagaaggcagauuucuacagaguaagaaaggcaaacucccaggaaccaaccuucaacuccuguuuucugcuauuagggauugcaauuguuccauuaaacuuauaaaugugaaauaugcuuagccccauaaugccuaagagucuggaggcuagaacacucuaccaugugagacaaaaaccaagguaaacuugucugaaguuugcaaaagagcaaaaggcucacggcagaccucuaaguccuucuggaccagauuucagucgauuggccucggccuuucaggauuacaugcagagucagcaaaagagcaucuuacccuggugcuugugcaaguucccuuaguaaagcgcuuauauuugcacauacugaucaguagaugagcccagaagcaacacaccuagaauauucuuuuuggacucuacagcccuguaaaguuuugguugacaguaacacuuauuuaaacccuauguuucuaagaagacagucacacucgagccaccacaccuggacucauucuuguccaaugauguccacaauaaagucucaguccucacaagcuccagagcagggaccucgguuagaacucuguaugguagcgagcucucagcuccaagaucaccucgcccaccccacacgcuggcccggcucuggaucucuaccucuuuugaugucauccaacuggggcucaggugagggguuauccuucaggggagaaguuuuggguccagcuggaggcuucguuggggcucggaacggcauggguggagguggaggggguggcugugacggcugugggggacgagcgggcugcugcuccauucgagcuuggauuuuacugcuucccucagcucugaaauagacaucacaucaagaggcaaagcaguauugcucaggaugaccaagcacacaggcagcguuugcagaaccaauguucuuuccaggugacugaaaaucuaauuguuuaauuucaccacaagaaugcacucaauguccauaugucuacugcaucccagaacugaacuaugcaucagugaugcagaguuggugaaaugacucugcuugcaaggcgcucacccuagaauucaagauccuuuagcugcagccuuccaagagcuaagauuucagaugugccacaucuaagcucagcaaggagauaaaacaaugugaucaagcauuuuuacagacuuaaauucaauauaaaguuguaauaauaaauauacaaguuucuggauaaacuggauuaugaauuagccuaauguuucuuagcuaagcaucuacacaaauucccuagacgucucugcaggucugaccuaguaagucuugagauucugugagcacaacaaauacccuagagguauggugauaguccccaaucacagaguagauagaggacggagcaccaauggguauuccaggaguagcacauuuaaaacagaccuugauacaaaccaacaaaggaaaggacagaaagggguaccaugggcacuucgccugaggugagggcuuagaucucgaagucaaauuagauaaaucacaacuucuguaacccccagucuccaaaagaauagcacuuuucuacgacuacuggaaaagauuagguguguuacaccuaaaacauacuggcccacgauaaucucaauaaaugggggcuguuuccuuuucuagagaaaugagggaaagaaaaacagaaacagacaucaagcugcaauagucucuuaaaaucuaauuaguguucugugagaaggagggggaggggaggacugagaggagaggagggaggggaacugugacugggauguaaaaaaaaaauauacacacacacacacacacacauauauauauauauuuuaaugaagaaaacccccucucuuuaguggacuugugauuuugcucaguggugagggcacucgccuaucaugugcaaagcucucucucugcauuugaugccuagugcccuccccgacaaaaaccuuaaucauuaucuuacaauaauuauuguauuccaguuauagaauauauugacuuucaaauaaacucuaauauugaaugaacccaaaaguucacuauuuuaaaaguaggaaagguuuuuuuuugguuauuguuuuuaaguuuuuaaaauuauaguuguauuuaugcuaggucuucuaccacgugaguccugaagacugaacucaagucauuagacuugguggcaaacgccuuuauucacuuagcaaucuugcaagaccacuguuauuuguuuuuguuuugacacagggucuccugcaauucagaccagcuucaaagucacucugcagcuguagagggccuugaacucuugauccuggugcgccaacucuccaguacugcacuuacaguaggacccaccauacauaguagacgacguuucauuuugauaguauaggcacaucaaauauauccuaauuuacaagcaguaauuuaauaaggucaugcaauuauuauuuuguauuuuucagucuauacauauaaacugaauccccuacuugauaguauaagagcaguuaugagucugacaaaauuggcucaauuauaaauacccuguucuccccaaaggcuucauguuuuagcuuucaaaagcauuauuucuuuuuacuguauuugaaaaaaauguacauuuuauuauugauguaucugagacaggaguggcuaauauuacugauugaacacuaaugagcaaggagauguucacacucuuauaaaacuggacugaaugccauaaagauuucgaaacacuuaaggcuauucuuuaggagaacgggcaccugccagcacaggagaccccgguuucaaucccuacaguacaagaggaagggagaacgcggagguuggccauaccuugucuucuugaccugaaugcugcugcucagcuucuccagcacauacucuccagugucgugguuaauaaugagcacacagucuuucugauagggccgcuuguucccuuugaacaccgucauuggcggcguggaccccuguuugccacaaaaguauaagauaaauacaccaauuacgaacgguccccuaauccaucaucagaccugcgcagaaggggcagaugacugaucucugucugacucccccagcuuuccaggcaaaagaaaggagcaguuauaguaagcaccugguuuuagggauucaagaaauagaacauaaaaacuuuaagcuacuaggcaacucuuuacuaaugugggcaaauaguucaaagaacagcaaugcccaaacugaggacaauucaccuugcccuacacuacacagagcuauuacuaacugguuagaggagggagugaucuuuguauuucuuuguaauggaagagcccagggcuuccccuucaugcaaauaacccaggcagcuuucuccaaggguggccagcccuucagcugagugaguggagcccauguuacuuagccaucaccccaagccuuucaauggcucccaugcugcucgcaaggcaaaggauaaugaauuuaaggcagggccugaccccaccacccaucucugggcucugaggucuuuaggaaguaagaggcucuuuuuccugcuucagggcugaaacuggccuucugccugcuauauuuugacacuauguaaauuacucgaucuucuguuaaguucaaauaacucuucucugguuuuccacaaguguuuauuuugguuugguuuugaaacagggucucacguagcccaugcuagccuuauacucucaaccaccuugcuuccaccucucaaaggcuaggauuacaggaaagcaucguauccagcagcuacuauauauuccuauauuuaaauuccagacccuaagcugcacaacaucaggaaauguacucauuugguuuaaaguuaauucuuagagcccacuaaugggcuccuacacuggacacugauuuaauauuuguuaaauauaagauuuaacuuguuguucagaauuuauagaagcacaaaacaaaacaacagcaaacuaaauugcuuggcucuucagccccuuaacugcacaguagaaacuuaagucugaagggugcauagggaccauguaccuaaccccuucauuuuucacuugggaaacucagguccaaugggagaugauguaaucuuccaugggcaacauguaaugaaacaggaguucagaugaaaaggcuguucccucugcuccagggcuuccagguuugcugcagucugcacucugucaccaguuacagaacuugcugugucugaggacagagccgugacacguacuaaggagcuuuucuagucuaacuguuuucuguuuauuucuucugugugugugugcauguacacguguuuucucguguuuucugugugugggcagaaauagguacaggugcauguguguaucuacaugcaccuaaaagcccaaagcugacaucaggcucccuccucaaucacucuccacuuuucuuuuuugaggcagguucuuuugcucaauccaacuaagucuagcuagacagcuugcccaggggauaccauguccuuaucugugacugugggcucacagcagcugccaugucugccaugguuuuuacauggguucugaggcacccaaacuccaguccuccugcuugaguacuucauuuccucaagccaucuccccagcccaaggugucgugaacgcaaacacaggucucccuucuguuuuccuuuggcugaacugggaauugacccuaagaccucaugcgugcaaggcaagaccucuaucacugagcuaccaccccagacucacagugcugcccugaagagagccuuacaguacaaagucuuuucuuccaagucuuuggugcagcuuuuaacugaguucuucaccccuaaauuagcugaguguuccaaacuuugguuccugccuaggaccaucagccugcaccggaucccuuacuaaauauagagaugucacucuggcuccuggccugccuucuggcuguucuauguucaggagcugcuauugcuaugcagggcacauagggcccuuuucuccagaacugcuugggauaaguguuauauaugucuagcaaaggggccacugucuagacggaaccuugccuacuauacuauauauuggacagagauggggaguaaagacuagagacaaagaacuaccuaaaccaagucccaagacgcaugaguaagaacccaucugacuccuaaauuccuuuuuuacuuacguuagcucucuaaacauuuaaaauaaauaaauaaauaaauaaauaaauagaaggaaauuugaacuguaaauaaaacacaaggucguuacauuagaucaacauuggaaacaacuuacagggauguguggcagcguaauggugacuucaucuccuuugccaaccuggaguucuccuucacaggaagugucuauugaugcuggcuuaaaaucgucuaaaaggaaacaauggauauuucccacuggguggcugaaaaugaagacuucuugggcauuuuaauuucagauuaaauaaaagcaguugagaaugccuuuaugugccuguauaugcacagguacauguguacaaauaucugcagguaccuauggaagacagcuuuagauaaucucuuaaguacuauuugucuugguuuuuuugaccagggucucucauuagccuggaacucacugaacaggcaaggccagcuggccgguggguccccaguaauccuucugucucaauauuucuggcacugagauaggaacuguuuauccuguggcuccuuuauguggauuccaacccggauauucauauuuucauaucaaguacuucacagacugaaccaacuccccagcccucucauuuacaauucuaaaagacuuugucauagaaaacuucauaugcuucauucacgguaauaaugagccccaaaugcucucacccaauaguuaucaacucagaaacaccucuauauacgcugccuucaacuauaccaucauuuaguacagggagcugaaacuuauauacucucugaaacuuacacucucuuauguuaauguaagacaaucccuucuuccaagugucaggcacacaauuaacaucucaccauccauaauaagguaauaccagaacuguguauauaaaaacuguguguauaaaagcaacacagcaaacauucuuuuuuuggggggggggggaggaggguucgagacagggauuucucuguauagcccuggcuguccuggaacucauagaccaggcugaccucgaacuuagaaaucugccugccucugccucccaagugcugggauggcgugcaacaccucugccugcuuucagcagacauucuuaacuauaaauccuacauaagacacagcaggccacaugagguuggccucuuuuugcacagaaauguucuaaaauagaacaugccacauucaaguucucauuuuggugggggaaaaaagucuggcuauguucagaagcagacuggcgaacuccagaaauuacccugcuuauucuugcaaauuacacuuacacaauaggaacagccauuuuacuucgcaccugacucaaacugcaggccaggagcacaugugcagaauugcacuuaaacuuacacugcucuucuguggaggaacaaauuagucaacugggaaaugacaaucuuaucguuuccccaguacugucucucugcaacagcugagucugcugugggugcaaagcacagaugcagcuaugugacaagaggccacacagagaugggacuuuaauaucuaacacaccccccugccuguguguugagucacaucgauuagcucccaugacaaagcaggucuuaacccacacuaacgcuaccggaaacccgacgccugugauucacagggaugugcuugguuuggucagccauguccugacucaggacacacaguggcaauaccccuuucagagucuauaaucacguaggaaagggcccaacauaaugacucuuuccacauuccuuaugcugccuucuucauuuuccaaacauagaucaggcuuuaauuuaugccagaugcacaaacucuaauuuuauucuucacccacaagugaguuggcccagaaguuaaggugaaguaggugacauuaaucuagcuagguaugguggaucagguccauauuuucagcaccacagaagcugagguaggaggacugcagcauguucagcgcuggccugaauuauauaguaauuucuaggccagcaucacuaguaagacugucucgaacagcaacaacaacaaaaucagugucauaagcagagaggaagaagaaaccuuauggguggcacgaagaaugcagguucccuggcuguggaggagaccaagagcaaggggaaaggagcaagggaaggaaugaaguaaacgacacucguagcaaacggaagacuuuuccagggcaagagcccugauggaagaauucgacaaagagaacggggacacaagggaggagaaaugggcaucgcuacuaaaggagaaaaguuuggcuuaagggcugggaaggggaauuugaaauaaaggggcuaugacuuucugaagugguauuugagacuguaaaguaaaagaauaguuggcagcaaucagagguuugguuugggagaagagauuucaaaguaaaagagcagaucgaaguuccagaggcuaagggaugagagguaaggaaagcgacgcuuucgagccgggauuagccaggggagucugggcuugcacguggcggccagggagccccaagugaaccuggaggggcgcucacucacagcgaaucguguggaaggaggcccgcggccgcuucucgaagcuuuccccuagccgcagacaguguuccucccgguccagcagcggguucgccgugccguucauggccuugcacuugcccggcacccggauuggagcucuccucgcgcggccgcaguccccccggauccccgcgcaagcggcccgcaggaccgcgcucccgggacaccgcuccggagcgcgcacugaaccaaguccgcgcccacccggggccggaaaccaaucuacuccgcgucucgagagacucugcggaaguaaggccgcugcacuuccggcauuggggagggacuuccgucuccccaacggaaauagcgggggcagugccauggagagagaguucuccgggacugcugcagcccacaguuuucuggucuaaggaggagcccaggucagcuagaagauucugcugccgacgccugggcuugacugacgggugagugcgcccugaccuguucuuugcuggggacccugggagcucagagcguggggaacugaguggacgcgaguuugaauguagguaugagugucccuggacaugcccgagacccuagcggccugcuuuauccgaggguucagagagcgaugacgguucucgggaccucagucacccuucccccuacuucgcuccaugguugcgaugagaggauuucaguucuccuggccgacgacgcuuccuucaguuuauggguacgaucagaaaccccggccucuccggaucagcuccgucaccuccuuagcccccccgcgaucccgugucuguuaggcaaucgucuacccgcuuucgguuagggcgguuguugccguuguuuugaagucacguuucccacgggcacugaacguugaugagaauuuuuuuuucucacauuuucucagucaacucguggaugcgucccuuugcccuaaguaaaccuauuucuuguaguacuuggcucaucug

SEQ ID NO: 7346 - RNA, 804 nt, Mus musculus
cuuccuuucuuuuugauuuuuauuuuuucuuacuuaaaacaauuguuaaauuuaaauauauuuugaucauauuuccccugcccuauaucuuuccagauccucucccucucccuaugcacccuacuucaaguucuuuugcaaaaacccaauacaacccccaccacccugccaaaaacaaaauaaugcccaagaaggaagaaacaaaaccccacuaaauugaccaagccccuacacacacacacacacacacacacacacacacacacaaaaaguguguagucugucauacauuggucaacuaccuaaugugaggccauucuggagugguugaaagaccaguguguaucaacucuauuggagaaaaugaauuuucccucucccagcaaguauaaagggcagcucaguuguuaacccuuacccuaauaaaguuauaacaaaauauaauaacauaaaacaaaaaaauaucacuucagaguuggacaaaacaaaccaacagaaggaaggaagcucaggaaaaggcacgggagggacagggauggugugaggacaagauguagcuacugguguuucccggcuuauggcaaaugugccaggauucaccaccggagaaauuagcuuuaauauggcuuacaagauuaggauucuaguuguugcacccagagauugaguuaccauuguuucugaacuaaguuugugggguguuuuucuucucacagcgauucgacuggguuccagagagaaaggugaaccuguagcuaaaagaaaaggaaaaaggagaaaggaaggaaagggaaggggaaagga

SEQ ID NO: 7347 - RNA, 804 nt, Mus musculus
uccuuuccccuucccuuuccuuccuuucuccuuuuuccuuuucuuuuagcuacagguucaccuuucucucuggaacccagucgaaucgcugugagaagaaaaacaccccacaaacuuaguucagaaacaaugguaacucaaucucugggugcaacaacuagaauccuaaucuuguaagccauauuaaagcuaauuucuccgguggugaauccuggcacauuugccauaagccgggaaacaccaguagcuacaucuuguccucacaccaucccugucccucccgugccuuuuccugagcuuccuuccuucuguugguuuguuuuguccaacucugaagugauauuuuuuuguuuuauguuauuauauuuuguuauaacuuuauuaggguaaggguuaacaacugagcugcccuuuauacuugcugggagagggaaaauucauuuucuccaauagaguugauacacacuggucuuucaaccacuccagaauggccucacauuagguaguugaccaauguaugacagacuacacacuuuuuguguguguguguguguguguguguguguguguguguaggggcuuggucaauuuagugggguuuuguuucuuccuucuugggcauuauuuuguuuuuggcagggugguggggguuguauuggguuuuugcaaaagaacuugaaguagggugcauagggagagggagaggaucuggaaagauauagggcaggggaaauaugaucaaaauauauuuaaauuuaacaauuguuuuaaguaagaaaaaauaaaaaucaaaaagaaaggaag

SEQ ID NO: 7348 - RNA, 22609 nt, Mus musculus
gacacauugucugcacaucuauugaagucaaauguguagcuauaaaguaacaaacucaucuuuuaauuuauccucauauguauguagagaccaagauccugcaucacuuuaaguaaaacacucgggaggugguuugugcuguuaccagccgacuagaaaagcuguuccuuugugguaguuugucucuagcuugagcaacccacuuccuuuggugugcacuggaagagggaaauuuugaaguacuaucccagaaaguguugacuaacaccaguauuuggaauaaauacaggagcacagcauagcgccauacguuacuuuauaguuacauacaccuauagugugcacaaagcauugguccuggugggucgguuguguauuuauccucgcccacaaggggaaagucugucggccuuuaauuucugugagaaaggugacaucuaagauauguguuacagaaauaccagcuuuugcucagaaacaacuuugggggagauaacgaugacaggugaccucaaacagugccauuuaguucagagaucucuaaauguagcuguaaauuugggguuaauuuggcuucaaauauuggaucuuuuaaaugaaauaaaaauuuuuaauguaaaaaaucaagugucuuucuuuuuuacauauaaagaacuuuuuucuuuaaaauguguuaaguuacagcagguuuuuagacaaguuuuuugcagguuguuaguguguuuccuacagccuagaaugaauuccugaguguuccuacuccacgucuaggugcugcaucaccuacagguaugugccuccauccccagcucugauuuuuguccuuuaagaacucaguggcuucuuaguaguuauuuuagacuuuuguacuuaccaaaaugaaucuuucacauguauuaacucaacaaguauauguuucuuaccugcuauguacuugaguaucagugggcagaaugguggugguguccuuuaacggcugacgguuucaucauguaagcaaaaagugauaaauaggacugagauaagccaccaccgaggaaggcaggaacaggacaccuaagcgagcaggaaggcagcgggcuucaugguggaggcagcgcagaaccuggacacuggggacaagucugacugaagcaggugaagaaggccuacgagauuuccuaggugcaagagcuuggaagugcuuggaagagggcagaugggggcacggugcucuucaacacgagguguuccuaugugaaaugagagcguaacaagcuauacagagcuuugauaacaggcauuaaaaacagauaaauauuaguagcugcuugggaccacagauaaaggaguuuuaauaaucuuugaaaucaucucugcagguaacaguaauagaaaaggccaguacacuguugaucauguaccaggcaaagacguaaaugcuugaaauauguuaucucuuaauccccaugacuauccaaugagguagguacuauuaauaacauuuaacacguggaggaagacaaaauaacuuuugaccacagucuugauuuuuaaaaccugacuucagcugcaggcaguccuccuccuguagugcucucuaaugcgugugcugauucucugguuuuugucuugacuucaaaauuguuaaauucccuucaguuuuauucucauagcucaauaucuuuagaauaaacaggaauguggucacagccaguacuggacaccugcugcuugcaauggagcugagguucuggguauagagaaguaagggggagggaguugucacucacccuugugacagaguggagccagagagccugccaucugcucaccucagucacuguugccaucauaagcaccaugcaucucacuugccuaaaauaacccucaugccuuuguagguuggcugacacgggcuuguuggaggggcugcuucaagcgggagccuucagagggcuuugccaccucauaggagccgaccuucaucuguuucaucuugauccuagguugaaauacaauaaguuacauggaaaguucucauaagccuggaaggaauucugagcacaccgacaugauuuguccucugagcaccacaucugcugccuuugggcuuagccucugggacaggggagcaugguuugggagccacuuccacaguuuagcuaguccugagauggugugcuggccaguugguugcaccuggaagccuucauuucaucccuauacccucuuuuuuguuucugugcccuacuuccuguuuaguuuguuuccugugagacaggacaugaaacguguaaucccugccccuaccuucugggugcugugcagguguguaccauguucauguucaguucuugacuccgucuauguggguaggaucuggagcuuggagaacuagucucuuucccaucucucugcucggcuccuccaaagcagauacuagacuaagggagaugagaagguuuggguaguggcugccuuuaaaaaucagaaaagaugaugacauacaguguugucuugacaacagcuuuccauccccagcaccaccgugucccaucccugccucguugguucucuggguuguuuccuguuuccuucugguuaccucacucuugcauucugaauccugguugguuuuuguuuauuguuuuguuuaagaaauaaaaugcuuuuaacauauuaauuguagaugaugggcuauauuucugucugcuguuuuuauuuugguuuuuaccaaggcacaaaguuuuacuuccccagaggguuucuaauucugcuccugucugcucucuucauucgauuuugaaacaaaauuugaguagugacuuaagcuuaaaauaucccuuacuauuuuaaacuaaaaaugaguuucgggguuuuuuuuccauuaauuuauuaacuuuacaucugaaucgcagccccgccccuuccccuucucugagaagggggagugccccauugaaggccaugcaggaggaaucacauagaaugcagcccguagguuaccacagcuacaugggugagacuuggcauugcaugacccaaagggccacguguccugaagacuuuauacuguuauggaguucugcucugcuucugcccucacaucccucuuuuuucuuucuucuucuucuuuuuuuaaucccucuuaaucgaagaguuauaugaaaacuuuaagagguuuucaguuccucucuggccaguaucucugacauucgcagugccgaugcuugaucucuuucaggcauugcugcgaggacagccaaggcuacacagagaaacugucucaaaaaaaccaaaauaaaauaaaauaaaauuguuagugaggcuagguugagaugguuuuacuacuggcuuuuauggaaaaaaaucuuagaaagcagacuaaaguucagaaagacacacucuuacuaguuaagcaauuaacuaauuagguaaccaguuaguuaaggugagggagcgagagcaguggcagcacuggcugacaugacucucugaggcuggacugguggugauucauuucuuaguccauuuuugcccucagcuucaguugcugaugaguggaugugcauugugaggacuuaagguagauaugacuggguuuaucuaaaagcuuagauuugugauucuuuuaagauucuuggaagauuacuuuuaaagauaauaaaauaauuacuccuuucuuuguaacugcaaauugcugccugcuaguaagagaaacuggcugagaaaaacuaccuugcuugcuuuuauacuuuguuagucuauagcaaguugcuuaguuauaaauguacauggguuuggggaaauaauuuuucuuuaccuguacuauguaauguuauuucuuguaaagguauuggagaacacauugguuuuuuucauaaccauucacuagaagaaaacuaaaagauaaucacauuguaauuuuauaaugcuuaaaagauuuugcugagauacauaaacuggaagaaauuauaguguggggauuggcauauuguuccuuccauccauccacuauguauauguauguauguguauaugaaaaguuugugugaguggagguuggaauacuguuccuuccauccaucaauuauguguauguagauauauauauguaaagcuugucugggugagcagugguguauucauguauguaugugugaacugcuuggagccugcuugcuggagcuuugcucuaaccauucuauguguaauuauguauaugucugucuauaguuauguauguaugcaugcauauauguauauauguguauaugaaguuauuggacucugccuuuuguuucauccacucagagagagagagagagaggagagagauuuucucucuucccuuucccaccagccccaaggaguuaaaaagaguuaauaguuuuuucacuggccacagggaguaccagccccagugaauuaagcuuuguucccucagagaaaaauuugcugaguaacugcucugaucccuggcugccauuggcagcagccccuguagguaucuggauccacccccaucagcagcuaccugcuucuguuuacccaacacauggaugccaaaacuggcuacuggcauucuggcucccaaacaggcuaugaugcaguaagcccacuguugcucugaggagacuggauaaagggcacagcuggaguugacuucaucuaggccgcaacuagcugaugcugugaaucaccugccacuuuaggcggaagcucccagcaccuuagaacgcugacccucugaauugucugccacuuugggcuaagacucccuccgguuaagcaucauccucacuaaaauaggacaggguaaaccuauggaauaaagguuuuccucugguguuauuaaacauacuuuugaaaaagaaaauuaagguuugcacuagucagcugaugguucuccccagcugguacaguaagccaguccuugguuuccuagaccaaggagcuuuagacauugaaccugggaaaccgcaggaauggagagaaaggcaucccucuuacugcacuaucugaauaugcauaagcagacauuggcaggugaucgagagcucuggucucccucaugaagggacuccuuuauuggugucucauucaggaucuaaaaacaauguuuauuucuugauagaauaaaaaaaagauaguucaggagaagauaguaaugaaucagaagaagagaacgugaccuuggagaaggaaucugacuugaagauggaggcagcaaaauacuguaaaccugaaugcccucaacugcaaugccugacccugagccuucuccccaggccuccugaacaaccaaagccgccugugggauucaucacugaugugcugugcuugacaaaagcguaaaacuucuuucaaauauucauuggauuuggcauuucuuaaaaauaauuacagcuaaauugaagccacuguuugauauucucaaccuggauacugccccagagucacuaagaaaauugacuucuaacguuaaaauuuuauuagcccuuuuagagccagaucagccccguugccccaagacagggauguuuacuuacggcuccuccgcagacacgcugccuugauuauugauguucagacagaauuuuccccacacuaaaacuucuacacaacaaaggagcuaauagcaauaauuacuguuuuuaaagacuagagaacaaacccuuuaacuuguaugcuaacucuuaauaucuagccaaguuguuuuccccguauuaaaaaauguucuacugucuucuggcugcuucacuacccuaacccugcuuucagaaucgcaaggcuuaccgcagucuagaaauugccuuuucuguguggaacacacucaagcuccuucuaugcuuccugguccuguguauaaagguaaggaaaaauugauccccugacaaaggcuguugcuuucucuggagaggcaacucagcagagccauucaucacaucaucaagucacugccugcucuucaccuccaaaggcugcuggagccaucuugcagaacugcuuggcuuaucccauccaugcaugcucucccccugguaacugacucgcagggcuuguguucacccuugcaaucucugauacuuagguuauuugugcuuccgucugaccugggaggcuucaaagauaugguacaguauuuuuuuuauuuuuauuuuuuuuacugucuacaucuuggggaugccaagggcuuuaaaaauggacagcgcuccuguguccacuggcaucccaugcucuaagaacaggcuguuauggagagagcacaucaagcuaaagacucagcuguuuacguuacaaagugaagaucacaaauacucaucuccuuauauuuuacaaaacaaauaagucccuuuuaaaauaucuuaauauaaaguuuacuccaaaccucuaauaagauuaaaaaaaaaaaaaaaagaccuacuaaugguaauaaaaagaaccagauguuucauuccaguaguuuuguuuguauguuuucauaggacucuaguucaccaauuccauaccaauugauuaugccaggacuuccacugcugccacguccuccauucccaccucaccugucaacaaagccacccuggcacaucagucacugcagggucaagcacauccucucccacugaggucagacaaggcagcccaguuaggggagcuggacucacggacaggcucagagacaggcacagccccugccccacuuguuggggaccuauauggagaccaagcuacacaucuacuaaguaugugcagggaggccuagguccaguccauguacgcucuuuaacaguuugugguucagucucugggacgcccaaggguccagguuaguugauucuguuggucugccuauggcguuccuaucccguccagauccucaguccuucccccaacucuuccacgagacucccaacuccgucugcuguuuggcugugggucucugcaccuguuuuggucaguugcugggccuguuuuccacauucaaccaguuuuauuagagacaggauuucucuguguagaccaggcuguucuugaacucgcaaagaucugccugccucugucucccaagugcuggcauuaaagguguacccuaccaccaccuggcucaaaaacugacaagacaguauguugaaaguaaaugaaaaggaaaaagggcaugguggaagagaaaguuuauuguagauaaaagagggaggcaggggcaucggcaucugugagaguccagaguagacauuacccugagccauaaugagggguggagagggaagaguagcuaccaaccaagaggggcagcccgggccaagagacuggccaagaaaguagacaaaagaaaccaaguaaccaaacuaguuugauugaauagggaagagcagccugaccucugggcuauggaaguuuaggguaggagucagaugugccagucagaagaccccuguuaaagguagggacagagggaugcugagagaaccuggccaggcccacuuugguuauuaaauaggcaccuuagaccuuugucccagcuuugaggccuaacagagaacaugcucuuaaauauuggaaauauacugggaccaggugaaguccuugcccucagaacacuugcacuuugggcagagacagacaaggauaauuccaaauaauuccagaugaaaagcaaugcucacaguccuggugugagagaagcccuugaggaugagaagauugcguguuuacacacuaaggauuacacagauauuucugguaaaaaagauggcaagaugcugcugaauaaguagaacaacauucgagcaaacucguggguagugguaaaagauggagacgcugagugaaccuggcagcaccaaccacagaauggcacagguucacccgagagacucuuguccuuggcuuuguugaguuugucuuguguguugguuugagcugaacuuggggccucagacgaucuaaucaaacacuaccacagagcucuauccucacccuugaguuuucuuuugagcuaguuugugaacuaugagcccuuuuugagugucugcugccugugcagcaucuaacuggccuugccucccgauagccuuacagacagugcaacacuugaguuggaggaaaacugcuuccuagaguaugagcuuuauucagaaaagggacaguuagaaaaugggguaaguuggcucuuuucugauaacuuaaaaguaucagcaggaccugugacuaauggacucuggucuaacagauuccauauggacaggaaagcuugcaccuaaccucugcugccuugguagccuggugugagcucacauucugauaaccaaggcacaacauauaugaaagaaaagucccuugugguucugauaguaaagccucaaaacaggaaaugccaagcaagacccaagagaaugaaugaagagaauucaaggcaaaggugcaucuggagaagaguggucuccuuucagccgagcagccaugaaugugaaggacauguggggauagcuggacguugguggcccacccauuugaucucagcacucggagcauugcaggaagaggccaugagaacuacagucaaagguugggcaucggcaucucgguuuaggacucaaucucuguucuuccucagguguggugcugcucauggaacaaggugcccagagcuggcuggaggcucuguucagggagggggccugugcuucacuacaaguucucaagaucuggguagaaugauggccaaggccauggguguggggagcggguguggcggcagucccaaaggcgccagucccaaaggcgccagggacugcagcuaagucauaugacuugcaccugacuuccucauauaagacacaaacaucuugagugcugcgcagguguaccaggauacaggugaauccaauuugguggagauuugccccugcugcccugauuagcugaagccucgugacuggcgagggggcguggccugcugugcauggaugggaacugagaguauaagagagugagaggcccaggguucaagggagauauaaacaagggagagauauaaacaagggagauauaaacaagggaaauauagagaaagaagaaacaggacugaauaaacgugugcagaaggauccuguagcagcgucguucuuccuggccaguugagcgcacgcaacacaugggaguauccagucagucugaggggcuugaaugucuaagguaacauagcuuuuuccaaacccuagccauaagccuuaccagcugagcugagaggacuuggagcagcuuucucacugcuggcuuaggugcucuugcuugcauucugaguccagcagagauagugguaagaaaaggaagagcuauuucuccaucaagguggugguggccagagaauauuccaccacauuugcuagcacauucuuggaauggacuagaagaaacaugccuuucagaugcucagaguguuccaggcauuuacuaggaaguauggaaauuccagaugugcacaaugaugccagguucaacaaagacaucugaaccaaaggaauaacauuugugugcaucgaucuagaaaauguaaggauuugucaagcccuauuauggugaccuaugucccuguacucuauagacagauagauauagaggauuucugagugucagguacagucaugaaaccucaguucaugacaaugaaaaugacagaauggcaguucuaauguuugccuccacagaagcagugguaaacuggcaaagugugucaaaacugaaucucccaauugugaauguauggcugcagcaacuucuguagcguguguuuaggaaaaagcacugacuauaagaacagcaagugucccagccugugguugcuggucucacucuccagcucuguaguagcuuggaaacuaguggcccacauuccuggugcagguggcaagcuaaugcucacucuuucaaaguacauuucauucuugccccauguuaaaauuccuauucaggcagcagcacagaccacagacauccgcacgcccuuuggugauagcaugggccacagaaauugacacaguccccagccucaguaggaccacggacccagauauggcccuugguagcaguacuucccacagacaucaucaugacuucagaccaaaaaaaguaacagccuaggcagacggccaucgaagagaacucuuuauugugauaaggaugcugaaguguagcucuccacaacugaggcuucaggcagggguguggguggggaagaacucaguuuucuuuaaggggcuggccaccaggaguuugacugugcuccaguugaauauaugggcaauacacauuggacuugggguuuuuuuccuauuuggggguugggguggagggaagguccacaagggagggcagaucuggggggaguaggaauugagugugcuugguguucauaaugugaaauucccauugauaaaaauauuaugaaaaauccuauuccuguucuuugacacauaacaauaggguaucagaauugaugcaaaaacugaaguugaagaauucacuuucauacuuauagguuuuccuauaaguaacaaguaaugggaacuagcagguaggaagucagcagucauagcugaucucagcagugucaccaacugcauggaguggacagucuguaggaucuucccaacagcaaaauacacacaccugaaauacggagcucaccauuagacuguauuauaaacuggaguauagaaaaucccauagcaagcuuacaucagcaaaaaaaaaaaaaaaaaauggagucugcuuuuggacacugacagcauuaagguagagcaaucaguggagcagugaaaacacgugaagauuaaguaacauauaaaccaaacauguuaaugaagauacugaggcuggagagauggcacagagguuacaagcacugacugcucuuccgaagguccugaguucaauucccagcaaccacaugguggcucacaaccauccguaaugagaucugacacccucuucuggagugucugaagacagcuacaguguacuuaaauauaauaaauaaauaaaucuuuaaaaaaagcuacuauaauuuuuaagacacugugaauuaaaugaaaggaaaagaugagaauugucuguguugcuauguaagcaguguuugaguguaaaguuccugacauugacuguccauucgaggaaggucugagaucagccaacugagcaucugccuuaggagacuagaaaaguccuugcagguuauaaaagggguggcacaugccuuuaaucacagcaggggcuggugagucuauagagagaguuccaggacagucaggaauacauagauaaucccugccuccaaaaacaaagggggcaugaaauugaaagcaauuucauuagcaagacaggaaauccaacaacugguaccuugcaaagacugaucaaagucuuuuaucaaagcuugggagcagggggagaaacagaaggaacaauuagaagacucaaccacagagccuacagacaugaauaauaaaggauugcgaagaacaacuuucuacacauaguuuuuauaaccuagauuaaagagacauguuccuugaaacacaauuugugaaaagugacaaaaaggaaaauguguguauucacugcaugaggugaacuaacaauacuucauaucuauacaucaguaauaugaagauaucagauaucuacccccuccacaauuaaagagucaauacagcccagaugaaaauuccagccaguauauuugcaaacaaaaggauucuaaaguuugaauauaaaggaaaguccagaacuucucauagaacacuagagaacaaagagaaaugucagaguugacuucauagcauaacauaaagcuauaguaaacgauagacuacugacugcagaguaugacacugggagaaaguggaacagaauagagugcaggcauaggaaucaauagucagcuaaucuuugacaauagaguuagggggauauaauagagccaaagaaaaccauuuaggcagacagcagggauucauggacaucuacugaaaguauagacacagauguacauacuucucagaaccgaguucagaaauggauuucagaucuagaugcaaaaccucagugagcugggauuuggcagguuuuaggcuccaucuguaaagaagagaagcuaagcuucaauaaaauguuuaaauucuuugcacaaguugacuggaagagaaugaaaggcaggacauaggcuaggauaaaauacuaacaaaaggcauagccaauaaaggaguguuauccaaaauguacagaugacuuuaaaauccauagaacgagccacccugcccucacugugggcggaggagggcagugggcaccauuaagaugaacauagacaugaugcagagauggggaaaaauagaaaaauggaauguaagguuggcagaguggugcaacaaccuggaacuuaugcagauacagacucagccccagcugaggggccacaggaucaccuuggcucuaggcaacaaugaagccugagacgacuggauuggaucuccuugaaagaccaccuuuguccaugaugccaccaggggccauguuggugucugguccauucuacugccccaggcauccaggaagccugagaucuauguggauguuuguagucuguccuggugacugguugccuuggugaugcccucugagggccugcuaguugugauuggcauguguagccgucugaggacaugaaguccauggucugugcacccacugagggccaugaguaggucacugguccugauaagaccaggggcuguguugaugucuguggccuacauuacuccugaggucugauguccauggucugggcugccauguuuaugucuguggaucagggagagcuggccccaccccucaccagcauggugugggcaugccagagagcuggccugcaccuguggaaguaugagcuggcccugacauugcagcagccucacagaggugccaaccauggcacaaguuugagggaaccguccugcucuuccccagcugucucacugcucuccacaguugauggccuaugguggggaugcaggugggaaagacucaucuucccuugggagacugaccacuaggaauuguccaugcuccaugauuguguggacaacacaaaauggacuuguggguuuucuuucuuucauucuuuuucuuuuuaggagguggagggucaccagugaggggggcucacaugggggaagcaagcauaacgggugcaugugagauucccaaauaauaaaacaaaaaaauguuaaacucuuuuuaaagccuuggaaaagagagguuaaggcucugaauuuggaaaauagaauauuaauuuaaaaauagaucuauaauaacccuuuguggaaaauaggcaacagaccuuaccaagccagauaaaggguguucuccccuuugugguuucacuguagaccagaaaaugaaaaugucaaaaucaggaaguaagcaguucucaagucccgaagcugugcaccguucugguuagugugguaaagcagcuccucgcccucucugccccucuaggggacacaggggacacgggucauucgcacgccccgcguauccacccuggacauaccagcgccugcccaucccuuagccauccugcccaucagagcgauugcugcagagucucagugcuagaguccagcuaacccugacuguguuuuauaugugucucaagucaugaaaagcaugguguaggguucaggcaagaggaagguagaauucccgcagaaccccaccgugaguggcagggcuucgagcagaccucugugaaggggagcugaagcagagagccuuucccaauggcugugacaguguugccuccugacagggccaucucuucacuuuuccuugccuuuguuuccuggcugugaaacaauaguggugugcgauguacaggguuuccgagcagugcugccaucucugcuacagacguggugggaauuaagugagagugcguggaagggggcugguguguaacacgcacaggguaaagguuagcucucuucucugcccuggcauuuuaugggaaggauuaaaugagauaauagacagccuagaaucugaacucagugaguugauggcuuugugacuuuaaaacuagucauuuaacuucucugaacuucaaguguuuugaggguuuuguuuguaaaaugagaacauuuaacauuuuuuccuauucuuuuaucucucuggcugcuguugcuugggggcuucuuguuuuuuuuuuuuuuuuuuuuuuugagaagggaucauggaagaucgguaggagggacacaugcagaggagaugggacauggucugguguuagggagcacuccugaaaggcgacuugccaaacacuuugcugcuaugacacucuucuccuaaagaagacguuauguuuuuucagggaaugaaaaucauucaaaagucaucuaaaaccuacugccuuggucugcgucugcaaaaacgcacauucacugugcaagagucugacuaaaggaaaugccuuuguggaaggaaguuagggaggguggagccugagguggcuucaagucuacccucaaagacaucagugaucaauuccuucugugcgacaaauaucugacaaaguacacagaagcccuugggcccagagugcccuucuucccagaaugucucugcuuuaguauccucagcauguucucagaagccgagggugaaagccuggccuaauggagcacuacagggcagagaaggcuccucaaggcugacucaagaugagaguguguguacaaauuaagguuuuugagccuuacccccccccccccccgcugguguagacuguauuugcaccaaccucaguacaguuuccaguucuaccaaucacaggccccacauauagaccagucucaaauccugcauugcaccaaucaccagcauugcaucuugcugaguuacugagagcugcagcagcugagggcagggcugcagggcucugagcccugucuugccugcaguacugccuucuaaggcaggugcagcugaucuggaguaguugugacucccaaagauaugauccagauaucuaggaaauggggguggggguugccaaagcaugggcaagaaaacacuaggcgguacacugagaagcugugcuuaauggccuggcaauauucuuuugacaccaggcacuuucauucccaaacacuauuguuucucuguguggggcagcguagcaucacucagguaagagguaugggcaagaugacuccaucauuaaccagagaagagcuuuugaaagggcugacacacauucugggcugaccagcacuugguuagaugcacuguugcuugccuugagcacagugacaccucugcucaucucuguugccaugcagguuauguccucgguccccugguguccuuugucugcuugaaggcucauaaacuucaugcccagagaaauugcugaaggcucauaaacuucaugcccagagaaauugccaggcugcucuggggacuccccuaagcaccccuccacucacccacaggcaggaucuccugugccucugagaccaucugagcuaugugggauagcucugggccaggacauugcccaacacaggaagagucucucuccugcagcaugcuuaggcaggccuugucauggcuauucuuuuuuuuuuuuuuuuuuuuuuuuuuugggguuuuugagacaggguuucucuguauaguccuggcuguccuggaacucacuuuguagaccaggcuggccucgaacucagaaauccgccugccucugccuccugagugcugggauuaaaggcgugcgccaccacgcccggcgucauggcuauucuuaaaucuagcaauuuaugagaauacaguuguuagucaauucauuaauuucucaugcacagaccacacaauuucaaaaucuugcucacauacaaccugggagucucagggauuuucuccucugugaaauauguuaguaaaagugucuugggguagagagagggcucagugguaagagugcuugccuuuucagagaacuugaguuuggcuuccaacauucauauuaaguggcuaagaaccacuuauagcuccagcuccagggaauuuaugcccuuuucuggccucugaacaccugggugaacauguacacacacacacacacacacacacacacacacacacacacacgaaacuaaauuaaaggaauaucuucuagagcaaaagcauuacauuagcuacuacaacuggcauacuaguaaacucuaaauaaaccuaccaaugguguagaaaccuccauugagacagguuuaagguggcugggauugcuuuaccagcugcuuccuggcacaugugacucugacuguaggagggagcugugucacuauaucuaguucuggcccaaccuuaaggaaugugaauagugaguuugaggccagcuuggguuauaugaaaccuugucucuccccucaaaacaaagaaacggggucagcaagauaacucagccaguaaaggcgcuugggugauagacagccugacuuggaucuucaggucccaugguggaaggggcaaaccaucucccccaaaguuguccucugacuggcacauauucacuggggcacacauuuggcuguacucauccacacaaauaauauaaacauaaauaccagcauauacagggcccuggcucucauuccuaguacugaaauaaaaaaacaaaacaaaacaaacaaacauggauacacaggcaaugacauggcucaucagugaaaugcuuuccacccaguuugacaaucugggaaucuaacgagagagagagagagagagagagagagagagagagagagagagagagagagagagagagaggagagagagagaucccauaaacuguccccugaacuccacaugcacacuguauuugcacacacccgauaaaucauuuuuguuaaaaagaaaauggaggaggcucuuucuucuugucuccauuacccaugaagaucaguugcaagucccagcuguccugcaacccucuuggcacaguaugguacacagagcagccaagcaggggagcaccccuggggucuuccuguuucccuaccccucuaccaggcacguguggccuuggaggaacugccuuugaaguagcuucuauccccagcuaagaggauccugcacagcuaaacacaccaacuuaaggcacaaaagacaauggcuguuugagcacggaugguucagaguagcuccuucuaguaucaguaaaugguaguagcagcugugaaaaucuaaacuuccuaaacagaugagcugaaagagcaggcggccuccagccuaggaacgcaggauucuggugccaaauuaaguccuuguuuuuguuuacaaggcauucuauaaucagggccaguccuguggaugguacuuacuccuauuuacuguaccaaagaauggaagugucugacgccacaggcuuagucuccuccaccccacagaaaggacccuucggcccagagaggucaagacauguguguacucaaagucacccagcaaauuuuuuuaagaaaccagacuuccucuuaacuccccaaacaguucucuuaagucuggugucuccuuuaacgucuuagucuuuucauagaauuacuuugcagggauaaaucuguauuuaaucguguuccuuuuacauguucagcacucauugcccauuccuugggaagcuccgagauagaauguucagaauugguagacugucacacacacauuguauauuaacugcaacgaauuuuuucuugcacuuucaaagcucauuuaugaugccaaagaauugguucucauacaaguacaucuuuguuuaucguucagccauuugccucacguauacgucaagcccuuggcacggcucagccuugucugcgccaguccccaugaagagcgcaucauauucagaggacacaacccucuuuguucuuuuaaugguugcuggaaauucgggcaugcaacuauucuuugaagaugcacugacuuuuacugaaaauauauaugcuuuucuauuaucuauggaugugggcuuugguuuugcuucuugguuuucauguaucugauaaugccuuaaaaacuugagcuucaucaccacccccagcccccacagcacuccugaaagcuuacucaaaagccccaaaaugcacccccuccccugggcgccauauuccagcccacaacucaggcagauuucugcuuuaucagaggccacacuguacuagggaaccccagguaagauacaccccauugccugcuaguacuacuuaaagcccauccaacauccuucaauaguaccuuucgccuaagccccauauuugggcucucaacuuuggcagaacacuucugcuuuacuggaggccaugccauacuaggaacuccagggaccaagcagguaacuagaacuccagaggccacacaguuacuuggaucuccagaggcaacauugccaccucaaagcaagagaucacacaggccacaaagacuccaucagagacaccuacuaggccugaagauucaacagucaccagaaacccaggccgcucaagccagaaaacaagagaggaaacagaaaccaagggggaaaaccauuuaacaaagauaaacucagaaaccagaaccuaaaccuauaauaaccccaaacgcagaugacuagaggccaguauaaaaacacaauuaacaauauccagagcaauaugguaccaccaaagcccagcuauccuuaauacagcaagccccgaguauuccaacacagcucugaagcacaagaaaaugaccuuaauuccaaucuuaugaagaugauagaggcccuuaaagaggaaauuaaaucccuuaaagaaauauggaaaaauacaauaaaaagaugaagaaaauaaauaaaacuguccaagaucugaaaaugaaaauagaagcauuaaagaaaacacaauuaucaccaacagaauacaagagauggaaaagggaaucucaggcauagaaaauacaauaggagaaguugauaauaucaaucaaaaaacaauauuagaucuaaaaucuuucuaacacaaaacauccaggaaaucugggacccuauggaaaaaaaaaaaaacaaaccuaagaaaaauaagaaucuaagaaaagggaggaggaggaagaggaagaggaggaggaggaagaggaggaagaggaggaagaggaggagaagaaggaggaagagggggaggaggaggagaagaaggaggaggaggaggagaaggaagaggaggagaaggaggaggaagagggggagaaggaggaagaggaggagaaggaggaggaggaagaggaggaggaggaggaagagggggaggaggagaaggaggaggaagagggggaggaggagaaggagaaggaagaggaagauuauuccuagaucaaaggcccagaaaauauuuucaacaaagucauaggagaaaauuuuccuaaccuaaagaaagcggugccuguaaauguacaagaaguuuacagaacaccaaguagauuagaccaaaaagaaagucuccccuccacauaauaaucaaaacacuaaauauacagaacaaagaaagaauauuaaaggcugcacaggaaaaaggccaaguaauauauaaaggcagaccuauagaauuauacccaacuucuuuuuuuuuuauuuaauuuuuucucuuacacuccagauuuuaucccccucccaguccucccucugacuauuccacauccccaccuccucccagccacaaggauacucccuccaucccccccaccccaccaaaccucgccacucccuggggcuuccagucucuugaagguuagguacagcuucucugacugaacccagacccagcuauacugugcuguauauguguuggaggccucauuucagcuggcauaugcugucugguuggugguccaguaucugagagaucuuggggguccagguuaauugagacugcugguccuccuacagggaugcccuccuccucagcuucuuccaguuuuccccuaauucaaccacaggggucagcagcuucuguccacugguuagauguaaauaucugcaucugacucagcugcuuguugguauacgcaacuucuuaacagaggcucugaaagccagaaaggccugaacaaaugucuuguggacucuaagagaccacagaugccagcccagaguacuauacccagcaaaacucuuaacuauacccagcaaaacuuuuaauuaucauagaugaagaaaauaagauauuccaugacaaaaugaaauuuaaacaauaucuauccacaaguccaucucuauggaaaauauuagaaggaaaacuccagcucaagaaacuuaaauacaccaaagaaacaagaaauaaauaauuucauaccagcaaaaccaaugaaggggaaacacacacacaaccaccaccaccaacaaaauaacaggaauuaauuaucauuggucauuaauaucuuucauaucaauggacuaacuucuacaauaaaaagacacagacaaacagaauggaugugaaaacaggauccauccuuuuauugcacacaacaaacacacuucaacaucaaagauaaauauuaugucagagugaaggacuggaaaacgauuucccaagcaaauggacucaagaagcaaggugguauagccauucuaauauuuaacaaaauagacuuuuaaccaaaauuaaacaaaagaaugaggaaguacacuucauacucaucaaaggaaaaaaauccaccaagauggcaucuuaacucugaacauuugugacccaaaugcaagggcauccauguuuguaaaagaaacauuaguaaaucuuaaaucacacaucgucaaauuccacucauuaauagugggagacuucaacacccuacuuucaccaauggacaggucacugagacagaaacuaaacagagaaaucauggaacagacauuaugacucaaauggaccuaauagguaucuacagaacauuucacccaaacacaaaagaauaugccuccuucucagcaccucauggaaccuucuccaaaauugacuauguauucagucacaaagcaacucucaacgaauacaagaaaauugaaauaaccccauguaucuuaucagaccaccacgaauuaaaccugagcuucaacaagagaaagcuuacaaacucaugugaauugaacaacucucuacugaaugaucacuuggucaaagaagaaauaaagaaagaaaugaaagacuuucuagacaucaaugaaaaugaaggcacaacuuacccaaaauuaugggaacaaugaaagcagugcuaagaagaaaguucacaacucuaaaugccuucauaaagacauuagaaagauuucauacuacaacuuuuguuuuguuuuguuuuuugagacaggguuucucuguauagcccuggcuguccuggaacucacuuuguagaccaggcuggccucaaacucagaaaucugccugccucugucucccgagugcugggauuaaaggcguguaccaccaugcccggcuucauacuacaacuuaacagcacaccugaaagcucuaaaacaaaaagaagcaaacacacccaagaagcaaccaaagacaugguucuuugagaaaaucagcaagguaaacaaacccuuagccaaucuaacuaaaaugcagagagaggcagagagagagagagagagagagagagagagagagagagagagagagagagagagagagagagagagagagaagagagagagagagaauauccaaauuaacaaauucagaaaugaaaagggagagauaacaauagauacugaggaaauccuaagaauuauugucucacuucaaaaaccuguacuucaaaaaaaaauuggaaauucuaaaagaaauagacaauuuucucaauagguaccacuuaccaaaguuaaauuaagaucagauaaacaagaccuauaauugcuaaugaaauacaaucagucauuaaaagucucccccaccccccuccaaaagaccagggccugaugugaugguuuuagugcagaauucuaccagacuuucaaugaagaguuaaugccaauacuccucaaauuauuccacaaaauagaaacagaaggaacauugccaaauucauuuuaugaggucacugucacccugauaccuaaaccacacaaauacucagcaaagaaggagaauuucagaccaauuccccucaugaacauugguacaaaauauucaauaaaauacucagaagcccacuucaagaacacauuaaaaagaucauacaucaugaucaaguaggguucaccccaaagauguggggauggcucaacauaggaaaaaucuaucaauguaaugcaccauauaaacaaacugaaagaaaaaaacacccacauuaucaucucauuaggugcuaucuuagccaggguuucuaucccuucacaaacaucaugaccaagaagcaagcuggggaggaaaggguuuauucagcuuacacuuccauacugcuguucaucaccaaggaagucaggacuggaacucuagcaggucagaaagcaggagcugaugcagaagccauggagggauguuccuua

SEQ ID NO: 7349 - RNA, 2922 nt, Mus musculus
gacaugacucucugaggcuggacugguggugauucauuucuuaguccauuuuugcccucagcuucaguugcugaugaguggaugugcauugugaggacuuaagguagauaugacuggguuuaucuaaaagcuuagauuugugauucuuuuaagauucuuggaagauuacuuuuaaagauaauaaaauaauuacuccuuucuuuguaacugcaaauugcugccugcuaguaagagaaacuggcugagaaaaacuaccuugcuugcuuuuauacuuuguuagucuauagcaaguugcuuaguuauaaauguacauggguuuggggaaauaauuuuucuuuaccuguacuauguaauguuauuucuuguaaagguauuggagaacacauugguuuuuuucauaaccauucacuagaagaaaacuaaaagauaaucacauuguaauuuuauaaugcuuaaaagauuuugcugagauacauaaacuggaagaaauuauaguguggggauuggcauauuguuccuuccauccauccacuauguauauguauguauguguauaugaaaaguuugugugaguggagguuggaauacuguuccuuccauccaucaauuauguguauguagauauauauauguaaagcuugucugggugagcagugguguauucauguauguaugugugaacugcuuggagccugcuugcuggagcuuugcucuaaccauucuauguguaauuauguauaugucugucuauaguuauguauguaugcaugcauauauguauauauguguauaugaaguuauuggacucugccuuuuguuucauccacucagagagagagagagagaggagagagauuuucucucuucccuuucccaccagccccaaggaguuaaaaagaguuaauaguuuuuucacuggccacagggaguaccagccccagugaauuaagcuuuguucccucagagaaaaauuugcugaguaacugcucugaucccuggcugccauuggcagcagccccuguagguaucuggauccacccccaucagcagcuaccugcuucuguuuacccaacacauggaugccaaaacuggcuacuggcauucuggcucccaaacaggcuaugaugcaguaagcccacuguugcucugaggagacuggauaaagggcacagcuggaguugacuucaucuaggccgcaacuagcugaugcugugaaucaccugccacuuuaggcggaagcucccagcaccuuagaacgcugacccucugaauugucugccacuuugggcuaagacucccuccgguuaagcaucauccucacuaaaauaggacaggguaaaccuauggaauaaagguuuuccucugguguuauuaaacauacuuuugaaaaagaaaauuaagguuugcacuagucagcugaugguucuccccagcugguacaguaagccaguccuugguuuccuagaccaaggagcuuuagacauugaaccugggaaaccgcaggaauggagagaaaggcaucccucuuacugcacuaucugaauaugcauaagcagacauuggcaggugaucgagagcucuggucucccucaugaagggacuccuuuauuggugucucauucaggaucuaaaaacaauguuuauuucuugauagaauaaaaaaaagauaguucaggagaagauaguaaugaaucagaagaagagaacgugaccuuggagaaggaaucugacuugaagauggaggcagcaaaauacuguaaaccugaaugcccucaacugcaaugccugacccugagccuucuccccaggccuccugaacaaccaaagccgccugugggauucaucacugaugugcugugcuugacaaaagcguaaaacuucuuucaaauauucauuggauuuggcauuucuuaaaaauaauuacagcuaaauugaagccacuguuugauauucucaaccuggauacugccccagagucacuaagaaaauugacuucuaacguuaaaauuuuauuagcccuuuuagagccagaucagccccguugccccaagacagggauguuuacuuacggcuccuccgcagacacgcugccuugauuauugauguucagacagaauuuuccccacacuaaaacuucuacacaacaaaggagcuaauagcaauaauuacuguuuuuaaagacuagagaacaaacccuuuaacuuguaugcuaacucuuaauaucuagccaaguuguuuuccccguauuaaaaaauguucuacugucuucuggcugcuucacuacccuaacccugcuuucagaaucgcaaggcuuaccgcagucuagaaauugccuuuucuguguggaacacacucaagcuccuucuaugcuuccugguccuguguauaaagguaaggaaaaauugauccccugacaaaggcuguugcuuucucuggagaggcaacucagcagagccauucaucacaucaucaagucacugccugcucuucaccuccaaaggcugcuggagccaucuugcagaacugcuuggcuuaucccauccaugcaugcucucccccugguaacugacucgcagggcuuguguucacccuugcaaucucugauacuuagguuauuugugcuuccgucugaccugggaggcuucaaagauaugguacaguauuuuuuuuauuuuuauuuuuuuuacugucuacaucuuggggaugccaagggcuuuaaaaauggacagcgcuccuguguccacuggcaucccaugcucuaagaacaggcuguuauggagagagcacaucaagcuaaagacucagcuguuuacguuacaaagugaagaucacaaauacucaucuccuuauauuuuacaaaacaaauaagucccuuuuaaaauaucuuaauauaaaguuuacuccaaaccucuaauaagauua

SEQ ID NO: 7350 - RNA, 131886 nt, Mus musculus
cgggcuggagcggcgcggcggcgggggcugcugggguauuucgggaagggggugugaggcggcggcgaaggcggcggcugcgugugggagguggcugagagcuagagggagagagcgagagaaaggacggaagaaagagggcgggaguccuuggaggaggcgggaccggcggggcucuucgcggcggcggcggcggcgggcggccggggaggcggcgccgcccccugcccgcgcucucuucaacguagccggccaccuacccgccgggcgcggguaguggccgaacagcggcgaccgccauggcguuccucaaacuccgcgaccagguaggugaggggcggcggggcgggaucgcgccaccgaggagucggaggaggguggaccagcggcgugggccgcccgggcgcccugucggcgcgguggcagcgagggaagagggugucccgggucggcagccgugcgggccguccgccugucagugcagccccagcuccgagaaacccacgugccgccgggggaucgcggccgccgccacaggggcggguucugcgcucgccgcccucgcguccggcgcgcugccggguaggcgccuccucuuuccugccaggugaggcucgggccuaacagguggcuuugcggugcggagucggagcggggcaggcggcggccgugaccuggggucacgaccuugcccucggguucgcuucgcggggcgguucacgguccaccgcaccgucucugcggagagguaguggcggucgaaagcaaacccaccggugccgauggauucugcuggggacugguuguuacggugcauauucccaggcugguuuucucuuggcauauucugcaccaucuugguuuaguuuuccugacuuaggaagagcuugucaaagaacaccugaagugcucagaagacugcaguacacugugggcugggaaaaauaacucuguaucuaccaaugaaaucgcaacuaugucugaaugaacgcuuguuacccuuuuaaaaaggcgagaaggugaauuaccagacgcuccccaguguuugucucuuuuaaagaaaagggaaaguaacgaguggauuuuacggagucgcgggaaccuauuaaugcuugaguaccccuuuugccauuguuuuucugaauaggagauacugaacagauuugaagggaaaccaaucagaaagugggcacaagcuuaacaaaaacgauagggaaaaacuuaauguuuuaugucauuuucuaccaauuaaaacuuaaguucugagucuagcuaaugucaauucucacuuaaaaagugaauauucuacuuaggcugaaugcugacuuuuaguaucauuugguaucagcagaauuuuagcugauauuaacaauagggcaugauacuuugaaaaacucugguugauaaguuuguauuucaaaaucugugaauaacuuuacuguucaacauguuccauuagcuacacauagaaucuuugaguugauuaaaauuaagaaagcacaguuucucaguugugcuagucaaaagcacacuuuucaaaagugcucaccagccacagguagcaaaaccuuucauugcacaaaguugucaggaaaaaacaaaaaaaucuguuaauaacaagcagaguucaagcccagaucaucuaauucauauguaguuaauaccaugaaacucaagaucuagauuuucagcuaaucuuuauuacucuaguaacucuuuguaccugaauauuugguuguaauccuucacuuuuggaaauguauuuugugauuuggucauuguguguguuagggauuugguagacuguuagaagaucuuacuuuauaaaaaaaaaugaauaaauaauaaaaaucuauuggcaucugugcauuugaguguuuaguaacuacaguuuugaagcagucguaacacugauucaguuuuguguaauauucuuuaacacucaguggugauauugauuuuuaaaauguuaccuguaaacuugagaauccgugaugaguaaguuaaugagauggcauugcuggggaagacuuacuguauuacaaaauaauuggcucaucuaguucuuuugaaagacaacugaguuuuucuuaauuuaaagggaauugcacuuguuuuuagaaaucaguuuauugauauguuucaagacauuagaagugaugauagaaacgaagugggauucaauaguuuaguguuuuccauuucuagggaaagcauauuagcuagacaaaguaguuuuuggaggaaaggugagaagaccuguauauguacacaggauuuuaaaucuggaagguaguugauaccgcuuuuaacgcaacagcuuuauauacauuccaguuaggaaguaguauaauuuuuuuaaccuugcaaagaauagaaggaagcuagacaugaguaaggauuuucuucaacauuuaaguaugagaaugguucuacaugguaaagauauaaagucagagaugaggaaaugacauaaucaguaaagagcuuacugucagcaugaggaucugaguuugauuccugaaacucaguaaaaaccuggggcacaauggcacaugcuugggaucucugcacggggaggcagaggcaggagaaucccuggggcuuccuaacuugccagccuagccugcuuuacuccugaggaauaacacuggacauugacuuccggccuccacauacacauaugcaaccacaggaacacacacacauacacacacacacaagauacacagggaagacaaauauaaaaucaguaagcaaauaaggaaauuguccucauucauucuguaaucagaauaggacagcauuuacuuuguggcagcauguaauucagcgaauaagaaagaauuacuguauuacuuucugccuauggguggaugaaaauauuuuuuaaauuguuaguaaaaugaagcuuguuuucuguugauaacaguagacaugaacuuuuuuccugaauuacuucacuuuggcuuguguaacaguggcagaauuuucucuccugagguuaucacggucuauuuuaucuccuuaggugaugaaaauuacucauauaugguuacauuuuaaaucauaaacauuauguucuauuaagaaagauuguuggucuuuguuuagguuccccauuucagaagcuaaguagcaacugacacuuacuucaguauauagaaaaugauggggagugguggagagggggaccuuaaugucagacuuguuaguagcugcucagccccaagccuuuguugugcagguaugucuaguauuucuggaauuccuuuuuccuuuaggauaccagaaguccacauugcuagggaaaaaaucuauuuuuguuaguaaacuggugacuaccaguaacaacagugaauacucagguuauaaaagagaacuacuauaaaacuaguuucuaacuucuaauucagaggaguuggagaaaaacuccagaaaugguacucauuaaacugagaauucuuuaacagaaaggggccacaguggucgcccucuucucccccuccauucccccuucccuucucccccuucccccuccucccuccuuccuuuucuccucuacucugcacaagugugcgugcuccucuguguguguguguguguguguguguguguguguguguguguguguguguguuuugcauagccagggauuggaucugggaccucuacacuaccaaccuggucauaaaccuuuuuaaaaauugagcuagaauauguauaccauaaaauuuauacucuuaaaauaagugggcuuuuuuuaguuguuuucacaaaacuguaaucaccacuaauucuagaauuuuuuuuuuuaccacuccagaaaaccacaugacaauuagcagucauuuuagcuuucucuugcuuucuacaccuggcaaucaacaaucuacuuuuuaugaacuugccuguucuggauauuuaauuuaaauggaaucauauagcauauggccuuuuaugucucauuugauuuugcaaaauucuuuguaaagguuucauuagucuguugaguauaacuucaugugucuuguauagggcugcuggaguaaaacccaagggucuucugcuaaauagacauucgaucaccaagcuggguuuuuaacuauggccauaaacuucuguagcauggucaagagugcaaaaaaaaaaaaaaaaaaaaaguguaaaauuacuuagaccauuucauuugcaccugaagcuuacuuaacauuaguguggaguaggauuuuucuauuuuucagaauuuguuuauaacuggaguuaaauuuuguuugcaagccgggugagguggcacacgccuuuaaucccagcacuccggaggcaggcagagacaggcggauuucugaguucgaggccagccugaucuacaaagugaguuccaggacagccagggcuauacagagaaacccuguuucgaaaaacaaaaaacaaacaaacaaauuuuuuuguuuguuuguuugcaguaauacuaaagggcagugaguuuuaauuuuuagauuuuuuucuaauuguauuuaguauauagguuucuuaaaauacuguuuuucccccauguaaaaauguuaaaauuuuagggcccuauuagguauaugauuaugagauaugauaauugaaaauacuauacaauguguaaugauuagaccagugguugguaucagccuuggcugucccagaacuugcuauguagacccaguuggccucaaacucacagagaucuuccuuuacagacaucuccugaguaauggaguuaaagaugugccccaccaucuacagaguguugggaggggccaguuugagacagggucucucuguaucccuggcuagccuggaacauggcuuguagaucaggggccuugaacuguguguaguuacaauuuaugaauuuuuaaagaauagauuuuaaaaucuauauaaaaauuuaauaaugaacuuauuuuguguaguacaaauucucacuugaucaaggaucuacugagaacugaacaugauuagacuuuucaugaguagggggaaaaaagaagagauaauauuugugcaguaguuugacuaagaaggaucccuugggcucauagaucugaauacuuaguauccauggaguagaacuguuugaaaggauuacaaggauuuggaaguguggccuuguuggaauagguguggccuuguuggaggaucuguguuacugggugugagcuuugacuuucaaaagcccaugcuaguuccaauuuaucuuucugcccgugggucaagauguaguucucaacugcuacucuaguggcaugcuccccaccaugaugauaauggacuaauaagccucugaaauuguaagccagccuccaauuaaauacuuucuuuuauaagaauugccuuggucauggugucucuuuuuagcaauagaacagagacugaaauacuuugcuauaccuuauaauuauauuuauaaaauacaucaaaugcugaagaacacugaugcucauauauucagguauucuauauuagauuucucuuugcuuugccuuagagaauaaacaggcagaagaaagagauaggcauaaucucugcccuuaaggguaauauuagcugaaagaggaaaaaaggcuacauagauacacuuuaugugaguuacuucaaguguaaaauauauagaaguuaaaggaaaacuuagguuauauuaagugaaaauauaauggacaauugaaaauuuaaagcucauuuguaucaguggcuuauagcuugugucauacaaaguaauaccuauugaguuccauaaaagauggagauaacauguuucaguauucaaaaaucaucagauuauaguuagauagaaacucuuggggcaagugaacuauuuuagguucaccaaaagucaaugucaaugucagaagcaaauaguuacgcuugaaaaugucaagagaaaaaugaggugguaggccaagaaagaagaugcaggauaaugaggagacggucuuguuaauugugauuguaaaggacggccaaguuaccagugacuguguuauaaguacuuugaauauuaggcugagaauuuagacagcaauagcugagccuccuucaaauaaagucagauuucaguaagguuguacauguguguguacauaguuuuugaacuuuacuagauucuagaaggaucugggacacucagccuuuaaucacuacauuuuaaguuuuaacaggaaugggccuggugcuuguaauaccagcacuuggaacguggaagcaaguuuugggaaggcauauuacaaaaggaagagguggacguccgagaccaguuagauagcuggugcuauaauuuggacaacguacauaaaauauuuuaugagaaacugaaaacuuuaaauaugaaaacagaauuagaaugggagcgagaacauuuuuuucauuuugauauuuucauuagcuuguguugugcaaauuaauacauuucauuguggcccuuuucauauauguauagaaagcacuuuguauucaacuccucccauugcugucucgucauacccuguugauccccuugcuuuucccaugcacuuaaauaucuuucuuggauuucuuuuuccccaucuagagucuauauauaagaaaaaacaugguauuaauuuuucugagucuggguuauuuugcauagcaugaugcucuccauucccuucuauaacauagcuauugugcugugauaaacaugaauauuuaucucuucugugugcugacucuaauuccuuugaacucauacuuggaaaguaaauuaucuguuaacuauuuuugaguaacuuccauauugauuugcaugguagcuggauuaauuuauauucacagcagugguuuuacaguagugaucuuucacccacauucuggccagguuuuuguuguugucguuguuauguuucuuuaugauagccauucugacugguuaagauggaauuuuacuguagggacuucacuucccagaugaccaaagauguagcugaaccauuuuaaacuuauaccugucuagcuuaugaaugaaugagucucggacuaugguuauuuuauuuggcuuuggacaguuacuggggguggggggugaaaccccuaaucuacuuuucuaacugcuggaccugcuaccuccccagcagugugccccagacacuugcuguuucuccuggccaugugcucaagggucaccuacucccauuguggcuuccuccucucucugcugcagccuucucccuuccuccucugcaacccccagccugguaacucaaaauccaccuaccucuaaucccuccaguaauuggcuguagcaauuuuuauuuaggcaguaguuucaaauuaaggagcaagguucacacaacgaaagcugguaaauguuagaauuuacucuuaggcaacuagacuuuuggguacagacaaaaacucaacacaaagauauugaccauuuuuucccacuuauuuauuggccauuccugcuucuuugagaacugucuuguuuuguucauuuacacauuuauugauacuauauauguguguguauacauauuucauuuuauauucuggauuuuaaccaucuauuagguaaacugcuuggaugagauuuuuccuauuguauagacugucucuucauucugguaaugcuuucauuuuaaaaauaaaaauauuuuauuucugugucaucaauaugccuggagcuuucagaaaccagaauuggauccucuggaacuggaauuauagauaguaacgagacacuguguggaugcugggaauugaaccugguucuucugcaaaagcaguaaaugcucuuaacugcugagccauccuaccaacauuuccccuuuggagacaggauuucuccaggucagcggcacucaacuugugggcugugacccaugugagaguugagugaccuuuucauagggggucacuuaaggucauuggaaagcagauaauuaagauucauaacaguggcaaaauuacaguuaugaaguaacaaugaaaauaauuucaugguugggggucacuacaacgugaggaacugaaugaaagguuucagcauuagggagguugagaaccgcucggguggguaguccuugcuguuuuggaguuaagaagaccagguuggcuuugaacugccucugccuuccgagugcugggacaaaagaugucuaucacugccuauacuuauuucuuuagcugcacacaagcuuuuaaauuuuaugcaaucccauuuaccaauucuugcuauuauuucuuuaacuauuggaguccuguuuagaaaguucucuccugugcuucuuucuugaaauuauuuuauucugguaguuucuuaccuuaaacuaaggucuuuguaauauuuugaauugauuuuuauacacaaagugacugaguggggucuaguugcagccauauauauguguguguguguguguguguguauauauauauauauugauacuguuuucuuaguaucauuuauuaagagccugccuuuuugcuaauguaugucuuggccccaguguugagaaucacauggcguuaguuauauagguuuauaucugggucuuuuucuuauuauccguuggcuucugugcguuugaacuuugcugccauuuuacugucacuuugcaguguaauuugucuuuauuacuuugguuauuuguauuuucauaugagguuuucuucuuuuccuuuucuuuucuuuucuuuucuuuuuuuucuuuuuucaagacaggguuucucuguguagcccuuacuguccuggaacuauguagacuaggcuggccucgaacucagaaauccacuugccucugccucccaagugcugggauuaaaggcaugcgccaccacugccuggcucauaugaguuuuuugauuaaaaaaacugaagaauuuugugagaauuuugauggggauuauuuuaaaucugcagauugcuugguaugggaucaugguuagucuuuucaucuucuguugcuucuuucauucucuucauuauuuauacuuuucauuguagagaucuaguuaaguuuauuauuuuguuguugguggugcuuugcuuucaggcuauugugaaugagguuuuuucuugauuuauuuuuuucucucaucauacucauugauggguauaauuuacauuucccaggugacuacuaauuuuaguguuuugauuuuauauccugcuauuuugcugaaaguucucucagaucuugaguuuucuaguggagugucgggcaucuuuuaaguauagauucaugucacuuguaaauauagaucauuuacuuuuuuacuguuuauauaauuuuuauuucuuuugaggaguuuuguuuuuugagauuaaggucuugcuauauaucccuagcuggccuggaccucccaguauagaccagacuuggauuugaagagacccaccugccucugcuuucagagugcuggggagaagggcgggcaguccugucucagucucagucagucuccgacgcuuucaguguuuccccuaucagugucagguugacuguaggcuuuuuugucaguaaccucacuauuuugagguacuauguauugaugaugauuaauugugaucuuuguauuacaaguuucuaacagccuuuuaugaacagauacaaauuugucaaaggcuuuuagguuucuuuuaagaugguugauuucccccacccacccaauuuuguguuuguuaccuuacauuuauugauuuauguaugcugagcuauuuuuacauuccugaaaacagacuuggucauaaucucuuaguguauuuuuguuuagucugcaaauauuuuaauguggcuuuuuguuuguuuaaucaaggaaauuggucuguaguugguuguucuuacuauuuccuuaucucugcuggcuuaguagaugaguuuguaguguuccuucccugucugucucauggaacagauuaaggagcauugauggucuuuaaagaucugguagagugcagccgugacuccaucugcucauaagauuuuuccuuguuguaauuuuuuuauuacuguuguaauacugcuugcuguucaucuuugaggauuuuguuuguuuguuuguuuguuuguuuuuuaucuucuugggucaauucugguauguuacacauaccuagaaauuuauucuaaaaaauucaacuuauuggaacacaagauuucaaaauauuccuaaugacccuuuguaugucacugguauucuuuuuaaaagcuacucuuuuggucuuuccuuuuauuaauuugggucauguaucuuugcuuaaauaaggguuuguuaaucuuguuuaaguucucaaagagugagccuuuuguuuuuauugguccuuuuuacuguugcuuuaaucaccauuuuauuucucuccuugauuuucuuuccuucuaauuuuagauuuuguuuuuccuagacuaugugauaaaucauuagguuauucuagugagauauugggguuuuugauauguguacucuuagauauaaauuucccccuaaaacagcuuuugcuguaucucaccugcuuuaauauguucucauuuuuauuggauuguaagacauuuuuaauuucucucaauuucuuuaaaaauuuguagguucauuucucuguauguuuguauauuuucuguaguuccacuugguauugguuucauuuugauuuggagagauaaaagaaagcacuucaauauuuuuguauuugcuaauauuuguuuuuauauccuaaaauguaaucaguuuuggagacagugucauaggugggcaagagcaguauguaugcuguaacucuugaaugggauagucuauagguguuacuaaagccauaugauauaugguauaguuuaacucaaaaguuucuugguugauuuuuuuuuuuuuuuuggucuagauaaucugucaugagagaggaguauuaaagucaugucuuauaauauguagacaaguaguguuugaugggacaaauagcugccuaaugcucagugauuuucuugcuuuuaauuuuuaauauacaaauauaaccuauuccugcuuacucuuggguucucuguuugcuugcaaugcaugcccugguaaggugauuuucuugcacacaguuggcuuuuguuuuuuuaaccaaacauauaugcguuaaaccaaacccguuuauguguuucaauugaaagauuaaaccuugccucuaggguuauuaaaucauaugcagaguuuuuccguauugcuggaaguauacacugcuguuuugguagucauuaauugcuuugcuuuaugcucauuguggcuucuuuuuuuucuuccuucagauuucaaagauaauuuugcuauauacagaaauugugguuggcagucacuuucaggauguaaaauacauuagcacaugcucuucuauuuuucuauugagcauuuguuauuuugauagguccauaguaauaaagaacguaccuucugccuugaaacuucagcaucuuuuuuuuuuuuuuuugacucugaacauuguaaauguaagaugauuugggaggauuucuggucacuauuacggauuccuaauguguccuauaguuggauguuucucuuuccuuaaaccuaagagaguuuucugcuauaauuucuccuccucucuucccuucccuucuuuggggauaagauguugcuauauagccuaggcuggcguagaacucacuguggugauccucuugcuucagacucccaaguacugggaauauaggcaugugccaucacacccagcuuuagagcuuccuucaguaccaaagacuuguauucuuaauuauagccuagaaaucuuaaaaguugugaugauacauucccuauaccguugcugucugaauguauucucaacccuuuucauuggcucuauucuauuuauugagcuuuucauuacuaggggcucccacaccccaauucuguaugaauuugcugaauuaggguugcugaauuucuuguccaagucauaaauugacauuauuuguuuauuugaauccucuuugaggucauugauacauuuuuaaaaucgcacacacaugugaauguguuuguguguguucccaacauuccagccauuucccuaguuuugaauuugguuacugaagauuuauuccauuuacgaggaauucugauaucuuucuuuuucaaguuguuuuucuacugugguugugcaguuauugggauguguaucucuuuaguuuuauaugugacuguguuagugaggaaccuuuuuuugaggacucaauucccaggacucuucagagaagaaagcuagugguagcuaagagcagcaauacccaagcaaaccaaauauagaaauacaauaaaaaaaucaauuaaagacugcuauaucacuuaaucauagaaaaagaaagagcaauguggaauaagcuaugaaauuaaaacuaugaaagaagaguuaauaaaagaaugaaaagaggaggagguuuaaaaaugaagaaaagagcaagagauaaaaauuugauuacaaaauaaaaaaacaaaguaaacauuauuagaugaggcgagaagaagcuggagaggaguguuggaucagcguagcacgcccagugcucugggguuuagucucaaggacuguuaaaaagagcaacaaaacauaagaagacagaaaaagcuuuguuuugaauuuuaaaaaguacugaaaguaacauaaagaaaaaagguaaaagaaagaauuagagaaggauucuuucuagcuucuauaaaacaaucugccaggucuggaggaggaacaguuaguggucauucuucucuauucucaccacacugguuggugcuguaugcagguacucuagaucagcccccaugguucauuguuagcaucugggucucaguuuagauguuuccccuaugcugacuccaaagagcuuugagacccaucggguggcucccaaguuguugugccuauggaugauaaacauccaaacugagggauaccuccaagugcaccugagaaugaggaaaacaguagugagauccacuuuggagagauuuuaguuaucccaucagucacaauguauauuggugacuucuuaaacauggauaucauuuguuucauccuggacacuguaacgaugaguaaaaugaaaauagaaaaaagaaucuuaguuucaaccaagauuguguuauugauacagcccuuccauccacaaauaaacauuuuugaauugugauucucaaauuugugauuauggacuugaguuuuuauuuaagcucagaucucuccaacauuuuccuauuugaucauuucaguccauuacauucacuccagauguaacacaguuuauuauuccuuugaccgacugauuuuauuuugcaucagauucuauagccagaauucuauaacaagaauguacuuggagaauuguuggcaggaaaucuggccaggcauuugggagguugagacaagaggauugcugcaaauucaaggacagucugagccauggugaguaccagaccaaccaggacuacauggcaagaccuggucucagugacaccuccccagucccccagucagaauguuaacauauaugguucaagcauaggacacauggagugugaggaagugaccgugguggagagagggaccaggucauagagagucugcguucuagggguuuggaacuuaauucuggauuaucacugaauuauccaaagcaggcaauacaagauuuguauuuuggaugaauucuggaggauugauaagaguacaggaauugguaggcuguuaaauucauuugaaauaaggcuugaccuuagccaguaagaugaauuuuauuuuggaaauauugaaguuggaacuuguaaacauugaaauguacuugaguaagcuguuaaauaugagacugauuucauagaagaguguuugagguaguaaucaaaguaaauaaauuuauuugagaaugagaagggcucaugaucagagacuacaauggagaacauagacuggguggaggaaagggaauucuaagaagccacaggagguaggaaaaagccucuagagauugcuugucacaggucaaagggaaaaggcuuuggccaguggcaccuauauucucuugggcuuuguuuaacuuagguauaaauugcucugauuaagaaacaauguuuuaaaguccggaaaauagaaacacucuaucuaacaugaccuugguugaaaguagaguuuuccuuccacugcuuucaguuuauacaaauaguuacaguaccuaagacagggauuauuauugaguauccgucauaaucaaauacauuguuguaagcuuuucuuagaauguacauugggagaaccuaguuagacccacagaccaaagaucacuuccacaguuaacuaauacuuacugcuucuucauaugugcauuugaugguggcggaggugguggaggaggaggagauagaaaauuuaguccaaguguugaguguuacuuuauuuccugccuugaauaauccuuuuucccauuuguugccagaacagcuuuagaaaugauggguucauauccugaacuucugucagcuugaguagauuccagcuuccuuagucucugaggugaucauucauuaaccuggaguuuuggauuuaaguaagugugaaauaaaaauaaguguugugcuaaccuuauacuuugggaaguuuaacuguuguaguguccauauccaucaauauaaguccuuggacuauuuucuagggauaacaguuucccuugauuuguguuauuuguguuuaaaaucucauuuguaugguaggcaagucuucaacacuuccaggucuuguauauuguuuucuuuguaauucuuuuaauggaaauggauguaauaaacacccugauuguuggauuaaaaaaauaaauucaugucugcuaucuguugguccuugauacuagggcuacgucuauaaaggaaguaucggcuuuaugauggaaugaagugaaauuagauauggaccauuauuuuagccgugagugggaaacacuaaagagguggcuaauuacacccaagcgugaaguugggaugauuucuugaaauuuacucuaauagaauuuuacuuacugguguuacucucacaguuugccauucuccuccccucccccuccuuguuguggagauugaacacagguucuugggcauuauauaaguucaacccucucuucuuuaucuuggcucaaggaaauuaacauucucccccuacccccaaauauauucuuaaucuuauauuaacugaaauuuagaaaaauaaucccuuaguuuuguuuuuaauucuuacccccuuccuacauauuguuccauauuagugucuauauauacuaugucuguuagcaauacuguaauacucaggcaggacaaagaaacagguaggauugcucauuauaguacucagauuagucuuguuuauucugguuuguuuugaauauagcauaggcuguccuuaaacuuaagauccuucugccucagcugcuccaagugcagagauuccaggcauauucuaucaugcuuuuucgccagaauucaguuuauuacuuaaaugugcuauguacugacuguaguacaacuuuaaaaauacaacuuacuucaguaauuagugaaaacaguucauugucauauaucauauuugaguaucugcauuugugaaaaggucuuuuuuuaaaaauguacugauucuuuguuaauuuugcaucaugcacuccaauuccaaucaucuucccaucccuuuguauccucccacccuugcaaccuccccccaaaaagcaaauuaaaaauaaacaaaacaucucaugcaagcugcauugugucccagugugucccauacacccuuuuagccacacaucuuugaucauuacagugagucauuggucuguuucaaggccucugguuccugcuaugcuaucaauacuugauccuccugagggcuccucuaggauauccugguguugcccugggucauagauccugcagcuuuggaucugcagaaccagcuaauaccauuccuucuagcuuuggguuuagcuugcuuuucucuuucaaacucugaagguagaaauugguuugaaauuuuucauauuuaguuauagauugccuucuauaaacauuaauuguaucuuaagcuugugcugugucuuauuuuuauccaaccuaaaauauauucugaguuacuuugugaugccauuuuugacccuaguuuuguuuguuuguuuguuuguuuggauuuugauuuucaaauauuguuugguuuuuauuucuaugucaccuacauuaugacuggagauguucuuuuuaucauugacaugguuuggaaaauggucuaugggacuuaacaagcauuuguuugcauuuugguauuguuggauucuuucaggugucuuuugggucagauuaguugguagugaaguucaaauccccauuaucuuuucuaauuuccugccuauacuuuuauuauugcggacaggaaugacaucugcuuauaaccuuuaacuuggcaauuucaucuaucauuuuuuuaaaaaaaauguuaccuauuuggggauuuuuaauuaagugcauacauuuauauuugaaccuuucugcuuaauugaguuuuaauaguauaaaauaccuuugucuccuuuaaaaaaaaaaacuuuacaucuuauuuucagugauuguuucuuagcauuguuuuuaugaugaguuugaaucugaagugucucuucuaggacugucaucaaugauuugguauugcuguguggguggugcguuuuaagacagggccucaccaagagcucacauuggucuggaaccgaguggucuuccuauuuucagcuuccccaguccuuggauuccugaacguauuggguauucuuucuagaauacagucaaacaaucugucuuuuuaaaaaaaaucuuguguguguaucuaugaugcaucuuugguauggauaugcuugucauaugguuuaccuguggaggucagaggacaguuuugggaucuauacuuuccaucuauugugagaucuggaguugggacccaacaaucagguuuguggcacaagugcugugucaucauacuggcccucauguaauuaaaccucuuuaaaaggagugcuuaguccauuuauuuaaaaaaauuuucauuuuuaaguguauguguauauaugugugucuguguggguauguguuugugagugaugguauguccaaaguaugugugucugugagauaccagguaugggugcugggaaccaaacuuggcuccucugcaagagaagugugacuucuuaaccagugaacuuuaucuucagacuuaauccuguuaucuuuuaauucgugugugauaucucuuccuauuuuaucauuuuuugauuucuuugauuuucaaaaacuauuuuugucuuuuuguugcauguauuaagcacuugucuuauuuauugcaguguacuacauaugaaugcuauuaaugucucaguguagcuaacucauuuccucuccuucuuagugcuaucauuguuauauauguuauguucauuaauaauaaccucauggcagucuuuuaauuauuucuuucaauagcauauaccaauuuaaagaguaaggcaagauuaauaauauuuuuauuaaccuauaaucuuuauucuuagauucaaguuaacuaccaacugucauucuuuuuucauuaauacagcuuuuauuauauaacuccccuuuucuuuguuucuguauguauauacaucuuuauauaaaagcccaauagugcaguuauauuucuuuccuucaauacacuuuuacauuagagagagaauaaaaauaggauguacuauuuacacuuuuuauuugcaguagucuuuggcuguuuugcauuuucuucauaugaauuccagcuacuaccuggcuucguccugaagaauuuccuuuaguauuugacuuuuuaucccugagcccauaaggaacauuuuucauucaaaucaccaacuuucacuccugggcccuguaggcccauggccaucucagaaugcagugaggacaacuuccaaacuuuccauagucucuaacagucucaacauuucaaacagucagaaguuucuugagacuccaggcucauuaucccuuuauuugagcuuugaggaaaugacuuuguuuagagaagcuguagaaagauaaucucucucguucucuguuauuuccuuaguauuuuggcuaauuucauccagauaguuacuugaaggcauaaauauuuagagauuugggaguuguggggauggcucaggagguacaguguuugccuugcaaacaugaagaucucaguucugucuccagaacacauguaaacgugccagguauggcaagaacacacguaaucgugccagguauggcaagacacauguaaacgugccagguauggcaagacacacguaaacgugccagguauggcaagaacacacguaaacgugccagguauggcaagaacacauguaaacgugccagguauggcaagaacacauguaaaugugccagguauggcaagaacacacguaaacgugccaguuaaggcaagacaggaggaugguuagggcuugcuggccaucaaguuuagccuuacuaaugaauucuaagcuuauaagagccugucucaaaggagauggcauucuugagggugacaauuaagguugucuucuggccuccaugugcacauaugugcacuugcacauaugggugcauguacaccaacauauauggaaacacauguaugcauuauuuauuuaaaaaauacauuuuuuuuugcaaaguucaaugaauuuuuagaagggauuguggaaguuuauccuuuugcaacaacaguugggggaaccacuauuacagagugaauagucuucuguuuguauacguggaaugggguuguauguacugaaggaacaaaacauccuuugaugucuaaucuuucucuuaaggagaggcuaaacauauauuaguagugaccugucgguaguuuugucacugacaaggaaguguuacuugcuguccauucacuaguuuuuauccauacaaauguucaagaggcauugcuuugcuucuacggaaaaacuggucagaaaauugauuaauuccuaguuuguacugccaguucuucaugucuaaagugaaagggagaaacaucccccuucuagucuugucagauucuguuaacaguaugugucaaagguauuuauuugcaccaccaccuacuuugaguguuuucugcagaagaccuuaucuuggacugcccuaauggccagaaguugguuuuggguaaacuuuccuggcuuuggaguuuagcauacugcuuuuuuguuuuugacuaauaaaaguuagacuugaagcaguggggaauuuguucaguccugagcuuaaacuuuauuauaucagaaagggagguaggucaaauuuugcccagcaccaaauacauaacaaagaaauuugaauuuaagcacauaaauaugacaugauuuuccuacauguaaauuaaaauaacauuuucaccuauuacauucaguacuuuaaagacaugucuauggaacauacuaagaacauagagaaauagagccuauuguuuuauuucccaguagccuuaucugaaaugauaauauuucuuugacacauguuuauaugggcugcggcuuccauacaccauuaucauuuauaacaauguuuuacauacagugacauucagauaaagguggauggaugaaugcuaugacccagcaccuauauuuuuuuuuguuguuuuguuuuugguuuuuuuguuuuuugagacaggguuucucuguauagcccuggcuguccuggaacucacuuuguagaccaggcuggccuugaacucagaaauccgccugccucugccucccgagugcugggauuaaaggcguguguaccuuggucucaagguuagaugagcuugucuucccucuguggcuuaauaaugcaccuaagaagcacaugauaaauacugucuuuacugaaagaucacuguuagauguugacucacuuggaauuaguagccugacugaauuuccuagaaggaagacuuagucacugcuacugaaauagugcuuguauguaggaacccaaacauaauuguucuccaucaucugguaauuaaguuuaggagagguggacagauggacuuaaaaugaguuuauucacuuaaaaauauguguguauauguguguguguguguguguguguguugucugcugguauguaagaguacuauaugugugccuggugcuuacagaggccagaaaaggguguuagaugcucuagaacuacaguuacagacaguugugagacaccauguaaguguugggaacugaacuucagcgagguagcaaaagcucugagcuaccuagccccgcuuuguuuucuuguuaaaaaggugaagucaaaucuuaacagacaguuuacaucaagaacacuucccagcuuuuucuuuuuucccccucuugcucauuuuuggcaauaugugggagcauucuuugauuguuaaaaagugagagaggaaaaagugcuacugccaucuauuggauagaggccagaaaugugguucagauuuugcagugauugggacaguuccuuaauggaacaacuccuuuuaauaaagaaccaucugccagguagugguggcgcacgccuuuaauuccaguacuugggaggcagaggcaggcggauuucugaguuugagacuagccuggucuauacagagugaguuccaggacagccaggacuacacagagaagcccugucucggaaaaacaacaaaacaaacaaacaaacaaaaaacaaauaaacaaacaaacaaggaaccaucuggggaaaugguucauguacaguacuugcugcauaaacaugauuuuagcuccccagcacauauaaaagccagguaugaugauaugugucuguaacccagugcuaagggucaagugcuuucuggccaacuagucuaaccaaaauagugaauuagauuuagugauaaucuuuucuuaaaaaguaagguagagggcuggugagauggcuuaguggguaagagcacccgacugcucuuccgaaggucaggaguucaaaucccagcaaccacaugguggcucacaaccauccguaacgagaccugacucccucuucuggagugucugaggacagcuaaaguguacuuacauuaaagagagagagagagagagagagagagagagagagagagaaagaagacgagucuagaguaucagcgcagcgguuaaggacacuuccugcucuugcagaggacuugaguucaguuccuagcacccacgucuagcagcucacggccauuuauaacuccagcuccaagggcuccaacacuauuaucuggccuucaugggcacccuuguacacacaauccauacaaauacacauauauacacaaauaauaauaacaaucuuaaagaauggcaacuaagauuucacauuacagcaucugcagugaucccacaaguuugcauucugggcugcuagccaaaggugaagaacagguuaaauaauaugaaagguuggguuguugaguuacagauagaaaacaccaccucagacauaguuagagaugcuuaugucagauaguaagaugggcuuucaguauaaaguuacuaauagcaauugccuaaauaauaugguugguuuccacacaaccuugcauauuuagugauaaggcaucaaacaccccaaguaggauauccuuuugugcuuauuguuggaauucaccucguacaugcccacacaggugagugcaauaacacacacacacacacacacacacacacacacacacacacucgccccacaugaguggggguuggaaggaccaucugauuuaaaauuggguauugcugaggugagaaaccuuucucuaaaacaaucugcuugucagcacaguccgcaucuugauuaugugugcauucauggguacauagaaguuuuugguucugaguagaauuacacugugguuuauuauaucagaggaaugcagguuuaacccaucaguagguaaaggugcacagguauggguccaggaaacuuacaggcacaaggcauccucuuguccucuuucuauaaaguuaauauagucaaugaauaguuacuucuccccacagugauguaagacaaaacuugccgagguucacuaaccaguaauacucaccugaacuuuggugugcagugauuuuauuggguaaucagucauagguagagucagccaucugugugacugaucucaaucuucaucuucuucauagguaaaucagaugcuguguggccuaaaguucugaacauaaaucuuguuguuuagacuuaggccuagacaaaggccugaguuuuuucuguuuuguuuuagcaagcagguuauuccaaguguuuagauuuuaccuucaagauuaguaagaauuauuaguaagauuauuggcuauaauaauaauguuuuuguuauuuauauuuaaauaauacauguuauaauagauaacauguguuauauauaacauaauuauagaauauauaaaauaaauaacauauguaaauuaaauuauuuuguagcuagcuuaauacuucucauaggcuaguuuaagaacuauuaauggauuaagaugacuuuguacccacuuaucuguugcuuccaggacuuauuuguccauugaaagcagugguuugaaaacuccaugaaccccuaguccauuucacucugcaguuuauugaauuauacaaaucuucuaauuauugauacuuuuccuuauauacaguaucaccuuccccccaaaaaaacccaacauacuugcuaaugucaauaaccagaaagucuguaaauacuguaaaguuaggcuuagguggccaguaaucuucaauuauaauuucuguuuaaaaguucuaauuuuuugauaguaaaaaaauacugauaagauacauuacuugaagugauaaauuuccuuuuuuuucuuuucaauggaauuucugagucuggauaaauacgauuuaucaguuauucuuucgaguaaaaauauaaucaaucuaucuuccuucucuucucucuucucuucucuucucuucucuucucuucucuucucuucucuucucuucucuucucuucucuucucuucucuucucuuucuuuaguccaguuagguaagcaacucacaaggcacuuauccuguaacuccuguaacuucuccuguaacucauaacuguguuuuacuuaccauauacccaagaguuaaauguaaucaaaugccaccauguggccaugagccaccaugugguacuuugaaugagaauaauagccuccaaaggcucauaugcuuaggccacaggcaguggaacuguuugggaaggauuaggaaguauggcuuugagggaagaugugugcuggaggggacaggguguugauguugagauuucagagacccacuucagguccugcaaucucucccugccugcugccuguggaucaggauguaaaguucucagcucuaguacuucaccuguuuguuucccaccaugaugaucauggacuaacccucuaaaacuguaagcaaguccccaauuaaaugcuuuccuuuauaaaaguuaccucagucauaguguuuucacagcaauggaacaguaacuaaaacacaucaccuugauacuuaacaagacacauggugagcaccacaacuuucaaaccaccaauacaaauucagcaggguacaggaagcauauaaaaggacugccaccugcucuguucuggacugauacaagaacaccaccaccaccaagaugucucuuuguccauugcuggggggauguggggguuccucuguagguuugaaugaguuacuauuauuguuguugcuauuuuguuuuguuuuucuuuuugugauuuugagacaggauuucucuguguaucccuggucauccuggaauuuucucuguggacuacacuggccucaaacucaagagauucaccugucucugcuuuaaagguguacaucuccuccugaauuuuuacguauuucuuucuuuuuuuuucuucaguuuuuaaaaucuguuuggaaaauuaaacaugauagaaguagaaaaaaaaaaucucuuaugaaguccuuccucuaugaaaggaaauugugacagguuccugauuugacaaaaaccauuccaucuccaagggacaggaggaauuucuuuucugguccaaucuauuuggaguucuguaggcuucuuguauguucauggccaucucuuucuuuagguuagggauguuuucuucuauaauuuuguugaagcuauuuacuggcccuuuauaaauguguugccaccugaagguguggcccagauuuagggcaaaucuucccacuucauaagauccaaucaggaagaccccaguugaugugguuugugagcugagcgucacauggcucuucuuuguucuuccuuuucucuuaugaaauagguucuuuucugugcuuucauaaaucuucuucuuuuuccucuguauauuauucuuguguuugcugcaaggcagauuucuugucaugaguugcuuuaguuuguguuuguguuuaaaauauucauguuuuucaucaauucugagagagagcuuuugggcauaacaaucuuagucuacacugucugcuuugcuuugagguauugaaauguaccguucuaugcuuucuuggcuuuuaggguugcugaugagagacuuaauacuauccugguauguuucccuuugugaguuggcguuuuccuuaaaacucuuuguuuguuuguuuguuuguuuguuuguuuguuuguuuuucgagucaggguuucucuguauagcccuggcuguccuggaacucacucuguagaccaggcuggccucgaacucagaaaucugccugccucugccucccaagugcugggauuaaaggugugcgccaccacugcccggugguuccuuucaacuuuuuaauauuauuuucuuuacauauuugacaguuugacugcuguguuguuuagagguucuuucauagucauacucaaaauaucauuuguuuggauguucauauuuuucucuauauuuuguucaauuauuuuuugcuacaauuuuauggacuauauuaucugugucuuuagcuuaccuuagauucuucuacuccacagauucuuagaugauuaucaugucaccauuaucacagaguucuugaaaguuguagucauacuuuuuuucccuagcaugugaccuugacccucagccuuuaacuuuguuuugucugaccuuaccuuaucucuugaugauacuuuccacuguuuuuuaucuuaauuaauacuuccauuuccagcauuucuguaguucuuuuucagucuuuauuuucuaaaaauuuccuucauguuuuuuuccaccaaauuacugacuaauucaucugcucuugucuagguacugaagugauuucuuccuuuucaucaucugcuucaguccugggaguggucauugaucccuuuugaaaauagaaauuccaagucuuucucuagcacuugaaagaugucaucuuuacuuuccauuuguaaguggaugguuucauuuguguguuuguggcucuuuuauuauguuuuguacuucucuugggaugacuggauagcuuucauuuuuuccccuuuuuucuuguuuuaugugaaucuucuuggugaguugucuuuacuuagauuuauggucacugcuguuauuuaauggggaagcuaacugcaguagcaaaauaacuugacagcauccccggugcuaacuuggacuaggagacacguguaugucuauaagauucagagguacuagaauacugauugcgggaaauguaguuuaaguaguaaagugagagaaugggguagggagaaggagagaaaaguauauggcauagcaguaggagaaaauacuuuauauuaugugcagagaaagaaaaggucauuugggcugaggaggauggcucagaggguaagagcacuuacugugugugccacaaugagaaccugagugugaaucccuagcauucaaguaaaagucaggcaggaccaucaugccuguaaccuuagcauuggagggaagagucaggcagccuugaggcuugguggcccauugacccagaugaaaucugagcuucagugagaaacccuauuucaaagguaaaacaugauggagcaggagaccugacaucuuuaucagcuuucugcauccuccugccacacacaaacacaagcagauaccauauguauucacacauggaaacgaauuagaaagggaauccaugaaagccgauuugagcaagaugcaagcuaaaacacuaacuggacaauuaaagucagaaauacaaaguuuuaaaacuuuaaaauaaagugaaauaaucuuccuaguugugauggugucguuucugccucuccucuuugacugucuuuuguagaauuaucugugaaauguucaagagucuuauggugaggggacuuucccugugggaagacugcuuauagaauaucuaaggucacccugucaccaauuacaacuuugucccuggugucucuagaauugugcuguccaggugucugcccauacugcuuuggucagugggaauuuauccccgcccuguccaucacacuauaccaaauccccaggguucuucccucauucuuuuguaauucauucauccaggcagugaggaggguuuuggcagcuucuccagccuuuaucuccacagccucuggacaaucucucagcucccacaccacacuucugccucugucuucagaaccugcucuguuugagcagucuuuccucacaguagauccaggcucuuguuacauccacauagauuggacaguccccccagcuaagcauugucacacugcagccgagugaggggagaguuccuccuuuuaacugauuccucugccccuggcuuggcuccugcuuuguagccaauccccacuugggcuuaauccauuuuuuuuuuuccuuugccaucaauaagauauuuacuuauuuaaaaaaaaauaaaugcugucauugucuagaaaauuauaacaggcuuauuuauaauucuuaaaagguugaacuauugaaauguguucacugaaauacuuuucuuucauuaaugcuuuauauagauuuauauuaaaaagucacaugcaaaugaaaaauggagaaacugacaguaccugauucugcccacuauguuucuauucguaaucauauucuuagguaccuuuugacuccaugggacggggguggggguggggggugaaaucuaacauucaaaacuacugauaacaagaagaggaaaacauugugugugugugugugugugugugugugucuguguguuggguuuuuuuuuuuuugagaaugaaauauauccccuuuuagugaacucaaacauauccuugucguaugcagcaugcuagcuagaggucuuuuagcauaguuguuacacguuuggcauggauagcauccaaguugcuaucuuccaaaaggccaaccugguaggccucacuugccuccugcaaaguaccaauagcugcacucugaaagcacagaucuguuuugaaguucugaacaauuucugacaccaggcgcuggaaggggaacuuggcgaaucagaaguucaacuucugauagcagcguuugauuuuuacggaguacuauaguaccagccuguaaagaugaaguuucuucaccccuccaauagagggcacacuuauuugaguggcuuuuguagccaguuguuuccugggugcccaaacuaccuguggauuuauaagcagucugcuuuguaggaaccaugauauaggcaccuccuuacuucuucggcucagcaggugagagauagcgcuggcacuagagagcagcagugacggcugugagcacaaugucagcuuguucucuuauugacuagauuccuucgcugaguugcagagacagcugauaaacagccuucuuacauggcaguucuagcuuuacccuuucuguuuuggauuacuguauuuuuguuucuuuugagguugguguguguuuguuuguuuuuguauguaguuuguuuuguuucuuuaauucuguaaagaguguugcuggaaucuugauccugaucacauugaaucuguagcucaccuucaauaguguagcuaguuuucacaguaucaauuccggaaguauguaacuuagaaccugagcaugggagaugcucuucucaucaaagugcccucaguuuuuuuaguguuugaaaguugucauuguagaaguuuucugcugaucugcucauguuuaauccuagguuuuguauuuugaagcuauuaugaaugguacuguuuucugguuucuuucucagaaaguuuauuauugauacacaagaaaaccauggaauuuuuaccuugauuguugcacucagcuacuuaugcugaaaguauguuuagagcuaaaagguucugauaguccuuagggucuuugaaauaaaauguuauccugcagguagggauuugacugguugguuguggauuuuuguuuguuuuguuuugagacaaggucucucuguguagcccugguugccuuggaacucacuuuguagaccaggcuggccucaaauucugcaaucugccugccucugucuccugagugcugggaucaaagucaggugccacccagcuggaauuccauccagcuggaauuugucuuacauuauaugacucuccugcuucuuucucucaucuuacugcuugagcaugaugcuaauauauguggagaaagugggcggccacgcacacuccuggauuugagaaaacauacuuuaaaaagucuucccauuugcaccaacacucaugcuugugcacacaugcacacacacacacaagugugugccaaauuuuaaaaaauacauaucuuuggaagcccacuaauaaaucaauacucggugaccauagaguagaaaauaagaaaaauauagccaggcaugguaguguuuuugcacgccucuaaucccagcacuugagaggcaggagcaggaggauaucuugaguuugaggccagccugguguacagagcuaguuccaggacagucauggcuacacugagaaacccuauucaaaaaaaaaaaaaaaaaaguaaaauguuuuguaaagcuaaaagucacuuagaguaaauguagaaaguuuucaugaacgagacaaagggaagggauagggaaaaggagaaauacagaagcuagaagggagguuaauaaaaugggcuuuaaaaaaaaaaacccuaaaaauguuaugaaggauaaguggaaagcgcagcuuauuuggaaauuaagaaagugcuagauaaaugugagaaagauuuauaaaaacaaauacaaaggcuuaaaaaugauauccaaaauauuaguagaguauaguaaacuuaaaaaaaaaauagaccugguaaaagcaacgaugaaaugcucggauagcuucuuuccggguccacucagauuggacucuggcggguaguugcugggacaggggcggguaagucagcaugcuggugccaagucaguauuuucgaugagucgugugcuuguuuccccucugccucuggggagcugguccaggugaagcugggugaagcuggacaccuuucuucccugagucacucuucugcuuuucuugauuucccagcuaucuuauuccucccuuuaugaaguucugacucauucucucccucacuucuccuuauaaucuuuauuaccuuuaacugggucacaugaaaguuucucaucccccaccuaucugcaagucuugacuuuuucaaacauuuuuuuaaaggauuuuuaggucuuuuuaugcccuaaaaguguuauuauauaaaauuaucuucaggauguguggaaagauauauaugaaacauguauuucauguuuagacugugguuuuauccuuuagccuguuacuauauaaauguuucaagaccugaaauuuucaaaucucuaaacacuuccagacccaggcauuuugagaagggaacauucagucugugccacguuucuccaucuguccauuuaccguugucgaggacgacuuugugaguagugcuagacauagcucagauauuggcauacuauauucucauacauacucacucauuauacuacuuuguauauguaccuuaugacauaacugcuggaucauauaacagcuccguuuuaauuucaaauaucuucuaaucuuuuaaauuuuacuugcaugugugagaaaggggucaguguuagguauuuuccucuguuuuugagacagggucuuucacugagccugguacugaacuggucuuaucaauuugguaagacucgcuggccagcaaacaccuggaauccuccuguuugucuuccuagugcuaagauuaauaacaggacacgaaccauucugucuggcuuuuugcaugguugcuaggauucugaacucagacccucaagguugcuuagcaaguaaguuaugguauuuuuuauuguuuuggguaaguuugauacuguuuuguuuucuuuuaauaauaggucuguuaguauacagucccauaagcagugugcagagggucucuuuucugcacauucuuacuaccacuugucuuuuucucuuugguaguagugguuauuuuuacauacaugagugauagugguuuaauuugacugauuaaaaaaaaccaauuuauauaugcaguggugguuugccuuuauggauguccgugugagggucucauuucuuggaguuaaagacagcugugagcugcugccaugugguugcugggaauuaaacccagguccucugaaaaagcaaucagugcucuuaacugcugagccauuucuccagccccaauuugccggcucuuaaugaugaguuacuuugggcaucuuacauguagcugaucgucauuuguaugucuucaucucaugaauguucacauacucauuucguuuugcuuacuuuauugguuucuuaauuuugagacagccucccacccaaacuagcuuagaaaucauugaucugaaacaguccuccugucuuugcuguguuaauauaggagaguuuuuaaaaaggaaaugauccauagguaugcauugcuuacauaacugaaggacgaucuuucuaguccgaauuuauauuccacauagcaaucgauuuccuucccacuuuuauagccuucuuucaaacuguugucacuucuuacuuggauuauacaauacaguaauuuucuaauuauuguacucauauuagcuuccuguccuacauugcaacaaaguacggggacauugcaacaaaguacggggcaaaagcacuuagaagcuuauuuuaguuuagaguuccagggaauacagucuaucacaguguucucaaccuuccuaauacugcaacccuuuaauacagugccgcuauuuguguugcuacuucauaacuguaauuuugcuacuguuucaaaucugauauccaggauaucugauaggcagccccuuggaaaggaucaguccacacagcccccucaccucacccccaccccaccccauccaaaggguugagacccacaggucaggaaacgcgguccugucaggguugccaaggugacccgagccggaugugcugcucacgcugauguuucgcuugcuuucuccuuugcacgcagugcaagaccccagcccguggggaugcuugccgcucacaguuugggagggccucagaaccucaguuaccuuagucuagagaaucccucauagagaagcccacucaagguuaaccguggcagugucuauuccagccacacccuacuguuuaguuuuguugucaaaccagucaggauguacuugggaauguuuucucucaaguugagaauuuaaaguaaaauaauauauucaguagaaacuuaaguucuuauugccuggaauaaacauguucgguaguuugcccuuuuuuuuuuuuccuuaaagaauaaaaucauuccauauaaaaauagagcugguacccuuaauuuuccuuaaguaaccaccuugaaaguagcauauaaggcuggagagacagcuuagcaguuaaaaacacugucugcucuuccagaggacccagguucaauuccuagugcucacguggcagcucccaacugucuauauaacuccaguucagggaaccuaacaaccucacccagacauacaugcaaacagaacaccaauguauauaaaauuaaucauuaaaaagagaacguagcuuauaucauugauuauuuuucuguaaaugcuauaucuauauagcaauauaacaaacaauguauacuaucacuuuuauuuaccaaaagguaagauguacuuugucuguucuaauacuuuuaaauuuuaccuguuuuuguuugcuaccguugcuguuuaucucaugcagauaaaccagcuuauugcucuauguucacauuauauacauguaauuacacaauguucaauuuugagcaaauugugcugugauagaaauuuugguuugucaucuuaucuucaguguuucugagauugauagaaggaaacagaauuacugggaucucucucgccuacccccauucccucccucucuauauauaugcucccacauacauagaaagauauguuuauuauauuuuucaaaguguagcaauuauauugcugcagguaauuguuaauuucucuuuacuuccaaauuuguuaagaaguauuuuaaauuuacaaucugcuauguguguaucaagugcuacgcugcuguaauuuguauuuuccacauucguaguaggcuauguuuugaaauguuuccuuuugauuguuuuaguuauuuugaggcaggguuucucuggcugcccaggaacuugcucuguagaccaaccaggcuguccucaaacccuagagaucugucuaccucugccuccuaagugcuaggauuaaaggcaggggccacuacugccaggcucaguuuggauauauuucuaucuuuggugaauugccuuguuuuuuucuuacaauguaguugucuuaguuacuuuccuguuguaauaaaaacaggaccaagagaacuuauagaagugguuucaugggguuauuguccauggugucagaacuaagguauggcagcgggaacagcuaagaacuucauuuugaaucucuuaaguuggagacagagagaacuaaaugggauuguugcgaacuguugaaaccccaaagcccgccuagaacaaaucuuucccaaaugguuccaucaacuggggacaaguauucaauuauaugagccuaugggggucauucucauuuaaauccccuuaguaaucauuaauauagaucuuuauauuuguaauagugucuauaggcuaugaaucugguuggcuuugucauauugcagcaaguggcuuguuuucuuauuugauuaguuuuuguucaaaaauguaauuguaauguaaucauaccuguuuuugaagaaguguuuucuucuucauuguuugaguguuuuaaucaugaaagcauacuggauuuuguaaaaaaaaaaaaaaauuugauuuuuaucagcugagauugucaguuucacccucauuuaguuaacauaguguggcauuuaaaaaauguuaaacugcugggcauaguggugcacgccuuugaucccagcaggaaggaggcagagauaggcagaucucugugaguuccagggcagucuggucuacagagugagucccagagcagccagggcuacaaagagaaacccugucucaaaaaacaaacaaaaauguccuuaguucuaagggguuuugaguagauuugauguaauuucuacagagacaaguauguucucugcuagugaaggcagcuccaugcuuuccuuuccaaguuguguguaugucugucugucuuuucacaguaauucaaugccuuccauugaauaggagugguaagaguaaauacccugcccuguuugcugucuuagaaguuagucaguacuucccccuggcacuuuuauauuuccuuaaauaauauguaauucucagcauaguaaaauuaaauaggaauccggcuucccugcuaucauucauugacugagagaucuuguaauucuagauacacuaaaauguauguauguccuuuccuuugcagaugugugcauauguaaacaucuaugaaagaacuuucugcuuuauuguuuauuuacucuucauuuaccuuucuuccuuaacagaagagaugagcauuuagggaaauagaaauguugccucuggggauuuuauguuguggacucuugauauuauguuggacugugugaaauugcucauuaacuuauaggcuguaaaucuuggagaaacaagaauagccaaaauaaaauaaaauaaaaguagaggagcuuuugacaauucuuaugacaagauauuauauaguuuguaguaugaaguguucauucaugagaaacaguccuucacugguuuauguuaagcagaacacagaacugauacacugcugugaaugagauacgaucccugcucuugaagagucucugaaggcugggccuuuacaaucuucuuguguguuuaacuccaugguuuaucuaucaguauagccacacuaucucagguugaauucacuauaaccagugacuucuacuauaagcauuuuggcaguaauuuugagaacagauuacugagaaaugaagcaugcuuugcuacaugaaaacuuugugcaagaaguugcucuauaugcaucauuauuauuuuaucucugugugggugucuugucugcauguauauauguacaucacaugaugcaugcaugccuaguaccuaaaagaggccagaagauggugucaggauucuuggaauugaaguuacagaaaauuagaauaugaaccaaccaguacccccagaaaauugagauucaccauguggguccugggacucaaaccagguccucuggaggagcagcuaaugcucuuaacugcugagucaucucuacagccccgaaauaacucucuuuagguguugguaacuuaaauacuuaggucacuuugugaaauuaagaagcagaauaguuaauaaagaguagcaggugcuuucccuuucaaaauaaauauuucaacaaaagagagggacaaacaaagcaagcaaaacaggagggcugugguaauccugacuucacuuuuuguguaauauuuuuucauuguaaauuaaauuacagguggaagaaagcuacagucuuuauuuuuuguuucugguuuuugguucuacagucuuuuacugucuguucuucacuauacuggucuguauagcaaaaccuagguaaaagaaaugcaugagagacuuuguguaagauucauaaaacaaaacaaaaaacccuuguucauugauguaauuuuagcauauaauuaauuaugaacaagcaauaaguugaauaaauauuuguggggauagauuauuugagcaccuaauuugguuaaagaaagaaugauuuacguauuuuuauuuugauauguuauuuaauaagcaucaaaagagucgcauauuuuuugaagugacugcauugugucugucagugcuguaauagaaggcuauuuuuaaacagauugagcuugacuggaaauguuaaaauaauuacuaucaaaguugaguauguuagcuggcacaugccaguaaucuuaauaaaggggacugagggagaaggaagagaagaguucaaggcuggucuagucuuguuuaucaauauaaccaacaacccaaaccucuaaaauuguccugaguaguguugugugugccugugauccucccaaggcaggaggugugugaguuugaggccaguuugaacaacguaaucagacuguuuguuuguuuguuuguuuuguguuuuuuuaaaaagaugaacuaugaagcuccuuauucauuagaaacuucuguuuaaaauauaagauuggaaaaauauuuuuguauugguaaaaauaaucaaauaaauacugaagauuuuuucuuuuguauuugcugccaccaaguggcugauuggugacauuaccaaguuuguuacaugucuagacagugcaauuuacuauauauaucacgguauacuugcaccuggcuugggcugaccuugaacucacugccccuugacugggaggauuuauagaugugugccaacauaaucagccacccugauacuuugaacuagcuugauuuggcuacuuuacaagccauagcuuacuuucuuggaccagagcuauucuuggcacagaacaucauuucuguguucccgguauuuugcagaggccucuuaggacauuagcaacuaguguuaauaaaggugauuaaacauuggacuagcacaggguccccaguggaagaguuagagaaagaacugaaggagcugaaggaacgaaccccuugcagccccauaggaggaacagcaaugugaaccaaccaguacccccagggcucccagggacuaaaccaccaaccaaagagcacacauggagggacccauggccccagccucauauguaucagaggauggccuuguggaacaucuaugagaggagagacccuugguccugugaaggcucgaugccccaguguaggggaaagccaggaguggguggguuggugagcagagggaggggguaggauaggggguuuuuggaggagaaaccaggaaaggggaucacauuugaaauguaaauaaagaaaauaucuaauaaaaaauuuaaaagcaaccaaacagaaaaccccaaacaaacaaaaaagcaaagaugguuaaaaaaaaaaaaaaaagaacaauuuucuaguguagugugaaaauaugguugaugcauacuguuucacacagguuuaauucugacauguauucuuuaaugagaguauacaugagaauuacgauuucauaaguuuuuagaacuaauuuuacuaaauuaauuauggagaguuuauuuuuacuccagaaacuguuauauaagcauguauaacauucuuagaaaaaagaaaaaaaaggaaacucaaauguuuacuauuaggaagugggcugcuuacaacauuguguacuuuuguguagaauuugauguaaucauucuaaguguuagagagggcuacguggagccaugggugggugcguccuucuuuucagaagcaugcgucugucccuaacacucagcuuaaagcuuaaacccccauuuuguuuugaggggaagaaacauauuaacaaaauauauaauuggaaguuuuuagaaacauacagagaaaauagcuagcaguauuuaaguuuuaaguaauaguaugguaaauucuuuaaauuuauauauuugaaauuaaugcuuuacauauuaauauaugaacaacauuuuacaaaucacugacagccuuugaaaacaaaccauguauaaacaaauuggcaaaguggcuggauguauuaucagaaaauauauacaagauuugcuuguguguguuuuuaagauuuaagguaauuuguugcgaccaugaaauaugaaagccccauauuuuggauuucuuccaagaauccaguaagaaccaguuuuuauauaaagacggucucuaaaaauauuuuucuuaaaaauguauguauguauguuuguacguguguguguguguguguguaaauauggcauguauauucauaguuggaaauuggaggcagguggauugaggauuugaggccagucugggcuauauagaaaaaucuucgucucaaaaaggaaaaaaaaaaggaauaaaaauauauagccuauacaaauuaguuuucuugauagaaggagaaaaacuaaaucugaaucaguaaaaaaaagaacaaaaaaauuuuguaucauuuaauaacucagugguuuuuuaaaaguauauagcuccuuccuauucuugccuuggauuucuguuuucugucacaggccuauagaacucaaauaauacaacuacugcuuccauaggaguauggaaaacaauaugggaauuccugugaggguagguuacguucaguagucguguguaguaaucuugucaacauuuguaauuggcaauuuuuuugcuaccuagaucuucuuaauacuuauucuuacacauaauuacaugugacuuaauaauuaaugucagccccauuuagagacaguucauguauaguagugagcccaguauugguugaagacuucaguauauagcaacuuaauaauuaugguagauuuucagugggaaggggucuauaaauccuacuuaauguugucagagaagcuuagagaagaaaauauuaaguaguggagauaaugagcaauaccgcagaauuuguuuuauuuuguccuguaaaaccaauaaauacuugcaucccauugcccagcuguccauuacuuuucucauucucuuacauauuaaauauagcacaucauuaucagccauaguaaacacaaggagacuucaguuaugugagugucuccugugguuuuagugaaaguaucuuagaauaucucucagacucuagaggagaagcagcagacuggggacacuaacaaggcaguuugauaacugcgcugcuguuugucgaccacauuugaaauagaaacauucuaaagacuuuguagucaucaaaggaagaagcuuggcucagugauguugcuuuguacugaccaggcagugguuugcuugcugucuuuuuguuagaugugcucucuacacaguaaugcuguaugauguuaacuagacucaauacaaagugcuucaaaaacgaaaaauacccuuacuggaguuuuauuuaauaugccuuuaguuuuauuuaacuuuuuuuuuuuuuaagaagaaagcuguuaaguuaggaauguuaagcuauuauuaccuaucuguuuucuaguaagagauaaauuauucgguguauuaaacuagaguaaauaugaucacacucaagacucguguaugggauucauaacugauggugagucuuuacuuggcucccuuuuaagaaaucuagauuaccuuccaaauguucuauuuuguuucuguguguuucuuuaauaagccaagaguuauaaaguaguuuaggaauaauagaaaguagacgaggcauagaauuuccagugaaaaccuaguuaucaacaaccauccugacuccuugaacccacugagcucugccugccucugcucuggugugccaccauacucaacuauucucuccucacuuuuaaaagcauguugaaaggcuaaauuguuauuaccccgaugguuguugauaacuaggguuucacuggaaauucacuggacuugcuauggugggagaauuggguucugaugaugccaaguaaccuugguuucugcugcuuauguucuuaugcuugccuucugccaucuuauuaucucuagugcuaccuguccucgcuguuucugacuggaaccuguccuugcugugauccugguugugucagaacuccucagaguucagcugccucugggauccugggauucugggauccugggugugucagagcuccugggagucaagaugccucugggccccugagauccuggugugaccaagccccugggauccugggauccuugguguguuagagcaacugggaguggagcuucuucuggaugcugcggaguucccacccaaggucugcucauggcaccagcccagacagacuggcuuuuucuguuaauaagucuucaaaacuacugaauuuccaaccugccuuugcuacuauccuuguaaaaguuguaguucuuaucucuugccacuggguggugcauuuucauuguuuauacaggcauuuucuuuucuuucuuuuuuuuuaaaauaagggaaccauuugaaaaauccauaguaaaauuaaggugguggauaguuugucauauaauuuaagugaguuuaaacaaauuccaaaaaauaucuugugacacacuacucaguuaaagaguguguguguguguguguguguuaacaaugucucauuauguaauucuaggcuggucaugagcucuuggcaaaacaccuuccccagcuucccaaauuuuaggauuaugggcaugugccaacacaccuaauuuacuuuuuuuuuuuuuuacccucucaaggagaauguucaaaaccuaugccuuacuguauuuucuuaaaauaauguuucaguuaccaccuuaaaaacauuuuagauguucugaagcuaagagugguggcauauguuuuuaaucccagaauucagggggcagaagcaaaagaaucuuugggaauuugaggccaaucugguucacauagugaguucuaggacaucuauggcuauguauguagagagaccaugucuaaauaaaaccaacaaaagagaagaagaaagaaaagauguuuugauacuauaggugauagauuugucaaacuaaagaccuuauacauucuaggcaagcugucuacccucaagcacacagaugauauuguaguuuaaauaacauccaacucccgcaacacacaauuucuuaaauugucuuuuucuccuguccuauagccauucacaccuuuaugacaaaaacuuuuuuaguaaauacuauauuuauauaguauuuauauauauuugcauauaccuaguaaauacuauauuuacauuucugcuuuuaaagguaccaaaugguuuauuaacauuucuuaauugaaugaguugaguaguuuggugucaagacuuuauuugggauuauaacaagguuguaguucagagaagaaggugagcauaaaugucuacccaucuuggagucugcucagauuaucugacaguguguuuguguucacauaugaaugcagaugcucucaaagguauuagauccaccagagcuagagacagcaucugcgagcuuccugugguugguguuaggagcagaacguggaucuucugcaagagcaguuuaccucugggccaguuuucuagcacuauuuuauagcuuuugaggaauaaauuuauaaauuaauuuuauaacccagugaauguagaagagugguucuuagccuuccuaaagcugccauccuuuaguacaguuccucaugucauagugaccuccaaccauaaaaugauuucauugcuacuucauaacuaucauuuugcuaguguuauaaauuauagcguaaauaucugauaugcaggauuucugacaugcauccccuacaaaauggucacuugaccugaaagggguugcuacccacaggcugggaagcacuuguuuagagugucgccauaacaaagauaaagggcuuuggcuuacagguuuacuuuuuagcagugagucucaauauaugcagucuucaaguuuugguaaugggugcuauugucaguuaaccuuucugggccuuacuuuucuuaauuauaggaugauauuucaguucagaaaaaugagagucauggcucucaggaauaugguuacucugaaauaugugagcugugaagaugagaauaaauaagccauaaucuugcuauggcuuaguuggucuguuguugcuuuuuaaaaacaucacaagccaaaauaaaaacaacaacaacaauaacaacacacacacacacacacacacaccccuaccuucuccugggcuugggagucuagcucaguguuagaacacuuaccuaacaugugaaagaccugaguucaaucccuaacacucaaacuuucuguguaguaacuaagacauccucccucccucccucccuuucucuuucccucacucucuguuuuauuccauguaacauaaguauugcgcuguguuuuuagaaaucccuacaaaggagcaaauauauaacucaguggauagaguacuugcuuagccuuuguaaggcucuuggaguucagucuccagcacugcaggggcagaggggauuuuaaguaucagauacauguguauuuuguggcauguuauaucuuaaauaacuuuuuuauucugcauuaaggugguuuucauauucuaacugauguuccauaagaucuuccuaugcauguuuuaugagcuucauauuuuucacuuaugucaacauuuuagcaaguagaaaugcuacccaaaaaguuuacaaggcguauucauugcuguuaauagcugucagcagguuuuuguauguuuguuuuuuccucuagaaaaauuguuguaguuuacaucuuucacugucuuaugguuucuguuagaguucugcaguaguuuacugcugguuaucucggcuauaggggcugcuugguuuuagguuaccuuuuauguucacagugagguuuuuuaauguauaaauuugauuucuacuuugcaacuuuguuuuaaauacguauuucaucauuuugcagauuaaaauguuuuugcuauaauauggcacucacgguccuucauaucuuagccacuaucuaauuuccuaccuuauuuuauauaguccuacuuuauauucuauggauagagagguugccaggaagcauucuagcuaacaggauggcacauauacaaaggcagaacugucauggcauauuuuaagugcaacaaguuggcauauucgaaacuuaagacaggguaguaauggaaguuguuuugcuuuugcgcgcgugcgugcgugcgugcguguguguguguguguguguuacaccucauagaggucaaagaaaacuugugggcguugguccucuccauccaccacauggguucagggaucaagcuuagguugucaggcuugcuaucaagucuuuacccacugagccaucuacuggcucugagacaaauauccagaugagcucaguagugauauuugacagguagaacaacaagaaauagaaagaucacccaauuagauggcauaugauauaggcaaguauauugguaacauuugcagaccaaagggaaggacuaaaagaaugcugucuuugcccaucuuuccucucaacacacaagcagguauucuggagauaacacugaaugggaaagaagcaauagccaacaauagagaagaccuugagaagcaugagcuuaggaaaacagugaguuuucuguuuuaacaucagaagguaaaaaugcccuuuuuaggguaguacagauugaagaguuaugcauaagaacuuauucagaaucugaaugaacacuuugaaaaaaucugccuuuauuagaauauaaacaaaaaaauuuuaauaagguuaaacagcaaguagagucuuuuagaaaauaccuaauaugccaaaaguaaaggaaaugaaagggaaaacuguucuaauacacacauacuacuacuauauuugaaaaguaaauuuauuucuucaugucuuaagaaguagguugaaaguaagccaagcuacuugaagccaguuugaauuagagggucuuuuauuuccuuaauauaguguuacucucaaaucucacuuuuguuacuagcuuuuguuguuguuguguuuuguucugcugucuugcuguguagcccaggcuggccuuguucauuuucuuccugcuucugccucuugagugggauaauagacauguaccauaauacccagcugaguugagguuauucuaaacaggcuaaauucugccugcuaaaaacaacuaaacacugaagagauggcucauugagucagagacuuagcacgcuuacagcagagcuggguuaagugccaaucauccacaugacagcucacagcugcccgugacuccauuuccaggggaccccauguccuuuuucuggcuuccaugagcaacaggcacucacaugguauacacauacaugcaagucucacacauaaacauuaaauucuuuaaaaaggcuaaagaaggauuauuuacaauucaugcuguuuucugugauuugaaaauaccuggguaaauguaguaucacguuacuguacugcaaaaguugagaagaacaguuugcaauucaaaaacaaguugcuaugguuacccgguguuugcuuuuuaaagcaauaauuacacaaaauacccaaagaauuuccuuuaguacagaaaggucguagcuuauguguaugcuaguuauuccacacacaaauugaaacuguauauaucacuuccguccuaaaguaucauuuggaaaauacuaaagaaaaugauucaugucuuuuugagcuguaacaggguggagacauacugaacacuauuuuaaaauucaaguaaugacucagauaguuuaggacauuuuucuuauucuuuaguuccuuuuaucaaauaaugcuguaguucuacauaacaaauuuaugguuaaaagaacgaaaguauuuuucugguguguuugugaugugaagucuuuuuaauacauuuuuauggcuuuaauaaccuuauaaaaagccaugcuuauaacuguuaauuccauuaauuauagcuuguuucaaacuucuuaaaaacaaagaagauaucuuauuagagucuaugacaaguucauucuuagccaacaaucauucuggaauuuuuauuguuuucuugacauauuccuaauauccagcaucacaggcauaccuaaacgcuuuuaagacaauauaagguuaauuguuauauuuuaauggcccuuuuauuuauaauaggauauuauuuguucuuuaauauuagggcuauuuuaaacugaaaauacuuuauauuuaaaguagaagcuggauuaaauaguaaagggucuuaucacaguagcaguaauugaaauacuaugcuguaaaagguugagugcuuuaguuacugcugugaccauaggaaguggcucacuuucuccuuucugcuuuucucucagucagacuuaguauggacucuaggauaacuccagccauaagauacucagcacauuucacaacaucauuaucaaauaugcuguuguccaguaggaggggacauuucccucuaucucucccuuuuuagguuaaaaaaagagagacuuuccuagaaacacuacagaugacuuuccuuugcaugugacagagcaagcuggcucagagcaugucauuucccaaaugagucacuuacuagguagaauagaauuaccaugaucaccuuacacuauucaagauuucuccaagucauguggaauauagaaauggcauccaaacaaaacuaaagguagucuguaagaaggaagggucaguggugguuagcuaaguaggcaacaaguagcaagccacauauuacauagaaaagucaagccuugucauuuucuuccaggguuaauuuucccaccaauuuaaaugauucacaacacaccgauaauggaggguucuagaguuuuguuuuuguuuuuuguuuuuuucuuuuuuuaaagcaggagaaaacagauugaaacaaagcauuguauaaaugucacaagaaaaacgucaaguauaugaaaacaauauauuuacaaauaggaaauaggaaaauuacucuuuaauuuuuuuggucacaugcaaugacaauuucauuuucaaauguuuccuguuaaccuacccuaugaaaaccauccuccuuucugcacccucgugaucauaauucaucaguuaauaccccuuucaccuguugaacggggccccugagcucauucuguagcuuggcugcugcuaucacuggacugugauagugauagauauguagugucucuguuauaugcugacuuugacuucuuuggguauauacugcugagugauguagacgggucauacaguucuauuuuuaauuuccugaggaaccucucuguugauuuccauaguggcuggauuaauuuacauuaccauacauacgcaguauauaagggugccguguccuaacauuccuagcauuuguuguguuuguagguuauugcuuugguuuuggacaagguguagcucuacuccaggcugauucccuccucuauccccuggauccacuugguuucuguuucucauuagaaaagaaaagucuucuaagagauaacaacuaaacaugacaaaauaaaauaaaacaugaugaagcaaaaaccaaccauaucagaguuggacacagcaacccaucaggaagaagagccccaagggugggcacgagagucagaguucucauaagcaggagucccaugaaaauacuaagccaauagcuacaauuuacgcacagaggaccuggugcagacccuugcaggcccugugcuugcugcuucaguucagucucugugagcucguaugugccugguugguucagggcgccuuguucuccugguguccuccauccccucugacuuuuauaaucuuucugcuuccucuuccgaagaauucucugagcucugaguuucagaaggauuugguacagaccuuccauuuagacuccgcguaaugucugacugggucucuucaucuuguuuuagacaauuuaaauuuuaccaguuuugccuaucguuuuuuuguuuguuuguuugagacaggguuucucuguguagcccuggcuguccuggaacucacucuguagaccaggcuggccucgaacucagaaaucugccugccucugccucccgagugcugggauuaaaggcgugcaccaccacgccuggcacguauuuucuaaguauuugacauauuacacauagagaaaauaugacacuauuuguucaguuagugcuaugguauuuuuugguacauguuuuuaaaauaaauaaucuuguucagggugguuuuauguauauuuuuaggugacuacaguauauuagacuuuuaguagaauuguccaggucuugccauccuuuaugaaauuuucuacugaugugucaguacuucuuuuuccaaucauggguguagaugcugagaugggugcuuuaaguuaaacuuuaaauuuuuuuauagaauaaauuuuauguaaagaaugauugggaaaauguaaguauagaaguuaggcucagaccauaaauaaauaaauaaauaaauaaauaaguugugacuucuuuaguccaaguagaugaauuuacacacuagagacuuuggaacaagugaaaauuacuccuauaaaaagagguccuauuuuggagaaaaacccugaaaauggacaacagaauaguacuauaauuucauuuuuguuucaaguauuaggaugauauauucgguacaacucuauggagauggauaacaucauuuauauguuacaguauuugcauacuuaucuuaaaaacauuuucuguauuuuaaaguaaccaguagaagcagacaugguggcauguagcuagaguuccaucuauuagggagguugaagcaagcagauccauucccugcaaaaguucuaggucaaccugagcaacauagcaagaaacuguguuauuucuuccuuagaugaauguuuuaugauuuuuaguaauuuauuuuuauaauuucuggcauucuugccuauauuguguuuuuuuuuuucuuugugauuuaauaaguaaauuggcuuaaacaaagaauagcauugaaaugcucauucaaaaauaacuuauucacacuggcuugguggugaaugccuuuaaucucaaacucucagauggcaggugaaccucugaguucccagggcagccuggccuauauaaaucaaguuccaggacugccaggaauacaugaagaaacccugucuccaaaaacaaaacaacagaaaaagcuuauucacaaauagauaauaauacucucuuguuaccuaaacuuucaacagucuaguuauagguuuucuuuaaucaucauuuuuacaacauagaauuaaaguuagaaaucuuaguggugauagaaguguauguuuuuggcagaugaccagacaaaauacuaaauuucuggauucuuuucucugguauaaaacaagacuguaggauauuuaaagugagaguguauagcagccaggaucucuuaaguacucaacaauagcauaaagucacucacaagaguacaggaugaucaaggugaggcaaauauuucuuuguaauugggaaauauucuuuuauuuauuuaauuuuuuaaaauguauuuacuuuacauccugcucacugcccccucccagucaacccuucccacaauccuucccucauuccccuuucuccuucucuggggggagggggauuccccccaacccugguaaauauauucuuagucugggcaaagugggaaagguagugaaagucaauuccaaaaugaucuggguggauuuguuugcaguguuaggauuaaacccauggccuggugcacaccagacaagugcuccagcgccagcccccaaaugguugguuuccacacuuaauuguagcuuuuggaaauucauuugaucaggaaggaggaguuguuuguuuucuuuguaagauucugagcuuuuuuuuuuuuuuuugacauguugguaauucaggacaagaacuuuauaagcaguuguuuuaugcagcugcuuaauggguucuuaaggcguuagaauauacucagauauaaaaauauuuaauuucuucagggaaauuucaaaugauucauaacauuuuaacacuaagauuucuuccuuuaugaaguuuaaauuuuuucuuuaagaaaauaugaaucaauaaaugauugauuucuuuaacuuagaagauauagcaagccuuacauuuguuuucuuuaagccucuuuucauucuagaaaauaacacacauccaaaggaagagagagggaggagggagggguagaagaagagaaaggucuuggagaaaaacaagaguagcccaccuaacuauaguguugcgguguuuagucuuagagaauauuuccuguucucuugagaucucuuuuaugaguucacuacaggcagucuuacugcagcugcugucauggagcuaaacauuugcuauacugccgcauacaaaagcaguuaagcuguuuggaauuguuuacuugcuaaaaccaguguuagucagcagaggcagugcaccagauuuccuuguggcuuuuaguggaaaauguuaaaagcgcacuuauuuuucaguuauagaauuuuucaguuugaucuggauuagucacagaacuggcaugaaccuucuaauugugaaggcuguccaaauguacuauuuuuuucuccugcuagaggaaguuacauccugagcaguugcugagcucucugguaaguguaacaugugagcauuacuaggcauuucauccugcggggcugcagucuuggcucuucaggcuguugcuuaguugaaaugcuucugcgggaccgauccugagguuguguagcuauuucucaagggccugcucguuugcggauaucagcggcauuuugcaagaucaucugaggaacaggaaagcauuugaaaucaacugaaggauaacuguagcgguuuucaccggggaaggagcuauauuggcacagaggcagaugacugaauaaaguaguuggcucugagaagaugcacaguccgcugcuuuuccucugaaugaagacuguuuaauggaagcuguauucauguagagaucaaaggaaauacuacagugauaaacuaccuucuucccuucuccuuuuaaaaugaaaacccugaagcaguaauuggagcucaaaggucuucagguucuuuugcugucugcuuguucuauuaagauucuccacugacaccauuucugccuggugccugugccuuucuugcugggcugcuagaaacaacugccugauggagaaagaaugaaagcuuugccuugccuguuacugaugggauaaagcuagcucuguuucgccuauuauugggaagucuggauuaaucaacuuguauucucguaccaguaguccuauugucucuugcgaucugacucaucacauguuaaugugcugcagcuuugcuguuaaugcagauggugguuuguucuccuucugucuucuucuucucuuucuuuccuaaacacggaaagagcugacaacgucugagcuucguuuucagaauuuaggcuaaauuuuauguauuuuuguuuguuuguucccugaauaauaucuguauuaagucagugaagcugaagaaaugaagaccaauuagaaguggaaacagaauagugagauucugguuuuaauuuucagcuacagaccgcccagccuucugguaacuauaugaccuugccgacgagaguggggguaucugcugcuaccucugugacagcagcugcuucucauuucauuuguuauggugugauggugugucacccaaaacaaugauuguuuuguacaaguaaauuucagagcucaauguaacuauuuugguggaagaaaauauuuuuuaaaagaauaguccuagacggaguuuuaauuauugacacgcugaugugaaccuuuuuauagauuguaguaaccugcagaaagaaguagguuuuuauuuuuaggaaguuauguaccauaauuuuaaacuuaaguuucucuaauauuacuaacuauaaaaccagcggcacuguucagagaauguuuauaagugguguacagaagaggaggaaaaacugcuugugcucgucccacugugacuuuuaucacauagcuuggaguuuaauguuuuaaaagagcgaaugagucgaguguguauuguuguuuuggaggagguagaagaugauucuccuguauucauuucuaaguugccccaggaaaguacaugucuacaaccuccaccuucuggaaauguguugguaagcuaugagaguuucuguuguuuguacuuuauagaacuaggcauguaacuguaacuuuauaagcacacacugaguuagugucuacuaguuucauuagugucacugguuucauacuccaggcagugugugggucuguaggaugcaguauuauuuacguguaaaauuagcgcauuucugaguuuuucuuuuucaaaugcuuagguuccacuuuaaauuuuauugucuguucaucuucuuacggggucuucaaaauaagcuaagaaauagugaaaucauuaugaaaaaugcucuuguuuucauuugguuuuagaacuaaucugacaagaaucagggacucugcauauuuuucaaaaaguuuacuaccagcaacaucaaggcauagccuuuuguguaaagaauuuuaccuauuugcaugcaagacuuuauauugcgaagaaucaggcuauauccuuaaucuuauuuuuaacacuguugucgacuaacuccauauuugagugguaaaacaugauaccuucagaggcucugcuguuaaugagggaauuauguuuagacauacauaugcuugucuucucauguuauuuagauguauacuuuuuuuuuuuuuuuuuggucuuugaaaaguaguuauuuuuuaucaguugccaaguuuccucucugggauuucugucauuuuauauauauauagaauaaaaaccacaugcaugugauuaucaugaccugaauagaccuuuuuucaagucuccuuucauagcucucacugggcuagggauugcuuauuugacuuguuuuauuccauuaauagauuugaauuauccaacuuauauuuguaugucuuuucaucauuuauaagcaaaaggcuuuuacuuaagaaauaaaaugagcguauuacuuaguuuuggucaaauugcauuugaauagauuagguaggcuuuuuuuuauggcucccacccaggaugaacccuauacuuugauaugauuaggcuguaugaaauauauaguucauauuccauaccccucaaaaauauuacggcugcagggaagaaaaaagccacuagguuggaaguccugcagaaaugucuuuacaucuaugcugaaugaugugauugacgcuuguuucuuuucuuucuuucuuucuuuuuauuuucauuucuuuuagccaucacuggugcaagcuauauuuaauggugauccagaugaaguccgagcacuaauauuuaagaaagaagauguuaacuuucagguaaagcaauugauucacuuacaccaaccuuuuuauccuccuuuuaaaaaccaaaaaaaagaacaaaaaaccuuuucuaauauugugauuuuguuugguagcuuuuuauguuuugguuuaaaagcauauuuuuuguuuaaacauaugcuuuuguuuuguugcugguuucauuuaaaagcauaauucugcaacaguuguuuuuagagaaggcaggagagucucacuugagaccaauagggguagucuggacgugugugugugugugugugugugugucuccaauguauaugucauacauuuauguguauauaucauacacacacauauaaaucugucugaaaacccauaauuccuggaagcagguugauagguuuguguucucugaauuuuuugcuuugaaauuuucaaacauaggaaugucaaaaaaagccacucuaagaccguuguaucucuaagacuguuguauauccuugcuuugguucagcauugauaguguuuuguuauuuacucucauucaucggggcgggggcggggcgggggaggagcgugagcgcacauaaacacgguuuucuguugcugaaucacauuuugacaguaaauugcaaauaugacauuucauaaauuuuuuuagauauggggguucuuuuaaaacuuaagagaaaagauuucuaugauuuuaaaauguaccuaacuugauuaugagagcagauaugauuucuguacauaacuguggugagaguuuuacaaagaauucauauuguugugaaucuaccauacagagugaugggcuucauuaaugacauuuuguuuccuguucuucccaucccuucucaaacagucuuuaaauuucugugugccauguuuguguaauucuauacagguagguagguagguagauagacacaaagacucuugauuucugauuagacucaauuacaaggacuaaaaugcuggaaaguguagaaagaggauguguguguguguguguguguguguguguguguguguguguguguguguguguguguguuuguguauggugguaugaaaauaauuuuuuuucucucucucuguauaggauuguuuguucuuguuuuauagcuaaagcugaucuuuuuuaacuuacuaaacuugccuaaagaauauaauuugagacaaaauaauuucauuaauuuauaaguauuuucugggaacaaauguuucucugagcuaaggauggaugaaaagucucaugacuccugaagcugcuauaacaacaccuagauguucuagaauuuuuuuuguaauuauaagaaaguuuguauuauaagcacaucuugaacacugguauuuguuuuuuacuuucacugacuaagugugaccacuuaauguugauagacacuuaaaaaguuuaccacuuuuaaaaauucugguuaugugaauagguuuucaucguuggcuaaaaugguugauuucuaagaacauggaguauagaccuagagauuacggucagaacuuuuuuuuccugaaccuuuucuaaguaaauggcuucucgguuuauauuuaguuggagaagcaugcaccuaacucaggauguauuuaucuuaaaugaagugcaugauucacuuugccuaauuaggcugucuuagcaagucuacuuuuccuagugcagaaaauaguuguaggguguagaugugugagcagaagggagacagacauacacuauuuuguuuguuuuuuaaugcuugacuuagaguagucuaauugccauggcuaauuucuucaucuuuacaaagcuuguagcugccauugcuucucugcuuuauuuaauaaagauaccuuaaacggaaaaaauaguugucuagucuuguuuuuggacaucacuaucaccauaagaaauaucaguggaccugcuaugagggaaacuaacaaauuucuaauaauaacaagaguaaguggugaagaacaguacuccuugaaauucagauuucacgucuuuaaaagugauuuuguggaaguguguaugugguauaugugcgugucucugcguguggaggagagauacaggcaucacauaucuccuuaagcucaucuucaccuuauucuuugagaccgggucauucacuuaaucuagcuauuuccugugucugcucagagcugacugggauugcaggugcuugccuccaccccuaguuuugguauagcugcuggcauucugaacucacauaaggcauuuuacugacugagcaucuccccagcccagcuugacaguuuaagguggauguauaaguucagguuuguuucuacuuacaauuuauaaauuucucuugucagcuccugaaauucaaaauuuuauggacagcuaaacaguaucuuucuuuucuaaacuaguuaacuuuaaauaaaagcuagaauuuaagaagcauauauucauauuauuuccaugaggauauaacuaaagcaauuugaagauuuuugacugaggaaguggaagcuuauugcauguauaauuuguugauagccauaguguuugggaucaaauucaugaccuuaacuaugcuuguuaaauaauuuacucuggaccaagaugguuagucuuaauaacaaugcagaauuuaggauccaaaccuuguucugacagcaugggauuaguaguaacuguacaugcuuaaaacagauaaagcaggaagaauauccucuagguuuccuuucaaaucagggaagauaucuuuucuagauuagcaacaaaacugccccugaggcaauuaaacuauuuuaaacauaucucugguauacaugguauacauaagcuuguguuucuauagaauauauauguggccuacagcacuguguacauagcauuuuauauuauguauuauuacuucacauucucaagagugcugugucagaauucuuguugguguacaucuuuggaucacuuucuuggucuuuuauaguagaaucuaauauuauaaaguauuugacuuucuccccacuucuuaaaccauagcacuuaaaacccuugaaacuuuuaagucuuaaagugucuuuuguauguuagucagaugacuaaguaucuaagggacccuaaauagcuucaggguaguaguugaucaccugaaagaccagggcauuauuaaugauguuucauauuuacauucuagcuucuagagaguaaagacugaagauuggugugguuaccaauguucaguaauugaaugaauuuuacuuaacauaauaaacauacacaaaaccaaaaggacuacuucugagaggcaucuaaagcugugcauaugggaauggccuauacacaggaagacaggaggaggccauggaaccuuaauuuauagucagaaguacaauaaagacaauguggaacuugggacuagugucugaauuuagggcagucuuaaggaaaugagcccuuuacugugucauuuaauacuaccucccagguaggguguguuaggacugaauccgaauaauuggucuuccaaacaaauucacagcaggagugauugcuuguuuccuggugguaaugggaaaucuaaaugugacacaucagucacagacauaggacaagcuauguuuguguauuccuauccuuaauaaaaaagacaacccauuuuuuuuucuuuugaaaaaagggcaaaggaugaaaagacacaccuccaaagaaagugcacaaugguucauaagcacaugaagacaugcugaacaggauuagccaucagggagaugcucaucacucauuacauauggggauggaguuuguggguguuugcuugcuugcuugcuuggucugguuuccuuuuuguuuuuucuauuuuaggcaaggucucaucaugucacccugguuugccuagaaaucgauacgguagacuaggaacacuugaacucauagacaucuguuccccccccccccaguguugggauuaaaggcauguuccacaaugugauggagauaauucauagugacauaugagagcccucauucacucugcuuaagaagacacuguagaugacagaauagugguuccccaagucuaaauaaagaguugcuauauuacccaauucuuucauucaaaagauguaccuauaaagagaaaaaaaacaaguccacauaaagauuuuauauuuagaagugaauguucauugcaguguucauauuccugguaauagacaaaacaauguaagcaauucaaauuucuaucaacuaaugagugaguaaaaaguguggaauaucccuacaguggaaucuuacucaucaauaaaauggaauacuaauagugcuauggauuaaacaagcccuggagauauguaagcaaagcaggcaagccuguagagauggaguauuuauuaucuauuuauuuugguaggacgaggggaaauggaaguggggaagauaguuuaagauagugguuuucaaccuuccuaaugcugcgacucuucuaacaguuccucauauaauguggugacucccaaccuuaaaacuacuucauuuauacuucauaacuauaauuuugcuacuguuauaaaucauaaugucaauaucuuauaugcaggaugucugauagaugaccccugugaaacaucaugacucacauguugaaaaacacugguuuaggagaaagaaguuucuuugugggugaaaagguguucuaagauugauugugaagacguguauaacugagugauacacagcacugaauuauguauucaguauguuuguacauaaagcuguuuuuaaaaagaaaauguuaccaaacauuuuaacccagaaauuaaugcaaaagaaagggccaccucaacaaacuaauguaugcugccuauuauagcauuuauuuccuuuuuaaaaauuguguguaugcacguuuauggaagacaaagcagcuuuaggaagcaucccuaggaaugucauccuccuuugagguccuucguuagccagggaaucacuaacuaggcuagacuugcuggccagggguuuagggggauccuucugucuccaccucugcagcacugagaguauucccacacuaccaugcugggucagacuucucaugcuuacaagguaagcaucuuaccaacugagauguguucccagcccuauuugagaccuguuccuaguccuauuuauaucuuuuguggaaucauuuucaguuccaggaaacgaaagguaguauucuaccauaaaucgcucuuaucgcaagaguucuguaacagauguuucuuuaaaucuuaaaauguaaagaauauggacuuuugccaagcaugguggcacaugccuguaauccuagcacucgggaguuagaggcaagauaauugugaguucaagaccagacaggacuacuuaggaaguuccaugucagccugguuacaaaccaagauucugucuuuaauaaaggaagaaagaaggaaaucuuuaaauuuaugacaaauuuaggugaggaaacccuuacagauuaaaacacagagccuaaguccagucuuggcuuagaaccuguaacuacagcacucaagaggguugggccaggagaauuguacacaaguuugaaaacagccuggaccauguuucaaaaccaaaauauaggaaaaauggcuuuucauugacuugcuggguuacacauggaagagucuuacuaacauuuuugaaaauuaauauuacauaaugaaguuaagugaaucaguuaauuguacaagcaugccucauuuuauugaacuuugcaaauacagugcuuuuuacacauuaaaauaauauaacaacucuaaauuaagcaagccagucuacaguguuuucaguagcucaaguaaucauuggcauccuuauuuuaauuaagguuuuaucuuuuuucagaaaugaggcuucugcacacuaauaggcuacuguaaaguauuaacauucugcuacuguuucuuuuguuuguuuguuuuguuuuuuugagacagagucucucuauauaguccuugauguccuggaacacacauguagaccaggcuggcuuuaaacucacagagacccccuugccccugccuccugagagcuaagguuaaagggguaugccaaguuauauaauaauguguuauguuuugucuaugacaauguugcacugcuuugaauggguuucuuuugacuugcacacagagccagccuguucaaucccuugccaucuuucuuuugaguuuucucuuugauuugcaacagcuuuucauauucugaaugagaccccuuugaaauacauauuauaaauucuauucuuguacuccagguugccuuaauucuuuguggaaucauugaacaugagguauuaauuuuaacuuagugcagguuuuuguuuauuugaugucuuguuaaagaaaucagcccaucccccaucucccaccagccccacccccacacacacuccugaugcauaugaaggccagaaaacagucuuguguggagcaggauugcauuguucuagagcucaccagguaggcuagugugcuuagcuagugagucccaggaaucucugucuuugcuucugaaugcugaucucaaguacuuggcucugugcccccaagcuuuuaauuauaguguugagaggggagcaguauacacauggacauugcuugucuggcauguggaaaccaggggaccuuaagugugagcuccugagaacuguaccuuuuuuugagacaagaucucucauuuacaggcuuagcaauucuccaggaucccuuuugccuguaccccucaacacucagaugauaaccacaugccaaaacucuuuuaguguguggauggcuauguauauguauuuuaaugcaagugcuuuccuuugcauggggcugucauuccucaggaaguucucaccuucuguuugagacagcaucucucauuaaccuggaucauuuccucuaagccaggcuaccuagucuaggagcuagggaucugccuaucucugccuuccaucucaccuucacugcaacuacaggcauuuuacuguacucuugugaguucuauauccucacauuugcacaguaagcaguuuaucacaugagcagucuucuuaacccaagaaaucuuuucuaacuugagucaaagauaauauucuauauucaugaggacuucugaaaucuuauucuuuacauuuaacagcucuguaacauacuuaagguuaaauuuuacauauaaaaauacaauguguuaaguucuuauguguguguguguacaaguuuaugugagacaucauuucugucucgaaguuuuuggcuuuauuaggaaguguuaaguguuauuuaaugaaacaauuugucuuucccucuauauuuuguuuuggcuucuuuguuugagacagugucguguagugaggauggcuuuuccugaugcaccuacaucucuguauccuaaguguuagggcacgcaugaaccaacaacuuuacuucuuuuucuucuggagcuucuauuaugcaauguuauucuccugugacaccacauacacacacacacacacacacacacacacacacacaccaucuccauuuucuucuuucuacuccaaauccccaacugaacuaauuuaaaagaccugugcacauucagaaauucugcuugacauacuuauuuucuagacucuaaauuuuaaaauuuucauucauugaagguuucaguuguaagauuucuguuaggggguuuuguuguuguucuguuuguuuuguuuuguuuaugaucucuauugaaauuuuuuauucgggucaugaagugcuuuucugauuucauuaaauuaucugucagguuuuuuguuuuuuuucuugacucguguccugcuucuguaagauuauucagaauccuugcuaggcaguuugcaaaugugcuuguauuugauaguaggagaugauuguguuccuugacaggugucaucuuuacuuuuacauguuucuguuauuguccauaaauugauauuugcauccaguacaauaaucuaucuuguuuuaugguuuucccccuuguguagagagagaaagauuuuucugugaguuuuucuacuaguuuuucuauuggguaugguguguaaacuuugauucuagguuaacccuguauaacuugugaaguuuucuuuaacuguaguucuuguaagagcaucuuacugaugucagugaucuaggcugcacacauacgucaguaugguagugcugcagcuuguccuccacuugaaaaggccaggcuuguuucuguuggcuuucacugugcaaaauauguagucccuagacauggucacugaguuugggagcaaggguuucaacuuuucugcuguacauagauccaugcaucaaauauagacauacugggaugacaauugucucucaagaauagagauacacauagcuacaagccguaaaggaaggguguauucuggcaauggauucaauuucaagauggcuucaagcuauaauggauuagaucaugguuguaaauauauaucaugggcuccuacucugguaauaaaguuacauaaacuccaagcaccuuucuaaauuauaaagagccuaugcgggccacaagaaucaucuguguaguuacuuuaucuacagggcaauauugauguucucuucauuucuucuuaagaaauccaucuuagcugucagacagucaugguggaggaaacaucucagggaggagacagcaugcuucacucuucucuguggaguuacuugggacuuugugcucuauagcaaucucagcacugcagucagauucugcaguauagucuguuucucucggaagaaggggaagggguagagcugacaacagugaacggcagacagcucuagucagucacucugcuggccucuuuauuuuuauuuuuuaaaacaaguacaugguaagaacucccucccucccucccucccucccucccucccucccucccuccggguauugugugugcgcacgugcacagugcgcaugucauagcucauauguguaagacagggaacaacuuguuagagucaguucucuucuucuaccuucuggguuccagggauugaacucaggucaucagguuuguugacaagugguuuuauuuuauuauggucccugcuucuuaauuuaaauuauaaguacaguauuucauuguguagauguccaacuggaaauuucagauauguuaaaagucugauguuuauuaagcauuucaauguaccaauauauucacuaggccuuuuuuuaaaaauuaagcucaagguuuuucauuaauaaugcauaacuuaguaauaggaauauuuuucuugaacuauacccacaauuuauuauccauaccuuccauuuugcguuucuuuaagugauaggagaaaguaagcccuuaacugaccauguuaagccaggccugguggcacgugucuauagucuccucaccaugaaagcagagguaggauaaucuugaguuuuaagccuacauggauuacauaagagcucuaggcuagccuguauucauagggagauucucuaggacaaaacuagcuuagaguaaaacucuggcucuuuauaaaagcaggcagcuuuaguguugcaguuucucacccuuuucccauuuuguagcacuugccuuuauugaauuuuaaaaauaauauuuagccuguucaucaucgaaacacuugguucuucauuccugauuuaguuauuuaaaugcuauuuaaauaagcuacaaauacacaaauuacuaacacauuuuacccuuggcaaacauagaccccauuguaugaucaagaguguguggauuuaguaguggaagacugugagucaaaguaccuuguguaaaaacuaguuauucaugcuacccaggagccaagaauauuaguuaaucaugugaguuaaauaaagguugaugaagagcuucuuguguucuauuauuuaaguaaccauuuaggggacaucuaauuguuuucagcauuugcuuccugcaaugauugaauaaacaaguuagaauucauuuuuuuaaaacauaaguuuuaaagccauauuuuacuaaagggacuuuuagcuauuuuaaugccuaauuuucaguguugaacucuaguagagugaaauaagaucuguauuuuuucuuucauuauuaauuaauucccuuuuauuuugauuugcauagaagaaugcuauguuuguaugagucauaaaauagcuucauaguauugugagcauugagucacagaauuccaggcaucucucagacacagaugacucacuuucugugucaucgugcuugcuguaaugcuuaugcguuacauuagagauguuugucuauuugacuaggucuaaucacauuuuaacauuagcaacauuuguuuguuuaauggguagcaccaaaaagccuaggcaacgaguucuuuuuaaaacacacuucuaaauuagucuucagcuuucaguaaauuuuuauauuucagugcuugccagacaaucucuguaagcuuuuuagcacuguuugguguaugauuucucucuauauucuauuuccuggggugaaaauuagaauaaaaggcgugaugcaguagauucuaacucuggucauagagaggaaaaacucuuagcucacuaacuuauuuaacauuaauagcacuaaacuaauuuccuguacaguauuuuuacauaguauugcuaagccuccccacucuaauccacacucucagcuguccuuagagugaguuagagagucccaaacuagaaaauuuuacaaucuugagcugaggagauagcucaguggguaaagugcuuguuagacaaucaugaggaacaaaguucgaugucugacccccaccuaagagcuggaugugguagugcgugaauaccagcacuaggaaggcagaaaguuaccuggggaugacuagacaacuagccuacccuaauggucagcaagcccugggucccaggaacugauccugucagaacaaagcagacaguucuugaugaaugguccugagguugacaucugaccuccacaugcacacauacacagccauguauccacauguacagcaucccucccccgaaaaaaaucaggaagacuggaguaauauccugaauagucuauaaaaguggguguuccaagaugguggcuuaguucuugagaucauucacaaucauagucacaaucugcucugauaguggccuacaucuacauguucaaaguuagcucaguuucaaaucugccuuucagccuauaggaaguaggaagauacuccagcuauaacguaguuuuuguuuuguuuucauuucauuuuguuuuuuaaggcaagaucuugcuuaguuuaguuuaggcugauccagaacuccacuauguagcccagaguggaguugauccucggccucagccuuagccucagccucggccucccccucccccucccccaugcugcugaugugcaugcacucacccagcuugacagaugccuuuuaaagggaaggcauuuucaaaggucuggcauuugauuucacuauucuacuauugguccacacuaaguauaaguacuucagguaaucuagggauauaaccucuuauuuaccauguggguaaauggcaaguuauagcuugcuuucuauagacaguaagaaaaacggauuaaaaaagaaaaagaaaaaaaaaaacaaaaacacuuaaucuacuacaaaagucuucaugaacaauacuaaguguaaauuucagaauaauuaucccuaaguaaauaauuuuuuuaaauucagccaugucaguaauagucaauuguagauuugugugguaucuuaaugugacauuacuuuauaccuugcuucaucaauuggugcacacuugauuaggagaaagaaaaucacaaagcuguauauuaacggagcucuccuuucuggggaaagauuuggaaaaagauguauuuuucuucuuuaaaacagacaugaaaguauucuggaugugaaaggaaaaacuaauaaauauuaagacuaaccuuaggauaauuuuaauucacaaagacuuucuucuaugcucccuaugagugcuccuauggaaacauuuugauuagugauuuaucugauuauuugacauuuguguuuaguguguuaagcugacaauucuaaacugcuuuaaaauuguacaaguguacugaugcaaaaaaguagcauauaaaagauuuuuacuccacuuaucagugauugcauaccaagugacuucuuuugugauuaaguuaccucacucaggaugauauccuccagauacaucuauuugcuuaagaauuucauaaauucauuguuuuuaauagcugaguaguauuccauuguguaaauguaccauauuuucuguauccauuccucuguugagggacaucuggguucuuuccagcuucuuucuauuauaaauaaggcugcugugaacauaguggagcauguguccuuauuaccaguuggaacaucuuccggguauaugcccaggagagguauugcuggcucuuccgguaguacuauguccagguuucugaggaaccaccagacagacuuucaaagugguuguaccagcuugcaaucccaccagcaauggaggaguguuccucuuucuccacauccucgccagcaucugcugucaucugaauuuuuugauccuagccauucugacuggugugagguggaaucucaggguuguuuugauuugcauuucccugaugauuaaggauguugaacguuuuuuuaagugcuucucagccuuucgguauuccucaguugagaauucuuuguuuagcucuguaccccauuuuuuaauuuuuuuuuuuuuuaauuucuggaguuuagcuucuugagcucuuuguauauauuggauauuaguccccuaucagauuuaggacagaaaccuaaaauacccaagauacaauuugcaaaacacaagaaaaucaagaaagaagaccaaugugugaauacuucauuucucccuagaguagggaauaaaauacccauggaaggaguuacagagacaaaguuuggagcuaagacgaaaggauggaccauccagagucugccccacucggggguccaucccauaaucagccaccaaacacagacacuagugcauaugccaguaagauuuugcuuaaaggacccugauauagcugucucaugugaggcuaugccauaccuggcaaauacagaaguggaugcucacagucaucuguuggauggaacacagggcccccaauggaggaggccagagaaaguacccaaggagcugaagggaucugcaacccuauagguagaacaacaguaugaacuaaccaguacccccagagcucgugucucuagcugcauauauagcagaauauggccuagucagccaucauugggaagagaggccccuuggucuuacaaacuuuauaugucucaguacaggggaacgccagggccaagaagugggaguggguggguuggggagcagggcggggggaagguauaggggacuugugggauagcauuugaaauguaaaugaagaaaauaucuaauuaaaaaaaauuaaaaacaaaaaaaaagaucuuuacuugagcugggcgugguggcgcacaccuuuaaucccaguacucaggaggcagaggaaggcaaauuucugaguucgaggccagccuggucuacaaagugaguuccaggacagccagggcuauacagagaagccccggucucgaaaaaacaacaaaacaaaacaaucuuuacucaagcuuuagucccagcacuuggaaaacagguagguagauauaucuggucuacacagugagacccugucuugaaaacugugugcgugcacgaguacauguguggguuugagcauuugcagcugugugugccccauugcaguauaugagucaguaaagucuuaaacucuuuccugucuauauuucaauuuuuaucuaucuagcuaucuaccuaccuaccuaucuaucuauuuauuuauuaguuuuucgagacaggguuucucuguguaguccuggcuguccuggaacucacucuguagaccaggcuggccuccaacucagaaauucuccugccucggacucccaagugcuaggauuauaggcgugcgccaccacugccgggcuuuauuuauucuuuauggauuuuauacagguugaaaauuccuuauuaaaauucuuaggaccaaaaguguagaagauuucagauuuuuuaaaauauuuggggaauauucauucauccaucuaacauuguucugaggaugagauucaagaaucaaaacauacgauuuaccaucuccuaugccucauacccaucagcugaggauaacuguacauaauaucuuuaagaauuuuacaugugaacaaaauuucuucaaaguuaguuuuuuauuuaugguuacacaucacuucucgaaaccuuuugggauuuguuucauuucagauauuuuaaaaauaggacugggugguuuggcucaagccaugguuuuauagccaaguaaauuuguaaaggcuuuuacuugucuuagcuguaaaacacccaagauuuuguuggcgagacuugcagaguagaguuguggaaauauuaauuuguuaguuaauaauguuggauuucauucauacuacauuauuuuuuauuaaagugcaguuuccucuuuucacaggacaaugagaagagaaccccuuugcaugcugcugccuaucuuggugacgcagaaaucauugagcugcuuauuuuaucugguauggcaacuccugagcugaguucaugguguucaguuugauguaugaguguuccuauggaaugcauagccuaugucuuaguauugguuucauaaguuaaccaauuauaauagcaaacuuugaucauagaaccuguuuugggugcuuaaaguacuuuaagaaauagaacaaagauuucuguccuuacagacuuauuaguuccauaaauacaagucauuuuauaguuuguuuaaaagauaauaauugcuacuguggaaaaaugaaaaacauagauugggaagaauaggaaagagacauaugucaggaaaggcuuucuguauuguacuuaaugggccucauugaauacagaguuuugaggagacaguuaacaucucuacaaaggugacuuguccaaaggaagagggcaauaguggcccagcaacuagaugguaaaaaauaaguccuauuguguacagaaauuuaaguuguugccaacagacauucuuucuuuaaaugucuuuuuuuuuuaagagccgaggaugugaauccgcugguaaaaugcuuacugugcaagcaugcaacuuagguucagauccccagcaccuucaucagaauccaguugcagcaguacaaaccuguaauccuaggaccagggcagcagagauagguggauaucuggaguuugccagcuagccagucugccuagcaaaagcagugaguuccuagguucagugagagacuuugucucaaaaaauagguagaaaaugacuaagacagccaauguuggcuucuggcucccacauacacauccauaccauaggcacccauaucggaacacacauaugccaaaaagaaaauagcuuuuauuucaauuuuuuaaggucuuuaagaugcuuuuuuugcgcacgucuuugaucccagcacucaggaggcagaggcagguggauuucugaguucaaugccagccuggucuacaaagugaguuccaggacagccagggcuacacagagaaacccugucuccaaaacaaaacaaaacaaauuaugcuuuauggacugaguauguaagucaguuggucuaacauauaggaagccuuggguuuaauacccagcucuccagcacugcauaaacuggaugaggugguacacagguugcuauaaucccagcucuugagagagagcagcaggagaaucaggaguucaagguaauucucugcucuaguauguaguaugcagugauggacaacaacaguaacccuguuaaaaacauggugagagaaagguacagccugagguugucuucugacucccacacacaucauagaagaugcagauguuacucuaacacauggcuacauacacacaucauauaggcauauacacaacauacacaaaaagagaaaauaagaaaauggcuguguaagaaacaguacaguuuuguuuauuuuaaugucuaggacuuuugauaacuacugcuauggauuuuuuuuaaagaaucauauuuuuuuuauuuuaauauacaugcuauuuuauauaaucuuauaugaagggguucauuucccccauuuaauuaaauuuuuuaugccuagaaaaaacuucagaugcuagagcugagucagacucucuuuuucuuuaaaugugaauacuuccauugacuuuagcuaccaaguaaaagcuauguaauaacuacagugcaagugaguuccuucagaccaaauguacuuuguuuuuauaacaacacaaucuccuuauugaaucuacuguuggaacuuccucagguccauaggcuuuuuuucagugaucuguuggugguucgcuguuaacccucuaucaccagugucaaaacuaaccagguugccugcuugaucucuucguuagcaguguucuuuugugcaaagaugacccagucagcucuggcucaucugagagauuguuugggauuuuagaauacauacagccaagagaaagggacacauuaacacuaggacaaaacuguucuuucggagaacgcaggcaccuucccuguaucugcagaagcuucccuuaagucaguguccaugcucauuggguacacauuuccuauaauagguagacauuuuuauauuuggguuuauaguaguguguuaguuacuauuuuauuucugugauaaaaccuguuaucuuagagaaggaaggaucuauuggcgggugggggcgggggggacggggacuuaugguuccuguagggucaauaauuauggaaacagcaugagagcaggagucagacuggaggcuggaauaugacugcucacaucuaaaaccacaaacaggaaguaaagacagagcacuggaaaccgcacaugguucucccaccccacgcacuuggcuuuuaaaaccucaaagccagcccuuauugacacaccucuuccagcaaggacauaccuccuaagccugucucaaacaacuagggaaccaaguacuucaguguugaagacuuaccggggucaucucauuugaacgaccacauucuacuuguuggcccacauaagcuccugaucaucucauaaugcaaauaaaugcauuuaguguaacuucaaagcccuucauaguguuucgcagacuguggacacagacuguagacuuuuacagacacugacacugcuuuaaaguaguaagucucuucugagauucaagacagucucucagcuguaacccccuauaaaauccaaaaacaaauuauauacuuacaugauaaaugacauaagauaaacacauuccuaaugggagggauagaggaauaguggggaaacauuagaccaaagcaaaaccagaacccagcagggcaaacuccagauucuguagcuuucugucugcugucaaagugcuuagauggaacugcuguucccagcuuuuccaccuaaaggguuacaccagcagcagcagcagcagcaccaccggcagcagcugcagcuaccgcuaccugguucuacuaucagaguauggaaaucuuuacaacauggggucuccaacacaaccgagauuucacuuuccacagcuucaggcagugagcucuucaaaccuccauacagagaccccguugccacauaacuaggcucagugacucuuacgcuggagaggaagcuugucuucuauacaucuuucaugacucuaaagccagcaccauguggaugucacugccaccuagagcugcaagcaugggaugaaaucugcccucuguaaccacauuaccagcagcuacuguuuuuguugcuuucucaaaaguugaaagcuuaguugguggggucuuguccuaagggcgcccuucccuuuauuccacuacacauuuggccucucaguaaugguaugaaucuuaacaguuacagccucucuugcugcagaagccauguugccaguaucccuuuucucucuagaacugugcacuuuuuauuucuuccuccugcauuguagaccuacaaaucacugcauuguaucacuacauauuugacccaguacucaagugcccaagguuuguagggaacgucucauucaaaccaucacagcuaguaguaguaguaacugucuccucauucaaggugauguaucuucauauuauuuuaucuuugaugacuuguuaagauuaaauguuucauaauuuauaguuaaauucauuggaccauaaauauuucuguaugaugcagccccaagauuuguaaguagguaguaguauuuuugaccugguauauacaaccaagcuuucuuagaaucuguaguuaugcugagauccacuggaauuaauaauuguuuuagaaggaguaaaauaauaaguacuuauuguaucucuuuaauaucauacuaaaauuagcuuuuucuuuuauccuauucugcccucagcucuaugaaaguacuaaaaacaagaaagcuaggcagugcuuaccagcagcauuauuuacgacugaaguuuguacugucauagcugaaaagcuagagccuugagccagacucauuaacucuaucaucaucugaaccucucuccuucuuuguaucuacccuucuucauuaucacuauuaccucacauugaguaacauuugcauacacauuuuuuauucuagaauguuucuccuaaagacuaaauuuuaucaucaauuaagaauagauaucuuguuuggaagcuauuaauuuaaugcuuccauucaaaucauauguuagcagacugcugaauguuaccuuuucagcacacggaaggcauuauucaaaaguucauuucauuggccucuuauagaaaauaauucuuaauacagaauagggauuugauauuucuuccuuuggaauuagaucuaaaaugugcacaucucaaaagcuuguaacauaaguguauuagccagggcugucauuagagaaagauugggagcgauggagggggaaccaucaagagguagcuuaaacagcaguaguuuguuuucucacaguucugcucagaagcuucaggugaaggcgugggcaggauuacuuccuucuuaaaagaagaggcucuagugugucuuucccuugacuuguaaauguuguagacagaggccuucucccucugcuuucacuccaucugugucacugucuacauuucucauuccuuuacaaauaucuuuauuaguucuuugagaacuguguauugagggcaggagaaauggcccaauggguaaaauagucauuaaugccaucuuccuuaaacugcucucuucuuugccuucagauugcuugcagugauuucuccugccaaaaugucuaccaauaaccuagcaggaaccguggagauagucuugcuagcauauaggaucuguuugagugaccgggaaguagugaagagauuaaucuuuucucagugacuuagcaucuuuguagcucauagauuuuaucuguugucauguguugaacauguggugcuacugagaggcuguuagaaguuuguuucucucucuacaaagacaguuuauuuauguuuuaaggagauagaauguucuucuuccuccaccccuuucuauuuuccuuucuuucuccccaucugucuugauaaccucucuggcuaguauuuuauacauacucuugaccagcuauugagccucuuaccucuacucuggcugugucuugcauuauuagaaugguuuuguugucuaauguauauaucaauguauggcuaauuuuaggagaguucuuuauagaacagaaaccagaaauauauuaucuucagagaguuuaccaaaagagguucuaggaaucucaaacaauaaaaauaugcugcuguauuuguggcucuuauaucauuguuguuguucauuuccuuagauaggaacacagccaaccuguguugagaauguccaucguugcucugucaugcuuguuagucuacaaaucacauacaacuuaaugcauguggauaagagagacuggugccugcagauuuuuuucauaaauuggccuuuacauuuaugagacauuaaaacaucugauuagugcuuuuaaaagaagcauaggauauaacaagagauagcugucuucuaaaaaaagagauaaugaucagaagauuaaaaauuaaaacccuaucauugaacaagcccuuuauuuuuaguauuguuuguuaccaguagcagugugauacccucaguuaacuuguaauggauucuuuauuguagucacuuuuguuuguuugguuuugguuuugguuuugguuuugguuuugguuuuuuuuuugguuuuucgagacaggguuucucuguguagccuggaacucacucuguagaccaggcuagccuccaacuuagaaaucugccugccucugccucccaagugcugggauuaaaggcgugcgccaccacugccuggcuagucacuugcuucaauaaauuaauguggcauauuaaacaugaaaaauaaaaaagacuaucagaacaagacagaaugaaucaggaguuuucuuuugaauuuccaucuccuuaguguaccauuaaauuagauuguuuucagguaguuauauaucugauaacccauaucaguaguuuuaaguauuuccaaaagaaauacuuaaaaacuacccaauuccugguucauuuuuuauuguuuguacuuggaaccaaauucuuggaauuuuuucaugaccaucuuuuaauucuuuucuuuaguauguuuuauuuuuugagcaguauuaucauauauagaaaauuauagaaacuacaguaauagagaauaacaaugaaguagcucucccuccccacuccuccccacacaccagccuucuguaugccugcccaguauuaaguguacccgaaaccaaccagccacucaacccuacucuuuuaauaucuugucaucccucuauggguucaguguucaugcuaaucaaaugugaacauagacuuaccucuuccuauuucuaacuaaagguaaacauuucuuauaguuauugcuuuuuauuuuuaucuuuuuuacauuuuauuucucgaagccauaucagcacauggagagccacccuguuuuuugugacagucacaguucuguucucuugucauaacuucagagcuggcuucuugaagguauuuaugagaccucaguuuuugccuuuuuuggccuagguacuaucccuuucaauugucugugucuguaccuuaggccuguauuucuccuauguauagaccuauaugugggcaugaguacuuauguagaaaaagcuguaggaauucuagaguaccauggaauuccucagcagacaaaugagagaaugaaagaucccauuguccuucacuaacucaacaacuugagccuuuaaaaaaaaguaaacaucucaaauguuucaaccuagacuaaaaaacacugacuucacuauggccagguugucugccuucauauucuuggccugcaggggccugaauauuuacagcuaguugccuaaauauuuacuaugcaaauaugcuguugucugaggugugccuaacuguuaagcauguauguggcauggacaggguccugaucagguuagaucccuagcacugcagagaauuuuuuaacuauaacuacucucuuugaccaguucuuuauuuuauuuuauuauuuuacuuuuuggcuucacuucuuucugucucagcucccccccugaccacuccccccggcugucccccaagacagaguuucucuguauagcccuggcaguccuggagcucacucuggagaccaggcuggccucgaacucagaacucugccugccucugccgcucaagugcugggauuaaaggugugugccaccauugccuggcucucccauuggcucucgguucuguugucuuugucacuguugauguuuacagagaauucaacuacucaaacuuuuaauugcuacauuuguugauguucuauagucuuuuguguucagcacuucuaaaucuaccaucaacaugugugcuauauguacuagguuauuaacauaaucacaacacuguuuagaagguuucuccuauagcuguaaguaauagagcuauaacauaaagucacugcacuugacugccuguccccugaacccucacacuuaaaaacacacgaacaguauuuaagcauuaggaaguaugaauuuuagucauacuugacucugguuugugcacauaaguauaaaacuacagaaauuuauuaaggauuauucagcauacuuuuucuguuaucaucuaggaaaugaggaauugggguuuggugcauaaaucuagagugauguuuaggccaggacuugauggcccguugacuagccagagcuguuucuuuucugcucgcagcacacuccuacuaugagccucucuucuacuggauucaucuuuuuuaaccuuauauguaauauuuuuaucuuauuggaucuauuuauauuuuguugguacuuuuguacguugacuuaauuuuuaaauuauauauauuugauuuuuaaaagauccuucuuuaaacuuuagguauaaugaagaaagacuugucaauugguuuauuuuccuacaucuguaaacacugaauucauuuuuguaugauaaccuuuaguaucaguguguuuuccuuauaccuguacaguuaucuuuauauugccuuaugccauuaugcauuuauuaguaaagaaaugcaaugaaaauuuuauguuaauauacaauucaucuuggaauaauauuguuuauuucucuuaaguauuugagauuaacacuuuaaaaugggauuugacuuuaccuugaguaugcucuguauaaaggugguuuuucuagccuaacuauaaaaagcuguuuuuuuuuuuuaauacaaagaacugauuccuuuuggauaauuauaucaacuuaaaagaauaauuuuguuuuauaacuugaaugaaggguaauauauuggaagaaaguacauaaguaauuguuauccccuuggggcuacauaauuuagguuuauuaaagaauacuuaauguaagauauuucaauuaucuuuuuucuucuuguugcaggagcuagaguuaaugccaaagacagcaaaugguugacaccuuuacacagagcaguugcaucguguagugagguaugacauuucucuuagugaacagauggauguaaagaagcacuaaguaggucugcaugugucacacuuaaaagugcauuuuuuaacagaagaaaaaaccuauuacaguuccuagaccagucauuuuccuucagauuuuguacaaacuaagcuaauugucgcauuucuccuuuuaugugucagauucuuaagagaguagacaaccuuauuucugccccuccuucacaagaaaguauuuucuaacacuaauccucuuugggccuuuucaguucauaaugccuuaucccagggcucuguguagcgcaaugacaucaguauuuagaaugauuaauuucaacauugaaguugaaucuuaggaauauuacuuuuaagugcauuuuuaugaaugguauauguauguccucaugcauguuuacauguguuuggacacacaaauauaugugagugugcuugcauuuguaugcacauggaauguagaggcccaaaguugacaucagauguuuuucuuguucacgauccacuguauucacugaagcagggucuuuugcugaacuuccccgacucaggcugggcuagcugcaaggguucugaggauccaagccuggguccacacacuuguacuuuaucagauacugcgccauaucuccagcccuugaugcccacugcagcagacucgaacauauuaccuuaaagaaugugagauuucucacauggaaaaaaagacuuuuccugguaauaguccaauaaguugugugugcauuaagauaacuggcauuuguccugguuggguuuggguugguugauugguuuguucaauuuagcauaagcuaguuuuuuaagaagaguguuuuguuuuguuuuguuuuguuuuguuuuguuuuguuuuguuuuguuuuuuggagacaugcucuuacucuguaauguaggcuaacaucaaacuccugaucuuccuuccucaucucauccuaccaagugucaggaugaugguauauaccaccauagccagcuuggucuguuuuguuuguuuguuuguuuuuguuaguuuuuuuguuuuuaauguguauggguguuuugccugcauguaugucuguguaccacauacaugcugaguguccauggaugccaaaaaggaguuccagguuuucuagaguuauggauguuuguaagcugcugugggucuugugaauugaucccaaggccuuugcaagagcagccagcacucucaccuucucagccacuccccagccccagaagagagaaucuucauugagaaaaugacacuauuaagauucugaccuguagacaaguuugugggguguugucuugauuauugauugauguggaagggcccagcuuacaguggguggugcaucccuuggcaggcaguccuggauuauauaagaaagcacacuaagcaguugggaagagcaagcuaauaaccagcacuucugcauggcauuuguuucaauucuugccuucaguuucugcccugacuucuuucaugauaagcuauaaaaugaaauaaauccuuuccucacuauguugcuuuuggucaugguguuuuaucacagcaguagaaacccuaacaaagacagcguucuugaauaggucuguuuauuuucucuaacuguaauggaauuguggggucaugggucugugugucuuugguuuacucccugucuucccagauguuaguagauuccugaacauaucuucagucuguuugccaacccuauuaaauacuaguguuguuuccuauauuucaaacaguucuaaauuguucuuuauuucaaagacuaaaaaucaugcuuaugccauaauccauagucuuucauuuaguaaucuuugaaaccuuguaacuuaacagcuauucacacuguaaucucugugcauucguuaucguacagcaaucuuuuuuuuuugagacaggguuucucuguauagcccuggcuguccuggaacucacuuuguagaccaggcuggccucgaacucagaaaucugccugccucugccucccgagugcugggauuaaaggcgugugccaccaugcccggcucguacagcaaucuugaaaagacugguggucaguuaguauccucuuucucuuaaagaagagcaccaaggggcaguuuugcaagauuugaacuguauguccuauaagugauagggguugaguucuuuauauaugcccaggaguaaaagcugagucauauaguaguacuauuuucuaauuuuuuaaggacucuacaaaauaauuuccauaauggaaguauuaauuuucauccccacuaguugugaauguguuccucuuucuucacauucucucuaacaucuguugacugugacgagcagagccagugagcugugagcuugauuggcaucugcugggagguccuucggcuguguuagaucuggagggugccacuguuggaaguuccagaagguccuuaagagcaucagccagcuacuagcucagacaugcaggccuguaugaacucagcaacuguguagguaguuuguucuaagagagccaaaguuacacaguagccaggcucaaaaugucuuugcagauggggaucaccacaguggcuugaaaugcccugagcaguaagaucuggggguuaccuccaaaguuccaguuucuguaugguucuauuggacauuagcuuuguacuaucagggcucacagcuuaggguugguucauuaacauaucagagagccuuauagcugccuacuuaauaccucuugcaaacauuacauuuuucaauguuacacagaaugguuuuacagaaaaugguuuucguuaauguccuaucgugucagauuucuuuucuuuuuucuuuucuucuguuugaauuauuuacuuugauuuaaugugucuugaguguuuugccugcagagccagacuagagagagagagagcccuuaguccccugaaacuggaguuacagaugauuguaaccuuccauguaggugcucagaacuaaacccaggucucuucugauucaacucuccucagcccuguuagauuucuugauguuagggcauucugaauuggguaagaguaguuuucauuuguauuucccugauggcuagaaauauugaacacuuuuuaaaaucagauacugaccauuuguguuucucuuuauuuuuuuaaagauugauuuauucauguauuuuauguagaugagugcuauaucuucaugcacaccugaagaggcaguaugauuccaugauagaugccaaugagccacccugugguugcugggauuuaacuucaggaccucuggaagagcagucaaguacuuuuaacuacugagcuauuucuccagcccuuuuugaaaacuguucaauguccguuuguugauuggcaguuuuguuuccuugguaucuaauaucuucaguucuuuguaaauucuggauauuagccccuuguguaaagaauaucugaaaagauuuccaccuauucuguggguuguuuccccugcugauaguuaaguuuucauagaaucucauccgcugauacaugaggcugguuccugcgcugcugagguucuguuucagaaaggucucucugagccuaguaucuugacgaguaucaccuguuuuauuucagugcuucagguuuuaaauuaaggaauaucagccauuuugaacuuauuuuuuuacaaggugaaaaauauaaucugaguucauucugcugcagauagauauccaauuaugagagcaccauuuguugaauagacuaucuuuuuucaaguaugugcuguuuguuuccauugucaaaauuaaguaggcauagcuuuguuguuucauuucugggucuuccuuuuuauugaucuucgugguuuuagccagugcacuguagcuaucuaucacuguaguucaauuugggucagcuauugucauacucccagcgaguucuuaacuccucaggauugcuugacuaguugggcucuuuggugguacuauaugauucuguuucuuuaauaugaucaguaugauaauauauuacauauaaugauuuuuuauguaaccugugaaacauggcaucagguuguugauagguaauuguaguguaucuguacauuguuugaugauacagccauucccacaguauucugccaguccaggaguauggaaggucucuccauuauccauaccuucucuagguuucuuuuucagugucuugaauuuuuuauuguuuagaggacuuugaauucuuugauuagguauauuccuaaauacuuaauuuuuaaauuuuauuuugaauggaacacuuuuauaauuaauuuuucugagaguacauaguuggaguguaugaagacuacuggaguauuuuuguagguugguuuuuguauucugcaauuuuucuguguuuauuagaucucaggaguuuucuaguaaaaccauagguauuuuaagucaaggaucauugcaucuauaauuaaaaauagcuuaacuucuuauuuuuauccaucuccuuugugucuuuugcuguagcuaaaacuguaucaaauaagagaggggagaauaggaauucuuaugucuuguuccugauuuuagaggaaaugaucuccguuugucucuauuuaauauaauguauuuuauaguuuuauuguauauguucuauuauuuugauguauauuccaucuacuccuaauaaucccaaaacuugauuaugaaaguuugauguauuuugucaaaugccuuuuuaguaucaaucaaaaugauuaugugauaucuauccuuuaguucauuuauaugcuauauuauauuuauuaauuuauauaugugaaccaguguugucuuucugcaaugaaacacauuuggucauaacauauaaucuucuuaauguguuccugaauuccauuugcaaguauuuugcugggaauuuuugcaucuguucauuaaagaaacuggucaguagcuuucuucuuguugugguucuugugucuuuaccuguuuugggaagcagaguaauacugaacuuacagaaugaauuugguagugcuccuucaucuucugacuuguggaacaagucuagaacaguugauauaagaucuuucuugaaagcuugguaaaagccaacaguuaauccaccugguccuuggcuuuucuuuugacuguggcuuccaagaucuuauaacuuagaauggauugguuuacauuauugaaauuuucuaaguuuaauuuuuuaggugauaauacauuuagaaauguuccuauuucuucuggguuaucucgcuucuuggaauauacuuuuccauaauaguuccuaguaauguccuguaguuuucuacuguaaugacacgcuuugcguuuugaauuuugcuagucuguaucuucucccuuuuucuuuuuguuagauuggcuaaggauuugucugucuuuuucaaagaaccaauucuuugguugauuuuggguuuuguuauuuaauauuuauuucacucauguauucccuaaucuguauuauuucuuaccauccacggagauauuuguugcugcuuuauuuacuauagcaaggaaaugaaaccaaucuaguuuacucaucaguagaugaaugguugauugaaaucaaaguuugcaagaaaauugauggacuuaagccgggcgugguggcgcacaccuuuaaucccagcacuugggaggcagaggcaggcagauuucugaguucgaggccagccugguccuacaaaaugaguuccaggacagccagggcuacacagagaaagccugucucaaaaaaaaaaaaaaaauugauggacuuagaauauauaauauuaauugaggucagauaguuucaaaaagaaaaaacuacauguuuuuuuucucaugaacucuucuggucuguaauuuauauauuuuauauauauucauacauagugcauaugagcagauaaauguaucuguguacgugucuaaaggagaacaagaaaagguaacuauuaggugaugaggauggaugcagugcagauagagguuacaaguuauaaacagaaauaaagcucauuguuucucuaguuuuaacucugauggauuuggagaggguggcagauaaauccauaaaaauauugaaggugagauucagugcuaaguuccacagcuucaggacgguuuucuaacuauagagcuuccuugugguuuauagacuuugggucuggugauuucuuugugugauguuauuuguuugcaaguucuccacaaaaaaguuccaauuaaagucuuaguauugacauucuguucuaguucuguugcuuuuuacuuuuauaugugguuucguacuuaccaaacaugauuaucacugugaggagaaaguuuugcuguuuaauuaugauuaaugcuuaaugcugauggcacgcuagauuuguaggaguccuaacagacaccuacacuauaaaagugggagugugugguuguuuucauggacuucuaggagaaggauuuuuugaaacaguaauucuuaaguugccucaguguuaacauucacauuaaguagcguuacaaugaaagaccuuuuuaugcuaauuuaauuaaccagaccuagugauucuuuuccacgugguaaaaugugacacauaacuuugagagaugagaaaugucuuuuuaaauuuuugcauauuuaauaucaaaauaaucuuacuaaagcucuuuaauguauauguuaauuauauuuugcuaauaagaaguguaagcuugugcuuuuaguaagaaaagaauuuuuaucaagauaaugucuuuuuauggcucuaaguacuaucuuuaaauucaaaauauuuucuuaaauuuucaauauuuuuagcacgcuuucauaacuuuuauuuucuccauauguguacaucuuuauaaauuucucaaaguauucaauccucuccuuuauauauuaggaagcaguucagauacuuuugaagcauucugcagauguuaaugcucgagauaaaaauuggcagaccccuuuacacauagcugcugcuaauaaagcuguaaagugcgcugaaucuuugguaccucuucugagcaaugugaacguguccgaccgagcaggaagaacugcauuacaucaugcagcuuucagugggcauggugagguaggugcauccaaauagaggcugauugucuucuagccucuaguuacuaaugacuuugccuuccuuuaauucguucaguucauagaaaaaaaauccuccucauaauugccccuagcaagccuccuagcuuuucuccagugauguaagugguccaaauuaaaagauuuauuuaguacuuacuacacacacacuagaguuucauaaugacugucagcuaacuacagauaacauaagagauaucuucugucauugucaaggaagugcagggagacagcaguuucauuguucuuucagaaugaaggauaauaacaaagaaaggcaauguuugguaacuaugcuuucuucuaguuuauuauugagauaauaccuuagugauggaacuaucuaaacaugaagaucagccaucacgaugcugggagaugacucaguccaccaaguaccuucugcgcaagcacaaggacccgaguuaguucagagcuccagcacccacagaggaagcaagcuagggggccugcugugcacuugauuuuguuuguuuguuuguuuguuuucauuguaaggagauuuuuuuaauauauauuauuuuuauuagauauuuucuuucuuuauguuucaaacguuauccacuuuccugguuuccccucugggacaccccuguccccucccccuuccucugguguguacuugucauccagcacagugggugcagagacagccagagcucuccagguuguugauuagccugccuaaccaaaguggugaacuccaggugagagacccugucucaaaauaagguggaaagcaacugauaccgagcuguggccuccacacccaacucugcacacacacaaaacaucaaacauuggcaagccugguugaaccagaguuagaagaaccuuugucccgccucccgcccaccgccugccugccuucuuuuauuucuuuuugugcuguuguuccugcucuucacuugccuuccuuaauuuaagaugaaauauugccauguuccaaacucuuaaacgccaaacuguccuccugccucagccuauccuaagcaguuggaacaacaguguacccagauccuaguccuucauuuugaagccacagaaucacaguuucacauggccuucucaggauugugcagcuggaagcucugaauccuugcaucaacugcagcguagaucacaaaauagaaaaacaauuaugaauaugauaguguuaguauuggcucauuaugagauaaguagacuuuguaauaauagguuuuaaagguaguggaucuaccauagaugauuaaauuaaauuucagauauuacugguaugagaggguuauauucuaauauagauauaaauaauuuagguguaaauaacaauacaacuuaagguauucaaacuucaggcuuucaagauuuguacugacuuagauguucuuaaaauacugagaagcuaguugcaaagcaccuuaaaagagacugcagccugauuucauaacacagugaauccuucccacguuaccauacuauauuaaugugcuucaacuaacgcaauucagugugagaaaaaucaaacuaaauaaucacaaggcauauuuaugaauaauucuacuucugaaucucaguaaaacuauuuacuuuuauuccagauggucaaacuacucuuguccagaggugccaauauaaaugcuuuugacaagaaagauaggcgugcaauccauugggcagcauauauggguauguaccuuuuaaauuugcuuuugacuguguauuuaggggaauuaaugcauuuugguuuuugcauuucuguauuuuuauauaacugaguuaugcaguaucugagauugcugcccaagcagaccagguagaggagacgugcugcagcagugcacuagaucuaguuuauagaaauuuagaagaggcaucgcagaugguggccuggaaugguuaacuugcagugaguguuuacugaaagcucauucacauauccauuccucuuuuacuggaugauuaaaguaugaguugugaagaugcauugagaaguugcauuuuacuaaacuggagguaaagcugaagcguugcuguguuugcuuuguaugcacaaggccuugaguucaaucucugucucugaaaaaacuaaacccuauuauuauaagcaguguguguguuuucacagaugcacaguaucauuccucaggaauucuucaccuuauuuucugagucauggccucugacuaggaccuaggauuguauuagacagacuagcuaacgaguccaagagaccuacuuguucccagcuccccagcacuggcauuagaagugcgcacuuccaccccuaaggauaccauuuuagucacauauccuauuuugauggccaaaauccgaaaaugugauguuuagugccaaaaauaagugccucuucuuauauaaggaaaaucuuucuuguuaauugaagguaaaaugccaggagggguuucauccugaagucuuucacucugugugcaaucuuacauccuuacgucucugaagacuuuccugaguaaucuguuguaggcuaaugaucggggcaguuuagaaacaguguauaugauuuuaaacaacacauucuguguuuaaaagguauaugcacaguaaguggaguauaguuggccuuucacuuggaaggaauuagguuugacauaacagacuuucaugaaaugaaagccagaauaauauuguuugaaguugagcuucugaaauaguuaaguaugugguccucagucugggccuuagcauggauugcuuguccucgguauagaugauuaugauuaaaaggguauucuaugcuuugaagauagcaguacaugcuugaucuaccuuguguugcuauaacagaauacccaaacuuagguaauuuauucugagcagaauuucauuucuuucaaauuuuggagcuuuggcaguccaagugaggguucugucaucuggucaguaccucccuucuugcugugucaugccaugaccugacagagcacaucaucacaagguaaaagggaaagaaggagauguuaaaugaccuugagauagaggaacaagaucuagucaagguuaacacuagaaguaaauuguauuguuuuuaguuauucucucuaccaauauuuuucaaaaauaaucugaauucgucuugaauucauuaugcauuagaaaauuaaugugcuauuuuauauuuaauaauuucuaugugcuaaugguuuuuugcuuguuucuuugguuuuuuuuuguuguuguuuguuuuauguauuuuuaggucacauugaaguaguaaaauuacuuguaucucauggagcugaagugacauguaaggauaagaagucuuacacaccucuucaugcagcagccucuaguggaaugaucaguguagucaaauaucuucuagaucuuggaguugauguagguauauagcuugagcaguauaaauucauguauucuguguuuuguuauucuguuaucagaacuuagguuugaaagauaacaguaauaucuuuguccucuuaccaagucuuucuaacucuucacuagcuaguauacugcuaugaucaguacauguaucuagugaggauugccauccugugaugaaacaccaugaccaacagcaaccuggggagaagggaguucauucagcuuaugcuuccaugucacuuccaucaccaaaggaagucagaacaggauccuggaggcaggaacugguccagaagccauggaggaguacugcuuacuggcuugcucauacauagcuugcucaucucacuuucucuuaaacccuggaugaccaucccagggaugacaucacucacaaugggcugggcccugucaucaaucaucaauuaaaaaaaaugaacuauagauuuguauauagcccaguuuuauggaggcaguuucucaauugagguuccuuccucuaagaugacucuugauugugucaaggugacauaaaauuagccaguauaauuagacaaacuauguaaagaguuaaaaccuauuccaaagaugagugauuuacccaaaguuucuuuuuuuaguuccuguagcucuguuucuuccaguucucugggugcuagcagaucagauacauguugacuagguagcuguguuauugucaguuuucugagccaguaagucuaacuuuacuuuaagugacuauagaauaaugggauacuggcaaaugcaagagaggaagacaacaaaagauguauuuauuauacguauauauaaauaaaaauguguguguguacuauaaacacuauauaagcacuguauaguacuaccauucuuuuuggcuaggaagggauacuaaucucuugguauauauuugaugccuaaauaaaaauccaucuagcuuuuauguaucauuuuaaaaacauguccuuuacucccacuuguaauagauuuacucuuuugguuugggggacagucucauuguauagcccaaguuggccucaaauuuggaauccuucugucucaauuugcaagugcuugcauaauaggugugugccacucucccugcucuaauguuauuuacucuuauuguaggaacaugugaguuaagcuuaccaauuuuucaaagcaguagauaaggagaaaggagagaacaaagagaggaagacuauaaggucuuaauugcaaaagcugucaaaaagcuugugauucuaguuagacaagacaugacaggacuaugagaaacacuuuacugaaaacaaggaauacauggaaaaugugggaauuagaagaaguugcaaaacacccaaacauauuguugaaugggaccccgagaaguacaagauggcuucaaguuucaguuugcuaacaguucuuguagcucucuuucaaccaauuagcauaauggcuuuaguggcccucugaaauagaugaccgagguaugcuugccuccaaucaccauuuauagugaauucucucuuagcucaaagacuuuugaaaauccauuauuuuucuuuucuuaaaauaacucuuguggaagaauuuaacauuguauuaugaagcacauucucuaaguguauguagcccauauaaaacuaaguugcuuauuguuaggucuauuauuguaaaacaacuuuagcauuauaaaccucaugucuguauuuaucccuuuuucuauuacuaguaauuuaaaguagcuuauaguaguaauagaauucccauucccauuuuuuccucuagaugaaugaaccaaaugccuauggaaacacaccucuucauguggccuguuacaauggacaagauguuguugugaaugagcucauagacuguggugcuaaugucaaucagaagaaugagaaaggguucacuccuuugcacuuugcugcugcaucaacacauggagcacuguguuuagaacuucugguuggcaauggagcugaugucaauaugaagguaggaaacaacuagaguucauacuuuaaggauguaguuaacugucuaaaacaguauucauaacauaucauccagaauuauaaaggauccacuaguaaacuuaugaacauggauaaggccagauguggaggugcacaccuuaaucccagcacaguggaggcagaggcaagcagaucucucaguuugaggccagcagagcuacacacuaagacccugucucuacugucaaccccaccaccccucccaaaaagaacauggaugaaguuuuuaaaucuuaugcugaaucaaagaaagaauuguauacauuuuuuuccucuguguaagauucuagaacagauggaauucuguuuauuuggaguuccagaauuuauaguuggggaaaaauaacagaucaguuguugcccaugggaaggaaggaaaggucaccugggcaagggacaugaggagaccuuauaggguaauggagcugcuuuguacuugggcagggcuuuguguacuguagauaagcacccgugaaaaccuaccauggaugcuuuuaagauuagagcccuucauuaucuguaaacuuuguuuuagaaaccagacuucagauagugaaucgugauacauccugauugucacacaaugacgacacacuuauaacuaccucuaaagcaucaaauaauuauauugauaaugugauagaaaacauggaguaaaguguuagugcuagaauccagaagguauguguauggauagucaugcugugagacuuuuuugaaauuguucuuuucugauauuucuguuacaagacuuuucaugguguuagaaacaucggugucuuuuacacuuaaagguuaaucacuuggcuuuuuguucauaauugcuuucagcaguaauguaagcauuuuagaaauauguuaaaauuuaggagucaaaauaaauuugucuucacuguaaaucugugagaaucgcagguaaccaagacuucaaguaugacuauuuuauaguacauagucauuuuugauaguuaaaggguauuuucacuguuuguuccuggguuuuuucaucaguuuguuauuuaagcacuugacaaaacccaucuuauguuaugaagaaaaccacaguugaucaaauuugaauaauuuaggauuaguaaagauacaucagcuuacaaauacuguuuacagagaaucucagcccacuuuguaugugguuaugauggacacugccuugccuaacuccggugaaagcacugaccagaagugaagcagcauuaagucuaccaggaggacuuaguucauuuauccccacccccacccuucucaacugagggucagguuuauuuaaguuauuuuaaauuuuaauuuaucuuauuacuuuacaugugugcacacuuugcuuguauauauuccuggggccuacagaggccagaucagggagucagauccccuggaacuggaauuacacuugugaguaacauaugggugcugggaguuaaacugggguuacaggugcucuuaacugcugagccaucucucuagccccuaaacugucuuuuaaagaauuuguuuagagguuguagaaauaaucaguaaaguuaggccaauaauaaacacugucuuaaaaaacaaagcaguacccaguguucucugccuccacaugugugcacauucacaucugcacaagcagacacacagaaauaauacauuuauagauacacaguuuuacacacacuuguaagccuaacacuuacuaacacuccugcuaaggcaggaggaggaggauuuuugaggcuacccuaagguauauagcaauaccaugucucaauuagaaacaaaauauacauguauguauguauaugugugcauguguauauguaugcuuucaauacucaagacacguaguaacuuuuuuuaacugauaacagguuucagguuuuguuuuguuugagacaaggucucgcuguauagcauggcuagccuagaaucagcugugcagcccaggcuguccuggaacucuuuagaacauccugcaucugucuuaggagugcugaguuuaaaggcgugcaccaccacacccaggugaucauuuucacuugaauucuuccccaucccagaaaaaaaacacauuuugugugguaaggagaauuauuuuuuuccccuaaagauauaaaaaaaaaaaaaaaaaaaaaaaacccucaguuuaucuuaauggacuucaggaacaaagauuaaaucuaguuuuuuuuaaaaaacugaaaggaaacuuuuuaaaguuucuaugauacauguuuaugauaaaauaucuaaaauuaaucuaucaccuauguuucauggaaauagugaaggcuuacuuauucuguuaguuauuauaaacuuuucagcuauaugcugcuauauuugaaggauaaagauuagauuuuuaaagauaucaguuuauacacuaacuugauaagucucuugguucaugucagugccucuguugaaaacucucuuaccuaugauuguuucuguuuaucuuuucuuaggaaauuuaaauugggaaugucaaaauaguggacauaauauccuuaaugguuuauaaaguugaguacuggcuuuuguacagcacaugaggacuuuuuguuaauuggcaaaggggaacgucuuagugauuaagcagauuugaaggcaguggccuacaauaaaacuugccuaaugguuuguaauagcccuuucaguucaguugucugaauuuuauucggacuaaauuccauugaaguauguuucuuguguugaagacuacugaaaugcgaucuagcucugaaauuguacaaagauuauugauagcucuagguuuucaaucaacaagaauuuucagugcccacccucucucugugugcuggcaagucuuuuacuuuacauaagcuagaauuaucugaaaggaagaaaacucacuuaagaaaaugccuccauaagauccugcucgcacuugcucacucucuuucuuucuuuuuugguuuuucaagacaggguuucucuguguagcucuggcugucuuggaacucacuguguagaccaaacuggccucaaacucucucucugagcucggcuugccucaacugcaggcuuuucuuacuuagugauugaugagggagagcccaacucauguggguaguuucaucccugggcuagugguccuggcuucucuaagaaagcaggcugagcaagcuacaaagaacaaacgagcaaguagcaccucaccauggccucugagucagcuccugccuccaggguccugccuugaguuccuguccugacuuccuucagugacggacagugauauggaaauguaaacuagauaaacccuuuuccuccccaagcuguuuucuucuugguguaucgucacaguaauaguagccccgacuaagauaguuucccucacuauuuuuagagacaggcucucauguagcccagacuggcuuuuuaacuugcuauaagcugagguuggccuucucugcauuguaagugcugggauuauuuacaggugaguauagccacaaugccuggcugucuuuauuuugagacaguuucuuacugaauaccccugccuggccucagacucauuggccuuccugcuucaucucaagugcugagauuaugaacaagaccaacugaucuguccuuaagaacagguuuuucuuccacacuugugugucagucuacuuacccacaaauggccaauagccaguauuccauaaccucccugaucuugcaaaaguuuugugcaaagagauucaaaucauuuaauucccacuuuguaaaacguauaugaaaaucuuuucauuucccccacucgguaaaauuuuuguccacacaaaggccuugcuccuuuucuggaaccuucuaaccucaguuucuucauuucugugcagcaauucauuuaaaacuacacacacacacacacacaagaacacacacaaaaggugucacaugccuuuaauuccagcacugaagcagagccagucaaauuucugcauauuugaggccagccugguccacagaguaagcuccaggaccgccagggcuacacagagaaacccuaucucgaaaaacaagaaaaaaagaaacauuuuuaugguagcuagugguagcacaccccuuuaauccuagcacuuggaaggcagagacagguggaucucugagaguuuugaggccagccuggucuacauagugaguuucaggacugccagccguagguguugagacccugucucaagagaaagaaagagagagagagagagagagagagagagagagagagagagagagaauaauuuuuuuuaaccaaacaaaauauaucacacugaaguuuaagcauaaaaguacuauaaaauauauugcuguuguuguuauuacuggguuuugauaacaauuccuagagccuuggcgaucucucuacuugcugacaagauggcucagcagaucaggguacuuaaccaccaagccucacaacuuaaguuugaucccuggaacccagauaauagaagagaaauuauuucugcagauugucuucuggucuccucaaaugcaccaugacauuagcaugugugcaaaaaauaaauaauacauaaauagauguacaaaauuaacuuguaccuugacucuaacacgauuuuagaugguuaaagacaaucauuucuguccaguguaaagagaaauauauguccucuccuacuagugguaagggauauuuuccaacugguaaucuuaauuucuucuuccuuugcauauuacuuuguuuuuuuguuuguuugguuuugguuuugguugugcgccccccccccccacccccagacaggguuucucuauauagcccuggcuuuccuggaacucacuuuguagaccaggcugaccuugaacucagaaauccaccugccucugccuccggagugcugggauuaaaggcauguggcaccacgcccggaugcauauuacuuuguauaucuaccuucuauaaucaguauguagaaaguagaaauauccuaauguucucuauaagcuuauagagguucaucucuuauuagcuagaagacaaaguggaauucuuuaaucucaggcucuauguuuccucaccuauaaaacagaaguaauaguauauguauauauacauuguauuauauauuuauacacuuagaauguguaguauauuugugugugugugugugugugugugcgcacccguguguguaucagaggacaacuugcaguauuagguuuucuccucuuaguguuugucuggggaucaaacuuaagucaucagguuuagcagugagcucuuuuucccacuaggccaucucccuggccuguaaauaacaguaucuauccgaggguuaugaggauuaaauggcugguauauauaaacuauuuugaaauuauaccaaaauguguuuacaguccagacucaagcucagcugcuggaguccucaugcacaggugcuucccacccguccuccagugccuccagagcuuaggaacaaacaagcugggcauggacgugcaucccugcucucaggaggcugagcuggaggaucacaagcucagagccauucugagcuauguagugagucugagguaacugugucccaaaacaagcaagggcagguauagacucagauaccuucguaacucuccaugucucuguaagauggcagguuuuacaggguuaguacagacuuggcgcacuuaucauagucagugugcagaagcugcacugugcugaggauuaggaacgaaagcauugucuuuccuuuguguaguuaacucaccagaagauuuuagagauaaaaaacaucauuuaacuaggaaggagaaaguaaugucacaucacucaggcauuauuuugcauuugaauuuucuucugaacuauagaaaaguacagccagccagucugauuaucuuaaauaauucaagaaacuagcuaacaauguugacuacaaauuaagaccugguauuuaaaauaauuuauagugaccuaagacggaaaggcaaagcaggaggugagugggaagcacgugugacuggagcacuugggguuaaggcgcccucgguugagccuucugauagcuucugugucugucuucccaccuguacaauacagaucucacaauuaagcuuuacggugccacugcaggauuuguauaaauaguaagcauggggaguuuuugugguuuugaucuaauauacauacugaaaaauaaaaagccaguuuaugcuuuaaacagcugguuuaccuucauaauacuugcuucuuguauuauauuuauaaauuuauauaagaaaauaccuaaguacaacuaaggcaugcuuauuuucuggguauaacauaguaauugaacaauuuuucuuuguuccuuuauuucagaguaaagaugggaaaaccccacuacauaugacugcccuccacgguagauucuccagaucacaaacgauuauccagagugguaaaaaguauuucuguuuguuucuuuuauuucuucaaugaaguuugggaaguuuuuuugucauuguuguuuguuuuguuuuauuuuuguuuguuuggcuuucccuuuuuguuauccacaaagugaauggcacuguggaauugcuauagcaguguguauacaguuaagauuuuauuucagauuucuugaaaaucagcacaggauaaaauacuaugaauauaugucauucagauauuucuauucuucugaauuauuuauuuccuuucuuucucacuugaggcaguagcagggaggaaucucccugcauagcuuaggcugaccuugaauuuacaguccucuuagcacaugcaccgcuuugcccaacugugaauuuuauauauauauauauauauauauauauauauauauauauauauauauauauauauauauacauacauacacacacacacacacacacacacauacauacauacaugcauauauaguguuagccuuucuuuccucauuauugcuaauuggaaaacuaccuuucuacauguaguauauauuaacaugaacuuuguugcauuuucacuuuucccuguuuaaaugcguuuugaacucuuguuaggguuuuauuuauuuucuuuacuuuauucucuuguguuugaauuaguacuaggcaaacuaaacuuuaaauaauuguauggcuauuaauguaaaucuguuucucaaacuacauuccaaagaacuguuuguuaaucauccuuaagauguuuuguugcucauuuuaaguuuuuauuuuauguacaugaauauuugccugaaagucuuaucuguguaccacaugcauggggcccaugaugaccagaagagggugucagauucccugggacuugaauuacguauaguugagaacuucaguguaggugcugggaauugaauccaggucuucugaaagaauacccugugcucuuaaccaaugagccaguucuccagccccuuguuggcacuuaacaaacauucuuuuauguguagguaugcucuauguguguaagaaagagugugugaaagacaaguauacaagugccauugugcacauguagagaucagaggacaaccucagauguuaguccuuaccucucccuuaagauagacuuaggauauuagcuccagacuggcaggcccacagacuuccagggauccucauucccaucucccaacucauccuaugagcauuugacuuacagauaggaacuagcauacccaacuuuacauguguucuguuccucauguuuaauggcaggcauuuuaccuacugagccucaagaaccucuuuguuagcuucuuguugcuagaauucugcaaggggggaaagcucaugauccaaagcuuuggaaaguacuguaagcaguugucuucaugaagcauaggauugcuggaaagugcugcucuaaagcaguguuguuagcguaguggucucuagacucauugcacccuagaacccuucuguugauuuaaauauguuuaaauccuauucucaauaaaacuuguaacuauacaguugguaacuccaguaaauauguugcccauuacuugaugcuuaaacaguauuuuauauuacacuguauuuaacaguuuuggccaaucuguauauaaucuaaugucucacauuauguccuuuauugcaggagcuguaauagacugugaagauaagaaugggaacaccccuuugcauauagcagcccgguauggccaugagcuucuaaucaacacucuuauuacaaguggugcugacacugcaaaguaaguagugcuugcaggagugcugguggcugugcggagagcagccagugagcuagaguggaaguggggauuucuccucagcaguggagugggugggugccugguuuuucuuuaccuuuuguuuuugacacugauagguuuaaaagguucuaugucuaauuuuauuugauuagucaguaugacauguuuuuauauuucuguuucuuuuuccuccaauauaaauaauauaaaguuuugaugagaaauuuaacuuuuauccuuuuguuuucaaacuagaaguucuaaaaauugcacacacucaaaugcuuuuuucuuggaccagcuguagacagugguuucagacuaaugugcagagcccaggaauucccuaguugcugguacaaaguggucccaaccccaacuucuuuaauuaguaaaguuuacuuuuaauuguuuuacauacuaaaguugcccuauaaauuuuuaaaguaugaauuauuuugugcauauucuguaaaaaucacgaucuuacucaaauugguguuuccaaguccuguauaucauguuauauguauuugugagcaauuguaagcuuuuuauauauucauaagugauaugcuacuauauacauggucuuugugguucagaguauauguucauuuagcaauguauauagaggcuucaaauuuuucauauuucuguagauaguucuaguuuaaguuaugggauuuaauuuuaccaucuaaggauacauacaauauucuuauuuacaguuaaauugcucuccaauuuuccacauuacagaauggcugauaugagcguucuugagcaucugaccuugcggaaaugguuuuaaaugguagggugagauggggcaggaggucuguucccugagcaaauaccuagagacauuuugcuuggggaaagcaauaacaaugauauagcucaaaggugcugcugggcauucagcauuuuacaguguagacccauaaguaugcagugaguuuauaaugaugauagugcugagguuagacaaacaagcuuuagaaaacuguagcuaggugauaaauuaugcugcuuuucaaugacugcccagaguuuucucuaacguauuaacaaguuucuacucaaccaauuaucuuuuacuuaagugauaucuuuauaaucuauuuaaauuauuauauuuugcauguguuguaaugaaguuucuguucuauuaauuuaaggcgugguauacauggaauguucccacuccauuuggcagccuuaagugguuuuucagauugcugcaggaaacuccuuucuucagguaaguggagcucccagacaaguuuguuugugcgugcuuguuugcuuguucucauacguccucguccucucccuguuguuacaguuaccucuucagcucugagcagugcuuuacugauucccuuuguuaauugguucaugggguguggaguguccauagagcagcuuuuacccaaugauggcagucuccucuccuuggccuauucagcaagacaccuuaccugcauguuucauuccuuuugggucuuaaaagucauaauaaauuaaagucauaguaugaguaucuuacaggcucaugaaauuauuaauccauuaccaguaguacuuaguuauaaaugcuguaacuaguugguaugggauguuuuaguuucacugcaaacuaugauccuuaguaaguacauugacuuacucacuguaaaagauguaauuaauuuuuaaguuauuuucuauuucuugguauauaagaaaguuaaauauuagcauuccuguuuacugaaauaaacuaaugagguuucaguaaaaauauuauagagugagacacacucuucugagguuuaggggcaaguuguuuuuguugaugugugugagauauuuuauguguguaaauucauuguguuugguuuuuuugaguaucaaccauguguauauaaagcuguucaucccuacuuagcaugaaaaagaauacuaaaaguauuccccaguaugaauaauagccacauggaacaaaguacauauccucuuuuuagaagggaggaggaagaugaguggagagucuguaaagccaaagcuaaccuugaacuugcaguucuguuucugccucccaagugcucagauaacagguguuuaccaucaugccuggcuagagugcuuuagugagauaucuucauacuauauauacacuuacacauuuacuuauuuaauacauagaguucaguauuuauaauacguucaugugcuuauauagccaaaauaacauccauucuggaguaucuuuaaucccuauaaaagaaacaccauuagcauauuaugguauauuaaccaccuaauaguacaauuuuuauagaaucaccuaacaaaaucuuuuauggcuagccuuuuucacuuuauguucuugaagcgucuguuaucaauacuucauuucucuuucuuguugacuauucccauugcacccuguagccuuuuaauaauuagaaugguuuugucugccugccugccugccuccuugugacagguuuuauaccauguuaccaagguuugccaaggcucggaugauccuccuguuuucaucuuguguguagcuaggacgaugagacugaaagugugagguguaaaccaucacuccuggcagagcccugcagacaagcacuacaggguuugguuuuguuuuguuuuguuuaauuuguuuguuuguuuuuauaauguuguacauuacuaugugguuuucuuuauucauuuuguacguuaagaauauauguuugcuuaggguugaaaagaggaaugugauauuuaacauuucuugauauacuaucuuaaugcaaaguaaugugucuguaauauuauauaagagaaaagauauauauucauuuuuauaggauuugacauagauaccccagaugauuuuggcagaaccugucuacacgcagcugcagcuggaggguauguuaauaguauuuucauuucuuuuaaaagaugcaggggggcguuacggaagucauuguuagaguuuaauuucuaagauaguuuggggucagucgcugugggcgguaggaggcaggagcagaaucacggaggcugucucuuuguuccguuuuacuaguuuugaguugccacagaauagaaacugaaccauggcuggauauuaauaaaagacaguucaaggcagcaaaaauuguuuuuguuuguuucauuuuguuuuuugucuucuuucaacuaagucauaaguauuaaucaggaaaggacaaaccuacaaaaggaaauguuacuuuuuauacgaaaaacuaauuccuaaacaaauaaaaauguucaugcaaugaugagaacaucaaaaacuugaugaauagucugcaugauacuauauuauuguaagagagaaaaauauugaugaugcaguuacaucuuggcucagaagaagaaauguugugauaagaacauuuuagacuaaauuuuauuuaaauuauuucaguuccccaagccacaccccccuccccuuagaucuuugaagcagucuuguuuuguagccaaggcugcuguaccacucaguccuccaaagcccugcgucugaagugcuggaaucauaagcaugcaguacccuccaugcuuacacuuaaauuaugagaaguccucuggggaggucagucagucaguccugcugagugaccagagcuucugcucccucaaagcacucuguugccuuaaugcuucggguaauuuagauuuguuuuuaagccauuuaauucaugauuuaucaaaagggauguuuugugagaauguuauuucuagugauaauuccuuaauauuuccuaugauuucaaaaaacaauugugcugaaccaaccaaggaugcuaccacguuuaaauugcagagaugaauugaacauauaugaaucccuucuuuauucuuuuaaggucaccagaggccauuucaguuaaaaccuaauuuguauguaacuugccuacaguagaagucaacaggcauguuuuucauuauaauauacaaagcugauauuggguuuauaaaaaucugaaauuguuauaaaaauauaaaaauuuauauaacaagcauauaagaagguccuaucauuuuaacuaagguucagucugaauaaauaaugauaguauaggagacagugggagaaauugacuugccauuauuauauguguuuuaaagguacaggguuuucuguuuguuuuuaauucuuuuuaauuuauuguuuuaaaacccccuaaauuuaagacauuuaaauauaauuauugguagaaauuuacuuaaauccaaaauccagaguuucuacccugcuuuugguacuugaauuccuggauaaaaaaacacacagccuuuauauuuacaacaagcccuaaaaacacaauagcuagacagcugccuacccuccaugcuguuagaaucuacuuuccuaucauaacaccacguuguuacuauuuacugugcuccuucugcgcugcucuuaccuccaauggccagcccacguggaguaaagucuucacuccuaucccauggcagcuucuccugcucccuccugaacuucuuccucuuccuaguccuccucuccugcaagcccugcaagccuugaagccuaagccccaccuaugucuucucugcccagcuauugacuguuggcaucuuuauuuaccaaucacaacuaacuaggggcaaagucacuuagcuagcaucuauguguggacucucucuggggcgaccaguuuugggggcccaaauuagcauuagaauacaagcagcaucagguuaaaccacuauuuaaaaaaaucucuuagaaucucuuaaaaaugugaucuucuuuuucuacaguaauauaauucauuuguuuauuucucaugugccaguauuuaugcauaucacuuuuuaaaugcuaaauagaaugugaaguaauucucacuuuaaaauaugcauuuaugcuucuuaaagccuaccauuuuuaucauagaaaucacugacaauuuuacauuuaaaaucuuuucuucuuuucuccugacuagaaauuuggagugccuaaaccuucugcugaauacuggugcagacuucaacaaaaaggauaaauuuggaagguaauuugugauuuagcuccuguagagcgagauuaaauuugcuuauuuaauggcuugcuugaccuuuaacugacuucugaaacuuaacuuuauguguuacacagcaucuuuugaguuguaaucaugauuccuuaagaaucugaaguagggccugguauguggcuuaucuuccucaaaugcacuggguuggguuugcucucuagcacugcugaaaggagcagaaaaagagcacacacaugugcaccagccagcugaggucaguggguucuaaccccagucucaaccccagucuuuugguuguguucucccuacaauccuaggcucucucuguccuuuucuuaaaucauuauuucuuaaauuauagauuuuuuuaucuguauagguguucugccuacuuguaugccuguguaccauacgugcacaguacucaugggaccaaaagaagauaccaaacccuugaaccuggaguuccacaucauugugaccuccucaugugggugcugagcauugaacccgggcccucuggaagagaagccagugcucugaacugcugagccaucucuccagcucucucccuguuuuucuugaugauaauaauuguccuuuucccauaauuauagcauggaaauuuaaaacuucacuguaccaaaguaccuucaaaaagcucaagaguaccuaaagcuuuuccaagucauuuuuuuuuuuuuugugagagauccuucuucccacuucugaaaggcaaaaauagguugcaaauauaugugugauuuuccccccccccuucucuucuuacucacauccauaugacccacugaguacauucuggaggagagcagcuauaaaaggacaaacucucauugucuagccuuacugcuacuagcauuuauaguaauagcaguugaagcuucuguuaacuguuccuacuuauaccaugaaccaacauacaagauacauuaaaaccauucagaaaagaagcaaaugcaguuguuugaaagauguagaugacagucuaagcacuguguaucaggcgguaagaacuguguauaucagacgguguucuggggagggugugaaucagaaggagauguguggguacauauugguguauaugauaguaccagcgcaaagggaaaagaaaagggcuuguguguaguaggaaguaagaaacgaagagaagaaagcuaaaugcugcuugacuauacaaugcugagggauagacuggguucacauggacuaauaaaaggaacaaacgaccuacaaaaugaaguuucauagcuaauuuuuauuuguaauuauuugcacauuccaugcaaaaauagcauagagaguuuugauauucuuauugugagcuuaaaagcuuuauuuccaggguuagcugcauuuuuaagucucuguaauaguucugcauccuggcacauuuccacauuugggaggaagaucuguguaaguucuaggucagccagggcugcauaguacaugaggcccucucucaaacaagcaaauuaaaaacucuauaguauuauccaguaagauaaaauaauguuuugcuauaauuuuccuaagucaguguauuagaugagaagaagugcacuguaaggagcucugaauaaacuuacuauaauuuuuguuuuucauuuaaugaggucacaaaaucaucuuauuuuuaucauccuaaaauaguuacucauauguuuaauagcauucuguguaauucuaguaauuaaugagaaauuaguugugacuauucaguuuucagagauuaaaccaguacacuagcucuucugaauaggaaauaagucuauaagagggugucuccauuuuugcuccagaaacuggaauuacuguugaggccuguguggauuugauauagcaacucuucuaugcuucuguuuuacucuuugcuuuuaucacucaagacauggacuguggggcauuuuuguuaauauaaggcaagcuuuauuaaaaugaaaguuuuuauguuucuaagcagaauauaauaggaguuguaauugacuugggaacuaaauguguggaguaagaguuagcuauggucucuuuacaaauguuuguuccugacuuaucuuucuucuguuaauuuggucacaaaagaucuccacugcacuaugcugcugccaacugcaauuaccagugccuguuugcucuugugggaucaggagcaagugugaaugaccuugaugagagaggcugcacaccccugcacuaugcagcuacaucugacacagacggcaaguaaguaccacgugagcgaaggaguguuauuuuuuuuauuggauauuuuauuuauuuacauuucaaauguuauccccuuucccaguuucuccuccugaaacucccuacccauucucccucccccugcuucugugagggugcucacccacucccacuucccugcccuagcauuccccuacaauggggcaucgaagcuucacaggaccaagggccuguccuccccuugauguccgacaaggccauccucugcuacauaugcagcugaagccgugggucacuucauguguacucuuugguuggacauuuggucccugggagcuauaggggguaugguugguugauauuguuguucuuacuaugggguugcaaaccacaucagcuccuucagaucuuucucuaaccuccuucacuggggaucccaugcucaguccaaugguuugguuggcuuugagcauccgccucuguauuugucaggaucuggcagagccucucaggagacagcuauaucaggcuccugucagcaagcacuuguuggcaucuacaguaguuucuggguuuagugauuguauaugugauggauccccagguggggaagucucuggauagucuugcccucagucucugcuauacaauuugucucuguaacuccuuucauggguauuuuguucccccuucuaagaagaauugaaguaucuacacuuuaguccuccuucuugagugugaugugguuugugaauuauauuuuggguauucugagcuucugggugggcuaauauccacuuaucagugagugcauaucauguguguacuuuugugauuaguuuaccucacucaggaugauauccuccagcucuaucuauuugcuuaaaaauuucauaaauucauuguuuuuaauagcugaguaguacuccauuguguaaauguaccacauuuucuguauccauuccucuguuaagggacagcuggguucuuuccagcuucuggcuauuauaaauuaggcugcuaugaacauagugaacauguguccuuauuacauguuggaacaucuuuuggguauaugcccaggaaugauagagcuagguccucagguagcacuauguccaauuuucagaggaacugccaaacuuauuuccagagugguuguacaagcuugcaaucccaccagcaauggaggaguguuucucuuuccccacauccucaccagcaucugcuaucacuugaguuuuugaucuuagucauucugacuggaaugagguggaaucucaggguuguuuugauuugcauuucccugaugacuaaggauguugaacauuucuuuagguucuuccuggccauuugguauuccucagagaauucuuuguuuagaucuguaccccauuuuuaauaggguuauuugguccucuggagucuaacuucuugaguucuuuguauauauuggauauuagcccucuaucaguuauaggguugguaaagaucuuuucccaaucuguuacuugcugguuuguccuauugacaaguguucuuugucuuacagaagcuuugcaauuguaugagguuccauuugucaauuguugaucuuagaacauaagccauugguauucuguucaggaaauuuuccccugugcccaugcguucaaggcuuuucccaacuuucucuucuauuauuuucaauguaucugguuuuaugugggggucuuuaauccucuuggacuugagcuuuguacaaagagauaacaauagaugaauuugcauucgucuucaugcugaccuccaggugagccagcaccauugaguagaguguuguucagcuuccacguguaugagugcuuuccauuguuuuuauuguuauugaagaccagcuuagucugugaugaucugauaggaugcaugggauuauuucaaucuucuuguaucgguuaagaccuguuuugugacugauuauauaggcaguuuuagagaagguaccaugaggugcugagaagaagguauauucuuuuuguuuuaggaugaaauguucuuuagauaucuguuaaauccauuugguucauaacuucuguuaguuucaaugugucucuguuuaguuuguguuuccaugaucuguccauugaugagacugggguguugaggucucccacuauuaucgugugagguguaaugugugcuuugagcuuuaguaaagugucuuuaaugaauguggcugcccuugcauuucagcauagauguucagaauugcaaguucaucuugcuagauucuuccuuucuuugaucaguaugaaguauccuuccuuaucucuuuugauaauuuuugguugaaagucaauuuuauucgauauuaaaaugucuacucuagcuuguuucuugggaccauuuacuugaaaaauuguuucccauccuuuuaccccgagguaguuucugucuuugucacugagauacguuucuugaaugcagcaaaauucugggucuuguuuacauauucagucugucagucuauguuuuuuauuggguaauugaguccauugauuuaagagauauuaaggaaaagugauuguugcuucuugugauuuuuguuguuagagguggaauuagguuuguguggcuaucuucuuuuggauuugcugaaaaauuacucucuugcuuuuuuuuuuccuaggguguaguuucccuuguguugaaguuuuccaucuauuauccuuuguauggcuggauuuguggaaagauaauguguaaauuugguuuugccauggaguaucuugguuucuccaucuaugauaauugagaguuuugcuggauauaguagccugggcuggcauuuguguucuccuaggguggucuguaugacaucuacccaggaucuucuggcuuuuauaguauuuugagaggucugaugugauucugauauguccgccuuuauauuuuacuuguuuuuaauagucuuucuucguuuuguauguuuggaguuuugauuauuacgugacuggaggaauuucuuuucugguccagucuauuuggaguucugagggcuucuuguauguucauggucauaucuuucuuuaaguuagggaaguuuucuucuauaauuuuguuggagauuuuuacugguccuuugggaaucuucacucucuucuauaucuauuauccuuauguuuggucuucucauuguguccucgauuuccuggauguuugggguuaggagcuuuuugcauuuuguauuuucuuugacuaucaauguuuucugugguuucuucugcaccugaaauucucucuucuuucucuuguauucuguuggugaugcuuccaucuaugacuccuuaucucuuuccaagguuuucuaucuccaggauugucucccuuuguuauuucuuuauuguuuuucuuuccauuuuuaaauccuggaagguuuuguucaauucuuucaccuguuuggcucuguuuucuaguaauucuuuaaaggauuuuuguguuuccucuuuaaaggcuucugccuguuuaccuguguccuccuguauuucuuuaagggaguuauuuauguuguuaaaguccucucucaucaucaugagaugugauuuuaaguuagaaucuugcuuucccaguguguugggguauccaggacuuccuguggugggagaacuggguucugauggugccaaguagccgugguuuugguauuagcuaguuggucuuguugucucugacuggagucuguccuuucugugagccuaugaucuuagguaugucagcacuccugggagaccagcucucucgggauuuggguccagagagcugugccacaggguuaacuccagggugcagguagagacuggaaggauucuguccccaguugcucuccgguuccugagcccugugcucuccuggugguuccauguuuggccaguuauuggagcaaaaguguucaucucaccuguugacuuaggaguaacagaaaagcguuauuauuucuacaaaauggcauuuuuguauggggacuguuuuacugcaaguguguauuuccuuuauguguuuuaauuaucaucccugaaucuacaguuuauaaaauaaauacauuucauaauuauuacuaaauucuagcuauugcugucuuccaaguaucuggucuuuacuugaaaaaucugguagucuuuuuucauucuuccugcaaaacaguauuuguuuauuugguuuaugacuugugguuuuucucauuucagaguuucucuauguaguauagcccuggcuguccugaaacucacucuauaaaaaaaaaaaaagaacuaaggauuagcaucacaauguguaugccuacacacagacacacauaguuaaaaauaaaaguguuggguuuugguuuuuuguuuuuucuuaaaaaucaaggacaaauugcuagguagugguguugcuugccuuuaauuccaguacuugggagccagaagcaggcccugccuaugcauuugaggcuagccuggucuccaaaacgaguuccaacacagccaaacccugucucaaaaacaaacaaaaacuauaaccugauucuagccaucuuaugauuguauauugagccuuacuaucugaaugagugaauaacaccacucacacccagucacucacauacaccuucaaccugauuguaccucagaggaaggaauggaguuggcagucagucaguauucaaagaccccuuuggaccaaguuuuagcaaguccaauuuagucucaguagaguacugguugaaugaucagaaaccaugcuuccgucuaauguuaauagacaacaguuuacaaaucucuuguguaggcuuagcagcucauuaagcaguaugccagcucuaguuugaauaauaccaaguugguaaagcauuuuugaauuuuauguuguuagaagccuuguaccuugauuuaucaaacaugacggcauuaguaguuuuauagaacuuuuauacauuaauuuugccuguacuuugaaacaaaauuaagacuuuagcgauuuagaccaaguuaagaaaauguaaguuauaagaaacacacuuaucugaugugcaaauguaucuuacauauauaauauuccuauugcauaagacuaguggucacuuagacgucuuccuaaauaguuauauaaauggguccuuucauuguuaaaagccugacaaaauuaacaauacaaaauaacaaccaaagaaaaaagcuauuacagcuuggauauaguauuuauguuacauaaucauggguaucaaaauauucauuacaagaauaauugccaguauuuaaucauuggcuuaaaauguaggugaaaggcuagguguggugggaggcaaaggcaggaggauuuccuaaguucaaacuggccuagucugcauagagaguuccaggacagccagaccuguagagaguucuugguagagagaccuuguauacauacauacauacguaucuugucccaaaugaauguagguggauuaguauauaaaaauacauuugauauuaagguauaaaaucuaauguaaagcuccacagcuuucauuccaaauucuuauucuuucuguauaaaaaagguuauugaguuuuauucauugucuucggaucugguuaauuuuggcaugugauuuuuuuuuuaauugcugcagguuuuuuauaauaaauauuuaaauguaaauuuuagaaucuucuuuugcuguuccuucacauaggugccuggaauacuuacuaagaaaugaugccaacccagggauccgggacaaacaaggcuauaaugcaguucacuacucagcugcguauggucaccgucugugucuucaacugguaagauucugaacucucuuacaggacuagugggagguuuuaauuugacuacaugauccagaaaacauucaguuuuguucuuuaacguuuucauacuccauuuaccucuuaaauucaugguuguuucaguaagauaacucuucucuuuucauuuuaaaaaaugaaaaaaaaaaagucacugaucccugugugguggcacauaccuauaaucuggaucguugagaagcuaaagcaggaauuuugugagugcuaggcuagccugugcugcagugagcuguugucuaaaugauggaguauuuaaucuuuugagggaagucaggcacagcaguguucccuugcaguccuaauugcgaggcugaggaaggacacuggcuugaguccaggccaacauacugagauacuuccucaaccaaacaaaccaacaagcaacaagaacaaaaccagauaaagcucugaagaaggcuccugaagugguguuguauuucuugagacagacacacauaaccaggcuggccuggagcagcucuauaacugaggaugaccuugacccuuuguuccugcaccuccugaauucaggcaggcgccaucacagcuagucuaugugaugcugcggaucacagaaacauucacguacugcuggccucgagagccgccuaggacaaaugcaagauuaguaauuuagcuaauaggaguuuacaaacaguucagaugauuaugauuugauaugguuuaauugagcuguacuaguucauuucauaaggaaaugauacaguagauaaauguaaauaaaauaugugagucaaccaucaaguguuguuuauuagaaauaaaauagaaaguuguaagcucugaaaaaaaaaaaagauccaccuaauagucaacaucuaggucuguugccguugacuccuaucauuuuaaauacagauuuuccauaguucuuuuaaagauguaauuauaucuuacuugaaaaauaaaaaugaaaaccccugaaagagucagauuauacccauauguuuagagaccuaugcaagguccuuucauuucccaguucuuccuaauaaaggagaguccaccucugcagaagaagcuugaaguucaacuguggucuuguucuggaauagagacaccaucccagacccuacugugccauacuggaagggaagcaaugaguuaaaauauacucuugugugacagaacuuucagguuauagacauauaauaggcauugcuuccuuucaauagaaaauaaaauugaagauauauaagauggucaacauaagccaggcauggugaugcacgccuuuaaucccagcacucgggaggcagaggcaagcagauuucugaguuagaggccauccuggucuacaaaaugaguuccaggacagccagggauacacagggaaacccugucuugaaaaaacaaaggggaaaaaaaaaaaaagauggucaacauauuuaauacagcauuuaaugugcuacuauaaaaauaacccauuuuccauagguuacugugguucuuuagaauaaaaucuuaggauauguauauagaucuguugucuacuguaaugucuaccuauguaaaagacaucuuuucuggaggcaaagaaagcauggguuuaaaacaaacuaacaaagcacuguaucaauaaagaugucaaauauguuaauauauauaaaucacuuuguauaaugccauuucuaacuuuuauuucagauugcaagugaaacuccuuuagauguuguaaguaucaaucgauucccccaacauucaaaauaugcuacuaccacucaagauaauguguuucuuuguucucauuaaaacugaaguuagacacugaagccaagacagugacaagagaguguguuccuuaagggaaggcauuuauuuaccugauggaaguguauuuccccaaacuccuaguuaaugaagcuccucugucuuaguuagggcguuacugcugugaagagacaccaugaccaaggcaugucuuuaaaagaaccacauuuaauuggggcuggcuuacagguucaaagguucaguccauuaucaucaagguaggaacauggcaacauccaggcaggcauggugcaggagaagcugagaauucuacaucuucaucugaagguuccuagcagaagacugacuuccaggcaucuaggauaagggucucgaagcccacgcccacagugacacaccuacuccaacaaggccacaccuccuaauagugccacucccugggccaagcauuuacaaaccacuacaucuuacuauacuuuuguggcuuuccuggacugugggcuuacuuauugucgugcucuacaguggauuggaaugagggaugagagaaguaacugcuaugaaauauuuaaaaauaucauuccuaacauucuuaaaugucucucuaacuuuuaaugucucuucuuuuuucaguuaauggaaaccucgggaacagacauguugagugauucagauaauagagcaacaauaagcccuuuacauuuggcuguaaguacugccuuuauagccaacuugauaguucacuacagaucuccaguaucuacuuguguugucucaaacuaaugcccuagacauuugguuauuauaguaauuaucauagaauuagaacguuaagaacuuguuuagugcauucuugguuaucugugucucaauuuucucuaagcggugguucuuggcucccucaagcccugcuuuuaagugagaaaauauuauuuugauaugaauuuaaaauuugcugcccccguaggacuguaauuuguuaagcagauaauauacacuacccaguuuguguaaauuucagcaguuguuggcuugcuuguggccacgagugccggcuaguuguagauucagugcuacuucacucacugcuguugggugcauacucuauaauuucccauccaucuucagauuccuccugagugccagucaaaauaaaacccaucuuagcuccucuguacuaaaagaauugauuuugaagacagauuuggguggaggacuugaauuaucagaagaccaggauaauaggacuagauguuucuaugaccccugguguuaagugcagaacuuuauuuaacaggaucacuagaaguucaguaaugcauuuguuucuuuuucacauguucuguaaccuuuuaucuuaauuuucuccuugcauaugaucgaacacugacauacugaaucuuucugccucuugcuccucucccccaccuuaguuaucuaaauuaccaguaagauuccuggcuuaguuaagguuucuguugcagugauaagacagcaugaccaaaaacuaauaggagauugucuuagcuacuguuacuauugcugagaagagacaccaugaccaaggcauuuuauaguuucagagggugaguccaugacccauuauggcagggagcauggugacaggcaggcaggcauggcaguggagcaguagcuaagagcucguguacugauccaaaagcagagagaaagcagggcugggccuggugugggcuaguccaccauguggggaccaagcauuucagugugagucuguggaagacauucucauuuaagccauggcacagaggaaaggguuacuuuguuuauacuuccagagcacaguuuauuguugaagaccaucagggcagagauucaaacagcaggaaucuggaggcagaagcuaaugcgaaggccguagaggagugcugcuuccugacuuucaccuuuggcuuguuuggccugcuuucuuagcacccaggaccagcagcccaagaguagacccaccuggaaugggcugggcccucacacaucccuaagaaaaugcccugcagguuugccuguguacgcaagaucuuacucuggcacuuucucagucgaggcucacuccucucagauuacucuagcuucagucaacuugacagaaaaccuagcuaagcacaguguuguaaagcuuucugcuuccuugucuccucuacccaggcuugaauuguaaguacuaagucugagacugugaagucaguauggagaaaguagcucuucuacuguuggugagaagaaaggcacuuuuugaguggauaacucgguguuucuugaauugucacugucagucauuucuaggcguuuguucggcggcaucagugcuuccgacagucuugccauccgucauaggccugucuuacuaacuuacugcuguuacugugcugcucaccaacuccacaaggucuucccuccccucuccaucacucacaggaccuugcuuuguagcugaagcuagccuuaaacugacagucccccuuaucuuagccucccaugaucugauauuacagcccuggguuccccauuaaauguacuuccuuaagcaucucuuagaguacuguucaauuguguuagaucucuaaaacuuuugugucuuaaaaggugaaaccauuaaggcaauagcuguguguuuccucuucuucuggcugcuacuauauaaauuugacuaaauacacaguuccuucauuuuugagcuuacauaugugcauuacauuuuguauucaaucagcuuaucaauggacgcuuagauucccccaucucuuggcuaucucaguauagcuguguuagauaggcuuucuaaacugaaauggguaguuuugcaauuuaguauuuaaguucagugaaaugugacuauauuccuaguuuugcuuuuuauaucuaucugucuuacuuaggguuuccauugcuaugaagagacaccaugaccaaggcaacucuuauaaaggaaaacauuucacuggggcuggcuuacagugucagaggguuagucuauuaucaucauggugggaaguauagaaguguccagguagacauggugcucuggagaaagagcugagagcucuacgucuugaucuguaggcagcagaaggaaaaguugucuuccacacuuguugaaauuugagcauaggagaaagccuaccuccacagugacacuuccuccaacaaggccacaccuccuaauagugccauuccucaugagccaggcauccaaacacaugggucuaugggggccauaccuguucaaaccaccauaauaccucauccuaagaagcuuucagaaauuaguugaaauaguucacuuucuuauuauuauuauuauuauuacuacuacuacuacuauuauuuucaccucaccuuuucaaccugauacagugggacacuggaaugagguuuuaggaaaguauuauuucuuccuaaauuuguugguacuaaacauacaggcuuuuccuuuggucccuuagaggagcugaugagggaaagagcccuauaacaaggcauuaucauuuucucucccguauuuguuuuuuugguuagaucugucuucugcauguccacugauuccucagagcuuguucuuggaguagcaugaguucuuucacuuuauauugccaaguaaaauuggacaugaaucuagaaugaauuccauugucuacacucacuuuagucuuugagauagauaaccuuuugaaucauuaaacuuccuacagagacaucaguagaaccaagcuuucucuuugcuuauacccucuggcuuuuucuuucuuucuuuagaguggguauccugaacccucuguaccccauuuucaguccaucucauaaaugauucaguucuguccuaccuuugcaugaguuuggaaauggaacuuaagucacuaggcuuguguaccaaguaccauucacacacagaacuguugcgcaagccugcuuuuuggacauuuugcagaagaaguacugcuuuauuauccugugaggcuuauugcuuuauucccuauacaguaucuuacccuauauaaauaauauaugugccauuaauauccuguaaaguaaauugucugcagaguuucuuaggcuguguaauggugggagcuccaauuuuuucugacagaucuuuuaagucucacuguuucucacaguuaccacugugccugacagauauucuaucagaucucaagucaguacuuuugugcuggaagauaugcuuauguuugagcucuggcacauuauggaauaaagguaguuguuuuaugagaaaucaaguauugugaccaccugucauuugagguuuuauuauuuauagaguaugaauuccuuaauaugggagaguacuagugauuauuacaaaauaaaaaucuauaguuuaauuuuucuggcuuuucaauauagaaguuuguauuaugucaggcauaaaaauguacaaauuaauuugcuuacuuuacauuuuccaaugcaguaggguaguggacauguaacucuaguagacuuacuuacuccuuacuuaccuagcacacacaaguccuuaguucccauccccagaacugggugggaggggaaaucuucuuaggaagucgaucuaacauacauauuuuuauuucuaggcuuaucauggucaccaucaagcccuggaaguguugguacagucuuuguuagaucuugauguaagaaauaguagugguagaacacccuuagaucuugcagccuuuaagggccauguugaauguguggauguacucauuaaucagggagcuucaauccucguaaaagauuacguuuugaagagaacaccuauccaugcagcagguaugccaauuacuauacuugauuugcuguugauagucauaauauucuuuuaguacugcuccugguaguuguguuuacuucuuauguuaaauagucaaaugauuguauucugaaggaaaaacaacagcaagacaacacuuuuaaaaauagaauaaaauggaaguuauuuuagauuaacauguacucuaguagcaaccauuaauguuuuaaaaauaaauacuuuuaagacuuauuuaaauuucauauguaugaagguuuugccuguaugaauauauguaugugccacaucugugucuuguguuuauggaaaucagaagguguccaaucccccagaacuggacuuauagguaggcuaucaugucaguguuagggaccaaagccagguccucuguaagaguaccaaacacucuuggccacuaaaccaucuguuagcccuaauagagguuuuugcuuauuuuacuagucuaauacacugcauuaaaugcuuagaaaaaauuuauagaauguuaacuucugcaaggacuaccccagauuguaauuuuauaguguuggcaauguaugaaaaauguaggaaucuauaaccaaguuacugguaugugagaaaagacuggaaaagggggaggugaacaaucauagaaaugacuaguacuauauaaauauaaguauauaaauagaagacacacauuucccaacucuuuacaggaauuacuauacagcaguacccauuuucaauagccaagacugguagguacaacugaaagauaguagucaagccaagugaugguggugcaugccuuuuaucccagcauucaggaagcagaggcagguggaucucuugaauuagaggcuagccuggucuacagaacgaguuccaggacagccagggcuacacagugaaacccugucuugaaaaaauaaaacagaaaggaaggaaggaaaaaagagagagagaaaagaaaaauaguagucagguguuuuucuuaguuccugucuuuaugcaaucugauucaguucacuuuguguuuauggagugaucuuuaagaaaucacucaaauauauuacuugaguucuacuguguacuguuugggaaaagauacauuuuagaagacuauagaaauauagacuauacuguugcucccagaaaagcuuuaaaaacuauuggauauucagccacagguuagaaacaacuguuuuaaugaacauuuaaagucucauaauaaauauguuuuuuaaaaacuaucaaggaguaugaauaagaaaucauuuucuauuauaaauaagagaaccauguaaaacuuuauaugacuucaaaaugcuguaaccacaaauuguuuacagaacuaauuuaaagcuuuaaauggaguguuugucacccccaccauauaagagagagagagugugugugugugugugugugugugugugugugugugugaaugacauggucucaucagccuacacugacuuagaacacugcuguauguagcccaugacugccucaaagugacaauuuuccuacaucagcuucugucucaagugcugugggaauacagacauccagcagucuuaacucaugagcauuuugagagagaaagagcucugagacaaauguacuguaaguguuacucaucguguaagacaaaaacucucgaugaaacuguucugcagaugucuuucacagucagagaucguuugggaaacauauuacuacuuaugugcuaugaggaaaacacuuguuuucccucccugaagguuaacauucuuuucucacaaugauacugugguaguacugugguuauugaacuuagaacacaacaacacucaucagaagcuacugugugcugaauguaaaugaauugacauuuuaauaauaagccaaauuagaacucuuugaucucuccccaaguauuuugacacauguuuauuacuaagcuaagaucuguugcuagagugcaacaugcagccugagugagggugguuuggagugguaaguuuuuauaaguauaacuauaaaaagguacuguauagaggcuuggggugcagcucagcugguaaaguacuuaccuaccauaugugaaguccuguccacauaaaagagggaauggugguguauguguaugaugacauagacagaaaagucagcaggucugucuccaguaucucauaaagaacgugugguugaacucaguagcacuuucagcacuuaggagauagagacagaaagaucagaaguucauggucauucuucgauaaacagugaauuugaggcuugccaagcugcaaaaugcucuggacaaauaggcaccuaguuuucucauuaccuuuuuuuuugugggggaggcuuaggaaucauagaagaccuuccuuucuguaucauuuugucacuugcauauuuccauacacuuuauuuguuuauuguguguggcaggacuugauuucuggaggagauauaacauaccuuaaagcuuccuauugagguggugggauuguucuucugcuugucaguuaauaagcuguggggcauauggaaacauuucuuuauaaaauaugucaucuauuaauguaugugcuguuuggaauucuuuucagcuaaaaaucaccuaaccaaaugugucguaaucaacagggauucagucccacuccaaagaguguacagcccuacagucgggugguuccacgccgcccucacucagcaugccaacagaguccuucucagcgcuugcuuguguuuaugucacagaaucaucgcugcugcuuuacaggacuauauccacaacuggcauuuuagaaaggggccuuucauuaucaaaauuaaaaagauuugcccaaauuucucaauaucuucaugguugacucuggaucuuguacuuaccuugcagcuaaucacuguugaaagaaaauaugauuaauaugacugacuuggucuaacauaguugacuugauugcaccccuuggcuggagacaggucacucuucuaaaugaaaugaggauucuguuagcauggaggaugaugaagggauagcuguggaguguguguuuuacuuccugugaacaaauacaauucccuugauagcaaauacaguauaaaaccuacuuugugugcaggugcuguccuggugaauucauugaaaggguuccaaaauuauauacucaaagauaugcuuacuccaguuuuguuauauuguacauauuaaaauuauuuucuuuuacuuuacagcaacaaauggucauucagaaugcuuacgguuauuaauaggaaaugcagagccacagaaugcaguagauauucaagauggaaauggacaguacguuucaaucauuuuuaaaugguuuuuuuuuuuuuugagacagcauuugaguauauaauccaggccuccauaacauaaucucacuaccucacccucuuuagugcugggauuauaggcauguacacuauauuuugcucuuaaauuguuguuaaaguauuaaauauucuaauacuuuuggucccuauuuuaguagauauaucaaaguuuguaacuaaaaaugucaaccauagcuguacuggcuaguuuugugucaacuugacacagcuggaguuaucacagagaaaggagcuucaguuggggaagugccuccacgagauccagcugcaaggcauuuucucaauuaaugaucaaaccgggagguccccuuguggguggugucaucucugggcugguaguccuggguucuauaagagagcaggcugagcaagggagcaggggaagcaagccaguaaagaacaucccuccauggcucugcaucagcuccugcuucccgaccugcuugaguuccaguccugacuuccuuggugaugagcagcaauguggaaauguaagcugaauaaacccuuuccucuccagcuugcuucuuggucaugauguuugugcaggaauagaaaccuugacuaagacaaaagguuuucauuuaaauacauauaaaguuauauuacaaaagugcauauaugaaaaauaagccaucacaucauugccguuuugucaguggugacacuaaaucuaauuccguuacuguucaggacaccucuuaugcugucgguucucaaugggcacacggacuguguauacucacuacugaacaaaggagcaaauguagaugccaaagacaaguggggaaggacagcguugcacagaggggugagccaaaauuaaacauaaaugcauuauaugcgugugcccuuccccacacauaguguguuuaauacacccaaauuauuuuugcaggcagugacaggccaugaagaguguguagacgcauuacuucaacauggugcuaagugcuuacuacgggacagccggggucggacacccauacacuugucagcagccuguggacacauuggaguucuuggagcccuuuugcagucagcaacaucuguggaugcaaauccagccguaguagacaaucauggguauacagcacuucacugggcuugcuacaaugguuaaguaucagauaaaaaccugcuuugagugucugccuacuggguacuaaguaaacaaaaacaaaguccuuuaucuugauaaagagaagucacucauuuucaaaaguguuugagauaagccuuacauuuuuuuuuucuuucaacucacuuggauggaagucuaauaauuauaccacaguagccagauugucucugagucaaaggaauuaccauaaauugccacggaaguucaguuuguuuuuauaauaugaauuaacauuuugugaguguaauauacugagaaaguauccacagaugggaauuuuauguaaaaaucagugagauaagcuuuuaaggcaauuuuuuuuugguuugguuugguuugguuuuuuuaagacagaguuucucuguguagaccaggcuggccucaaacucaaauaucuaccugccacugccucacaagugcugggauuaaaggcgugugccagcacuaccuggcuaaagcaguuuuuuguuggcuaauauauauauuuuuuaaauauaucaacaguggcaauuaaccauuaaaaaaauuugcaaagaaguauguuuccaagguaaaacauguacuucucuuuuggugauuuacuuuguuuuacaacauugcucacaguaaaaucaagcaaguuuuuuuucucgaagugguuuuagaaaagaauuagcuauauacuuacuaagcuuaaaguuuagaauuucuguauguggaaugcuuuuccuucucuaucgccgauggacuugggcuuucuaaguacauucuguaugagaaacaagcagacgugucugacuuucagacgggcaggguuuuagugauuaugaacugagcuggaagaagucuaaaaugaaugccucguuuauagccaaaugauugccuuacgguaauuugacauuuuaaaaguguaauauauugaaugguuuuacuaugauuaguaauucuugcacagaaaaaauagaaacacuccaguagaaucaagcaaguuuuuuucucgaagugguuuuagaaaagaauuagcuauauacuuacuaagcuuaaaguuuagaauuucaguuuauauagucauaugcuuguauaauuuugaguauuuugauuaucucauuuauuccuuucaaaaguuaacccucagaaauagcucucuggaguauugagagaaauggugagguugucggcucagcuccacccagugcugauucuuggagauaguaaagcagcccuugcccagcucagggugagggcucuguauuucuuggugucaggauuugacaguuucagcuauuaguaauguugcaauguuaacaggaacugagaaguuuaaaaaucuucacaagaauaauuuuugugggauccacaaaaagucucaucaaguaaaggcacuugcuaccaagcauauuugucagcauaguuguccuuuuuuucacaguaucuaguguuuuaggaaauuguccuauaugugcuauuuuaaaaagauauauaccauuuauuaguugaaaaggaaaguugcaaaacaaaacacgcuauuugaacuguaaaaaaaaaaagugugcaggcagguaugugaaaaaccuaggaauuuucuagagccuuugagaucaguaguuacauuaguuaugcucuaaggaguggagcuacagucaagcagggacuuaaacuuuuccuucucaauacuuguauguacuugagauguugcaaguaugucuuauauguuaauaucuaguucuuaugcaccuauuaggucaugagacauguguggagcuacuuuuagaacaggauguuuuccagaaaauagauggaaaugcuuucagcccccugcauugugccguguaaguaaagccuuagugaaucagauuuauugagguguuuugagaaacauuguuacugugacacugauggccuuguuuguccaggaucaacgacaaugaaggugcagcugagaugcugauugauuccuuaggagccagcauugugaaugccacagacucaaagggaagguagggccccgauuaguaccauccagcauuacuuucaacaggagaaagcauggggacuauuggccuucuguuugagagcuuauagagaacucacaacuaauugaaaacaggauuuugcagauguaaauuaucaagucuuaaauuuuucacauuauuagggaauuuuaaguuuugucacuuuauuuuaaaauauaaagguuacucuccuauuuaaagaaauaugauuuuaaacucagagaaaauugcuuaaaaaguuaacaguuuucuaaauuggauuacagauugaaaaaacagugcaacaauuguaauaaguagucguuugggguaaacauuuauuucuguuaaguuuucuucagugauauaguguuauagucuuauguauaguucauccuuauuuagacaaguuguaguuuaagaguuuuuagauuauguaaaguauacauaucuaaaauagaaauuagucccuuugagcuuauuuguuucuuagaaugcuuuuguaacauaaugaguaaacccuugaaaacuuuguucuagucuaaggaauaauuguuuccaguauaugugccauuuagcuugugucacguguuuuacugugucccagaacuccucuccaugccgcugccuucacagaccauguggaguguuuacaacugcugcucagccagaaugcucaggucaauuccgcagacucuaccggaaaaacaccucucaugauggcugcagaaaacggacaaaccaauacaguugguaaagaaacuaucuagagauguagaaaugccccuaguuugagggucagccuugguuacauugugucuccauaagaaaggaaacacugcuuagaaccaagcuuaguuuguuccuauacacucugcugcccaagagccucucagaagauuauuaguagaaggggacucgacucuggacuagguaauaaagcacaacccacgaguuaaaaaccggggugggggguagcugccagaauucccuguguguaacuuagcuucccagugcccucaucauuccacauuucauuuuggagcauuacccuuucuuuaucaggguaguuuaaccucaggauuuaauaacgguggcuauggaaccagauugcaugagugagaguccuagaucuaauuaauugaccuccugccucaguucuuucacuugcaaaaugagaaaaaugacagcaucuacuuuaaaagaucauguaaggguugaauaaguuccuauaaaacuagagcacauaaaacaauguuugaaauuuauuaacacuccaaucugauucguauaagaauauaaaaguucccuauaauuauaugguaaugugcauuauaguguuuaucuugaauuaaguauuugcaagagggauauuuuuugcucuaugucuucguuucucuacagugaguuacugguaauuuaagaaacauguucauaagcauaagaauugaugcacuuuuuccucccagagaugcugguuagcagugcuagugcagaucugacauuacaagauaagaguaaaaacaccgcccuucauuuggcuuguggcaagguauguacauaguuuaagaauggguucucauaguuacuguugauggacuuuuuuccaguucaccaaaaugaccagaaauaggaagcaaauggcuuagguaggugagguuacaggggaguguuggcuuaccagguuuugaaauacaagcuuagcgcuucauauugaccugucuucucaguccuauuucugauaccuguggguagauacuuaggacauuaccuuaggaaaauuguaucugugcguaauauuguacauauauuagagaugguuggauuuauauguuuauucuuuauagugagauguuuuuaagagcuauuuuccacaauuuuagggucaugaaacuagugccuuguuaauucuggaaaagauaacagauagaaaccucaucaaugcaaccaacgcagccuugcaaacgugaguacuuuaaguaucuaacuaaauuuagugaucucuacaauuuauaaaaagguaaaugcacuuuuaaaauagaucaguuacaaagcauuuaaagaauaguuuuuacaguugucagaacucauuucugaaaccauauaacuaaaagcucuauaauauuaauguugcaacauuauuacaauuugaaauuacagcauugauaauaauggucuuuuucucagucugcuuauucauuuaauuuucuaaaggaagguaaugcuguucugaaaagugcuauucauacuagcuuucucugucucuguguguguauguuauaaacuuaaagagguuuccgaaagaaccagucucugaguauaagcaguaagacuugaguuucacugagaucuuaaacccaggucucccaucauccucuuucaauuuccaguuuaaaaaaagaaaaagaaaaaaagaugggaauaguucacauuccagguuuagucaaaucccucaaagguccaaauguuaaucacuggaccaguaaacaucuuuuaaagacuauuugaauuugugauacugcaguauaaaaguuuauagccuugauuauguauuuguuaacuucauuucuuaaaccaguaaguuaagacuguagcucacccagucccaguggacacauguauaaaaugcuccugccccuaagauucagggaacauugugaaagcaggggcugaaagaugguaagagcccgagagucagugugagugagagucagugccauguaguaaggucagaagcuacaccuauacagucuugccaaaaugacugccucaacaugaccucaauagccaugccaaaguggaccaggggaagccaggagggccucaaccccuuacaaagaacuaccacugcuaccuaaggaauaccaagagugugaaaugaucuucucuggggaagagaacaucaauccaacaccaguggucagcccugaagaaucuguacaauagacacaagcagcauuauaccaacccagcaaguuauagauagcaguguauuuguauacacacauguauggaauagcaauaaaugaaaaaaagagaccaugaauuuggaagaaagcaaagaggaauauaugggaggggucuagaggaagaaagggaaggggaaauuauguaauuauaaccucaaaaauauaagguauauauauuagaauguaguucauuggcuagcacuuugaauauggagucuuagacgguccagugguuugaugaggucaggagcuacugcugcugaccaaggcugggcuggaggugcugcucuccguccugccuucacggauugacaacuggaggagcucggguuuguaucucuaggucuucacaacuugcccaaguguuugcugacagccagguguguaucugucuguucacuguacauaaauguacaacuuuuucccacagaccucugcauguugcugcccgaaaugggcucacgaugguuguucaagagcuccuggggaaaggagccagugugcuugcuguugaugagaaugguaaguaggcuccaugggccuccccucggccaacuucuuggagcuuuuuucuuuugauggugcaucuuugaaguaaagugaaguuuaguaggguuuuuauugggcaaggaaaaguguuggaauuaauauugaggaguucuauauaauagagaaauaagagcacgucugauaggugagcuucugaaugcacauauauucuguuagaugaagcuuaauauuuccuauuugcucaccacuauuguucauuuuggaacucaagguuuuguuuguuaaacaaauauuugccaaagcccuacuaacguguccuauucguagacaaagccaguccuucuacucuuaaauuagauucucuccccuuuuuccugugagagaugaucacuuuagcaaucauucccuacuaaugucacuguguguuuguggcauuggaaucaaguacugcgaguacucugccacugaacuguaugucaagccucucaccccuaacauagagauauuaguucugccaacuucagagaucacacaucucacagccucugccagcugcugcucuguuuucuacugccgcagaacuacucagaaacuggcuuucuguaggccucuguccccagcacacuguaacguggucagucaaaucucguuucaguuggcaggccagguuggguaugugaguacccuuuuugguaaacuuuguuugcuuggcuuuuagggacuccacaccagugcuggagaguccaaggcuaugguccuugcugcuuuucuugucugugcuugcccucuagacgauccucucuaacccuugauucugaaaauuccuugcugagacuugcuuacuuuuuauuuagaagcgaccuucucugugucugcauucauaugucugccugucugucugcuuaauuaauaauaccaugcagaugucuaauagaacuaucagcccuuuuuccuuaccugcugcagacuuacccuggugucaguugacaauucucuccuucauagcuugaggaguuguacuugguuccucucucaugcccacuguacaguccaucagcuuugcuacugauucuuuguuuaaaguaaguguaguaucuguccuucuuuuucucugcuuauuacccucacugguaauuuuuaaaacagaagaaguauuucucccaucaguuuuuuuauaguucucacagugaacuacaaacuacuccacuccuuuccgagcuuguuuccuaucccuguccuuucugcuucucucuucccuuccaguuccucucccguggaaucagugcauacauuauaaucucuguuuuagcucugucuucugccuggaacacucugguguucaucuguuucaagucauagcucaaauuccaucuucucgaugaaagcuuaacuccacuaaccuaucuguguuacagcauucuuagucccagucaucgugaucgcuucuucuuauuuucaguaaaacugucuguguaacuuacugaauauaaugugcuuuuuuuuuucauguugaagugacucuuccaugagaaugaauaugcgcuccguaagagcagaggaucgucuuuguugucuauguuuacugauaguuucugaguauuagaagauggaagugguagaaaaacaaaugcccaguaauuagauguauauacugugauaugaucauauauugaaauacuauacagcaaugaaaguuaccugacuauaguuaccugugacaauauuaggucucacauaauuaaucaaaagaagucaaauuuuaaauauguauacuauaugcuuccauuuauugguuuaaaaaacugggcaacaaggaauuuguuaccacagaaagaaaaggucaggauagugguuacacuguggaggaggaaaagacaugcaguguuugugguauccggcugguggcuauaucaauauuuggucugugauaaaucauccuauuuuaaaacaaguuaugucuuuuaaaguacguauuaugugacugcuaaaacaugagcacaguaauaugaaaaauagagcaacaguaaagcuagucuaaaauuucaagacaucuauaacauuagcgccuuuuggcugcccauggcuuaaaacaagggcaacccaaacuugaugugggauaguuggaacuugccgucacaguaggauguuuaccauccucucucccaucucagccacaagguuagugcuuugccaaccaagguaccacaugcguuauccauggcuuucccauugaugcuuggggcucuuuauauuugaggaaauuuuuuggcuaaguugaaaggaaauacuugucuggaauucugagcuuuuaacgcuuuguuuaguuuaucauuuucucacaaggcuguaucuacccaguggguucugggaacucgcucuuucagcaguggaauuuuaagugcauaccagcccgccuggcuucuuuaagagggguccaggacugugcucagguucucaugcuuacaagguacuuuacccacugagccaucguccacgucggaggcccacaagcacaccaaaauucugacuucuguaauucaguugguauguaguuagugaucaucuccuuguguuuaauucauaugcuuccauguuuagauggucaccauguagaaguuaacuuagacaggugugaauuacaguaagccucgacucacuguucuaaaggggaucggcugaugugcguuucuugggguuuuuuucuucccuuuauucuaagagugcuccaucuuacccaucuccaacccagagauguugggggaaguacccauugugaggcuuuaguucccgcuucuguuacuuagugugaaagcucuccuucuaccucacauucuuagcauuguaccucuuccugcuuacuagacaguugugaauuuaucuacucaaaguaucugcuguaagccaucaaaucugugugugaagauggaagaucuugggauguuaacuuuuaaauuuuaaauucaauuauaggcuacaccccagcuuuggccugugcucccaauaaggauguggcugacugccuggcucucauuuuggccaccaugaugccugucucgucaaguagcccauugacaucccugacauucaaugccauuaaccguuauaccaacaccucaaaaacaguuagcuuugaagccuugccuaucaugaggaaugaagccagcuccuacugcaguuuuaacaacauugguggcgagcaggaguacuuguacaccgacguggaugagcucaacgacucugacuccgagaccuacugaaaggccgagugagcugcagcucuaaggaaguucugacacugaaacuucaaaucgggcuuuuucgggaaaaaggcacuuucuuaucauacacagauucaaccugaagaaagaucaugcagugaacgaauggaagaaacaugaugacauuaggaagaagagucuuaaaggcaaguuuugcaaaaggaacuucuagaaucuuaauaaugacuugaccaguggaaaacacagugaugucgauugcuuugugggaucguuuaauuggcuuugcagugccagaaauugggacacugcucccugaccugcuuacaugggcaacacugcuguaaagaaagagaucaaaacacuagauuaaauuuuacccauaaaauuacagcuaaauuuuaaugcaauaaaaguuugguauaauaggcauuauguacacaucaaauugccaaggaccaaauaacauacagauuuuuuuauuagaacuccauuuuguggaaacggaaauagaugaaaugagaagucgucuaaagcaaacuucagugcuucugaaagugaggccagauucgguuugguguugguuuuuauaagaaagcaucuacuguauuaagccaugagaggaagcagauguauuuuuacauuuuuuaauauaaaaguuuuuaaauuccacuuuuuauagacuucagaaccaguuaacugggugcagcgugguugaaaguacuagagacagacgcagaugaagucagggcuguugcccacgauugagugguuugcuuuuaaauugaauuguuuuuguuuaaggaauuccauagaggaaauuuuuaaugaauuuaaaaaacagacuauuucaccucuuguaaugcagcgguccuggagaagggacaucugagccucucugugcgcggcacaccugcaucacguuaguuacuuugggaccucuaccuuuuuuggcuggaggaauucuauugucauuuauuuuaaucuuugaacuuuaaaaacaagaaucaaaauuuuaaaaaguuugaagacucuuguuaugaaacauugucgaaagcugguugugaauucuauacaaacugggauuguaaauguuuuauguaaaagaaaauacuuaaaaauguaccugcuuccucuccugcguccucacagcacuggaagguucuugaaugcauccuuuccuuuguuguuguuguuguuguuguagucguuuguuguuuuaagacagggcucucuauguguagcccuggcuguacuagaguuugcuuuguagaccaggcuggccucgaucucacagagauucaccugucucagcuuccuaagugcugggauuaaaggugugcaccaccacugccuggcuucagauguuuucuuuauaaaaaucaacaucaaaccauuuggcuuccuucucagaagcauuggaguuugcuuuagaugaugacucauaacauaaacagaaucaggucauuuggaaggcauuucuguacugggcaagauuuaaaauacuucaggcuuuagguccuccugagaucuagaguagcgggugugcagcuucuuacugucagagcuugccugccaaauugaagacugccuuucagguaacagagaagaggcugacaguaggcuaauuuuaaauuacacuuuucugugguucuuuuauuguaacugucacuuucccaguaacaaugauuuuacauuggggggaggggucuuacuagagcuggguaaaguuccauacauugcaacaaaaugauacccaauuccaucuuacccuuuuuguauugugaaacuggaacuuuaugacauuguaaauuaucagcugguuuuucugaauauaaagugugaaaacacagaacaguauuuugaucuauuugauaauuuuguggguuuuuugaagaauuaaugagcauguacauagaaauagugacugcuugaauccuguauuuacuugcacucuuucaguacaucaagauuccuguauauuuuagaguauaauaaaacacagacgugagcuguauuuaaugaauaauguauuuguaucugugcauauuacuuaaaaaucuauaaaguuucuagggcauugacuacuagauuuuaagcauuuuucuaaaauauuugcaaaauuauaaauauaaucuccaucuuuucuuuauaauauaaaggagucguaaugaacccuucguaauuaauagugggagaaggguaaauaugcauuuuaaaagaccguagacuacauuucuauuguaccuuuuaaaaaagaaaacucaagaggauucuaaaaguauaccauaugugugcuuucucuuuccuuuuaggaauucucuucugaauucccugagggaauuuucuagaaucucagaauugaaagagaccugagguccauccagucuaaccucuuaaaugcaggagucccuucuccaagguugucuuuccaccuugaacacuuccagugacuaccucacgagcaguccauucauuguugagcagcucuguuaggaaggucuccuuaauggagcugaagccucccuccugguaacuucuguccuugggcccagcucuguccuccaagggaaugcuggaaggaugacuuuccacccucugccaugucuucucuuucacaggcugaagugauuuccagauggacucauuagacacauugucugcacaucuauugaagucaaauguguagcuauaaaguaacaaacucaucuuuuaauuuauccucauauguauguagagaccaagauccugcaucacuuuaaguaaaacacucgggaggugguuugugcuguuaccagccgacuagaaaagcuguuccuuugugguaguuugucucuagcuugagcaacccacuuccuuuggugugcacuggaagagggaaauuuugaaguacuaucccagaaaguguugacuaacaccaguauuuggaauaaauacaggagcacagcauagcgccauacguuacuuuauaguuacauacaccuauagugugcacaaagcauugguccuggugggucgguuguguauuuauccucgcccacaaggggaaagucugucggccuuuaauuucugugagaaaggugacaucuaagauauguguuacagaaauaccagcuuuugcucagaaacaacuuugggggagauaacgaugacaggugaccucaaacagugccauuuaguucagagaucucuaaauguagcuguaaauuugggguuaauuuggcuucaaauauuggaucuuuuaaaugaaauaaaaauuuuuaauguaaaaaau

SEQ ID NO: 7351 - RNA, 804 nt, Mus musculus
ugaaaucaaauccuuuaaacucugaaaaaguguuuuuuacaagaaaauaaaauguuuuuuuuuaaguguuuuuuuuuucccuccuuuccccagacaucauaauguuugggacuucuuuccucugaguaguccauuccaucuccaaggaaagugauggcuuuaccuucagagcucuuuccgggagcccugggugaguucaggcaucgccuucauccacaccaacacagcgcccuccuuccucccuuccucuggcuggcugucagccuggucuucugaagacccuagaauggaaugaagcacuaaagagaucauucgcaaacagugucggggcacaaaugagcauggcuggucuucaauagcccagucacacucagugucuccccacauggcagccauuguucuucccagagcucuccacuacagaaagaauauuuucuucgugacauuucuuuccugggccuacaauucugacaggaagcaaugugauccauuucugguccaggaaagcagauaucccacucuguuccucuugucuccuuagacguccacaaaggucuccucccuggaaaacaaaaaggcagaaguucuauucauuucugcuccagaagaaagcacauagggggaaaaaaagauaaauccugugugagacucgggacuuccaaaccaagaggguguuucggagggcacacaucagaagagucauagcugugggagccagaagaacaaaaguggggguggauuaagagugaccagccgcugagaacugagguauaccagacuccacaugcugcagccugauguuug

SEQ ID NO: 7352 - RNA, 20794 nt, Mus musculus
acuaccgagaagcgugguagggaggccauccuaucgcgagaacucugucuucaggguccggauccuuccacggcuaagugucugggucggucuaagguccgcucggaucaccggaaggagcgcugccagccgguaaggacgagaguggccggcgggcgcgcuuccucuucugcccugugcccuucuucgcuccggccuguggccuguccugcccuccccuccauucuucccgacccucggguccgggaccaccaucccaccugccugcacgcggggcccaauggcccuucccuuccccaggucacgucugcugugaucgccucuccaguccccgcgucgcgccaggccagagcuccucucccuccccucgucccgacgcuaccacuuuuccuucaugcccaagcgcuggaucugucuucucuccucuguccugucgacauguuucguuccugggccacgauugcagccugaaugcuucucuuccaucccuuucccuacauugcccugacuguccucuggguuuauagcggugacagcccuguuucucuggucccaggcgggccugguuuccauuacugacccagugcacauuugccccuauuccuagugguuuggcaagguggaaugacuucuggaggcccacuauccguuuccuucucccagcagucccuuuaaaucguuugauucgucccuucagcugaugagaagagagagcuugcagaaucauuaauucauagcucgggcguucauuugcuauaugcuuaggguacugaggauauaguaauguaaagaaguggacgugcucccggcccugaugugacuuagcccuugcggugggaacaguauggguuuaagugcuacaggcuggaacuugggaggauggcucaagaaugacaagucagaggggcuggaguuaucugacccuccugcacacagcucuccugcuaguguuguuuaguagguaagggccugccacccuggcguccuuuuggaaggacuugacuuuccacccacuugguaauuuggaguauggucauagaccuuuugaguuacuucccuggguguguaugggacagguaaggcuguugguucuccguuagcaucccacugugauguuucugaacuuuuaaaguacauuagaacauuggaaagaauuucauccugugugacaaacaggagacuaauuuguacugcucagcaggucgcuugauuugcucuguggauuuuuuuguuuguuuaagaagagugucagauccccuuacaagccauugugagucaccugaugugggcccuaagaacugaacucuggcccuuugauaaccacugggccaucucuccagccugguuuguuuaguuugcuugagacuggcugcagggauccuguuggcucugcuggguuuacagacguacgugccaccacacccaggugauuugcucuuugcaagauuuacucgcccgaagaauuguucugcuaagugagauaauggguagcugcuggcacuaacagucccugcauuuagaucucuuuuuucuuuuuuuuuuaccuccucccuugggucuuugagccuuucggaaaauaaccuagacauuuaaaguuuucagauugaaguuugaugaugacgaacgugucugucucuacaguuacguuauucuuuugaggaaaauuaccgaacuacagaugaacuaagaugcuucuuaaagcaucuuguaucuaguuuuagaaguuaacuugacucccauggccaguuuaugaaagcagugcagguugcuugugucccagggaucuguauguaggucuuauagaacucugggugucccggcacacaccccuucugcacuugagagucucucagcuagcuuucugggccuuugcccacacaguguuaacacaccggucaguacuuauagcaacucacugagccuguuagccaccuuuuuuuaccugugcuucuuauuucagaaaucuauuguugucugugaaucaguggcacaaacguucugcuagauggcagauucaccaucgucuccacaggaacaacaccacugugccuuucuguucaagaccuuaaauacuugaaugacuacauaaaccuuaaacggccccuucaaaauaccuggugcagaugagggguuuagacucauacuagaucauagccaaaaggcuaagaggcaaccagacucagacuuuuggguguagaagccugugacuacagguauccuauuuaacccuguuaagccuauaagaguugcuaaguugagcucuucugcucuaggugugucaccagugguacucuuguuucuaugcuugucucuuagaggggcugucaguuguccucagcuugccuucugugacuguuaaaucuaacacuucagacaucauuuguaagcuuaucgucuguauaccugaauuagauagauucacaggcaagugagcuaaauaauuacuguguagguauucuguuuuuagcuagcaugaaccacucaucaggugcucaugacugucuuccuccagguuggcuuugcuuggcuugauugcgcgguagaaucaacauguuuuucugggggaccaggauugcacuuggggcuuuugagcuuguaguuccucccauuuggcauugccuugauugcccuacagaccgagcaguuuugguuuaguguugagugaguagguuaaaugggcuuagcuugugucaguaaguauagcauagucuuuuaauacguggacaauuacagcuuccaaaauaauucagguauguuuugaguuuuacuuuagcuauauugcuagucccucaggcaauuucugugguacuuacugcaaaaucugaggggggaaauguugaguuggcuguaaauacagugcacauuuuaaccaacaagcccauuguuauuuugaguuuguggaacuaagauuuuugggucuggcaguuuuaaaaacugccuuucucagcacucaugcuaggauugugauuucuguggagacaacccucaucaguucuguauuguuugaaaacaagaaauuaaguuuuucugggugcuguugcaaggguucuggaaguccagaaggucuaccaagaggcagaauacugaguucaagaccggcuugaacuacaggaaacugucagaaacuaagggcuagggcguggcuuaguuaaaguguugucuagcauauacaaagcucagcguuguaccuccaauauuggggggaaaauguguuggaaacauuguccucuucuaaauuacuuuccuaaauuaauacuacagguuuuaaggggacagcaucaaguugauuauguuuauaacacaaagauuuauuuugcagcugcucugaauuugaccauuaacacauuauuuauucauccauuaauaaaagauguauuaaagcacagguugguucaagaccaagcauugguacaagugcugcggguccuuuucuuauuuaggccaacucuguugcacauacagcacgcggggaagguuguuagugccaagguacagaugaucccaagcuguguguauagugcuguguguucuagcugggagagccuucaggguaagaaagcaggccugacaagagaggcauguauucaagcauugcuucucaaccugugggucuugacccuucgaggcgucaaugacccuuuuguaagggucacuuuagagcaucagaaaacagauauuuauguuaugauucauaacaguagcgaaauuaguuacgaaauagcaauaaauaauuuuaugguaggagguugagaaccacuguguuagcggguucuuacuggaaaccuguauagauaguaggcacaagagggcagcaugacaguucuauugccugguaauauugaagaaucguguauuugaccaggaaaggcuuucuauugcuuauaacuugaaaagcagacggcuagaagggacuaacguggcaugcuggcagaaagaacuuggagaaccaagcuggacaagacaggguggaaagagggacuucuuaguuuacuaaaauggagaugucaagacucagacuagcuguauuucccuuccccugguauuuuuggacagggucuugguguauauagguggcuuugaacucacuagcccaguaugggaagggugguuuuccugcuguagccugcuggcauuaccuugcuuaaauguaccacugacaugaaguacagagagcuguacauuuuucauucauuuaaucuuuguaucuucaccaaaugugcuauccaaacaggauaucuggaacuagcuguuucugucuuccuuuuguaaugaguguaugacuugggaucucaaacugcguuucaggguaaaggaggugaugcugaucugggauguuugagucuucucucaugguuuugcuuuacucuuaauguccacaaagucacuuuauauguauaggaaauagaaaauaagugucugauggggcucauaccuguaauccuaaguaccuccagagugcugagucagcucacaggcccuucccuccacucuguaaggcuggagggauucugaccacaccucaggaaagaaugcucuaauuagucugagugaagccaaguuaaugaguuuauuaaguagagauaagagauguccacccuucuguucuggcaguagacaucaaaggcauaggugaaggcgucuucagaguucugcacguacuugucuuuaccaugauuuaugcgguauugcucaaaaguugugauuaugacaaagcuuaaagauuaaguaagcaaaguuuaaaaguugaguaaaguucaaacauuacguaaaaaaaaaaaaaaaaagcugguuuaaagaacucguguuuguaaauggcuguggugguucugugaggcauguuguuggggccaggggugagaagaguuaagauggucaggaccucaaauaagcagagggcuuuuguuaauuuguagucuuugaaguguaccaggacugaccuggaguucuguggcagggcuuuaacucuggauccucuuuccuccugacuguugagauuacggguuugaguaccgcagcugaugcaauugguuguuucugauacccuuuucugaaaugccuuuaggaaaacaaccucuggggcuggagagauggcucagugguuaagagcacuaacugcucuucuggagguccugaguucaauucccagcaaccacaugguggcucacaaccaucuguaauaggauaugaugcucucuucuggugugccugaagacagcuccaguguccucauauacauaaaauaaauaaaacuuuaaaaaaaggaaaacaagcucuaucucuguaggcaguuucuguuuuaucauguauguuguauguugaaguuucuuuacuuucagacaggaauuguaaaguagaucccaaggugaggggcacguuucucuuucuguaucugccaguuucagcacucuggaaucuuaggcauuugcuagaggccagccuuaacuacgcagcaagaguuuuucuguuucuucccucccaaccccccaucccagguauuugcuguguaguuccagcaguccugaacucgccgcgcucuagaccagucuggucuuuaaaacagccugucucugccauccagccaguaacagcuuuucuaagcguaaaaaggaagaagucuccuaacuaaccaagucaaaauagcucuggggagaaccccagucggcugcuggaccguuaucgcggucgcugcgggccccgcuuguucucuguaguuagugacuugcugcugagaccucuugaccgccgcugggcccggggaggggcugccgaaggccccagccucgcgcccacggaggcccuguggugggcggaguagcagguguguuugcggagggggagggagacgugacgcgcgcaaggcggggcgugaccuggccgguaggguauaaaccuggccgucgagcguguucucgcagcaguuuucgucgcggggccagacuaccugguaagugugccaccugggccaggagacugcgcaugcgugcggggagcccugggggaccaauuucauuagccgcuccuagaaagggcaacgggaagccuagaaagcuguuugagucacugcuacucuagcuuaauuuuuuuuaccguucgguuuuuaguuuuugaaacagaaaaaccuuacuuuaguuuugccauuagguggcagaauuuugcagccuuugccuuuuuuuuuuuacaccccccccccccccccccaguuacugcuuauagaguuuaugugcuggguuuaguagcuacuugugaaagcaagcuagagggcuguggaggcuaaagaauuugaacuggacuuaacucaagaucuguauacucuuugagauaaugugcugugauuaaaaaaccccuuuucacuggaagaagaaacagcaagugaaggcaagaaauggcucaagguaaaauugcaaaauaaccacguacuguuacuaaauugauagcuuuuucacuccaaguuuguacaaacggucuccuguaggcugucucuucaaacauaauacaguugacaguauuuuaagauaaauauguguguguccuauaggucuccuauggccucuugacucaacugccaggaaaaucaguaaaacguggaggacaguuuuuuagagguagagagauuaucuauuccagccaggggagguggcacccgcuuuuaaucccaguacucuggaagcagaggcaggcuuggucuacuuggugaauccuugcauuaaauuaaaaaaaaaaagauaaucuauuuuaaaaccuugauuuagucaacaaccaaagccuggagugguuaugauuacccgcaugcuggaacugaagggucucuuccuccauccuuucagcuggacacugggacuugguaguauuuggauuauucugaggcuaucgugacagugcugccuguuuuuguaguugcaauccaagguagaugguucuggaacacugcuuguaauuuaucaaggacuauaaaauguauugagacucuguggaaauuaauaauaaacccauagaaacauuaaucugaaacucuaauuuuggcaaauacaauucauggguugagaacccuuguucuaaauccaagucucacccuugugcuuguggccuuuaaagggccauuuaggggcuggagaguugguuuauuuagcgugugagagcacuugcuugucuugcagagcacucauguggcucaaccaccuguaacuucaguuccagggaucuguugccuuuuggccucuuaaaguagaaggugcacuuguagugcacauagucuuugcaaacaaagccugugcugagcuccaggcucauucaguuuuuacacacacacacacacacacacacacacacacacacacacacacaauguauguauguauguauguaucauuuauacuauguaguccuuuggcuucaugcaugaaaugugggucuaguauuaaaauagcaagguuuuauuuaacuauauuauugguguugagcguugaacucaggaccuugagcaugcuaaacacuuuacuguggccccaguaagcuuuuccuucuuucaguuugugguuagugugaaucaugagaauuacagcuuuuggaaaucuuaugguuaaagcaugugauauaaguuaucuuuaguuugugguuuguugcuaauacuggcucaaaggucuuuggacuuaacuagaucuguaugcugcauauagauaccguccccucagcuugguggaguuugaggggugcaggggguggugaugcuugagaauagggugugcugcuuuuacguuucccaguguucuaaaacuuaguacagaguguggcauaugccuguaauccaaguggcuggguggcggaaaucggcuugugaaguuuaaacaagaugauuuauuuuuugaagggauuuuuuauuuuguugagacagucucacauuguagcccaggacgccuuagaauucaguauguaacucgggcugggcuugaacucuaugcaguuuugccuuagccuccugagugcuaagaugugccaugagccaccauuuguuuugucuguguccacuccugggaacauguuuguaguuggauuucaaggacuacuguuaaggaucuaguaguacagucuaaucuacuuauagucaaguguuucuggcuuaucuagaauuguggaggguuucacauugugaagcagaauucuaauuaaaaauuucauggugucaggcauuuuaguauucuacacaagugaggacuugagaagguugacacagguaaagacaguugggaaaauaguuacauaggccaugcauggcuaacuucagugcaguguggaaaugggggacacucagcguuucaaaccuuccaauacuacugugauggcaguuacccuacagugugugcccaauacacuugaagcccacuuauaauaugagauggaaacaaauuaauauagcugcuguuuccaggauuaggaacaauuccacaggggcuucugacaaaugcaauugaggaagcccuuucuucuguaggucauuguggguaaacauacugagguagcagaauuagcaagugggaaguuagaaaauuuccugaacuuugaguauuggguaggaacucagaaguuccucgaucugagcccuuugcugcaggggaagaaagcugcagagcuuuaucuuucugcuagcugcuucuuucuuuguuuacaaauuaucucguguguauggguggguguuuugucugcauuuaugucucuguaccucgcuuacauuacuggugucugaggacccucugagacuguaccuacagauaguugugagccaccauguggaugcuagaaaaugguccucuggaagagcaggcaguacauuuaaccuaccuagccaccucuccaggccccuagcuuauuucugagggugagaacucaguauugcuucuguccagcuuucagccugagaggaaaccuggucuuggucaugcugucaaggccaguccacaauucugccucuccucaaaugggcagccagccauugcuacucuauucauugagcugcaugcugccuuagagaccaaagcaggcuucuuugaagucauugucuucaggauuuuaggaaguuuguuaagacaauccccuccuuggagcuauucugaagucugacucuacuagacaggucuccaaauguuggagagguguaaucauggccucccagaguugcuuaucuaggccaaacagcuuuccuguuuggagauguucccccuccgcccuccaugguuuugagcccuccuucccuuuuucuaaaugccuccauagcaugucacuaacggccuaaugaucauaggaccaagaagccuugugacaaauguauccaaauaacacaugaauuaaaauuuccgaauauccaguacaguaguaccaagucagaauuugccuucaacaucuccaucuuuuauuuauuucuuuuuauuaauucuuuucuaacuguccuuacccuucaaugcaaacaaguucuuuuugcuuuauuagguuuaaagcuacauagaaauaguuuuggagucuguuucugucacagaucuauguuguuucuaacauuugccuuuuauguuuucaaucccaguaauuagagaaaacagguauucauuaaacaaacaagcuaacaaacaaaacaaaccgcuguacacaggccugguggccucuuuggggcugugacugucgcuggcuuuacuuacuguguagcugaagauggauaaucauuuuaccuuuaauucuuagucuuccucccucugauuuaggaguccagaaguuccaggcauaccuucaugcagguuucuguagugcugaggauuaaaugaaggcuucaugcaugcuaggcauucuguguuuauaccuuaauucuaaaucugucccagacaaccgcgguuguccucgcagugaacguugucuaguccgcuauguggcuuucugacacuuuuuguuauucaccugguucugucaugugcuccuccccaccugugcuuuucuccagcuucugcuagugaacuccggguacuuucccacacuaaauucuuuuuuagaaagcuuuuauaucuaaguuacauagaaucguuuuguuagauauagcuuacuaaguauaauauugucuguuaaaaaaguauuuuugugugucugucuguccuguuguuauguggguacccaaggaagccagaaaaggaaguuagcucuccuggaguuguuguuacaggugguuguaagccuccuagcagaggugggugcugagaacugaacccagggacucacacguggugagagaguuacuucuacacugagccacauauguaguucagaaacuuauuagugauuggugguuuuguuuuaguuuuguuguuuuuuggagacaaggucucaaaaccaaugcuuuguaguccugcuugcugucaucuccccacuuccagcacuacguaggggaggagaucacagcaagcuugauguucuucuaacauucucacucgcauguguugugcuauuuuaggaccacuaguguuuuuuuuuucucagauacauauguucacauguagauugcccuuacauaaaauagacagaauuuucucccucccucccguuaccccucgcuccuuucuuuugcuuucuuuugagacaggguuucuggagccuuggcuguccuggaacucucucuguagaccaggcuggccucaaagucagugagacccaucugccuuugccuccagugcccccucuccaccuaaacgcuuucuagcagaaauagguuggugaggaagggagaauacauguguuggaaucaccaaaguuguuaguagugagagccuuuugggccaugauugauugaaagaugguuuggggauguaauuauggugcuauuuagauuucuuucuuuuacaggaacagugagcagaaugaacacaucccuggaacagaguggcugcuacaguaauagagaaacucuucugaggugcagugaugcaaggagggagcuggagcuugcuauugguggaguacuucgggcugaacagcaaauuaaagauaauuuacgagaggugugcugggugcuuuucucuuccuuggucuggcuuuagcacaagggugguuagaguacagcaaaggacuccucagugucacccagaaagcuugaucccauauccugaguggucuuaacccuaauccucugccugguguguuggagcuuuugaucucauagggaaauaaguccugcuggaagaaucugggaaucugacuguagaaugcucuucagcacaugguuuucauugcacuuuuguaugguucuuguacacagucaugcaagguaacagaguaggcaguagucugccuagcugcaguuuuaauuuauugagacagggucucucucuauaguucugacuggaacucucagauuugccugacucugccucccugggugcuagaauuaauuaaaggcgugugccacagugcucaggguagcugcaccuuuuugauacauaaaauaugucacuucauuauguccccacuuaauuuguugguaacaugauuuuaaguaguguagucucuaaacuacugucacuuugcauaucagaaugaauuuuuuuaguuccaauaguauucugcuggugagugcuucaaguuguauaugauuuagaaaaccuuucccuacccccaaaggggaacuuugugauauacuuaugugggugcccaugugauuuauaggugucuugaauuuucccucagaauuuuuauauauauagacaaaaugugaauugcuauauacguucuuaggaacauuaguuaguuuauaauuagucuaaacuguuaauccuaauggucuccuugcuuucuggaauacucuaaaggacuguuuauuccaugcaagugggaaaagcacacagacuaacuagcagcauaucuuuucuuuugcccccccccccccccccaacaggguuucucuucccguagcccuggguguucuggaacuuguucuguagaucccucuaauauacagauaucagccuuccugucucucuaaugcugggauuaaaggugugcaccaccaaguuuaucaaugauaaauuuguaagacuauauuuuaaaguucauggaaagcugaggggaauuaguauccuggcauaacuuuuucuuuugauugcugauaccccagauaagucuaguucucucaggaggaggagugagugaaggaguuuagaaguuagguauggcuuuuuuuuuuuuuuuggcuuggauucuuuaacuaggauucauaggacuucaugggaucacugaaauuguaggcacauuuuugaguauagacugaaaagggaagacccuucacaguggccaguaaauauaaaggauuucugacccucagaaguuuaagagcaugaacauuuuaugggaauugucauucuuuggcuuauagcacuaguuuauguuaucaugcauuuccuagguaaaagcucagauucacagcugcauaagucgccaccuggaaugccuucggagccgagagguguggcucaaugaacaggucgaucucaucuaucagcuuaaagaggagacacugcagcagcaggcucagcagcucuauuggguaaggugacuguguuugagcugccuucuccauuccagugaauguuuucucugccuucuauuacuaugucagauaaaagucagucuaaaaugguuuuuauuaguuugaauauuucugguacuuuuaauaucuuuguggcuagauguuugcauuuuucuuguagcuaaugggccaauucaauugucuuauucaucaacuggaguauacucagaacaaagaucuugccaaucaagucucugugugcuuggagagguaaagacuuuuuacuuguuuugacucuggucuauacuaguaggcauuaaagcaagucauuuguaacucauugucuguguuggauuuaacucaacuuuguguucuuguguaaaaccacccuaccuuuauauuuaauguuacuugcugauacugauauuccuugaaaaauaccuacauuuuaucauuuugguagacugggcaguuuggcccugaagccugaagauucaacuguccuacucuuugaagcagauacaucugcucugcgccagaccaucaccacauuuggaucccuuaagaccauuguaaguaauguuaauuucagcuauuucuuaggucacuuuucgggucucugaccucauggaugguggcuugcuagaggcagugaccuuuagaaaugugacaguaagcuggcaguuuggagauuguugcugauucacugagaauacuuagagcucauuuugacacauuuaaacauaaauguuaggaauuuggacaggcaaccgaguauagucucaugagucuuguuuaaaucgagguacugcuagguauagggaagacaucuuaugacacagauaaugcaaagcuuguaagccauuggauuuauaguggauaguacuuuagugaaaagagaauuaggauuaugcuaucagguuuuuuuugauaggagaucacaguguaaauaacacaguucucuucuuuucauagcaaaucccugagcaucugauggcucacgcgagcuccucaaguauugggccuuuccuagagaaaagaggcuauauccaggugccagagcagguaagccgcagcucugugucugguaauucucuugugucuugauauccauuuuuuuuuuuuaaauuugugaagagcauccacuugauugccucucuugaagcacugaaugucaaauagaaauuuaguuuuauaaaucuuuaaguuuuauagauuaaggagaaaaauaaucacuuuauuggaaauuccuaacauugcuacugacuuguucuugcuugaggauucucuaauucagagauguguuuguaaaagcaagugaauaaaggguugaagacaucugaguugagaggaacucuagcacucagacugucucccucagucugauuuaguaguuauauaucccacacuggcuucagugugcaaaccuccugccuuggccucccagagcgcuagguuguaggcaugcaccaccacuccuggucuuguuuuguaacugugaaaauugggacugguaggauggcucagggguaaaagcuuaacccuguagguuaccugaguucaauccguggaaucugucuaaagggaaggagagauccaaauccacaaaguuguccuuugaccucuauacacaugccguaccaugugugccuucucacgcagugcauuuaggaugcacacaccacagugccuguguggaggucagaggacuguguaggaucaguggauuaaacucaggucaaucaugcuugguggcaggagcccucacugcuaauccaucucaucagcccaguaagaaaaacauuuuaaauugagguuggggaaggcaugagacuuccuuaagguuagugguaacccuagguuagagugcuuggguuccuguuucugcuaaguuuucucuugcauuuguuaaugccuuguuacacaacuaaguguuucuuuuuuccuuucuucauggcuucaagaagucagcauccaguggcacagcuguaucucugagugaguggcuucuuguaagcaaaccugccauuggucuucaggcuccuuauguacccaguaccaacccacaggacuggcuuaucccaaaacagacuucagagaauagucagguguguagcugccuuuauuguuucugagguagauuggguuaacaguaauuuguguuucugagcauuauuuaaaaguacauguuuuuaagucuuuaauuacaauagugaaauuacuucacuauagguaggaaguuuagaaaaaaaaucuugcaacauacaaguccauaauccuaagugaaaugacaucaucaagauauuuuuguugggauccaaugcccuuuucugaugugucugaagacagugacaaugaacuuucauacauaauauaaauauaaauaaauaugaaucuuaaaagagucacucaagcuguguauacauggcuuaaaaaaucauuaaaauuuuuuuuuacagcauuuuucuguauaugcauguaauuaaaaauaauuugugccaggugaugguggcauauaccuuuaaucccaagcacuugggaggcaggugugaguucauggccuaccuggucuacagagcaaguuuuaggacagccagggcuacacagagagacucuaucucaaaacaaaaccaucauucuguauuucauuuuggcaaguguauaauguuugaucacauacaauucgauuggcugaaacuuaagauucuguucccuaaacauuuaugagcucuuaguucuuaggaguaaacuccuauaaauugaauuccuagguuacuauucugccuauauacccuuuugacuuuugauacauugugccaguuugucuuucuaggaaguuaaugguugauaauaaguggaguauucaccacugucuuacuuuuuuucuauauucugugaagagaaaccagguccaaaacaacuuacaaaagaaaacuuuuaauuggguacuuguuaaaauuuaagagggugggugaguucaugacucaucauggcagggagugugacaguaggcgggcauaguguggggcaguagcugagaguucacauuuuaucugcaaguuggagguggagguagggagagacagacaagacacuggaccugggcuuuugaaaccucaaagcccacacccagugauacaucuccuccaacaccacauggccuaguucugaacagccuaccuccuggaaaccaagcguuuaaauagaugagccuguguggccauccucauucaaacugccagccaccaaaccucuccaauagugguaguaguuuucaaguuuguuucuuugauuuucacagaguaucaauuuugcuuuugaagcaguugaauguuuuuguuuguuagacuuugaaugucuguccuaucacacaggcauuauaccaagaauacauuucauuuucuaaaaccuaguacaguacuuugaaaagauuacaaaaaugggauuuucauuuaaauguuuuaguauuuuuuguucaggaaaauuaagcauuaauuuuggguacuuuuauagacuucugccagagccugcaguuucuucagcgaugccuggggcaaucugaagggcuuagaaaauuggcuccuuaacagucaucaacaagaaauugcuggaaaaccaaguuccucaaaauguaacagccauuguagcaccaguucuuucucuccugaagcugaaaaggcugaagauguagagcuccuugaucaagacgagcuggaccugucugauugguuggugacuccucaggaacccugugagcuggagaagccuguggauggcagcugggaaaccagcgagaaguuuaaacucuuguuccagguguucagagagcccuacaaugugagugauuggcuugucaagccugacuccuguaccaacugucagggcaaccagccuagagguguggagauugagaaccugggcaaucugaaaugccuaaaugaccacuuggaggccaaaaaaucagugucgguccccggcgcaacaaucagcgacggcuggcuugcccagaaccaucaggacacauggaaaguagaggaaguguguaaagccaacgagcccugcaccaguuuugcagagugugugugugaugacaacugugagaaggaagccauguauaaauggcuucugaagaagggaggaaaggacaagaauggaaugccuauggaaccuaaaucugagccugagaaacacagagagucccugacacuguggcucugcccuuccagaaaugagcuaacagaacaagcuaaggcacccaaggcuauggcuccugcuagaauugcugauuccuuccacgucauaaagaauaguuccuugucagaguggcuuauggggccuacgugcaaaggaggcccuaaggacgugccuaauacagaggagagagcuggcaaagagaugcuucaaagcuccauggccacuuccuggugucccuuuaacacugccgacuggguuuuaccaggaaagaaagugggaagccucagccaguuccccucuggagaagauaaguggcuacuucgaaagaaggcacaggugaguagagaccaaauuuuucccauuucagucauuuaauuccugcuaaguuuggaugagguaguaauuuuccuaagucauaagagaauaacuuauaacuugcauuuuuuaugaguuucucagguccuuagcauucaagcugcaguaaagaugaaaguccaaccuauuuuguuucaaguugcaaccuuuguucuugaaaaacauaauuguucuuaaccauuugauggggaguuuagucccaugcuuaccaguagucaucuuuuuuaucuucaugcaggaagcauuucuuaauucaccccuacaagaagaacguaacuuucgccccgacuguuacggccucccagcaguuugugaucucuuugccuguaugcagcuuaagguugauaaagaaaaauggcuguacagaacuccucuacagguagguaccuaccugcauuaguguuauuguaguggcucauaaauguuuucuucuuaugaacuuauggguuccccccaguaaaccauauuccuguuaauuugugcgugaauagaagucuuuuaaauuuaauguaacugugugcuaucaaaguaaaaugccugacaaucugaguucaguccuuagaacccauuaaaacuagaacugauuccacaaaauuauccuuuguccuccauacccacaccauaaagcacacgcgcccccacgugcaucauacaaauaauaaaacuaaaaauaaccuugaacuuuaucuuacuuuucaauuuguuaacugcccauaauuuucuuauucccucauggauuguggguagcuuaagauuugagucuauuucauggugggaagaauuuugcugucggugugaacugaaauuucuauuggcuuuucuuuacagaugugaaggaacagacuaccagaaucgagcagcuuuccugcagauuauugcacauccuugagcugagugacugcgauuugccaaaccauugugcauuccaagccugacuagucagcuuaguuccucuccugcuuaguuuugaacuaguaaacagaagucauaaacuaugaguuaagucugugaaagaggcuucaaguggaggugauucauucuuuugaaagccguaacgugcguaacuugaucaacucccguacuagaaaccacaucccgguacacaggccuuuaccagcuuuucuacagccaacacuaguuuuaaaagugaaauauuccuauaucaaguguguuaauguguucaagguaauaaguucucuaacauuugucuuuuagcuguuucucauuacaggcuucuagagauuugaaaauuuuuuuuguucaguugauauauagaauauuucacacaaauaguuaaccuugccaauacaguauauuuuucccuacuaaaugucuauuaguuauauugcaaauuuugauacucaucagauauuuagccuacauaccauuucuaacauuucucauuuggaagaaauuaagcuauuauaguuguugccuuuauuucuuuccaguauccagugagcucuuugaaagggacuuuguuuuaagaccacucuuagggcagucagagcucuuaaaguccuacaaaccucggcuuuaacuaaagugaacccuaaagcagaaagguaaaaaguguuaggaaugcaguacccgaaccacuggucauccuaaggauuucuuggugcauccuguguaaauggaagcugagcuugacaccuggugcucuuaacuagggauaaagucaauguccuguuacuucaagcacagcauccugaaccuccuaaaguacagugcagugacaucuugauuaccaggcugugcucaacacugugccuuggagugucucaccgagacuucacagaacugauauccuugaguucuguauucuagaaagcuucucuaaggauuuaucuuuuacaguucccaaggauaaauuaguugcuuucuauucuuugaacuauuaauauuaagccucugaaaugccuaugcuauuggaaguacuuuugggaaaauuuuauggucccauagugacauuaccauacagcuuuacugaagcuccaaaucauagcugaaaagaaccucauauuuucuuaugucccucaagaugccacugaguauuauaaaguugguagguaaagacaauuuaaggagccuuuccaacauuuuagguugcagggaacuuuguaguuucuuuuuugaggucuaacacuguauucacauuauuaaaacauaauuuaaguuaaucacuugcuaaugauauauaaaacuuucuuuugcauuaaguuuuaaaucuccauuaaaagcauaauggacacaucaguuguguuuguguuaucuguaaagcucagaauguaacgauuaagggguacaauaaauaaucuuaucucuagcccuaaacuacacauauauuaaaaauacacauaucccagugugauuuggccauguguuuaguacuuuucuguuagacuaucuuucccagagguugcuuaguauuuaccauguuaugcacccugcagugcaguuuugugaugaucacuuuucccuuuaguuuuuccaggcuuagaaaacuuccagcucuuaauuauuccgaguuaccauacggaaugaaggucaacucuuguacagaguguucuguucuaggauacaacucuaaugauuaacuugaaggacguugagguuguuuaugugagcgugcugcagcugccuuggacacacacuagaagagggcaucagaucccauuauagacgguugugggaauugaacucaagaaccucuggcagagcagucagugcucuuaacugcugagccaucucuccaucccauguugagguuguuuaaugucauccauguuggaggaaaaucuuagguuaugcuaccaguagcccuucguuuuacaugguuuuggccuaauucuggcaggaaagaaaaagcuaucacuuuauacuccaguagcgugugugugcgugcgcccuugucagaggcugucauucucaagcauucuuuaccuuaucuaguggaagcagucucgcacuugaaccuagccagcuugcuccaaguauccuaucucugccugcugaacacugggauuauaggugggcugucacacuuguuggacauguauguaggugucagggauccaagcccagucuucacacuugcacagcaagugauuuaccuggaagucauauccuuacccacccacauguuauuaaauggagauacuauguuuuauguuggaauuaugacuuugguucuguuuucacccuuuauuuggaaaacagggcaacauuuaaguuuuagauuuuuuaaaugaauuaacaugguaauaaaaaguauggccugaauuuggagaguaagugguuuuccaguuuggggugcaagaucaucuccaaaggagaagagaacacauacucagugagccaccaagggguuggcuuccacucacugagggcaagcagugcaguccaggcuaaccauccaugaucuuugucacagcaaaucagagucuccaauuguucaaaguaacuguagguacaagacagaaagcaacuccagacuggcuuauuaauugaucuggaugacuaugaagugucccccauuccugaggugccaaaaaucuucagagugacuguuggagcagggaaccuuucaugugcucccaguuguuauacagugcauagagacuggugagugucaguccugccaggccaccgcgugcuauuccucgaagaccaccu

SEQ ID NO: 7353 - RNA, 2381 nt, Mus musculus
ugccauuuaaguuauugaaaguaacauuuguauuuuucuuguaauuuucuugacuuuaaguggauuugguauuucacuuccuuaaacugauauuaaauuugauaccuugagauggcaguaaagcaucccauucgugacuguuugaccuugcugaguacuaauuauuucauccuuucauucuucuuuccccuuccucucuaauaagaaugcucagccaggacuuaccucuuucucuggagaccuugccucuagcaugcacaaaagggucaggaugauauauauaugacaaguuuguguagauuuaguguagaucguaaauauaaggugauugcgcaggugcagaugaugguuuuauaguucuuuagggaaaggguucauuucuguuuuuauuuacuuugucaacaugcagaggguuaaaggaacuuaaaaccagauccaauacuuaacugucuuacuacacucuucaaguccuugccuguguguauaaugucuuaaauauuuauauuugucugauauaguuaugucuauaguuagauauauguucagaaugucuuauuauauauuacaaaauuuuguuauagcuuuauaguuuuuaguauuaaugauugcacaguagucuaucaaauugacauuuacuaagcccuacaguguuauagauuugagaauaucuguauaaagcauaucuagagacuuaggguauuuuuuucugcucugauagaauagcuauucugucacuguucuuguaguuaaccaaguaauuuagauguuuaauaaguguguguguguguuuucuugucugucacaucuuggaagaauaauacagaccuuugucaagcauagcccacagggacagugcugcccaggccuucaguaguuagugagaagugagugucagacauuacagauggcagcgggaauggaaaaggagugcuuuagugcaagggcaaucauuguuuggcuaguuugaaauuauaagugaauuauguuuguuuuauaguuuuucuguuaaacuguauuuauauucuggaguaggaugcuuuucaaucuaagaauucuuaaauauuuuuuaccuaaaggauuuagaauuugucuuuugauuuuuaaauuuauuuucuaacuaauaagaauuaagaacuuggcuggagaaauggcucagcgguuaagagcacugacuguucuuccgaagguccugaguucaaauccuagcaaccacaugguggcucacaaccaucuguaauggagugugauacccucuccuggugugugggaagagugacaguguacucauauacauaauuuaaguaaaucuuuaaaaggggaaagaauuaagaccuuuaaaaacuaugucuuuauagauaccaaugugacauguuuauucuguauaauauuuaaauuaaguuaaugauuuaacuuauaaugguuucguaaaacauuuaucauuucuuucuagaaaaaccagugaagauccuuacuuacaauauuuuaaacauuauugcuaucuuuuggucaccuuggaaugcugagugucaugcuucauaaagaggaauauccagugaaauuuaacauucuauuaacacuaauaauaaagcaugauuuuucauuacuguuguuaccugcagaccucugucuuuguaagacucaugggacccauaguuucacuugugacacaugagcaccccguuuuggaauggaaguagaaggauugcugaagccaucuuuauuuugucaagagccagcauaaagaaaaaaaaaaucacagacaucaaucuauuaauuuguaauuuauaguaacuuauauuagguacaccauguugaaauugcaguuauuuaaugguuuugaaucuugagugcuaguguuggccuuccuuacugccagcuguuagaaggauugggaacaaaucauguuuuuuaugguacucuaguguggcauuccacaaaauuaaauccaagcacuucaauaauuuauauuccaaauggaucaauauucuuacucuuggcauuuuucacuggagauuuuaaugaaaugcccuguauguuaguaaagauucucuuauuuuaaugcauuauagaggagcuuuaaacguuuccaucuuuuagcaccuguggcuuuauuuccuuucacucugagugaacuugaagcuuggguugcacaguaaagccagagucugagcaggaacuuggguuugccguuccaggggccucuucuguuuccaggcguggauggugggggugacacggaugcuugcuuuacaguuugucauuaacccacacacgugcuuuuguaacuuaaauauuucauacacuaguuugaucauguuuucccucccugcagcuccucccacauccucccuuccacuccuugauguucuuucucuuuuucu

SEQ ID NO: 7354 - RNA, 1004 nt, Mus musculus
agcaaguuuaugcucuagaaggaacauaggugcucacgagucucauaaagcccugucaugucaguuagagugaguaguuagaaaagcuuggguguguauuuuacacauacccaaaagcuagagaaaugaacguaaguauauccaccaucuuuucugaugauuaauuuaucccccauuucaccuuuacuacauuccugccuacuaccuaccucuaaauuagggaguucaucugagacauuucaucuguaaucaauacaucuuaaaaagaugugcccacaauaacacacacauaauaacacaugcauaauagaggacuaauuuaaaagagcacuuagacauaauugucauuauccugguuaaauacagauaagacccauggacguguguguguguguguguguguguguguguguguguguguguguguguguguguguguguuuaaguacaaaaacaaaacugguacacugaaagaaguagaaggaaaggggcagacuagcuagagacccugggagucaacaacagggguuccuguggauauucuuguuacuuuguaaacucugcucucacuagagaaaccaacagcugggaagugcugcaugcagaaggaaaugagaaagaagaugugguuaaaaguguucagagaaaaaauuucuauacauuucccaauuuggcgaaugacauaugaaacuugucaagcucaaacaaaaugccccagaaugcaagguaacuuccaagaacuaaagaaaaaaaaaucuugaaaguaaugagcaaggacauauuccaggacaaacaguucaaaugacuggauuuaucagaauccauaaagaugggaagggagugcugcagacugcacggucgccaaaagaauucagcgagaacauaauucagugggagagagcaccaugacagucuuggacgcaggaaagccaagagaaccuguuggcagcugaccugacuaauagccuggccaaagcucuuaaaagaaaugaaauguuuaaaaa

SEQ ID NO: 7355 - RNA, 26135 nt, Mus musculus
ugaccuagguaauugauacagcgcgcugcucgugacccuccgcucaguccccggaccuucagccccccggaccgcguggcccggaaccucggccagccggugagagcggcggcgcgacccccguuccugcgagcugaacccucugcaacucgauccuagguccuggggcagcgcugcccacuaaccucagccaggcccuuggggaggggguggggugggguguggggaacgggaacuugaccuuggucucucccuagacuaagugcagcguuccuuaggacccccgguccuuugugcuugucagcaggugaaugcagauuucgugggaaggagugacuugccaauaguggggcuucaggccggaaggcugcagccccccccccccccccacuguuugccguaguggccuggagaggagccugccugguacucuuccaaggagaggggggcugcccagaacagcacugagauugaagagguuccaggguugcaucuggcgggacaugcaagcagcuucgaagucccaggacaggcccuauacuuguuuuuaacugcggucugugcucccacuugaggaaauggaggccgaccagauaucuaggucaaguaguuugaggucucagccauccucccgcacucaggaugagcccuaagaggacuuaucugauugacccuaaggaccaugcucugcaaagacccagcgcugaaacccccagcccuacgggcuccaaucccaagccaaucuguguauuuccucuccauccaccaguaaccuucaacagaccuuacccaucuuuguacacaccccaguucugggcuuuaguuuggcccuuccuuccucccugucaagaaaguaagcuugcaccccgacccccaucacacccuucugccuagcucuuuggaguucuacauuuuccagucaggcagugaguucaguuucuaguacaagacagguagaaagacucugcuacugcgugcugcuucaggguuuggagggaagggggccucccuacucugaccucuacuaacugauuuucccaagggcaguuuacagagcagcccuccccugugcaccacugcaggagacuuaguauuaaguugccugcccugguucugacuggaugacauuguuccaaaaaggaugcccccaagaucuucccacuagaaacuugcacagggcacguuuuagggugugcuugccgccauccugcccuguaugagcaggaccuaacaggguuaauuagggccuuggcuauagauuuggagcucagcaaagcucugggguccucaagcccagcuggcauggggguaggaauggcuggcaucuccugccggguugggugaaggccauagcaguaucuggcugcccagagcguucuguauuuguaaaacacaguguuccaacacugggccaggcuggauauagccaggccuugucccuaucuggccuggauuguccuaucaccuuguggggguaaagcuggcagaaggagcaguuggggcauugucccaaggagauauuaagcggccaugaggaagacacaggcccuggaacagacagcgggucacucuccaguucagugcucgccucugugcuccugacuguguacccuuacuguguggaaugcggaugcugaucccccaugguuguuccacauuugacccuagggcccaugcugaaccuuuggaaacuuacugcugcuccaggagacccagccccaaguggcucacuaagggaccuggcuacauuagcucagggguuggaauguuagaagggaauccuggggcaccugagguucagaguucugccacaccccccucuagaaugucuuuucuaguuauuaauuuucuucuaauucagacuugccacaggucaccucaggaaaucaccauuccuuggcugaggaacucaccugccccuucagcucaagugaguuugcaagggugaggggaggcagccuagaagagccaugccugcccuuugguggacuugaaccuuugcaagaacuccagccaguggcauccugacuugguuuagcugguggcagggguaggguggagggaugcagcugguggacaguuggcuggacacacauugacucggaacuaguucuaaccaagaccacauacccuagacuguaaguguccugggucagggaguuguauaagggccauggacucugauggguaguucuagggcugcacucuauacugaagcguggacuccccaggcagaagaacacuacucagucuucaguaggaaggaucugcuuccuggaggaucuaccccguggaggcuggggcuggacuggaugggacaggagaggaccgcccacucaaagccauggggaaaggaaggacaacagaggucccacuuuacuuguggugguaggacccugggacagcagggggcucaguaggucugagcagggagccugguaguucucuacaaguagaggagaccuuuaaaacuccuggggggguuuuggggagaggcccauugaaagccugcccacuauuuagguuucuuccuugggaaggggcagguaauuuaacaagugaagagaacccaguauucuguuuuccugaccuggguggccccgaccuguaaguacccugggaugacagcgaccuuggguggcguuuguccagagugugaguucuaggucgcuuuugggaaccacagaaggcagcuguagcagggaucuaccacugggcuggcuucaguucucuuuccaccacagggagccucaguccucacuucugugaaguggggcuaagguugagucuggguuccugaccucuggcuuugcccaggaggagggauacccugacuuaguauugcacuccuaaugagucaccagucacuucuggccagugaucagagacuccagggauagugggucuuguccuuucucaucugucuuagucaggguuucuauuccugcacaaacaucaugaccaagaagcaguuggggaggaaaggguuuauucagcuuacacuuuccacauugcuauugaucaccaaaggaugucaggacuggaacucaagcagggcaggaagcaggagcugaugcagaagccauggagggauguucuuuacuggcuugcuuccccuggcuugcucagccugcucucuuauagaacucaagacuaccagcccagagauggcaccacccacaaggggccuuucccccuugaucacuaauugagaaaaugccuuacaguuguaucucauggaggcauuuccucaacugaagcuccuuucucugugauaacuccagcugugucaaguugacacaaaacuagccagcacaucaucuuucugagccuuugcuccucaacgcccuucccugccuuuucugaccauguacagccaacucagcgccuggaggacccccgccccauuuccagggugauaggcuaugugcccauccuuuuuuuuuuuugguuacugccaugaucuucugagugggcuccagggccugagcuagguucccccugaagcaggguuguguauaggggagcuggacggaaggguaggggcacuggguuucggaguccuugggagaagguuacugagcugagaccucuugcuuggaaaugaagcucaaugagauaggaguguguccccugugucucaccuuggcuuagucugaggccaccuuuccaugggaccauagggguuaggagugaacucggacauauccgagcuuccucuugacuggguucugugauuuguguuucuuucucucuuucucuuuguccguguucaggaugagccagcugaggcugcugccauuccggcuggggccacgggccaccaagcuccuggccacacgggcuaucccgguguucagugggugcaggaggucuucuggaccaccaacgaccaucccgaggagcagaagcggagucagcuccaguuauguggaagagauguacuuugccugguuggaaaacccacagagcguucacaagguuggcaccugcauucugcauuuuaugggaaggaagcugcaggggugaaugggaggaugggaggaugggaggaugagggauugugagaaccagccaugaccucagucucuguguauugugugggggagaagggagaggcuucuugcuuucuuacugaugaugaaagugugugaguccaucccacuugauggaccauagagagcuccugcuugauaugccagagaccugcccugccugguuaugcuaacucucuccagauagcuccuggcaugagauuaagaaauaaaugcauauagaugugucaucugauaagcuaauaugccuugauaucuaagaagugagaugggagaaagagcaaaagucaugugauccagacgcaagcagcaugaaaagucaagaggucccucuuagcccgccacaggguuugucuguuaguuucuucucuuucugagauuuuuucucuguaaauguuugcaaacacaacagaauuuccccccuuuuccaucagcgugacaaggaaugauccuggcuggguuguuuuuuuugguuuuguuuuuggcuuucauuugaugaucucagcucuuuccaugucaguacaagaagagccccauuguuuguuuguuuguuccugccuacgaaguauucuaucacauggaugucaccuguccccaguaacagacuucugguucacaucuucucuugauugcugugaagagugcugcagaguauacuugugucugugcacacagcuggcuguagaaagaauuuucuaacauaugugggcagauguuccugguauaacugaacccacauccugaggaaagcugggguguguaagggaccugggcuaguagagagguucccugaauggaggcucugcaaagucccugagcauuguggugccaagaacacugaaugcuuuagggaucccagcucuucacgaccugacccagcuggguucuuucuccuucccuaccuaguccugggacagcuuuuuucagagagcaaguaaggaggccucuguggguccugcucagccgcagcucccagcuguucuccaagaaagcaggacaucagugucaagcugcaccaagaccagcaagcugguggaagaccacuuggcaguccagucccugauccgggccuaccaggugagagagauggaggauugggggcggggcggggcgcagggugucugagccauaaugacaccuccacugauaaccagccuuugucacgugccauuuagagcuuuugaguguauuguuuuguuggcuugucuguuucucggcacuguugucaucuugcacaugauggccuaaguaccuagaggggcacuuaguagguugcguuuagccuucagugacagaggagcacuccgacgcuugauaaccgcucucuaguccgggcauuccaagaaacggggacuguuugcagcaggagcuucauuagugaagauggaaugaauuaauaauuuacuagacacagcucccccaccagcugcucauucuggaggccuaggcucucucacaccggguucccuaggcugggcccggugguuggcagugugucuuggugaugguccauguucucucagcugaacaggacuaauuggaggccugcacugguauugaugcuguaacaggugcaacuauugaggaucucugugggaaccaguggcagaaggcaguugacaagggaaacguggcaugcagaggaugauucgagggguucugggcccuugaagagaccuagugggaggagcagcgagcuacuacauggaccugggaacaucaaggcauuggcaaauggaaacagugugcugucuccagcuaggcauccucugugugggagcguggaaugggagagaauuccccgagcaccuggugcccaagggucacaggggacucuuacuggccggaggacccaggggcuucaugcagcacaguaacuguuauaccagcugagcauccaaaaaaaaauugaugaacuccaaaaucugagacuuuuugaggaccgaugugacgucacaaguggaaaguuccacaccucaucuccugugacggguuguagucagaacgcaggcauccugagaacauugugcagaaccacauuucagcucugcauacaaggugcuggggaaacaaacgcauuucauguuuaaacuugagcccuuucuccaacauaugccauuauguguguaaauauccccaaaucaagaagagugugaaaugccaaaugcggcuggccccaaguauuuccaauaaggcaucuuccaguucauuguguuuucuuuuuuuuuuuuuuuuuuuaaagauuuauuuauuuauuuauuuauuauauguaaguacauuguagcugucuucagacacuccagaagaaggggucagaucuuguuacggaugguugugagccaccaugugguugcugggauuugaacucuggaccuuuggaagagcagucgggugcucuaacccacugagccaucucaccagcccucauuguguuuucuuaacugggugaaagauacugagugaccucaugggugaucuugacaagaacaaggacggucacacuagaacugucuuguguggagauugacaucucggaugcugcuuaaggcuggccuuaucucaggaugagauggccuuaucucagcacagcgcucaguccuuuccguucugugcaugugagugugcaggagugugugugugugugugugugugugugugugugagagagagagagagagagagagagagagagagagagagagagaguguguguguguguguagaggccagagcaggaugccuggucucuuuaccucuucuuuauugccuugagauagugucucacugagccagagguucaucguuuaggguaggaaugguuagccagcaagcucucuggguccaucugacuccacuaauuuuaauggagguuacagacccacaaaaucaugccuuguuguuuauaugguuucuggagauuugaacucacuucucaugcucuuagccacugaguucucuuuccguacauauuguccuguagcccagaagucuggucucaaaccaacucuguaguuagggaugccuuugaacuccugacgcccuugccucugucucacgcuugcugagauguagccaugcaccaccauaucuggcuugcuuuuuuuuuuuuuuuuuuuuuuuaaauuagccaguaccaagcucaugacuuguggacuuaggcauucccuguuugcaguaaggucacaagaaagcagcacguugccauggcugaugugucuccccugggcugguacugcagcuccaucucugguuuuuguauuucuugccagguuuuuccuguagagguuuucugagccggggcuucucugccccacucccaugaugucauuuucccgaucccauggugucauuuccccggucccuuuguccauguaaaugagaucugagcucuagaggcuucaccuaguguggacuugauuuuccccaaucagcuucuugguguggcuuuagggcagugagcagccugagguacuugucgcaggacagcuccccuuguccacgguacacugaggugcacauugcacagcaaaggcaggguuaguuagggauugcuuuauuuucccuuuuauugacugauuuucaaaaguaagauguuucaugcauccuucauaaguaaccagugaagguugucgucgucguccuccuucuccuucucuucucuucucccucuuccucuucucccgccuccucuucucucuccuccuccucuuucuccuccuccuccuccucuuucuccuccuccuccucuuucucuaccuccuccucuuuauccuccuccucuuucuccuccuccuccucuuucuccuccuccuccucuuucucguccuccuccucuuucucuaccuccuccucuuuauccuccuccucuuucucuaccuccuccucuuuguccuccuccuccuccucuuucuucucuuccucuucucccgacuccuccucugcuuccuccuccucuuucuccuucuccucuuccuccucuucucuucuucucccuccuccuccucuucucucuccuccucuucuuucuccuccuccuccucuuccuccuccucucacuuaauagucggucccacuacuaauuaggcugauuuugaauucaugaucuuccagcaucagccuuccauuguucaauuauaggcaugcaccaccauaccuaacuuucuuucuuucuuuuuuucuuucuuuuuuuuuuagaguuucaugugaaugaacacacuuaaguguuaaaccuauuagaugguuacagugucuuuauucccagcccuggcagugacuagcaccccuuugucauacuuagcuucauuugucaauuugacacaccugggaaaaagagaacuuuagcugagaaauugccuugaucagauuggccugugcacaagucuguggagcauuuucuuaauugcuaauugacacaagagggcucagccgacagugggcagugggucugggcuguauaggaaaggucgcugagcagggcaguaagcagugcuccuguccugggaucauccccaugguuucugcuuaguucuugccuccccguucuugccuugaauuccuggcuuccccuccuuucaucccggcucuguaggcuaaauagccauuuccuccccaaauugguuuuggucaguguuuuauuauaccaauagaaaaagaacuagaauaguguuauauuuuuccccuuuccggaauuggguuuccugggaguucugagucaauugcagugaugagagcugggagcugugugcauuuuagaaagauagcaugcauuauggauuuauuuuaaugcagcgcuauacuucaaaugcaggacuaaggguuugaccucauccgucuuacggcaccuucuccuuucaaagaugccaacaauagauguucucagagaugccaugcgguggcucaugugauguuuccauagcccacacgcaacaggcuuagaauaacaauucccuacuguugcuacugauuggcaauaggaaaguuuaugaguuuccuccguaguucugcaugucuuuagggaauauuccacuggccagauggaaaccuccuucugugcacagacacgcugcugggguguacacugcguguuacaucuuacuauucauguuacaucuuaauuuaguuuauaauuaaaguguuuauagggcuucaaagucaaaucuucaaaauaagguauuuuuuuuuuuuuuauugauuauauguaaguacacuguagcugucuucagacacuccagaagagggagucagaucuuguuggggaugguugugagccaccaugugguugcugggauuugaacucuggaccuucggaagagcagucgggugcucuuacccacugagccaucucgccagcccccaaaauaagguauucuuaaaaagccugguucuuugaaacuuuauaucuucaauccagcuuuuacaauuccuauauuaucccaucucuauguacaguaacuuuucuuacuucaggguuucuuuuuaguuuaugauuucucauaaugccuauaugcauuaauuuuugaagcccucugcuccaucuuuuaaauguucuccuuauuauucuuuauuacuguuguguuuguucaugcacaacugcggguaugggagauuguggaaaugguuucauaauagcaggugggaauuuuccucacucuuggguggguuuuccuuguucaugugucagacgcuuuggaaauucacacuaaugguguauggcauauaaaacuucguguggccgggcagugguggcgcacgccuuuaauccuagcacuugggaggcagaggcaggcggauuucugaauuugaggccagccugguuuacagagugaguuccaagacagcuaggacuacacagagaaacccugucuugaaaaaccuuuaaaaaaacaaaacaaaacaaaacuucguguguaggucuuucuuauauuugccagccucauauuguguguuugagcugaagcucccaccgucugccagcaggggauucacuggugagcgaccccacaguaggaugugugacagcucagaacucccaagcuggaaguggggugggguucugagccucacauggaacaaauaucuguccagccuuauuacucuuccuuuuccuagauccgaggccaccauguggcccagcuggacccccugggcauccuggaugcagaccuagauuccuuugugcccucugacuugaucacaaccauugauaaauuggguaagaguugggauccuucccugucacccugguggcccagugaggaguuugcagggccugaagccuagcugagcccagcgucucucugcucagggcuuccacacaggugucaggguggaugcaucgagcccugcugagaugcuuuccaucccccagcccaacuucagucuuucuuucuaugcugccuuggccucuuuuccagccuucuaugaccugcaggaggcugaucuggauaaggaguuccggcugcccaccacgacuuucaucgggggcccagagaacacacucucucuucgagagaucauacgucgcuuggaggugagcccaggaaggcaugccuggcuuagcuugggagcccaugagcaugugcggagggauggagggagcuuccuuuuuagucucagacucuggggcuauccccccucuugcccguuccucauagacucuccuccuaucccucuuagagcaccuacugccagcauauuggccuggaguucauguuuauuaaugacguggaacagugccaguggaucagacagaaauuugaaacuccuggcgugaugcaguuuuccgucgaggagaagaggacccugcuggcuagacuggugcgcuccaugaggucagccacuaccugauggacauucugcauggcuggagggccacgcuugguuccuguggcagggaaacuagcagggccuagcaagggaaggcagcugacuugcucccacugcuggaggccugcagaagcccuuaggcaaaacaucaggaccauaugcucaguuaaugugaccaucagagccacauaggugggcggggaugggacugcagagaaacacugcagcagaggucgcacugagcaugggcagaagugacacccuguagcucuaggaaugacaugauagaauacuguccccggcauguggguggggguagcgugaaggcacuccuggcagaggcagugcauuacuuccuaaugaugccuuggaggaggggaccaucuagagcugcaggguccuggaggugcaccaggcuaggcugcugggugccgagugacuuucugagcaguggggugugggcucaccuuaggcauuggcaggguagagguguuggaggcuugcaggaggguggugggcgggaauauggaaggauaaccucuuagggauguaugacugugaagaggagagagugguauuggguauggguggcaucuaagguuuugggaagacucccaagguaccaugcuuguccuuuauguugggugagugugacacggugucugggcuggguccuggacuauacaguaaggaggugacuuuguccuuccuguguccugggcauuuagcucccagugcuugugaaaagcccccaggagccccaaccuugucccuuucuacccauuuccugcccuucccuauuccccaaacagguuugaagacuuccuggccaggaaguggucuucggagaagcgguuuggccuggaaggcugcgaggucaugauuccugcucucaagaccauuaucgacaagucuagugagauggggauugagaacgucauccuggggaugccacacagguagggccacugaguccccucaccaugaugcuuggccaaaaagcaaggaccuugguagauugucagagccccuggucuggccuguuuuuuacagcaagagccagauacuuagccaaagccacaugcagccaggcccauucagauucucuggucauguugcugcuuucuccaggaggggcaggaucucagacuguggaacauauuguguucagauccuguagaugggaagaagucaagggugugugcuuagggguguaugcauagacggcucugaguuggcaucccuuggacauaggucuguagagaugggcacagucaguuucccagcuuaaggcgacucuguguuucccuugacaaagacuuugacuuuccacuugccagcagucugugggacaaagcccuuaugugaucuagaaagcuggucgugguugugcuagcacaggacuguaaugucuaagggacuccagauguaugggguggacgauuucugucuuggcaggccugucaggagucugagguuugucucucacggucuuuugagaagucuggaaaugcccagugucugguagguuaggcagagcugucccgguagcuguggugacaugggacacauggcuuugugccucaggcuacuagaacagcaggagaagauaacaccuggaagacagauggcucaggcaucugcuggguggcuauuugccuggaucagaggggcccuucuaggccgguucaggcuuccauggcauaaaugguaaccccagggcugugaagggccuugcccagagcagcugaggaauguccuuugggccugauugucugcgggagcagguguguggagggggacugaccagaaggaggcucuccuuuccuguguggggcuaggagucaggcuuagggucacugucacccugaagcuaauggguucagaagggaguuuuuugagucacuuaaguguucuaucaggcuggugcccacccugcaggaaguaccuugaauaguaaguucaggcugggcugaagaaucugguccauggcugccuguuauuucuuaguauuuuccccaucugaguccccucgcugcuccauccugcucaaaacugcugcuggcuaggcugcaggggcaugugagccuuagcauacuagauucagugugugggaggugccuauauaaugggcugggucuuuuuugguaggggaaugaguagggacaugcuguaggugauugguggcuuucugccccuccccaaagggcuugcuaaaucauugaugagcagggagucugccugagagaagcugacgcacugggacuacuccagggccugguauaucaaggcaggaugggaggauugggccuuacuugggcaccaucaggaaggguuccaauagguucaauggcagguaaggagaauggcuguacuuggccaaugucggaaagagaccauagugucaggugacagcccuggucauucugguccucaggggcaggcugaaugugcuggcuaacgugauccgcaaggaccuggaacagaucuucugucaguuugaucccaagcuggaagcagcagaugaggugggugucacacuguuccugggggacccccagagggccugguguuugggcugggagaguuugggacuugaacugccaggcugacaggcauggagagagucccagggacugggcugcuugcaucaggucccucaggcuugguaaguaggugcugccauggacccuccaggccagccuuacucuuuccagccagugggacugaggcccagagagguucagggacuucccagaaguuucucccuugagaguuuguagcugagccuuugcacccacagucccuuuaucagccucuagugacuuguuggcuccagagaggcauggguggacugaugguuuccugugcccuuggcccacccuguagcuuguaugccacugagguucuuagccaugccaggcccucagcccuacugccugccuuccucuccuuugcugcauucagucucuagcuaaacuucuggaccuggacauuuugucuguccuuccucuucugugucccucugcuuugucucuggccuuuuucauuccccuccccccauugugugguguguguguguguguguguguguguguaugugucugcaucuggguguguuguguauguguguugucuauguuggugugugugugcgcaucugugugugugucugcauuguaucuguguguaaccccauguguucauccaugucuacaaguucaucuguuuuucuuucaagagcgagggagggacuuugucucugaccacccagcacagguguuuaguuugguuaaagaaacugguccaggaguacccggcucauggugccagagcaggccuggugcccacauggcuggcuuccagcccaggaucuuccugcauccuguucaugucacucagccaccuucacaccguuaagacucuuuucgcuccucaauagagaaguuacaaagggcccugccccagaauggugugaggaauugaagagaagauuugggggaagaaaacgaaaauuuuugucugaguagcaccuuuuuauuuuauuuuuuuuauuuuuauuuuuuagauuugaaaacauguaaguauuguugaaaggaaaaauauaauuugaaaaagaaaugggacauuauuuaaagaacauuuaaaacuucauccguguggugugcccgcgcaugcuugccugcauuuguggugagguguguucucugcagacacauauauuuguccaggagccaugagaacagcuuggggcacuguagguauuuggcgguuucacucaccaaguugccuguguuccgugccagcacguaacgagcuuggcuuguuggcuucuugcagcugcaguguucugugucaagacucugccugcuguagcaggcacccucacccugcaagugagcacaugacuguagcugucaggugccgccugagaagugcaggagccugggcagggagcagacacugcggagccuccccugggcccagccacagcacgugcggcucacaacuguuaccccccauuucucuguugguuuuuccuuugccaauuggaugggugcaaaaugauuuaauuuuaacauacuuuuugaaaugaaucaacuauuuugaaucucuaugguucuuguucuguaaaauccccuucauagcuuuuguuuauuuucuugggacuuugggauuugucuuuaguaauuacaaagccauuuugcauauugagagcaauuagcucuugcccugcguuugacauaccagcuuguuuuccuccuugguacugugccuggauuuucuuccccuugcuaauggaagauuugcccaggcuuagcuaucuuaacacguagggacuuuauauauuguuuagaaagucugcuuucucuacuccuagauccuaaaauguccucuaacgucucugcauuugauuucauuggugugagggguaagguaccauugagcucugguacauucuaagaagccuggcaagucggcucagcauggucacgagccacacuggaggugguagguucaucauaucccacccuuacccucagggcucuggugaugucaaauaccaucugggcauguaccacgagaggaucaaccgugucaccaacaggaacaucacauugucacugguagccaacccuucccaucuagaagcuguggaccccgugguacagggcaagacgaaggcagagcaguucuaccguggggaugcccaggguaggaagguaaguuguucugagucuguagaguggccccuggcaaucagccuuugagaacaaggcucugaugggagaggaaacagggugugcuucacaggcugggguguaagauccugcuuguuuaugcccugccauucaggucaugucuauccugguccauggggaugccgccuucgcuggccagggggucgucuaugagaccuuccaucucagugaccugccuucuuauaccaccaauggcacagugcacguuguggucaacaaccagguaagggagucggcucuguaccaggcugcaugcccauuccuagaaguccagguuugggucagugggaaaugugaggcagccaugguguucauaccucugcccugcuacuucccaacacaugugacuucagguagaaaaccugauccuuagacuggcaggaaaccucaggcagggaaccagacuccagccuugugcccuagucugagaaauugguagauacauaacauauauguacuggacacacaucuguacacguuacagacaguuuuauaacgacuggagguuacacauccauaggcucaguugacuauggauccagaccagguauggugguaccugccauuccagcugcuccuucauggaaaguucauggacaguuugagcuauguagugagauugugaaaguccaggaagaaucuugccuagcaucuguaagccuuggguuugagccacaucgcacacacacaaaaguaaccaggaaaaacccgaaacacuaaccugugcagaacaccaacaggcuuuuuuccccuuguucucuaaaguuuauaauauagugacuauuuacauaugguuuacauauauuagguauaugauuaaaagugcaaaugcuguagaauuguguaucuaggccuggaguccugaaaaaguucucccaggcaccuagagacaccauaaguagcagcccagaggacagcacaggggcuggcuguguagcuguaggugaccuugggcuccccugaaccauuggucuugguugguagucauguuccuuccuuccaggcagcagagucucaaacagcuagaagcccuggguuccccgccucauuugcagcagcauuuaaucuuccucaaguuuugcucggggcaggacuuuaaugaucuuccuuauagacgaguacaaugaggcugggaaccgaaacaucuugcccaaagcucugcagucacucugguggaccagauccacaggccuuguaccugugcagcacagaggcugguagaaaagcaagccagucucccugcugcaucgcugccagcccauauuaacugcuggcauagcuggucaaggacucauugacuguuaucccuucacguccccuguguguccuagguacccugauaccucccgcccccagcucccugauuugccugucaccguaugucuagccuaaaacaagcaggaguuguggacacagcaguauaugucuguaguuccagcuacucuaaagccuaagauuggagcauuacuggaguccagaccuaaugaaauccugucucaaaaaagaauacacagagggacacaucuggcuucuccugaccuugcagaucggcuucaccacagauccccgaauggcucgcuccuccccuuaccccacugauguggcgcggguggucaaugcacccaucuuccaugugaacgcagacgacccagaggcugugaucuaugugugcaguguggcagcugaguggaggaacaccuucaacaaagauguuguuguagaccuggugggucugggguccugacugaggccagggcagggguggaguagauggcuuauuccugcuaugcaggguaugauggguguuuuugggcgugcaggagccaaggacggagugaguagcccauucugacuugccaagaaaaucggguguguuugaggguggcugguaccagagcaggcuuaguagcccauccuguggguagcuaacaaaccaggugauuuuggcauaugggggcucuuuucugcugugcugaucaagcuugguauauuugagggagcggcccaucuucauguaugguuagggcuucagucaugucuuuggcacugagggcuagaugcuuuuggacugaggguuggugucaccaagaaccaaccaucuaugccuaggccuaggcguggagcauucauucagugacaggagaaagcagguccuuugggaugcuucagauuggacccuggccugugugugcacuguguucucagccuguaguagggacugaagccccggcugcccaugcaggucuguuaccgccggcguggucacaaugagauggacgagcccauguucacgcagccacucauguacaagcagauccacaagcagguacccgugcugaagaaguaugcagacaagcucaucgccgagggcaccgucacucugcaggaguuugagguagguaggcgggacuucuagacacaaaccucagauggacagcaugggaacgugggauggcugcagaagccaucagcccagugcuagacaucgaagguuugaaggaguagcugauguucccugucucugaaagucucuggauuuuaacagggcacaggaauuuaggcauggguacaccuaggugugcagugugaccugggacuagccaaguuucaggcaggaaagggaucuuucuguagggauguccuguaacgauucucuaaaagguauuauauugggauugugccuaaaauugcauaaauaugucaauccuccugccuuuaugguagacccucugaaaacaaggugagagucucuccucugccucccuggaucucuuucuguagcacacuuugggcucuucaggcuuuggaguaucuguccaagaccagucuaaacucugaggucuaggccuccgaccauggcauccuugugaaccaagaaacagaguucuagaaccugugauggagaccagggcuuuugagucugggcugacugacccucuuggaugcuuaguauaugacuguccacaucuuccucucccuuccaggaggaaauugccaaauaugaccguaucugugaggaggccuacggcagguccaaggauaagaagauccugcauauaaagcacuggcuggacucccccuggccuggugagugaggaacacgcagccaagugagcccuuugagccuccuuuaagcauugcagugacucuggagagcagccacugcggagcuagaaggugaggcuugugccuggcgugcaggugugagcuguuccugcagguggaggcaggccaagguggccuuagagcaagaguggcaaucuguaccucgccagggaugggggugggugguacuggaggcgucuacuaagagggucccucugguggggccaagauaggccagcugugaccucaggggauuauuagggcagguguaggugcuauggccgaaccuuuucaucuguggcagauccaaggguguauacugaugucucgggagggaaggaauuguagccuuccuauccuaggacagaaaacuaaccaggggugucaaaguccccucaccucaucaccggaguaugaauggagucuguccccucaggcuucuucaauguggauggggagcccaagagcaugacaugcccuacgacaggcaucccugaggagaugcugacccacauuggcaguguggccagcucugugccccuggaggacuuuaagauccacacagguaaggcugcuguguaagccccagcaugguuacccucagagcugacacuguagcccucagagagaguuguugggauaccaagggagaacagagauuguggcauggcccugcuuagccucuuggucuccugguuuggcucagagccucauaugggcccguucccauguuccuaacuccacucccaguggguauggggaguuaggcauuuguggauaucacauuccagcugggugccagggugagcucuuagauuggaacauugaaaagacagccucuaggguagccccgggucauuuaggagaacagagaagcuuguucuaagaugucugugucucuucuagauagcuuuugggacugcaacucucaaaaguaugcaugagguacccacugauggcacccaagauuagagcuguauucuguacacauugcaagggucuugcuggguguauggaguuuauuagcucagucuccucuucuagaguacagggacaguccucuauggaagugucauagagaauucugacccaguauauuaccacuuccuccuuuggagaggaagcucagaucagcccuggucuggcuacaggcuagggagaagagucugaggggaccacccacauccuuugcuuucucacugagcccucaccccauagcucuggugcuucagccauccaggccugaggcugaacuauguuccucauccucacaggccucucucgcauccugcguggccgugcagacaugacaaagaagcgcacaguggacugggcccuggcagaguacauggccuuugguucauugcugaaggagggcauccacgugcgacucagcggccaggauguggagaggggcacauucaggugaggcugaggcaagcugggcccugggcccuugggcgcugcucuugucuucacugagaccauggaucucauaacucagcaaaacacaggcaucccaggguuaagccuuagagaucugagguagaccuggccucucuaggaacccgggggaggggggcggcauuugucuggcuaaaugcauagucagggccaaguuuucagacgguccuuuuccugacccucacaugccgagcugacugguugucccaagcugguaaucacauguggcccucaggaaccuuuauuucuauaacuggugaccuuugucagccuagaguucccuccuugcugccugaguuuuggaaucugagugaggacacauauuucuucuagguugggacccuaaauauucagagucuuggcucugcaucauguucauuggcuuccaagaccacaagccauuuuuccguucccagagcucauuucugccagccuuuuuucagcuuggacccaggcagccaucagcugcauccugaacugcaugccauuguuuguugggcuugggccucaaucugguggcccacuuacucuuucaucuuggggucuucccagugcuucccauggaucucauaacucaguagcaacuccucugagcauggacagggcagguguggugguugagaugguaggacauguaagagaugugaccugcugggaucucaagggccacccugcuucuaggaugcucgcaaggcaggucucacugguucccucugugguugagaagauaaggcaagagacauuguagcuuucagaucucagccuggcacccuugguguacugugugggucgcuggcaggcagaaagcggggcugguaagacacugggaaaggaacagguuguuggguaaccuugguguggccauuucauaggaccuuauaggccuuugggaacauacaagaccuaccuaccugcugcugcccgugugacagccuccuugcucuugucccuauccugacuucucucuccccagccaccggcaccauguucuucaugaccaggaaguugaccggaggacgugugucccgaugaaucaucuguggccugaccaggccccguacacugugugcaauagcucccucucagaguauggaguucuaggugggugggggcucacuggcaugccucagggucugggaggacaggcggccucagagacugggaaggaggucagagguacuaggaugguccugagggacuguggcuggaccguuucuucccagagacauuugggauaugaaaucaugucccacaugguccaccaggcaucucaguugggggaaagggacauuugcuugguuuucuuuucuuucugucugcuggguuuuuuuuuuuuguuuguuuguuuggguuuguuaguucaagacaaaguuuguuucucuguguaacaguccugacuguccuguaacucgcuuuguauaccagacugaccucaaauucacacagauccaccugccucugcuucccgagugcugggacuaaaggugugcgccaccacgcccaacuugcuuuauuuucuaugugauaccuaaacucuuucccuggaugccaaccacagagggucuguacaaaaguccaggacaguccauagcagaaugcagcuacugaccaccuagcaggaagcccggccauggacacauggucuuaagcccaccuucucucuccugcaccccaggaguccaguauugagguucgccugugacucuacagggacaugccuucccucagcuuaccuuaagccagcacccuugcccucuuacuucugggguucagccccacuuuugggaguugccugugggcuuguguacccuucaucgggaacuuugugcaugucuucaggggucuaugggguguccccaagggccacauaaagcugagcugcacaugacaacaugugguguaagaaaagcaugcuuccacauccaggaacacacagccaggccuucgaggcccagcgagccucugccuuuuucuggugugucgggaaggucugguugggacugguagcauauacugaggaaaggcuggguuuaacuggaaccacuacuacuuggugacauugcacugagcucugucuugguguccuuugccuaggcuuugagcugggcuaugccauggccagccccaacgcccugguccucugggaagcucaguuuggugauuuccacaacacagcccaguguaucaucgaccaguucaucagcacuggccaggccaagugggugcggcacaauggcaucgugcuucugcugccccacggcauggagggcauggugaggguugggggcccuugcaggccucccauaggagggcagggucaccccuugguccccugaagagcuuuucaggcccuuggaacuugugauccagaccugugggcaaggugggaacaggcacagacaggguuaaucugccccuugaagccaucugggcaccacaaggcugagguucugcaggcucagccugggucacguguacuuucaggguccagagcacuccucagcaaggccagagagguuccugcagaugagcaaugacgacucggaugccuacccagugagugcugccugcuguccccaggcggggggggggggggggggggggaguagaguccaggguagugccacuccuagccaccagguguucccugcagguguucacugaggacuuugaggugagccagcucuacgacugcaacuggauuguggugaacugcuccaccccagccagcuacuuccacgugcugcgccgacagauccugcugcccuuccgcaagccugugagcugcccuggccuuuuagcaccaugacggugcagggguuggaugugggaacccauaggaggauaggagcuacuggcagcuggcuuuuugccuuccagcucauugucuucacacccaagucucugcugaggcacccugaugccaaguccagcuuugaccagaugguguccgguaugugucugcucugggccuggugggccuccuucacugggguggugaccugugaugucuaguggcugauguguggauucugcccccggagcuccucugucuucucagccucugucuucauugucccuccgcagcuccuggccugguccuugggagaucagaucauuuggaauaagcuccagggucccaggaguuggugggcucucuuaccugucaguuagggcuggcaggagaugagacgccagcagagcagugucugguuugcuggacacugagugccgcucucucccucauuuucuaucucuaguuucacucaugaaccaaguagacaucacugggaaccuggcugcccucucccccaagagucaggggccaggaaagcacaugaagacucgaaggcugaccugguagggaggcagggaggcacaagagugaagcuuguugccagcagcagaucugguuuggcugaguccugaguagagauagacaggaucuagcuaggucagggccucagcagcauggacacuugagggguuuauuguucguuuuuuauuuuguuuucaucuaugcguccauuaugggaaggcagcuguaguggauagucagauccacuagugcgacuacccccugggagacugguagcucugucccuacaccuggcagcagcugcccucuguacgucagugcccucagagggguggugauacagggacaccacagcagcucucugaggaauuuuacagcacguugacuucaggaaggagaaauggccagggcugggagauggaggcucugcaacggggcuaagggaggaguguacagugaccucccaauagcuuacccuagcauacaggggcugagugccaugucuaaugugggcacaacuggggugggaauacagaucuggagcaggauggugcuauccugggcccaucauguuaccuccucugucccucgggcccuuuccacuccuguaccccauaccuugaauguguuaucucugcucuuguccacagaccugucuccccucucccucugacaacauaggguaucgucuguccuuuaguccaucuuugggaucaaaagccgucuaauguaaucagucuuaccugaaucagcucaguagcugggaguagcccagggaugguugguguacucaguggcccguugcccuucugguacugauaacccugagguaccugguccauccuuuaggaacuagcuuccagcggcugauuccggaagacggccccgcagcacauucuccugagcagguccagcggcucaucuucugcacgggaaagguguacuaugaccugguaaaggaacgcagcagccagggccuggagcaacaaguggccaucacacgccuggagcagguuugccaaguguccugccacuguagugauagacaggccccuggcucuguggugugugggcaugacugccgagcacagagcaggcccugcacacguuguccccccucgacucugccuuuguaucucuaccuccccagaucucuccguuuccuuucgaccugaucaugcgggaggcagagaaguacucgggagcugagcugguguggugucaggaggaacauaagaacaugggcuauuacgacuacaucaguccacgcuucaugacucuccucggccacucccggcccauaugguacugggcuagagagcucaacaucugucucccuucccugcacugguucuugauccuggcaucccuauacuagcuuuuccugccuuauuggcagugccaccgagaacuagccuucucuggcaagcauuugagucccuauagguucugagcuuucuaucuauaggcuagcauaucaggguuggggggauugccagugggacgaccuucaaggacaggaagccuaaggauucugcagcaaguaucagauuucagacccucuugugugacucagaucuucacccuuuagucuuagccccuggccguggcacugccuccccucugccagaaaaugcuaguauagcagugugugcaggccagccuccugaggggcuugcagguggcagccacugcugcucagugugggcauuuuggucuucgcgaagaugguggcggggaugagaaaugugggaaaagccaaagaucugugggcuguggcaugguuauugucuccauggucacggagugggcaacuucuguguccuguggcuggguagcugaauuugguguaggcccacagugcaacggccucuaaguagaggaccaccugggcaggcagucuucuucaugugugcgacccuacccggccuucccugagcugacucuccuccuccagguaugucggccgggacccagcagccgcaccagccacugggaauaagaacgcucacuuggugucacugaggagguuucuggauacugccuucaaucugaaggccuucgagggcaagacauuuuagagugaucuucugaaggagguuauaucuggaaacucugggccccagaugaaccacauccauguagcaauuuggaccaaagaguagcgcugcuggcuuuggucuguuauuucaggauuaauuggucaggaucaaggauuagcuuuccucagauagaggggacaucgauguggugucuugccagcccugcuaaccuuucuggauuuuuuuuuuuuuuuuuuuuuuuuuuuuuuuuuuuugguguggugaugguuucuuuagcuuuacuagucaugucucuagacagccacuggagccguauaggguugugcccauccuggcagacuuaguugccgaucaccuuguuguagccauuucgucuguagauucagagaugcucucuguugugcucuuggaaguagagaguccagcaauaagagcagguaaagcucagccacaccaggagaugcagugagaugcagcacacgugugcgaaccuaagcaggagaccaaagcgcagaggaauaaagacaugccugagaaagcc

SEQ ID NO: 7356 - RNA, 12898 nt, Mus musculus
aggauuaaauauuucucugagugcguuguaaucuggauugacucugacaaaugaaucuugggccaaggcuccaagucagcacguggaaucucuauugggcuucguaauuuggggaugcgaggggaccugaggcuuccugggaugaagggaaggacagacuccaaggugguauaaauucucugcagggcaugagagugccuucuuucugcauagucuccugacuuccacugggaucuucucuaaggugaacggucuucuucaaacagccucauguuaccaucauacagugauauauauacacaacacacacacauaaauuaauacauauucuuacacacacgcagagcauaggacuuggaaagcaaacacacaucauuucacaacugauuccuuuuuuaccuugccugucacuaaagcuccuuuucaugagguucuguucuccaccagagagcccgagagccacuccagucugccccagacugccuccugccuccuuuagagcauccugauaaacuggcuaacacaaaaggcggcagaugcuuuucuuguuugcagcggggacaaguaaagauuugauuucacauaguuuuauacuagcaauuaaaaauguauuccaguaagaacaagaaauaaacccguacagaaggucagguuucagaauucugcauuuacacugguucgguccagacuuucagagcccucauucccacccccuacuuggaagcucguuaacuucaccugccccugguucuuggcaggcuucggaaugcaaugucuaaugcuucuggcaauggugcuuuauuaggggauggagcucuguuauuagauugcauuuucuuauuuccuucagauccagugcaccugauauuggagggcucucccuaugggcuaagacugggagacgcugccagggaggaguuuuuauuauuuuugugggugccuaugcagccagaugagaauuccagacuggacagacuaguggacagguggcaucgccauguccuaacugguagagcccaccguccauguggcuccuaagccccuuuugcagguacuguagacuggaggacauagcugguguucuucugucugcuccacgagaucagaaggcauuuagcacagcgauccuggccucuucacacagugggucuaguuugccaucacccccuagaaaaauagauaacacuuuuuggacaguuuuaaauacaaauugauguaauauuaaguauaccuuggguuuucacuaggaguguauuuccgaaggcuacaggcaugugaacuguuaagcagccucuagcaguuuugguggagcccugaagcucuugcucuuaggcacggggaggcagacuuggugccagucuauagggccauaaaugucccagggcaaagaaaugugcagacuauugcugaucaugucauauccugugaauauacugacucuaauugucucagaaaucuagauaaaguaaacaaauagaacaaaaaucauguugaaagaaaauaauaagacauacauuacuaaugugaaaaauggaaacuaaacacaaaaccgcauuuucuuccaauuacaucugaaggcugggcucagcuuucuuuucuuuccucaucugucuacaguguuuggugaagaaguuaggcagcacaacagugcaccagauguguguguguguggggggauguuugugguauguguguguggugugugauguguuguuuaugggugguguguguaugacaggguguguguguguguuugguguguguauguguauuuguauguuucucugugucaggguauaugugguguguguguguuugugugaguguguguuaggauauguguguagugugugcauuuguauauguacaugguguguguguggugugugugaguguauaugguauaugugaguguguguuuuaugugauuguguuuguguguacauggugugugugugugguaugugugagugugugguauaugugauuguguuuguguguacauggugugugugaauguguauuauguguguuuguguguauaugguauguguuguguguuaugugugaguguauauugugugugugauuguguguuaugugugaguauguguuuguguguauauggugugugugugagugugugcucacacaaguguauaucccccaacacacacacacacacacacacgcugucuuucaugugcugcagggaccaggccucuugaagugaguuugaaaugcaaaaagaaccccaguuugauucuaggcauggcucccugaccauuuccacuagaaacagagggcaaaggcugcucagcaaagaccaagggcuagggagagcuccacagccuuaccaaacuccagcucuuggauaucacauugaaagaccgucuccucauuuaccacaagcuccaccagauuccagucuucuaucugcuccaggaugaucugauguccgucuuuggccaacacagcuggaaagaaaagagggacaugugugacauggauagauuccacauuagccuacgcccacguccucacggaugucggcagcuugucuccuccccgguuguucacggucauaagcuaaccaccuggugggcccuagcugcucccuggccuccauguguucuuaaagucucaggaaagcaaagacagacccucaagugacacaggccuugcuugugaauuuccucagaccuggaggaggaacuauuaggagauauuccaucucuuggaaguggccgcugggugccccacagcgcugcaucauggaggcagugcucaguauagaggugacccaggauccagaaacuucuuuucccacugauggaaauagaauuugguugcuuucuagagggcaauuuauagcggaagcaaagaccuucaaaaacauguuucaagaacauucuacuuaaaagaaaucccauaaggaaaagucagaaauacaggcaaauuuuuucaacaagacguucuuucuauaauacccaaauucuaugaacaguuuacaagucugauaauaagaggcugacggaguaagcagugcuauguguacauaaugagaguuuaauuuggaaauuuaaagcuguaggcuggugagauggcucacugggugagauguuugcugcugacacucacagccugaauucagucccagaaauccaacucuucaauuguccucucguguucacaugugugccaugauguacacgggugugugcacgcacacacgugcacauacacagaauauguaaauacauauggagaaauagugacagcuagcugggugguagucucucgggacauuugaggaaugggaagcaguucggucuggcagaggauggcggacagcgugagaguugggucuguuuugcccuuggcaucaaaggugccuaagugaagaaacgccgggggugguggugguggugauggugguggggugugugugugcaccuuuaaucccaacacuugggaggcagaggcagguggaucucugaguucgaggccagccuggucuacagauugaguuccaggacaagcagggcuacacagagaaauccugucugaaaaaagcaaaacaagaaaaaaggaauuuuuaaaaauagugauauuugugauaagaacaaaaaucaggauauaaauacguauaauauauuaagaacauauacucaauauuaauuaagcuauguauguaagaaagaagaggccugugugguggcaaaccuauaaucccagcuauaagggagacugaggcagaggauauugaauuagaggccagccugggcuacaaaaugagagccugucucaaaauucaagaaaacgagccaggaaaguaagcucccugguucuuucuuacucucucagcauuucccacaaugucuauaauaaucagaaaacuuuuaagaaaacagauuuauuaaucucaccuuugagucugaggcuugccuaucauuuacacgcugcggcuccuuccuacaagccagccucggguaauuuguaaagacaauuuuucuuuucccccucugaaccuaggccuuaggcuggcuaggcaagucuccacuacagccccgcccacuccaucucggcuguggcucgcgggaaaggcagcccccuacaguuagucuccccagccaucuucuccgguuccccugaugcucucauggccccagccauccuagagcuggugcgccaucgcucaccuuuagcauucggccugcugggggugagcuuuuggguuagaaggaacaaggcaucagauggggucguguuuuuuuacauuccaaucaguuuucggaggggaagaacagacauuuuugucagcuaauugcauuuaauuacagagacaaucgcuguuuccgaacguuguuguguccacucccucauccuucaaucaguucaagcacauccggccccagcugggagccuuuuaauugcauaauuuggauuucacuucuggaaagaaacuugagaaagacuccgugagggucuccauuaacacaaucagcuccccaggcacccggggcuggcccuaauugacccaucucagcuaaugccucuuuccaaagaacgcccgcgucauuucuuuggcuuguuugugcuauuguauccuguuuuagugucuugaucuuaaacaucuuuaaagagggcacucaguggcuuguuuaacuggaagugguccagcugguuuggaaggacagugcaucaggugauguaaguccaaggguaggaauuucuggccucuccuuccccugcccauugcaccgcucuccccaacaggaaguagcuacacaugauaaggugcacuguggcuucuaggacuuaggcuuugcauagucuguagaccuuccuggggaguggacuggaauuugaaaggggugggacgggagucuagcugucacucugcuccagauuccuagguuagcuuucuaaggccugaggagcucugagagaagaggagacacucgacuaggcagaugauccagcaagagaccucaggaggcaagcacuucccagcugcccacgacuugucccugaaaggcccaucugacugaaacucagguuauacacggcgguguuggaguauuuuauagagacagcauuacucuuccaggauaagguguagcugaaaccagauuugguccacaaaacaagccaccccauagagucgagaggggaauggugagggcucccaagaacaacugaagcagacaagaagagaucuucucucccuagagggguugccaggcacaagcaccugaacucuuuaagggcaggucucuugaccuuccugcaggaaccuggggucagcacaggcuccccaaagcagcaaacucggcauggugaggaauaccaccacuuuccccuggggcuauugguuaccucucugauuuguacucuagugacaacuaccucagagucugucacacuuaucaaccucaggacuucuaucccuuccugucagagaggagguagugaaccugacuguagcauggcuuaagggaugagagaaaacaacccccccccccggaauuccugcagcucauccaaaugccaccgcuuggcacggagggggacauaguuuccugggcugcuacuggguugucuauucaaagaaaggucagauaaauauguuccccgaaacaaagucuaugcacaggcaguggcuaaacuccagcauaaaucagccagaggcgcuaagccacccgcagaacacccaccucuuugaaguggcaccucauuccucacagggaauccggauaaagugcagggacaggggagaggcucuguccucccugagcugguggagcugugcaccaucuguggaggaugucaaugcugcugguacacugacggauggcuuuccuuccuuucacucagagcagacagaaugucagugaccauuaaugagugcagcuaaugcaucgcuggcgaugggaggauggcacuugggugccuugacuaaauaaagauggauuccauuuuuaauggucaguuccagugccuuccaauuccuuugagggcgucguuuggcaggcucaaguacaguaguugaggagaaaccaugaccagggcaauuacuuaggguucuuuuaagcacugguuuaguggagauuuuuuuuuuuuuuuuuuuuugccgagccauuauaauucgugaauaauaaagaacaagaguguucagauugcuuagggcauggcacguucagaaaagaucgggcauccuuccaaagacagcggggcuucgggaaacgauaaagcgcuaugauuuuuaaaagucauacgcagaauucagaagcagauacuacagaggagugccugcaaguaggucugcucgcucugaugggucugaagcgggagaguggggguggggcgggggaguaaauguucccugcuuuguugcuauuaacaccuuggcccuugucaccagguccuuuguaaauguuggcagcuguuauuagaugcguuaucaagcaccgguguacacagcuuacuuuacaaaucacccacccgcagaugccuuacaaaccuccacagccaucaaaaugcaccccaggacuuccucgaaauaccauuuccuccccaagaagaaccagcagcuucuggcuccacugaguucuguaccuaagggcuacuugccucucaaggccagagaaccacgaauccaguaguucaccgagcuucucuguuccucucugaucccugucugcuuuccucccucucuguccuccacccuuccuuucccccaccacuuuuuuacuuuguugggggagggaggguguuagcggaaucuuguagaugccaggaugcccuagaacucaugauccuucugccucagccuccugagcgcugggaucacagguauugucacccagacugacugauuguccuuccucuucuuuugucuucccugcuucagagccccaggcagcccaagauggcuugaacuccuaauccuccacccccugcucuccaagggccaggacugcagauguacacugguucuuuguuucucugucuuucuuuaggacauuuauuuuuuccgagaucgaaaguacaucuaaaagauuuucagauuacaaauguaaagcagacucgggauucuguaaaaaucuuagacaucauagaaaaggacaacguuuuaaaaaccagccuaacuuuaccuuaugccucucuuccaucaucuguccucucaaguggagagagaugugcaggagacacgggagaggcucuacaccugucuagugcugugcucacccacccaggccuccaccaucccugucaggugccagauguguugcagcgucuugagccauugcaguuucugauugcuuccuuuuuuuuuuuuucuaucaagaaugcagcagaaaacauugcuaauaugccaccuguguuaccugcggggguggggguggggugcagugaaggcagaaccuagaaaugaaacauuuauuuuuuguuguguggguuacauuuuauagacacucccaaguugcccuccuagcgagcucacuguccaauuugucuuucaacuggaaccagaugagaauauucauucucuaauccuuccaugacccaugacccacaauuguaaaugcaucucucucucucucucucucucucucucucucucucucucucucucuggaagacagcuggagcucagcaguuugggauguuucuucugaaaucccgucuaacacgccuucugcuacuaggucuacauuuccccaauucuguacuaccuaauuuuggcccuuggcacucuguccuuaggcaacaccucugcccgcugccugguucugucuccugcuccagucuuccuccagcauaugguucuauauuuucugaugaguagcuauguccucacauuugauacauucuuuccuggaauguuuagaaaguaacauuaucaggaaaccccacucuagaggucaucuaagcagcuagccauggcuaggggagaggagacccuucaauggggcuagcaggaagcagagcagggagcuccagggacacagcucuugugaguuauugcccaggugagacuggccuuuccugugaugcagcugccuuucaaucauuccugcuccuguaagugggcaacuccaguaagcucacuggcuugccaaguuagacauggguggaauuguuucuucggucugcuguuagugccccaucuggggugaauagaaauuuggccacaucgccccagaaaaagucuugcaacacuuuucauauauauaccaggaaccagguccuaggaacugggccccugcagggaacaggacagauaggaaucugaagagauaggacauacggaagaguauguccaagugugugugagguaaggagcuaagaacagugcugugcuaucuaugaacacuaagaaggacagagggggauagaggaggaaggaggcagagcuaccgagauggauugguggguaaagacauuugcugucaagcuugccagccuuaguaugauacccaguaccccacaugguagaaggaaaaaaucaacuccugcgauuuauccuuugacuugcacacgagugucagcauguguacaaggcaugcaauacacacacacacacacacacacacagagagagagagagacaugagauuucagaaagucuugcccaugaaggugacuuucagggaagauggcaugaagccugaggaaggaaagagaggaaaaagcaucgcagguacaguuccuccugagcaccagguguaagcuccugggguccccagagagguccauggucagugagggugcagguauggccggaguggauguguaagcaggucagaaggagcccgauggccuuggaaggucuugggcuuuuagcccaagugagcuaggaaccaccagaguuaucuagcaaugaagccauauucugacccugcccugguucugagaacagacuacaaggagaccgugaugguuacagugagcucagguuggaagccaugacacaacauagaggauggcaaugacggugacaaugaagaugacugaucagaaaugguggaagagggagguucacuugggaggcagaggcagguggauuucugaguucgaggccagccuggucuacagagugaguuccaggacaaccagggcaauacagagaaacccugucucgaaaaaacaacaacaaaacacccccccccccccgcaaaaaaaaaaagauugaauuaccaacaugcaccaagaacaaagacucugagguagacggacaggcugaguaguggauauaacagaggaggagggacgaaaauggguguaagguucuggccacagagacagcaaaaagggagaggccaggaccugagaccgggagaagggagguauugaaugucaucgguguccagacucauugacagaaucgcucccgccuucauuucgucuaaauccuagaacaugguuucuacacacugguuugaugucucucaauaauucaacuucuuccauuucucuucuccaauuucccccuucagaacuggaccguaagguacaaaucauggcaugucuuuauuuauaguuuuucaagacagggucucucuguguagcacuggcuguccuggaauuagcucuauagaccaggcuggccucaaacucagagauucaccuaccucugccuuccaaguggugggauuaaagcuaauuuuugguucuucacuuaggcaccuuugcugacucuuugaugucaaggacaaaacaggcccaacucucguguugucugccauccucuaccagaccgaacugcuucccaguccucaaagcucccuagagacccccccuccuucuuuucuaacgacugccucugaaauaaguccuugccccauguggcaugcugcucacuagucccucugcauuucuugucagacucaugucacugagggguucacaaucuccuuuaccaacaaggaaaggaaggcucgugaaggaggccgugucagaacuaggagguuaccucaucuucagagccccuguguucagccucugcuaaugccauuuccauagugcagggcuauaaguggauuuuaugcaucuuaaauaucaaaugcacagggauggaaaguugauuugagugcaggaggacuagcgguggagguuggaguugcuacuuaugaaguagugcuauuguuuaggauguuggaaaccucugggaacagucaaacaauguucugugauacugcgaucuuuaguuaauguugcaacgugacaccguuaugggcugaguuauacuuuccucaauuugugugcuuaaguucuaacuccggcuuuuggucuauaacuaagguuaaaugaagucacagagaaccccugguuugaaaggauuagaguuccuuauucuucguauauuuuccaguugugggucucugucaguuugcuaccuauugcaagaagcagcuucucucaugagaggugagaggucuccucaucuguggguaucaugauaagucuuuggaaguugguuuaauugguaaguugguuuaauggucccauuuagcagaaagcgaagaagguuugucuuuagagcauauaaccugacuacccagcaaggccaugguuccaaagguuccagguacggguuccauuuuguagaguguuccuuaacucuaaccagaaagucuuuaguuguucucauaauguaggugccaccacugcaccaguaggcaugucuugccaggccagucacuuuguagcucucaggguucacagcuguguaaaaggaacccuuacucccagcacuauaaaagcuggccaguagggcucagcccugaaugggacaugaauaucacacucuuuauugcugugucucaggggacugcuguggaacagagaagcagagagacuguaagcagagguggcagaugacuaaagcaaaacuaguguaaagauacaccaggacaggcacacacgugaacucacagcaguugugauggcucaugccagacaaaucccgguaugccaagggggcaugggcaugaagucccacucugagccuugacauuauuaacaauuaauagcugcaggaagagucaguuuucccuggggugugucucugagaagguuugccaugccccaagagauagauuuacacccaagaguauuugggcagcacagagaugacuagcaguauuuugagaaacaaauaaacaaacaaacaaacaggcaugagagugaguaaauuagaagcuguggguggagcuggagggagcaaaucugaucaaaagauguuguauaaaaaugucaaagaugcuggguggugguggcucacgccuuuaaucccagcacucgggagguagaggcagguggguuucugaguuugagaucagccuggucuacaaaaugaguuccaggacagccagggcuacacagagaaacccugucuugaaaaacaaacaaacaaacaaacaaacaaacaaacacaacaaaaaagaaaaacaaaacaaacaaacaaaaugucaaaguaauuaaaauguuauuuuaaaaaauguagaaggaggauguguggcucucugagacgagcuauuaguuuguuugcuacuguacccaucuucucaguaccuggggcaagagagaaaguggccuucagcauacaaggaagagagcuacaccagaaaucaccguaccuagccagggccuccagccuccagcauggaaggaaguaggauuucuauuguccaaggcgcauagccuguagcauuugaugcuggcaaccgaaacagacucuuauaaaugcugucuuagaguuucaaguguuaugauaaaaccaaagagauccucggggaggaaaggauuuauuuucggccuacaguuccacaucacuguccgucacugaaggaagucagggcaggaacuuacagcaggaacucagagucagggccugaagcagaggcuauggagggcucugcuuacuggcuugcucuuuguggcuuguucagccugcgaucuuacagaacccagggccacaggaccaugagugguaccacucaaaacgggcuggguccuccccacauuaauaacugguuaagaaaggguacuacaggcuugccuacaagccaaucuuacagaggcauugucucaaaagagagucuucccaaacaacacuagcuuacgucaugcugacauaauuacaagcacagauacugugggauuugcuacaaaaaccucucgacaacauuuucuuagugagagugaugucuuguaacagugaaaagcugacccaccuuucaggugugaacuucaaauaccaccuccucccaaacugauuuuuguguccucuggacuuuagagccuuuggcucuagucugacaggcuuuaagcaugacucuuggucaucaacauauccuguuuagcaguucaacaccugccugaguuuaugcacacguuuaacauggagccagcugcauaaaugaacaagcaaaggguagugucuuaggccugucacucugcagccacuugacuuacaaaggucccuuguuauuccucauccuaaacuuccccaauccuaaugugggauuagcuauuuucuccuaacacucaggauauccacagauuauguucauguuuagcuuuuauaucuaaguagggagagccagagggagaugcuaaaucaucccgggaaggcuuccuggggaaggagguacuuuacuggggucugaggagagaaggucuaaguaggggacucaaguugcauccgggaggcuaaggcucaaaaacaggcacucagugggguggcccaccuugcagacccugcagucgguaggugcggugcuccacggacaggcccacugcgcuguagggcccauagcgcaaggucaccaccgcuugcgcaggcauggugcuuuguccuggcugagagagguugucaaggacucua

SEQ ID NO: 7357 - RNA, 4195 nt, Mus musculus
agccuuuaaaauuuuucauuuuuaaauguguaucagugcuuugucugcauguaugucuauguguaucaugugcaugccuggagucugcugagguuagcagagggcauuggaucccccggaucuagaguuaugaaugguugugaguccccauuugagugcugggacuugaacccaggucgucuguaagaacaccaaguguucuuaacugcugagcucccaaauaaguaauuuuuaaaaaggauguacaugcaugcgugugcgugcauuugugugugugugugugaacuuuguucagucaugugugguggaugggcugacuuacuggcuucugauuuccacuugcauccugccacccaucauccuguggccuugaugagcaucgugugugcauggcaccuaccucccccuagggugagcagugcuaugcuuccuccaugcucaggggcuuggugggcacaguccugucucugcuugguacuggcugggaugcuagaucccauucagacacaggugaggugccccgcaggaccaggcauccuguggcugagcuguaguuagaccugaguguguuagaggcacggguauugccacuugcagccaaccucucccuuuuaucacaggcacgucucugguucagcaucugaugacuguccucauccgcaaacauggacagcucuuugcugcaaccucccuugaagaaccugcuucaccacauggcacaguagaguggggcucugaagaggucaccagggaucaccggggugagccuggcagcccuggcuugcccacacauaggacuucaucucuggaugggccagcugcagcagugcuaucuagaacuucgccgccgcgccuuggcagccaaacuggccccgcagccaccagcccugggaagaagaugcacacuuugccugucuggaagucuucuuuucggcagcagggaucccggucagagagccccaaaggggucaacucauccuuagagguacccaucaucuccucuggugggaacuggcucauaaacgggcuaucgucucuucgcagccaccgucgggccucaucgggggaccgccuuaaagauacaggcucggcacagagacucuccaccuaugacaaugugccgccaucuagccaauuuucuagcacugccagcguggccagcacgucauggucuguagccucguccucccgagaggccucugucagcagcugcacagccugccgggccagcaacucuucugccugcagcuccuuacacaccgagugggcucucgagcccucuccucuccccagcagcagugagggccaccaguccccggaccugggccacagccuggaugagccaugugugggcaguggcagcagugagcccaaugacccaggcagccccacacaggcccauguucgccgcugccgggcucuccagggccagguggccgagcucagggcagaguugugucagcagaggacugaguacaagaggagccugaaaagguaaaggaccacucuuaugcuggcugcuuggaaagcugcagggggcagggcucagagcagcccgcucccagggugccuuucuuggaaaauggcacuagccuauucgggguugggaggggguguacccgucagcuggcaggccuccacaagggagaaugucaguuuguagaacaggagucgggagccaggcggcucucugggauacagugagagcagagcccugaaugaccguaucacugaaaguggccacagagaggguugcccagaggcuguccaaugcgcagcccagccuaucccagguaccuauaguaagccuaguuauacaacgcuccuucccuacacaggaucuccuugggaagaauggaggggaacagugaaggcccuugaaccacucucaacugacaggggccccguggaaggagaguuuguaagaggauggucuccagcacaggaaggaaggggacuauggcaccaugucccaucuagcaggcuucugggaauaggcucuguuggcauacagggugcucacccauucugccuccuguaauccagucgcugcccuuccaguaucucccuaagaggaucuuuuguuugugaaaaacagauagaugcugugcuagauaccggggacagagcugugucccaaacucaccagaauucugggccugacuuguauuugggauuaccaggaugagacaauacacaagauucaucagaaaugcaugacgugcuggggaguggauacaggacaggagcccuggggagggaagggggccuucucgggagaggauaggaaggccugaggugugugugugugggggggggggggguaggagagcaugccuuggagcucugcuagccuugagcaggguaguaaggcaggggcuucaggccuggauacuucuuggucuucuucaggggacagugaguguggagaaacagauggagcguuucaagggcuuuggcucucuauuggaaagcuuacuggagguuuaguaggcaccaauuaggaagcgauaggaguccaggcucgugggauggcaugggccacgggggcaacagcagaggugggagaaacagaaauuggcacauguucugaagguggauugggcgggccuugcucucugaugaacugagaagagcucaccuggcauaaaagucuuagugcuugcuguaggggaagagcuagaagcagauacucauuggagaggagaaggaggcgggacagagcacggcuugaggaagcucucaggagcuccacaucggacuguucaguuagagaugcucguggccaggccaggagcuuacuaggagggcuuagcaucaagagacuggacaaagucacucucacauaggacagacagagaggggaggcccaagcaaggagaggauaccauggaaggguuggggacagaagagaagcaagcgagaccucagugccauccuccacgagguccccuuucugguaguaugcucacugcuauggugaagggagguuaccuuccucugagcacuauauagaaagcagcaggagauauggguaagaguauaaaaacaugagucagggaccucugccccucuugcuagugaaaggugauuuuuuuuuccuccccucaccaggacaguugacaggaguagagugacaaaaggcgacaucuagcaagggcucagggauacugcuagucccagugcugggcaggaauccuuaugguggcauuucugggucauaaacccaaggaaggcagccucccuguagggagcccccauuggcuugcagcacugagcaagacugugagaucccuaccuacagccaccucuccaugucccugacccggucucuuccugcugugacaguaccccacccaguagcuggagucugaaaaucccccucuucuugauuuuuaagcaucgaggagggcagugcugaccugcggaagcagaugucucgguuggaagaggagcuggaccaggagaggaagaaguaugccaugcuggagaucaagcuccggaacucggagcgagcccgggaggaugcggagcgcaggaaccagcugcugcagagggagauggaggaguucuucuccacccuggggagcuugacuacagggaccaagggguccagagccccggagugaaaggagcagaggcacgcgucugucuaugucugcucacguuuccugcagggcuggccacagugcagaggaagccagaagcuucaaguuugggccaggccaccagcagggccaucugccuccaagugccagagagagggagccugacaccaggauggggacugucaguauccccaagaguccaggcaggaucuggauacuuuuccaaacauacgggucccagcaggggucagaggggauggugccccaggaucaugagcauccgccucucauccaggaagaguccucaguggccacccaaaaggauggcaccuugagagccaggccaccaagaacuuuauuaaagugcucugaaagcauggcgccugucaccagccucauucuucaugucugugccgaggggaguuuaccaggugauaaguuucuuggaaggcugaucauccccggguguggguggagcuccccgagggucucagcacuacugugggggggagccaccucagaagcuucuucaacucucccaucucagagccucuguggcuacuucuuacccugcaggguccucugca

SEQ ID NO: 7358 - RNA, 751 nt, Mus musculus
ccaguaaggcagguggaagcugggacuaacucugcacacagcccuaaagguguccuguagguaacagcggacccaguacaucaggaccauggaucagaagguguuaggcaagggacuccacaaaagagaagaaagaauugaaagggggaagaucuggcagacaucaaguccugguuuccaugcaugugucacaguacuuccccucuuucugugcacaaguccaucuguaggucaaagaugcucagcaugaccaagacccacacauagccagccauauggggcuucuuacccuucucagaagcaucacaaacacagcacuguguucacagggacccucaggcucagagaagggaccaccagacccuuuuuagcaacugauaagaauuagaagagcccugaggaucugcacacaggcuuuccagggaagccuggcucuguggagacccacccaacuaaagugcaggcagcucaccucuucuguugccccuuauuaucugcuuauuugccuguaaggaaacaaagaaaaaugggggacauuaugagaugaccccacagugcucauuccauaagugguucuagcccucuguaccuuccacaauccuugguaaaugaguucauguccugcaguuaugcuauacuucauucuuucaauacccuugaggauuucuucucugaaaauaaaauaaaguaaaauaaaauaaaauaugauuaugaagacuauggacagugaugguacauggcuggauauuag

SEQ ID NO: 7359 - RNA, 1268 nt, Mus musculus
uccaggacuuagaaggcauauguaacuaaccuuccugagucucuuccugagccugccucugcaacucguggucacuggcuggaagguaagcccuggccaccucucaccucuggcacuuuccugccagugucccagggacaagcuguccccacccagccuggccuugaagccccuaggcuuuccgaguaacauucaauuuccccaaccaggcuccuucuuuugcccuagcugcagccccucuucuuggagcauccuccaugaugagucucaaucaaaacauagaucuucuaucugcuuuacacagggccaugguggaaaacggcauuuguucuggaugguucagauggcggcauguuaaugaagagucucccuguggaagugcguuccagaaagaaagcugauaagaacggaaggcacacagagagaugagccacuguggaguacauucacacccucagacuaaagagccaaagagggcauggaguucuagagccagaaacagcucgacacaugggcaagggcugaaaguaacagcuagaaacccggaagguugugaccuggccugggagggaggguacccugacuucuccuaugccauuuccaucuuucagucagagcuucccgcuggcugauucuaaccuccaaccagacaauaggaaagcucuggagaccgcugaaaagucaggucuugaguuccaacuggacagacacacagaaacacaagagaauaacuacacaaaguccagggcuucugaaaaugucccuuagaguccaaagcuuccucucucaaugagaaaacugagaccaggggagauuaaugaucuguucaggcuucaugggguuuauggccaaccugagggcagaucucccaucaccacauccccugugacccaucaugugacaaaguccaugacugugacacucccuuuuauguagucucuugaauuguuuaugggcuaaaaauaauuuuaagccauucuaaucggguacauugcuuuggaucucuucccccacaggaaauaugcuggcuagcuggugggagacucugcaguugaccuugaauucccuugaccucccguguccagacaaagauuucccacuccgugcuacugcugaagucuccgaccaaugaagcagacaagggagaaccaaucccccucccacucauucuucugcagccaacagcuggauugaucuccaaacaggucggaagagaugcguaauugaauuaaaagcauaauaaauugaagccaacucguucgauuaau

SEQ ID NO: 7360 - RNA, 1268 nt, Mus musculus
auuaaucgaacgaguuggcuucaauuuauuaugcuuuuaauucaauuacgcaucucuuccgaccuguuuggagaucaauccagcuguuggcugcagaagaaugagugggagggggauugguucucccuugucugcuucauuggucggagacuucagcaguagcacggagugggaaaucuuugucuggacacgggaggucaagggaauucaaggucaacugcagagucucccaccagcuagccagcauauuuccugugggggaagagauccaaagcaauguacccgauuagaauggcuuaaaauuauuuuuagcccauaaacaauucaagagacuacauaaaagggagugucacagucauggacuuugucacaugaugggucacaggggauguggugaugggagaucugcccucagguuggccauaaaccccaugaagccugaacagaucauuaaucuccccuggucucaguuuucucauugagagaggaagcuuuggacucuaagggacauuuucagaagcccuggacuuuguguaguuauucucuuguguuucugugugucuguccaguuggaacucaagaccugacuuuucagcggucuccagagcuuuccuauugucugguuggagguuagaaucagccagcgggaagcucugacugaaagauggaaauggcauaggagaagucaggguacccucccucccaggccaggucacaaccuuccggguuucuagcuguuacuuucagcccuugcccaugugucgagcuguuucuggcucuagaacuccaugcccucuuuggcucuuuagucugagggugugaauguacuccacaguggcucaucucucugugugccuuccguucuuaucagcuuucuuucuggaacgcacuuccacagggagacucuucauuaacaugccgccaucugaaccauccagaacaaaugccguuuuccaccauggcccuguguaaagcagauagaagaucuauguuuugauugagacucaucauggaggaugcuccaagaagaggggcugcagcuagggcaaaagaaggagccugguuggggaaauugaauguuacucggaaagccuaggggcuucaaggccaggcuggguggggacagcuugucccugggacacuggcaggaaagugccagaggugagagguggccagggcuuaccuuccagccagugaccacgaguugcagaggcaggcucaggaagagacucaggaagguuaguuacauaugccuucuaaguccugga

SEQ ID NO: 7361 - RNA, 563 nt, Mus musculus
uguuacuuuuucagccaagauggcgccgaaagcgaagaaggaagcuccugccccucccaaagccgaagccaaagcgaaggccuugaaagcuaagaaggcggugcugaaaggcguccacagccacaaaaagaagaugauccgaacgucacccaccuuccggcggcccaagacccugcggcuccggaggcagccaaaauauccucggaagagugcgcccaggagaaacaagcuugaccacuaugcuaucaucaaauucccacugaccacggagucagccaugaagaaaauagaggacaacaacacucuuguguucauuguggaugucaaggccaauaagcaucagaucaaacaggcugucaagaaacucuaugacaucgauguggccaaagucaauacccugauaaggcccgacggagagaagaaggcguauguucgcuuggcuccugauuaugaugcccuagauguugccaacaagauugggaucaucuaaacugaguccagauggcuaauucuaaauauauacuuuuuucaccauaaaaaaaaaaaaaaaaaaaaaaguauug

SEQ ID NO: 7362 - RNA, 563 nt, Mus musculus
caauacuuuuuuuuuuuuuuuuuuuuuuauggugaaaaaaguauauauuuagaauuagccaucuggacucaguuuagaugaucccaaucuuguuggcaacaucuagggcaucauaaucaggagccaagcgaacauacgccuucuucucuccgucgggccuuaucaggguauugacuuuggccacaucgaugucauagaguuucuugacagccuguuugaucugaugcuuauuggccuugacauccacaaugaacacaagaguguuguuguccucuauuuucuucauggcugacuccguggucagugggaauuugaugauagcauaguggucaagcuuguuucuccugggcgcacucuuccgaggauauuuuggcugccuccggagccgcagggucuugggccgccggaaggugggugacguucggaucaucuucuuuuuguggcuguggacgccuuucagcaccgccuucuuagcuuucaaggccuucgcuuuggcuucggcuuugggaggggcaggagcuuccuucuucgcuuucggcgccaucuuggcugaaaaaguaaca

SEQ ID NO: 7363 - RNA, 3176 nt, Mus musculus
cagaaggguggccagacgcccucuacugggaagguggggcacagcauuagacccacuuaguggguggagccucuagugggaguagggaaguauucacccuggggagugaagcucccauggcugguggaaggcccaucuggguagacagucauuucacugcgacauccguuucgaacacuuacucccuuccugggggacuccgguccaaucuggagcauggguagaggauccagagacgacaaagcuagagaaggcagagccagugcaguagcccacggccugcugggggagaucggacaacacgcauucuccagauggacugugugagagucggaaugggaaccuugccccucccaccuagcccauguggcuauguaggccuuuggcucaaccuucaacauuucacgccucaaaugugcuugccuaucuuacggaagaaagucuucccaggccugaggaaaagguguggaucgucaggacuguccccauuccaggcauguuugacagaagagaccagagaauacugguaggcuagacgugaaggugagcccccuuugguggugacuagaagagacagaccgggugggcaugaagcuccuuguggggaggcagcaucucuacguggaggacgaggcuggcuggggaucagcgcauacugggagccuggagagggacuggagagaaccuguuucuuacagagggguuuuagagggaggggcugagggugugcaugggaacgaaugggaagugaaugugagcuggcacccuggcuucucugccuacaugaggggcagggugacuguccagacaagcauuccccuugucacuccaggucacacggcaucucaggugcugucuuaggaucucuugacuucgaguaacugaaucgugaacugaaagcuaccuggacgguuagaauguucccuucccgcuaaagaauucaggaggucucugguuccaggguugauucuauggcucaacaaggagaucaaagagucaaguucuuuccagauaucugcucugccaucuuuaggggcuuagugagggcugaccucauggucacaugauagcugcugcacuucgaggcaucaugaguguauccagagcugccacaggaagaucuucacauaugcaucugaacgacugaaaauuggguucuuaggcugguucauaaaauaauuaaaaaaaaaaugguacaaagccaguuuuacuaggcuuuucgagaaggggaaaauggcaggcaaacuauaagucuugagagguugccagguggagggagauggagaagaggaggagagaugcucacagugguugacuuaggccagcauguugagggucaguaagcagucaccuggcagaguaacaguggaugcaggaggaacagcuucggagaaagagggagaaagcccagagugucugggaacucacaccuaggccuugucuagcaucugaaagcaaaagaaauaggagaaaaagaacaaguuauguucuuaugauuaacucagaaauguaagcagguucuacaguugccguguaauaaacauucggcaggcaucugcacugagggaggggcuucugggagagacaaguacaucaucucauuaaaaggaugacuuuagucuuccccuccccguagcaugucuucagguaaaccaaagcuggaaagggaaguuagcagggugggggugggcccuggccaggugauugacagguccaguuguguuaacucuuaaaaggaggagauaauagaauauaauguugaucucgugucuucuggccuggccaaacuaguggacucuuuaugacaucugugguuuugaccuuuucagagggucaucucuuggggcucaugugauauugauccuuuucagacuggcuucucucaccuagugagguggaguugagcuuccccugggcucagcagcuuggagaccaccuugugacagcuccucccucucacaaguauugauugucucccuacugagauguuaccugugaguaaaggacuuccuagugucaggcucucucaccugggaacugagcucacacacagggguaccggauggccacacuuccugcuccucaccguggcccacagcuugugcugugcaucgagucggcuguggcuugugcugugacaccuuccuguccucagaagcaaacucucuuuugccaugugggcucugauuccuuguuucagaguccgggccaugcugccugucccuuguguugggacugagcuccucuuggagccuccaccauggcuguugccucucugucugucugucuguccaugucaucuauaaccuuuaucauaaacucuguacucccuaaaagcuguaucccauuauauggaugugccagagaguaucaguccugccgaaggccgucuuguuugcuguguguuugaacuguagaaaucaaacgucuacagacaucaucaaagagaugcaauaaaaguccagcuugguuggaggaaaugccaaacucaaaccucucucucacagcagcugcccagauuuguauucucgcuagcagaguacgagagguuuacucaucuuuuuauuccugguuauuauacagcugggagcauuaacaagugagucucaguguguacagaauuuuauggguaugugugagacugucuguagaguaacguuucaaaaagauuuuuaucugcaaugcuugaaaauguucauuuccacaccugcaucgacugcgugcuacuaagcuuuaauauuuuggcaauuugacaagugaaaaaaaaaaaaaggaugacuccugaaggcuucuacugugagagagugagguggugcucuggcugucugggcgaggucuuuucucuggugacucucaagcugugcaguauuggguacgugacugacugucucugggcuuuggucccuccaccuauaaugugaagauagccaugauucuugccuuguuaacuggacuugaggacucaaagguaugcaucauguaaaaugcuaacauauccugucuuuaaguaaguggugaguuaaugaauauuauuguguaauauguuuaugacaauuugggcuucuuagcguaugauugggugguucauaauaauuucccguuuucucuggauucuucuuuugcauauuaacugauuagagcucuuuguauuuuaauaaauuucauauauaccucau

SEQ ID NO: 7364 - RNA, 943 nt, Mus musculus
caugggaauuuggauuuugauaaucucuuuaaaauccauacugauggagcugaagcgauggcucauagcaguuaggaacacuugcugcucuucgggaggaucuggguucaguucccagcacccacauuagguaacuccauuccuaggagcucuggugcccucuuuuggccuucuugggcaccugcauacauaugguguacacacaagacaagcagccacccacacauacacagaaguuuaagguuuuuaacuuaaaaauuauuauaauagcuguuuuuuauuauuucaugauuuuuaaaaaagauuuauuuauuugaaagaguuauuguauauacaguguucugccugaauguaggccugcaggccagaagaggacaccagaucucauuacagaugacugugagccaccaugugguugcugggaauugaacucaggaccucuggaaaaaccuuugagccaucucucuagcccuauuucauuuuaaaaaguaucuucuucagaaaauaaaagccuaucuaagaagaauauaugguuuuuaauucuuuuuuuauaguuaauugcccucacagcuaacauuucuuauaguuuguguuuuauauguuugauuacuaucuguaagaugcuuuaucaaguuuauagcaggauguucuuucagagauuuguauaguaauuauaaagcuuauuuccacauggguucacacauggguugucuuuguacuaugcugaugugcacagagcuauauucugaagccccacaguggagcuaugaugcgggucaaaagaaacagacaagauccuuguguuucacagagcuucaauuauuuuuuacaauuaagaucgcacauacaguaaacaucaaagauguuuagaaaaauauuuuuccugugcauuaugaaaauucaaaauuuaaaacuagaauguaaauaaacucuuaaccaggac

SEQ ID NO: 7365 - RNA, 74015 nt, Mus musculus
cgcggccgcggcccggaaggucggucccgugugcacgcgcggcggccugggagguggaagcggacugcagggaggccucgcuggcuggccagcagccccggccgcaugagucaccaggccccuccuuuccgccuugggccggaacggugugcggauccgcugcgcggccggccggagagugacgccgcgccgaagccgaagaggcgcggggcaaaucccgacucaucccgaauccgacuguugaggaaccgggaaagcaagaagccucaggacaggagggaggcccugaccccacaggccuuuacuuugcacaagguuuuaauuuguuguaggcaacuucagcgauuuugagguaaaacaguuaugcaaagcauuguugacucuuucgcgugccacuuuauuuuaccuuuuuuuuuuuuugaaaagucagggccccuguagcccaggcuugcccagaacucaugggaacuugccugcuucugcucccccagcccacuccccugagugcuaggauuacaggcuugagucagcacacccgcacauaguuguaacuccaccauugacugagugugugccccucuuuuggaaucacguccuaaaguaaacuagaaauauaaugucucaguauauauauuuaauuucugcgacucacuuuauggaucaggcuggccuugucugagugccugagugcuuagauuaaaggaaugugacauccuguguguguguguguguguauauacacacacacauauauauacacacauauauauacauauauauauacauacacauauuauuuaaauggucuaggaucugauuacuaaguuauaauuuucacaaugguagccaggcuugagugcuacacucugggaaccccagaaccugagaggugggggcaggaggauagaguuugauuccagccugggcaacaugagauacucauuuuucucaaacaaagcuacaagaaaauccaguugaacacacacacacacacacacuaacauccuuuaagucaagcuaccuaucacgugccacauuacuaguaaaaucaccccagagugccuuggcgauuuuguaaacccuuggacuuugugacacuauucaucucuuacaugacuuuauucaucuacuaagcaugaaagagaaauucuuaguucuuaaaauguuuuguacacgugaagugacaaccuagaccaguuaaguugcauucauuuaucucagcgaacucuaaagcaauauugagcuuuccuucccagugacuuauaucuuaucuuauuugcugagugauaaccguuaacuguauuuauuauguauuaauauuaauuacaucaauauaaacagugguugauauaauaaaauauaguuauauuuguaauaaacaauaaaugauaaccauuaauuauauuuguauuguguuuuuuuagcaaaaaagauucuccggccugcagcaugauuuuggcuugaugugaaaagauuaagguaccaaauuuccuuuucacuugauaauauuaucacucuaugauuuuauauuacacaaaacaaaacauucuaccuagaaccuaaaguuucaaaagaauaagacucccaaauccugagguuuaagcauuagccugacuagugucugugagcacauggaagcauaucuuuugauauauuguuguuuugaaacaagagucucacauuauagccaggcgugucuguagcucacuguguagcucagugggauugccuguuaaacuaccauaucaauuuucuuuacugauagucauagccuuaaaaaauguuuaauagcugggcgugguggcucacaccuuucaucccagcacuugggaggcagaggcaggcggauuucugaguucgaggccagccuggucuacaaagugaguuccaggacagccagggcuacacagagaaacccugucucgaaaaaacaaacaaacaaacaaaaaacaagaaauaaguuuaauauuacuuuuucuaugcuuuaguuaccuaaauugaagacauuuuucgaagggagaagaaauauaaagaaauauaacuguagaaguuauuuuauuuaaaaaaaauucauaucucuuguguguuaguauguuaaaaauagauaaggucuauggugcugucuguaaucucagcacaggaggaaucaggcugaagcaggaggauugccaugaauuuaggccacaacauucaugucacauaaugaacucaauagccagaaggacacugucuuaaggggaggaagggaggaagcaaacaaacuuagaacucugagaaccugagaauauaguuuuuuauuaaaacauuuuaguaauguuuuaacauuacaugcaaguuacacaaaauauaacauuacaugcaaguuacacaaaaucuaacaaucuaauguuuuaacauuacaugcaaguuacacaaaaucuaacaaucuaauguuuuaacauuacaugcaaguuacacaaaaucuaacaaucuaauguuuuaacauuacgugcaaguuacacaaaaucuugguagguuuuaaaaauuagagugagcaggcauguuagcacaugcccaugcucuuuggcagagucagggugaucucugauuuggauuggagccuggguuauauagugaggaacccuccccccaacucucucacaucccccaagagaaagagugaacuucuccaggcccgccucuuuaaccccuguuuagaacacagauggaguuuuccuuucuuccagaaggagguacugugacuccuuacuuacaaggacagccugaggcuugggggcacauuguuggauguuccccuaucuaauaagugggcgaagagucaaacuucauauuugacuccaaaauuguuaucuuuucuuauccaaaaagcauauauuugcucuacuuaauuuuacaucugacugcuguguaaaguagacaaauaauauccaaauuacaauuuaauuaugcauaguaauuuccauuucaaaaggagaccaaaauuuaacuugaaaggaauuuuagucuuugauggcauucaacaaagaccaauugguuuucugccuuugggguugauacaacuuuuccuugcuauuuuacaaucuugcucuguucuugauucauaguguucuuuugugcuuucaauuaguugaaaaaagauuuuagaagagagcuggaauuuauacauauaaauauaugagcaaaaaucauuggaugaauuauuuaguuugaagggcuguauacguuuucuauucuguacauuuuauuuaaauguaaucaguauaugaucuuuagagguuaucuucuuucacugaacauguuuuaaaaguauauucauugauguagcacgugucacucuccacuuuacugccugguuguacuucucucuuucaugaucuaucacugagcuauacccacagugucacacuucccccacccuucaagacaggguuucuccguguagcucugcuguccuggaauuagcucuguagaccagguugguguugaauucaccugccucugucucuggagcccugggauuaaaggcguguggcaccaucaccuggcuaugaacauuuuuguagaaguuuuuguguagaaaucuuuucucuguucucuuaggugucuaggugggaaguguaggugugugguaaguuuguguuugccguuuugagaaacuaucagauuguuucugugauugaacuauuuuaauaccuguuguccuuguagaugggcucccauuucuccucaccagugugucucuguccuuuugauuauagcaucuaguggguguuaaguggaaucacuggccugugcuugaagucugaugauguuagcuugagcaccuugcuguuggcuucuuauuguacauggcuuuagggaugugucuuuagauccuuugcucauuuuaaaaguuugcuuauaugucuuuuauacuugucguguagcccuggcugcccuauaauucacuuuguagaccagucuugccuugaaccuaaggagcucuaccugucucugccuccugagugcuggaaucaaaauuauacgcccucauaccuggcucacucacccuuucuugucuuguuuuauaccuuagguuuagccauuaacuuacauagcccaaucguaggcagucuugccuuuucaguacugaguuuacaggcauaagccuugaucccuggaauguccuuuuauuuauuuuuuugaggcagggucucauguagcauagucuggccacaaaucucucuguagcugaggaaggccuuguacucuugaucucuggcaaccguugguauuacaggcaucuaccaccucacuuaguucccuuucacuaaugaacugugagaauucuuuugguacucuaaguuuuuuguuagauauguguuugcaaguguuucccuccuuucuaaguguuaucuuguguauauaauaugauauauauacuuauaugucuuaacuuauuguguagaaaauaaaacugacuaaacguguuguuaugucauuuuauuuauccacguggccauucuuuuaacuaaaacuuuccucuuguauguagcagggugugcugcugcagcacauguguggaggucagaggacagguuuccggaguagguucucuuuguggaacugggaaucuauuccgaccauuagacuuggcagcaagugucuugacccacugagucaccucucuggcccucauucauuuuauaucagcaccacacuuuuugauuauucuagcuuuuucauuuguuuagagacaaggucucauguagcccagguuggucucaaacuugcugugugacugagacuggucuguccucaccuuccaagugcuuguuuuauaggugucucccucccucccucccucccucccugucucccugucucccuucuucccuuuucuuucccucccccucucucuaucccuucuucccuuucuuucuuuuuuuuuuuuuuuuuuuuuuuuuuuuuuuuuuuuuuaaagauuuuuauuuauuauuauaauaaguacacuguugcugucuucagacacaccagaagagggugucagaucucauuacaaaugguugugagccaccauaugguugcugggauuugaacucaggaccuucggaagagcagucaguguucuuacccgcugagccaucucaccagcccuucccuuucuuucuugaucucucucucuuuuccuuucuccuuucauuauaguuuuguuuuauauuccaaccuuguucuuuuuuuugugauugguucuaugccacuugaauuuccauauaaauuuuaagaucuugcugaucuuuguaaagaauucagaauuuugaugauuauguugaaucuauaaaucaauuugggacaguucucaaaacuuauaagagaauggaacccagaaauucuguacaauuauagaacuggugugucaguggugagcauauuucaaacugcgagcucuuuaauaucaugagaagaacugaaaaucuuaaagacuacaguaauauguuuuauauuuauagauuuguacacaucugacuuaaguauuuuuguagaauuaccuuuuaagguaucagucuaugauuccaaaaaaauguguaguaaacuaauaaaaauaagaucugaucuuugaguuuccguguguguguguguguguguguguguguguguguguguguagggaugaaccagaacaugaugucuuugucuuagcuucccaagugcuaagauugcagucugcaccaccauuccuaguuugcacuucuuuaggcaaauuuauugcuaaguaguuugcuuuacuauuuuguaagaugugguuucaucguguagugcaggcugaccuugaguuugaucuguagcauagucuaaccuccagccagagauccuuuuguuucugucucccaaguauugggauuacaggcaugugccaccauucuuagcuucuuuuauccuuuugaauguuuuugagacagggucuaaaguggcuuaugcugaccucaaauuagcccugacuugagauucuccugcuucagucuucaaaugcuggguuuuauaggcaugugccaccacacccagcaagauuugcuuuuggggggggggggggaucaguuaguaaauagagcugagacaaacauguugacacaugccugucauuuuaucacuugggagucggaggcaggagacuugucaguuugaguuauccuguaagccgucgagugccaugauuuuuagcuuuguguacuuauuaggugaaagcuggagagaggcucagagguuaagagcacgugcugcucuugcacaugacuugggguugguucccagcacccacaugguagcccacaaacaucuguaguacaguuccuagggauccauugccaguuuggccucuacugguggccuucacauggugcugaguaacucaugugggcacacacaaacacacacucacacacacucacacacacacacaaacacucacacacacacacacacacacacacacacacacacaaacacucauuuaaaaagaaacaugccaugccagguggugguaguagcacauuccuuugcccccagcacucuggaggcagagcaggcagaucucugaguuugaggccagccuagucuacagagaaaaaguuccaagacagccaggacuacacagaggaacucuaucuugaaaaagaaaucuuaaaaaugcuaggucacaauaaauaaacauaauaaaaauaguuugaggcugcuucucuccccagcaagggcagccacccuucuguguuuuuccaauaaaucuguugugugagaucuguggugugccuuugugguauuccuuggcuccugacugccuggauaccuuuccccucagagcuauaacacuuacaacugggucucucaucgcugaguucuggagugagcagguagggagcagauuaacuacaagguagcacagcgugguagcauggccagugcugcuggcucacacccacaggaaauguagaaaagggagaacauggacuccuucaguaagaacgguucacauccuggaaucaggagaccaacugauggcugugagcccaagccucugggcagugacaucaggaacagggaugggaccauccuggauaggaaccuagcucugccccgggagagacagcugcagcaccugaggaggaguuugcauuauuuaaguugggggguggggugggggagacggcaggagagcauggauggggaaggaaacagcuguuagcagagggcaauaaacaggaugcugugaaagcugagaaaacaggaaaaagaauuguaaaaaaauuuaggucaauuuaauauuguguugacauuugaauaguaauaaagcggaguugaaagguaggaccuauauucuagaucuggaaaaagugagacuuaugguagaaacagaauuuuacuuggagucauacaguguagucgcacuugcucccuaggagcacuuagaguuuccaaaggcaggaaagauccagaucaguggcacugauguccugagccagugagaaggcggggcucugacuuuagaacuggaucgcagagggaagagauacuugcuaguggguuaguuaggcugcuuuugcauauccaaauaaaaauggcuuaagcucaagucauaaacuaagauaucugcugccuaucaagccuagagacagcuuucucacgguaaguacaaaaggucaggucagauaccaaaguacucuucucccuguuuuauauugagauagcuagugauguuuuuccuacugguuguaagauggcugucuuaguuccaggggucacaugcaggcacagcugaguacuaagacccagcagcaauuccuaccucuuuuuaguauagauaauccuuuccaaaggcugccaugccucuucaguaaucuuaggcuaggucuaaauugcagucuaugccuuggcugcagggaaggccgaggucacuccccaagcaguaauuacuuucaaucaacuuuucuaguuugcuuuaucuuucugugauaaaaaucaugauaaaagacacuuggagaggaaaggcauuauuuggcuuacuaucccgaucaagguccauccgucugucaaagagggaaacugaggcugacacuucagcagaacccguggaugaauguuauucacugucuugcuuuuugugguuugcucaguuuuucuuuucuuuuuuguuuuggaauuuugagacagggucucucuguggcccuggccauccuggaacuuacuauguacaccaggcuggccugaaacucacagagguuuaccuaccuuugccuccagagugcugggguuaaaggcaagugccaccaugcuuggccaccuugucuucuuaugcagguucaggaguggcauuggccacagugggcuggacacuccaaagucagucauuaaucaagaaaaugccccacagacuagccucgcagaccagcguggucgaagagcaucuucuccauugagcuucccucuucccacauaaccucagcuugugucaaguugaccaaaaacuagccagcauaacaaccaacaguacuuaccauguuugccacagaaaagaacuaccuuccucuuuguuuuucaucgugaucauguaguucccuagacaacuuugaauggaggaauacuucuggaguaugauaugagaauuaugaugcuuguguuuugauguuuucaauacuaaaaucugaaaaaucuaguucucuuugauaucuuauguaauggugaucauuuuaagaucaugcuuccagcuuuugaauaacagcuuaaaaacaacuuugggauccgguauuuacuguguuauuggacaggaggacagaacagaaaccauccucagcuuguggggguuauaaucaaaaccaagggcuggaaugaucuugacagauuuucugauaacguugcucucagugacuugcuaccaguguaggacacaggcacauaguuuaaaacguugagagcacuaaccuggccuauauguugucagacguuuuugccuuuguccaaggcagaaaugauagacucuucagagucucuguuucagugguacuuuagcacaagcacaguuuaggauaauacuacuuuaaagauacagaaagaagcccagcaguguugaacaucuuugaucccagcacuugggaggcagaggcgggcggauuucugaauucgaggccagccuggucuacagagugaguuucaggacaaccagggcuacacagagaaacccugucucgaaaaaaacaaaaacaaaaaaaaacuucgcuauuuuacauuaauuugucuuuauaccauaguugaaugucacugauccacagaaucagugugcagagauuuugcaauaagaacauugucaggaagagaaauuguuuuuccuggccuaagcauguagcacagugcuaacuugcuugucuagcauugguaagacccuggguuugaucuccagcaccucaaaaucaauacauucuuucccuucaagcgugacacaucaugagugauguugccagaugucguguucacccaucauccuagcucuggggaaacagaggcagaacugcugugacuucaaggccagccugggcuacgaggcaagacccugucucaaaaaccccaacuaaaaccgagucagacaaagcuagugaguggugugauccaguuuguauuuuuaaagaucucuuuaucuguuccauggagacuggacugaagagacccggugacccugguacugucauagguuguuccacagugaaagcacaguugaaagauuggauaugaaagguggaggaaaguuaguaugugugacucucuaaguucuggcuuccauaauacuaccacuuugaagauaaauaguaacauauaggacauuuugaaguugagguauuuguuaaggcaacgaaaugaaguugcuaaaugggaguacuaucaauaaaagaguuugcaacagaucuggaucacagcuauaaauguaaaagauauuuaaaagaaugacaagaaaacuuaggggucaaguauagaaaccggguaguucccaguguagucaugaaagaucccacgugugcaaguuuggacgguggauuaugucaguucugucaggauucacuggggacuauagaauggcuuagggggagugcuucugugccagaugacgggaauucaguccugagcaccuguguccuccggagggucauaacuccagcuccagggcauccugacacccucuuccuucccucuugccugugcaugggagcgugccugagcgccugggugcaccugugugucuaaaagaaaagaauguacuggagaauuuggagaugcuguacaggagguauauauauauaaggaguaggacggggaaguugguacccaaggagucuuggaaggaccauuuuggagagcaugaagccacauaggagcuaaagaagcaagucugacuuaggaaauugaaacaguaaaaaaaauucccauccaucaagguccuuucucagauacuaaauagauucuggaagucuaacuuauagauguaaauuuuguuaucaccaggacuagguaauauaaauaagguuagaacaaacaaaagguccugggaguaucugaacccaaagguugacuagaaagaaaugaucugagauaguaauggaagagaggaaauuauuauugaagaaucuuccaauguugguucuaaguugcagucuguguguguguguguguguguguguguguguguguguggugggacugaaccuagggccuugagcauauuaggcaaauacuccacugcugagcuacaucuucagccuuuuuaaugaaccuuuucccagucaaguuuaagaugacagcagcugaguagcugagauuagagaaagggcaggcuuagugugucuaaaacauugaggaggaaggagaguuuugagaaggcuuuggagacaacaugaggcaaguggaaugcgacuaucuaggagaauugggacaguguguuucccgaaguucugguguguuuaguuaugugagugcgcuuuaucugagaaggcaagugaaacaguucagcugucuugguauaaauucuaugcucaugugacacuaggauauuguggcgagaagaguaaguacagaguacauuuuuaaagugaugagcuuugaaaugaggcugacagagaauaaagccagaagauacugugcguuguaacucaagaguuagaaguacaguugcuguuaugacagaucuggcaggauuucugaaauagaagcaaagugaagguucuuagaaucaagauaagccgacuguaaagcuggguuguuagaggacuugguggcagagccagggagugaggagacucugaaccagauugcagagucuuucgcaaauagagugagcaggucaguagguaauagaagcccauuucaggguaggagcagaugacacaagcguccggaaagugguuuuuguuugaggguaacaagcagguggugaacauuuaaugcuuucugugggcugcauauuugaaugggggagugguuugugcuuagacuugguuccgacaaaauuugccaugucagugaaugaaguuaguucagaaucagaaucuuguuuacaguugaacaguggagagggccgucaggaggcauagcuugggagguugugugucagggaagaggggagggaagguguagaacaggaacuacacagguccucaacaggaaagggaaugcauuguugggaguuguuuuuggagaauugcaaauaugaugaaaaauaaaaucuuagauaucaacaugucaguuaauuuaguggaaacuguguuuaggcugacagacggagaugcugggcuuugugaaacuauauaccugccaguguccccagcucugcuugcuaauaccuagccgucuuugccuuuugcuuagugugccauaaagcucccuacuguaaagcuguuuuauucuuggcaaagcucagcucugaguggugaggaagcuuccauggaagcaguuggugcgcuuuuaguuuuuugacuucagagaucucaucucugagacgugaggacagagauaacucuuaguaagagugagaaaacagugagucuucggggcccauuaagcaaagccugacgucccaugaagaagggcuauaaagaaacggagucccucugcaacccuauagguggaacaaccuuaugaacucaccaguaccccggagcucuugucucuagcugcauauguaucagaagauggccuagucggccaucacugggaagagaggcccauugguugugcaaacuuuauaugccccaguacaggggaacgccagggccaagaagugggagugggugggugggggagugugugggggacuuuugggauagcauuggaaauguaaaugaaauaaauaccuaauuaaaaaaaaacaaaaaaaaacaaaacaaaacggagucccaguaggaauaaauagcugggacugucacacuucaugaucugcuuuuuuauuuuugucugugcauauauauguguguguaguaaugugcaagcuaggugugccuuuggagguuagaaggugauaguugggagggaguccuucucuccuuccuggugggauccagggauugaagucugcuugcgccauuugaauuccaaaugcuuucacccucugagcucucuaucccuccuccuccugccuuccagcuuccuuuuuagagacuggucucaaguaacucaggcugcccuccagcucgcaguguaaacagagggugaccuugaauuucugaacucccugccucuccuucccagugcugggguacagguacauguuucuuaaugugguguugaggauggaacccagggcuucaagcaugcuaagcaagaacuaaauaguuguucuaaauauaauauauucugauuauagucuuucucucucacccuccuuuuuagauauuuuagugauggcauuuuuguauuuuuuuaagaguucuuuuuguuguugugcuuuuucuuuuucuuucuuaaaaaaaaaaagagagagacaaccucacucuagcuauucuagaacuuuucguuuuuguuuuuagaauaaauguccacuuaucugaauagauaacaacaauaaucccaccagcauccagccugaugaacuggaaucuacuggaaauacuuagaggacugcaggugacucacaggccgccgcugcuucacugaagagcccuaacccaccgggacgggugggguguguguggggugugacucauggaaggagcaucccuggagcucccaggaagacucucuucucugcagcaauagcucuugucuguguuaucuugaggaggaaucuuaggaauaguguacauuuuagguauuuccucagagugugaaauugucuacuuccugauuugaaucuguaaguuucuuuacuuccugauuuuuuuuuuuuuuuuuuuuuuaaaucuuaagacaggguuucauuaauguagcucuggcugaccuggagcuagcuauguagacuagacuggccucuaacucacaguuuugaguuuuuuguauuguuucguuuuguuuguucuuuuguuuuuuugugguuuuguuguuguuucugcucccaagugcugcuauuaaaggcauguaccacuacuuacugauuuuuaagagcucuuuccagugaugaaguguuucaguuugaaauaaauugcacccaggggugccuguagucccuagcucugcuguuagccuucuaagugcuuguuuauuuguuuauuuuaaaacacauuaauuaguuuucuugaagguuguccuauaaaaaagauuccauuaucaaauuaguuugggaaaucggauacauauuccagcacccuaccuccaccaccuuagcaauucacagugaauaucagcgucuuccagguugauaaagaugcugggaaaugguauuacaaaucaucuuaucaaggccuuuuaaaaaggguguuccuccuaguucuacugcaagcuaguuccuauacucucgaggucaagcugagccggaacugaaacccaggguagcuggaugcucacucucaagcccaguuuccuguucacagugagcaaacagcuuuaauauuaaacccccugguuucucaaaguuguuuggauguaggcgucguuauuuuucaaaacuuacucaaaagucagucgucccugaauggguuccaggaauguugccugggucaaucuacaguagugauugcagucuuuuaaauaaugauguuuugggguagaacuugguuuuuaaguuagcauccaaaguaaugaguuucaucauggcuucuucauacauuguaucauuagacuuuagaauuggguuuucuauuugugguguuaaaaacuguauuuacuuguuacuuuuucuaauuguaccuauuuuguguucuuauucacaaugacuuuccuccuaaguugugguaggucuuuguuuuugagacaggguguauuccaggcaggccuggaacucucucugaaugauggagugacccuaguggucugaucuuccugcuuucacccaguaguaguuaccugcuagcugccaugaccacuuuauguggucuuggggacugaguucagagaccugugcaccuacucaagcagucuccgcuacauccuuagugccugcuuuuuggguguguuuuuuuuuuuuuuguuuguuuguuuuuuugagacaagcaagaucuugcuauguaggcuaggcuagccucaaacucaaaucuuaccauaaccuuacagauguuucacauuagcacuuuucaaguuuuuuaaaaaaauauuuauuuauuuauuuauuuauuuauuuauuuauuauauguaaguacacuauagcugucuucagacacuccagaagagagcaucagauuuuguuacagaugguugugagccaccaugugguugcugggauuugaacucaggaucuuugagcagucgguucucuuaaccgcugagccaucucaccagcccccaagauuuuuuuaauacuaaaacacaaagauugccgggcaugguggcggacaccuuuaaucccagcacucagggggcagaggcaggcgaauuucugaguucgaggccagccaggucuauagagugagucccaggacagccagggcuacacagagaaacccugucucgaaaaaacaaaaacaaaaaaucaaaaaccaaagauuuauuuuuauuuuauguguaugagugcuugccugccugcaugcauauaaguguaguauugugaacuggaguuacacuaugugggugcugggaagguacugggaagcaaaccuggguccuguacaagauuaguaaguacuuuaucugcugauccaucuuucuaguuccuaaaagcauuuuuaauccaaauugguguuucucuucgcccuuucuguucuaagauuauuucagucauaaacuuuucguguuggggguccuugagauggucuaccucaucuucuucguuauuuuucuuuaauuuuauggcagguuaagaaaauaauacccauuuaguaauuugcaucagaguuugaagcuuuuucuaguaguucuguaaucuuagaagaguuacuucauucucacaacuuacuucuuugucuaaaauaaugucguguaacguaaccauaugaaucaaguaagaggccagcaggauggcuuagcaaggaagggcugugccgcuaagccuggagaccuguuugauccccgggaccuacaugguggagggagcuaugacucucaaaguuguccucucauguccacauauguacuuuagggcacauacacaccuguggaccugugugcacacacacaaaauguaguuaaaacagaccagaaagauggcucaguggauaaaggugcuugcuuaccaccaagcauaacaaccuggcuuugauccaugggacccaaugaugaaagugaggagcugccuccugcauacuguccuauccuugcauccacuccucccauccccuccaaaaauaaguaagagaaaagguugaacaagagcagcagagcuggguggcgcacgccuuuaaucccagcacgugggaggcagaggcaggcagauuucugaguucgaggccagccuggucuacaaagugaguuccagaacagucagggcuacacagaaaacacagaaacccugucucgaaaaaaaccaaaaccaaccaaacacacacacacacacacacacacacacacacacacacacacacacacacacacaaaagcagcagagaggcugcuggaauucagggguuguuuuaacacuuuucuuaggccaguuauguuagcacaagccuuuaaucccaguacucaggagaaaggccucugaauuauucaagguuuaccuaguuuuacauacugaguucuggacuagcaagauuaugcagagagacccugucucaaagagagaacuguuuuuaaugaaaaauaaaaaagacuuaacuuaggaaauccauguauuguccagcuuguugaagguucucagucucuccccuugcccucaggaaaugcucuucauuuuauuacaugaaugaguccugaaacaguuggauagugcuaaguaguuuuagaugugaacuuucucaguuuuaugcugacaucugccauacuucucaaaguaauguugucauggugacugcagguuguaugggaguugaagccagucuccuuccagcggacauaaaagcagaaccuacuggguaagcacagaccuacuuacuagcucaccuauuggugaugcuccguuagcucugcugcugacccacugcugcuggucuuuuugaaguuucaucauugcaguuuauaaccugauaugucuucagaagcuuugcagaaugcuacggcuuaaaucauccucuagaacaugugaaauaucuuuccuaaaauggacuuaccuauuaguauguuugaagucaugcaucuaagaugaugcaccauguucuuuuuuuuuguuuuuuguuuuuuguuuuuuucaagaugggguuucucuguguagcccuggcuguccugggacucacucuguagaccuggcuggccuugaacucagaaauccaccugccucugccucccaagugcugggauuaaacgugugugccaccaugcccagcacaccaugggguucuuguuugcuguuuguguguuuauggguaguacuuugcuaauguaaccugaggauggacauugcaugaacauuguauaaaacaaagcgauuauaauaaaaaccuacaggaagcuuaaguuguuaaaaaaaaaaaaaguucccagcucucaaagaagcccuucaagaguauugcuaaaucuuacuucuaauucuaacucugccccuugucauuucuaugauccugauagcuugacagguuucugcguuuaaguuuccuuauacauaagaaagauacaaccaaauuuacccacuuuguuccaauaauuacuguguagccauguaaucaguagagaagauacacacauaggaagcauacaguacuuugcauguuuugcacaaauaaccuguugcauucaucaggaauguucuuuucaaucucauuuucuauucauuuccuaaacauuuagaagcuauguauucaagauagaauauaaauguuuaacaauuagaaugaaaauuaaaauuuauuuaaaauuaauaauaaguaauuuauuuugguccacucaaaguguuuuagcaaaaaaugguuuuauguuugacagauauugguuugaaacuuccacuugcaauguuggugucauggcuguaggcaaauuauucaagcuguguguaaacuguuuggaugaguggguaaggaugugcaagcaugaggaccugagcuuggaucccagcacccauguguacagcuaggcauggcugugcuggguaugccugcagcccagcaugggcucuguguuuuagccaaggcuggucaugaguucaugcugagcuuucuggcauuuugaugugaaguccauuuaucaauuuuggccauauauuuucauguuaauaaaugcuuuuauagucuaugaauuuauauaaagcgaaucauaaagaaauuaaauacguuucaauaaaaguauagaauuuuaaagcagaaaaggugaucaaaacaaauaguacuuuugaagguugaguaugauggcacauguuuguaauuucgcaguugggaggcugggcaagagcccauggcuucacugccacccugggcuacagauggacacugagccaguuagcaagcacuacacaggaagauccuauuaaaauaacuccccuacucugcaagaaaaaaaaguacaaauaaaugaaaacaagaaaaaacaaaacaaaacaaaaauauggucuuaagaguuagcccaggcuagccuaggcuucauaggguccuguuucaaaaaaaaaaauuacagauaucaguuguuuccuuagagcacugguuacuaaauuguguaauuuaaauaguaaucuuuaguaauuuuuggaguuauucuuuuuuuuuaagauuuauuuauuguuauauguaaguacacuguagcuguuuucagaucucauuacagaugguugugagccaccaugugguugcugggauuugaacucaggaccuucagaagagcagucagugcucuuaaccacugagcuacucuccagcccuggaguuauucuuaucucuaaaauguuuuuuuuuuuguuguugucauugaaugacuuuauaucauauagugcuuucuacuuagacaagguuucucugguuagcucuggcuguccuggaacucacucuguguagaccaggcuggccuugaacucagaacugccuccuuugcuucugggauuaaggcaugugccucuaccuccuggccuuuaaaaaaaaauuuuuuuuuaaaacauuuuauugugugugugagacaguacaugggugggaaucagaggacaacuuugagaacuggguucccucuacuaugugaguuuuagggauuggaugcugacuaccaggcuuaccagccagccccuuacacaccgagucuccuugccagcuuuugugggacaggggcaucacuucuggcuguaguauaguuugcaagugauaaucuacuaacuggaauugugcauaaauguagauaaggaauugacucaaauaaaauauuggucauugcuguuuuuaauacaacauauuaggaaagauaaaggaaaagaagucagggaaauuugagguuaaguuuuauuuuaugaaaucucaacagaaugauuuaugcauacuuagauauagcaaggaucugacuaaaacgugauuccuauggggauuaccuaaguacacucugaagaaauucuuggugucccagcucuggucuugcuacugagaucaaggacgguguucaugcacauagaaauagucaugcauuuccccaaagaacugcuugguucuaguagaacucugaauucucauccaucauucauuaaacaaccauuuuaagcuauucauagagggcaaguacuaugcagaacauuguguuuaaaacaauccaaagauaaauaagacaauuaugauacaauuugugaucuuaaauuugugaaccuuuuuuuccuucugucuguggagaacacagaacauauaauugaagguuaucuaaaugguuuauguuuauuccuuuaauuucuaguaguucuuaggagguacuuuauaggguuaauugguuuuuguuuauuaccacagcuuuagcucuauuucgucauuucaaaaaauguuucucaaguuuuguagugaacuguaagucuccuuggagaauacaaucucuauauaaauuggagacuuuauuuauaguagaguggaacagugcuugcuucagcauuacugaguuaauguauaguugguacaaaguuuucccuuucaaugacuaacuuguuuagugagagugaaugauugauuauggcaacugaaaguauaaaacaugaguguucuauucugaaguaugguagguaucuuuauaaauaacuuucaguacguuuuuuuuuuuaaaucuuagauaugaaacuuagaugaucacccuucucuuuuguuguuaucuauuuuuuauucuuugcuuuuuugggacagggucugauguaucccagccuggccucaaacuuggcauauagcccaggauaaccuugcauuucuaauccucuucuugccuccuaaguguugguguuauagacaagugccaccaugccuugcauuugauaccucauaaaaauuuaaaucagucaauuuuucuuuccuuuuucaagacagggucucucuauguagcucuggcuguccuggaacuugcucuauagaccagacugucccugaacucagagaucugcuuaccucugccuccugagugcuaggauuaaaggcaugcgcuacuaccucccagcuugaugcuuuuuaaaagggagggauacaugaacagggcuuugaaucuuugaauauacuagauaauuguuacuauaauaauugaauauuuugauauggaaacaaugcuaguuguuuaaaaacacaguaaguuacuaacuuuauuaaugauauuuauauucaacauugcaguaaguguuauagguauauuagcuuuuaaaaaugaucccuagauuuuacuuaaaauauuuauuuuaguuuuaugugcaugaguguuuugucugcagguacguaaguauacguguguguucaguaccucuaggggccagaagcagguaguggaucccuuggaacuagagucacugacuguugugagagucaccaugugcuggggacuggacccagguccagggcaagagccauugaucuagccccauucaugcuuuguaaacauuucacaaaagggaugcuauuauuauacccacuuuacagacuagagggcucaagagacugaaacccaagguuucugcucuugguggcaguuucuuaacaagaguuuuaacaucaugaaaauacuguuuccuauuuuucuccuuucuccuucaaacucaaguguuuuauuauuuuauaucuugcagggcaguuuuguuagauauaguuuccagaggucaggcuuaguuccccaguuggguuuuaugucuuuaugacucuggcaaagacuuggaaacuacauuccacccuuuuuaucuuugucuucuuucaaagcuguguagauuaaugagucaaguaacggucaggguaauuuucaacccuguaucacuuuuucacuuaacccaagaaacuuuauaucaauuguuuacauuaucuauuuuuuguuuuguuuuuuagacauguuuuaaagauauggucuugcuguauguagcuuaggcuagcccugaacucucuauguagcuaaccuaggccucagacuuauuuuaucacucaaacuggccuugaacugaucuucugccauagcuucugcuugcaggaauugcagguuuaagucuccgugccuaaguuguuauguuucuuuuaaaagucuaauuaacuuguauuuuggcuucuuauuaauuagagagauuaauuaauuaauuaauuaagauuauaucuuugaaaucuuaggguauuauaucuuuuucuuaacauugcaauucugaauuuuauuuaguuucguaguuccuucugcagucuccucuuuuuuuuuuuuuuuuuuuuuuguuuuugagacaggguuucucuguauagccauggcuauccuggaacucacuuuguaaaccaggcuggccuggaacucagaaauccaccugccucugccuccugaguacuggaauuaaaggcgugcgcuaccacgcccagcuugcaguccucuuuauuaaagauaaauaucaguuucugccacaugauuguuaacagcauuuuguuuuguuccuagaaaccacuaggaucauuuuaaaaacaaggaaugcuaauuaugaauaauauccuccuucauuuccacugaacacuuacugauuuuaucauuaugaagaguguguucaguuucugcucagaaugggagcugauagcaggacacgaggaaguaguaaaaguagaugugauaauauaucaugcugcucagagaaagugacgaacauuguaccaucucucuuuuguuuucaguuuucuaaacuccuggucccauaaaaauaucucuuccuuuauauaauugccuccaaaacaaacuaaagcaaucuguaaguaauuauauuugcucaaaaccacuuugcuaaaucugagaauauagugacugaugagaaaaauaaaauuccugucccaugggaccuaaucuuuagugaaggacauagguaaagaacagaggcucagaugaagaggagggcuguagaagaagaaagaaguaauaugguaugggggugaggggcacuggagccuaguuagacuuuagauggaguuggacaguaaugugcugagguagugagcuggauacucuugcugacuuuucagauggacaaaguuauaauguccacuguauagcccaagcugacuuggaacucuggaacuuaaucuguaguccaagguggcacuucuuuuucagucuccugagauuagaaguauaagcuaccauaauauugcuauucuuucccugaaaaauauuagaugcuaaauaagaauaaaauccuuucacagggaauguaaccaaguugguagaaugcuugcccgacacacucagagcuuuggguuugaucuccugugccucauuacacaguacuguguuauguggcuacaguuccaggacuccuguugcaugaaguaggaggaucagaaguucaucauccuugguuauagaaggaggugggggucagccuggguuagagguucugccucaaacauaaauaaaucaauaaauuuccauaacagaauagaggacauguagaccccuaagugaacuacaugucaggugauguaaaagguuugaguuucuagacaucacuacuuuuacaucagagcuggcaaagaucugucuuaggguuucuauugcugcaaccaaacaccaugacuaaaagcaaguuggggagggaaggguuuauuuggcuuacacuuccauaucaauauucaucauuaaaggaaaucaggacaggaacucaaacagggcaagaaccuggaggcacaagcuuaugcagaggccauagaggggugcugcuuacuggcuugcucagcuugcuuccuuauagaacccaggauuccuugcccagugauggaaccacccacaauggguugggcccucccucaucaaucacuaauuaagaaaaugccuuacagcuggaucuuauggagacauugucucguucgagguucccuccuuucagauaacuaguuugugugucaagcugacauaagacuagucuucauagauccuauuagaggcaauugaaccuuuccagaggguaggguaggcacccucaaaaggcagggacacugagggagaccagugacauucuaggcuuucaguucuggaaggccaaagcccucuacuccauacucuggcaccucacagauaaggacucuggccaggcaacagguaagagaaaguucucucuuucacaucaguccuucaccuccucagaagcccauuccgaaaggcagacuggcgaggaaaagcagggcaggagugagcaccuuacugaacucuccugagaaccaaaagccuggcaccugugcuuaaaacagcgcuggcauaucauuugcuuuugguuuucuuucuguuuuuaguaagcuuuaauuuuguaauaguuugaaguuuauugaaaaauuguaaaaaaaaaaaaaagaaaagaaaagaaaagaaaaauuguaaagaugguacagaguccuccucugacccauacccauauuucuguguuacuuuaauaggaauaguuauacauauuuauuuauauaucuauuuuguuauuaaauuacuggccuuuguuauugugggaaauaaguuucuguauauaagcuacccaucacuguauauaauagccaucauugaucaagacacuaaaauuaaaaaguagaugagccacaagauggugguguaaucucuucaaaauauugaaauaaaacuaaaaacuaccaucauauuaucaguaaaaaaaguuuuaauuuuuuuugacuaacaaugaugcaauugccagcagaucucaucuauuuaaaaauauuaucugcacuguauguuuaugaguuuuaggacagccaaaccuauguaguaagacucugucuuaaaaaacccaaaacaaaacaaaacaaaaacaaaagcaaacccagacaagcaaaaagaaaacagguggggcagauuugucccauuagaggaagagaacagguaaacacucauucauuagcauccuuggcaggccgccucauagucgguagugagacugaugguuucuucuacuguugucugcugaaagauguacaugguagaggagcccauuagcuuggcucaagaacucuagacaguuuucacuggccagaguaaguucagaaguugacuaucagucuccauuacaaccucaugaaaaacauuaagaggcagaguuaaugagagaaguuaccugacaccaugauugauaugaauugugcuuguaagguaaagugucauugcacugacugguucauguacuagagccgugcagaagaauaaggugagggaaacgcuguucucugugucuagaaguauugacaugguguuugguucuucagaagcagaguauuggaggaggaguugaauauaacugaguaaguuaaauggaaacuaggaagcugggugguaguggcacacacuuuuaaucccagcacuugggaggcagaaacaagugagucucugaguuccaggacagcuuggucuacaaguuccagaacagccaaggcgacacagagaagucucuaaaauccaaagaggggacagggaggagaaaggaagauggauuggucauuuucuaaugaauaagauuaauugauuauauaaagcaguaguuacagcauguuuuaaguuuguggaugugugugugauauguagauggucuuugacuuauuauaauucagccuagcauuuuugcuuuuaugaugguguaaauaugauaagcauucaauagaaauugcacuugauucuaauuucccugagcuagcagucugugauaggauacucuucagugaugcugggcaguagcagcucccagucagccaugcgauuaugagaauaaacaacuguguccacaguacacaguguugcuaagcuagguuguucaguaagcuagcguguggaauacauuuuuauauguaaugcuaguuuauuucuuaauguuaucugaguccaugcaguuuuccccuugauucucagaacugccuuuucacagaugagucacauacagcccaaacaugauauuugauucaucucuuaguuaucuuauuuggagcagucuucccauauuuuuguuauaggcuaacuuaaaaguuuuaacauuuauuuacuuauuuauguuuuauuccuuccucuguguguaugugugugugugagugugagagagaaagagagagagauuagaucagaagguaacauguaaaagucuauucucuggucucauugugugggucccaaggaucaaacucagguugucaggcucaguggcaaacacuuuauuuuaccuucuaacccagugguuaucaaucuuccuaaugcuuuaacccuuuaauacaguuccucaugccacuucuuuauuaaagaaacuaggccacuugucuuguagaacagucuucugaguuuacuucuaugugauguugacaaguucuuuuauuccuuguauugccaguaaagugaguugauaaaguuagcuuuuauuuuuucucugagaacuuuuauuauuuugagaugaggucucccgaugugcucagauuggcugugaacuccuggaaucaugcaggcuuccaagcagcuaugacuguuauuuuauuucuuuaaagauuuauuuauuauuauauguaaguacacuguagcugucuuuggacacaccagaagagggcgucagaucucauuauggaugguugugauccaccaugugguugcugggauuuuaacugaggaccuuuagaagagcagucagugcucuuaaccgcuaagccaucuuuccagcccgugcuaugacuguuauugugugugccaucuugcccaguuuuuaaucugucugucuaucuaucuaucuaucuaucuaucuaucuaucuaucuaucuauuuaucuaucuaucuaucaucugucugucuaucugagauauagucucucucuauguagccauaacuauccuagaacuuuuaacauguagaccaggcuggccuugaacucaagaucucccuccuaggaugacauugcuugggucaccaucccaacuuuguuuuuauuuuaaguaauuccacaaccccaagucaguguuagguuuuguaugaauguuuaaguaaguacauuguuuaaguuucauauucccuauuagacaguuggcaggcaacuuuucagcugugauuguuagcuguuuuauagguacuaaauaaucugaaauugauuuucuaagcauauaauaauucuucuacuuagaaaaauuuccuuuuaugcuauuuuuauuuuuuaauaacaauugaauuugaaugucaagaaaucugaaagccguuagucuguaguccuccaucuuccaaaguccugaagaaauaauacuugguuugcccaagcuauaguaacaaaauacuaugaacugggaugacuuuagaagucugaaauuaagguguugguagggugguaaggcaagauuuguuccaguauuaggugguuuauuauuuuauuuuucauuuuauuuaugugugaagagcucagaggauaacuuucauaugcuaauuuucuccuuuuaccauguguguuccuggggaucaaacucaagucauuacacuuggugacaaaugccguuacuuauugagccauccuacuggcccagauuuucauuuguuuugaaacagggucuuacacuauuucccagagugaccuagaacauacuaugcagcacagaccgcuuuugaacuuguggaaguccuucugccucaggcccuuaauugcuggcauuauagaugugagccauccaaccuuaguuuaaguguauuuuugauuuacuauaucuucaauuuagaguucaucaagauacagcccuauuuguaaaccaagaaucaucuucaucauccuagacauauacugucaagaaaauccaggcgcucugauacaugcuugcaaucucagcacuugugaggcagagacaugcaaaguucuaugaguuuaaguuaagcauggucuacaugucaaguuauaggccagccagggcuauguacaaaaaccaaauaagcuaaaugaaaacagagaguucaagagagaaacauacaaacaaaaaacauuuaaaaacuauaauucuuuaauuuguaaaugacauuauuauacacaucagaaaucucauagaaccuauaaaagucaauuuuauaagugaguuuagcauuuuaaacagaaaaacuacacacacacacacacacacacacacacacaccacacaacacauacacacauauaauagcaaugaaaaauuuguaaguuaauuaaaauuuaaagugucacugaaauaccaaauauuggggcucgagagauggcucagcgguuaagagcacugacugcucuuccagagguccugaguucaaaucccagcaaccacaugguggcucacaaccaucuguaaugggauccaaugcucucuucuggugugucugaagacagugacaguguacucacauacauuaaguaaauaaauauauuuuaaaaaaagaaauaccaaauaucuauaaauaagucuaaguguauuccucaacacucaaaguauaaagcuuucucaguuaaguuuuaaaaaauaacgaguaaaggguaagcuagugcaggauuagaagucagcaucguucacaugaguucccuaguguuccguagaggucgggaacguuucauuaacaccucucaguaggcuuuuuuugaagaaauagacaaaccaauuuuauaaauuuuuugaaauguaaaggacuaacaagaacuaaaaucauuuaaaggauagcauuuggagaacuuugcuuuccugauaccaauauuuucuuuaugccauaguaaauaagauuguguggucuugggcuggugagauggcucaguggguaagagcacccgacuguucuucugaaggucuggaguucaaaucccagcaaccacaugguggcucacaaccauccguaacaagcucugacucccucuucuggagugucugaagacagcuacaguguacuuacauauaauaauaaauaaaucuuaaagaaaaaaaaaagauuguguggucuugaccaaagaauagccauagaucacaaacagagaguuuagaauaaacuugcacauguuguucccaucccauuggccaguucaguccacugggagaaauaaaacuucauauggauauggguaugagaaacaaugagcucacacuucugcuuacuccauacacagaagcuacuguaauaaaaugcaaaagcaaaagccauaaaaucucuuuauugcaucuugcuacauauaacaaguuccccaagauauaguggauugaagacuaauuuguuacuugauaguuacuaggugaagaacucaggaggagcuuugcuagauaagggucuccuucggguugcagccaaaauguuagggaaguguagucaucugaaggcuggacuuggguggagcguugugauucgugucccauggcuguuggccugcagucuugguucauacaagcuguuagccgaacucaggucuuuaccacuugaaucuguugguaggucuaccuggaagacagcguuggcuucccucaggugaaugaucuaagaaucagaacuaggaggaacagaaaggccuuuaaaauuuuaaggcuuaaacucuuaggcucaguguaucucuggagcaugggauaagaggcuggcuaccacacuugucuagcacugaugcagcugccagggaucucaugcacuccaucuacugacccucuccacaccuccucacugauuucuucuuguuuuuguuuuuuuuucgagacaggguuucucuguguagcccuggcgguccuggaacucacucuguagaccaggcuggccucaaucucagagauccgccugccucugccucccgagugcugggacuaaaggccuaagauuaaaggcaugugccgccacuacccggccccggucugauuuguaacagaugauuacuuuuauuuucccauccaagcuuuuacuuuauuuguccucucagaaauccucaugucacagcagaccaggucacugcagaacuugucacagcagaucacuccuuuugcuguauccugccuacacucacuggccuuggcagucuccuggaacucugcucugcuuuuaccuuccuuucacuguuuuuuggaggucuuuuucuucucauaaaggccaugucgucuugcagggcaguguuuaggcucauucuucuugacacaaucuaaagaaucauagcucaugccaaugccaguugucucgcccccaccaaaguagguucugaguucagauacagagaugauauaucaugugguuuuguacauuuugaccaacuucccaauuuuuuuugucuuugguacaguugccuucccagggugaaggacaugagugaaccaccuguuucccuugaagcugaagguuaggaacuuguuagucuguuacugugucauucaugaugguggcagccccaggcuaccaaggaggagauauuaaaauaaagaaaaaggugauuccuucagugaugaaguuucuuugucuacaucccagagguucuguuagguugucucauuuucaguuaauucuagcauuuaauuuuuucucugauuucuuuucuuuucuuuuuguuuuuuuuuuuuuuucuuuuuuuggggguguguguguugagacaggguuucucuguguagcccuggcuguauuuguuagagguugcuuuguagcccacaguguggucaguucuugcgaugguuccaugcaccacugagaagaauauguauucccugucagcugaguggaaugcucuguagcucuguuaaaucuaguuacccguggugugauucagcucugcuauugcuuugcugauuuuaucuuggaagauggaucuagcuguggcuagaagucgucuuuucaguguuuuugaaaucagggccuccaauauuugauguauaaguauuuauaauaguuaugcccuccuaaugauugcucccauuaauuaauuaauuaacugauuaauuaauuaauuuauuauuuuuaucucuuuugagaguuauggauugaagucuuucauagaucugacauuuccuauaccaacuugucuauggcuucuauuuucuugguagugugauuucuaacuguugacucuugguuuuaaugucucucacagucaagugaguuucuuagagacaacaaauuucugggucuuguuuucuaauccauugcuuuagucugccuuuuaauuggugccuuaaggcuuuuuauauuggagguuauaaaugagagguuugcuguuacuuaagauucuauuuacuguucugguuggcuaguuucucggcagcucuuuuccucuucuccugguagccagauguccgcucugucggucaugauugacucguugccaguuuccugugauuuguguucaucuguuguuuucaugaaauacacuauuucuuacaucacuauguaugguauuccuuuaagaaguuucuagagccaugugagguggauaauccuagaacuggagaagcagaggcagguggaucucugagaguuuaagaccagccuggucuacagagugaauaucaauuccaagccagccagagcuacauaguugaaaaaaauuucuuuugcaguucugguaaauugucaugaauugacuuaacuugugcuuguauuagaauaucuguauguaaacccuuuuuuaguuauggccaucuugguugacaauuacauuccgugcuuuucuggcuuuuagaguugcugcugacaauaucuucugauauugucucuguauuaguugauauuggccuuugugaccuuagcauuguuucuuuguuuuguauuuuuuagucaggucuguuugggguucuaauuguuuccuauauuugauuguuucuucucuagguguggaauauucucugcuguaauuauauugauacaccauuugauuugugucucagcuccuucuauuccaugaauuccuagggcuagucuuccuaauauguagguuucuuggaaguuuuggucuuacuuuuccuauucauaugucuguguguuauugucuuguggauugucuccauuucugagguccgguuuucuacuuggucucauguauugauaauaccaucugcuaugcuuuucaucugacccguugauucuuucaucacuucaguuucuguuugguucuuugucagcaucucaguauccuugcuaaacuuuuuccccaugcuuuaaaauuuucuucuaaguuagugauucuuuuauuuacuuuagcaacuuucuaguuuaugucuucaguugauuauauguucuuguucagguuucaaauuacauuuuuaucuguuuauuugaguccaacuauucucaucuuuagaauuuagaaauuguuaaucuguguuggugucuuaguagacuguuuucugucuuucucuaccucccuccuccccuuuuuaaaaguuucuuugcuguagauaauguaucugccagagugcauguguucuauaauuuguaguuuucccuccuaauuuugcuuauuuuauuuuaugugugccuugcuggugaguugucuucauuuggauuuauguuuagggaaaguggacuauaguaacaacauuuugcagaagucccagugugggcugcaggagaagcuacugugagccuugcuuaugcuuggaggcagagucuaggauccuggauggagaaaauacaguuuauaguuuuuggggaucccccugcucccugcuccagacuauaauauuuaaguggugaaaugaagauguaaggacugagagaguaagaacgagaaggagacuuuauagguuacaagaaugaaagacacuagagaaauuaguagguauuaaauuguagaaaagaagaauuaaacaacuucugcaugacagaagaaucagucaacagagugaggagacauuccucagaaugucuuuacuaguuaguuauacuucaggcauggacuuaauaucuagaauauauaaaauuuacaaaauuucaacccccaaaccucaaaacugccaguucaugggccaaugaauuuauggucaguucucaaaagaauaacuacaaauggccacugauacuuuacgaagugcucaccauccuuagccagcagggaaauaaaaacuguuuuggaauuuauuucacccuagucaguggcugccaugaagaaaacaaauggcagcacaugcuugggaggguuggggaagagaaccugacgcacuguuggugggaguuguagcccuguggaggcacuguuagaacuuccacucugacccagguauacacagcacuccuggacagacauacggagauguagcucagcuaauggagugauugccuagcaugcaugaagcccuggguucaaugcugguauuacauaagccuggcauggcauuugcccguaauccgagcacucuguagguggagaaaggaggaccagaagguuaggcauccuuugcuacauagccaaguuuagggccagccugggaugagugaaucacuguuucagcaacaacaacaacaaaguuucauauuucacccgagacagguguacuuccaugucuagugcugccuucucuucucuucucuucucuucucuucucuucucuucucuucucuucucuucucuucuuuucuuuuuucuuuuuuuccagugcaaaguuauggcaucagccucaauaucccaagguucuuuuguauguauguugcugggaggcauguauguauguauguauguauguauguauguauguauguauguaggcugaaggcaauccuaagcaaucuaccccugugcuguagucuagcuuagguuagauuucugcaggagauggagaggugaugaaaauuuguuauauacacacuguagaauuuuauucagcuguaaacaaaagugaaaauaugaaaucuguagggaaauggguagcccuggaaaaucuguuaaaggaagugaccuagccacagauaaauaccucuauguucucucauauacauauccuaguuucuaguaguuauauguauguaucugugugcagguguagggagugccagaaaacuagggagggaccugugggaaggagaaaaaaguuuuuuugguuuuuuuguuuuguuuuguuuuuuguuugguuuuucgagacaggguuucucugcauagcccuggcuguccuggagcucacuuuguagaccaggcuggccuggaacucagaaauccgccugccucugccuccugagugcugggauuaaaggcgugggccaccacacacggcgagaaaaaagguuuaaaggagaggaauggucaggguaacagaacacacaggacgugaggguagaaggaagaccaccagggcagaugagccugugggagaugggaggggguaugugugggucagaguaaagcacaaauguuauaaagaaaugguuacucgccgggugugguggcgcacaccuuuaaucccagcacucaggaggcagaggcaggcaaauuucugaguuugaggccagccuggucuacaaagugaguuccaggacagccagggcuacacagagaaacccugucucgaacccuccccccccccaaaaaaaaaaaggaagaagaaagaaagaaagaaagacauugcucugugugcuaauuaaaacaugaacacaaguuaugaauggcaauguaaaauggauuugguuuucugguucuuacuguugugaauuuguccuuuuuuguauuuguuaagugcauaaaacuauacuugaugauggaaauauaaacuucagugugaagcuccacagcuucuauuccaagugguuccucuaagccuguagaaguucauugaccuggaucaucuuugggccuguauaauuucuaaguaugauuuuuuuauuuguagaguuuuuuauaaauaauuaaaguugaaaaucaaaaaauaagaaugaagcauuauuuugugugacaaauuaaaaacauauguuuaggguagcauuaagaaugucucagaauauaaugaauuggcauaagaucaaagcaguaaaaaguuuuaauuuuaucauugcuacuguguaaaaauaugauaggaacaaaaaaugugaaggaaauacaacuuguuggguaugucagcaaguugugugagugugguuuucuagauuuaagaccauagaaggcucucacaacacugugagguaggaaauauucucaauuaacaaagaauucucacuugacagauaaaaagcuuaacauuauuaugaauauaagaaauauauagaaguauaauaauaaaaugaaccaaccccauguagcugucaccuggcuuuagcacuugcuaguuucagaguaggagugguuugaacuuauauaccuccugucuuauuccaaaacggaugcuuucaguuaugguccccuuacuuuuuuuuuuaauauuuauuuauuucauuuauaugaguacacuguagcugucuucagacacaucaaaagagggcaucacacuccauuacggaugguugugagccaccaugugguugcugggauuugaacucaggaccucggggagagcaguccagccccccucuuacauuguuguccauugaugucauugaguaauccuauaauugcuugaaauuuaggggaguagacacgaaaacauucauaauggcgaugauacuuauaauugugagguuuucugguuauuccugggguagagaaaguaguuucuuuuaaccgcacggauuuuguaagaaacauuuuucuuuuuaguuguagugugggcaaagacaaaaccugcugauacgguucauccuguuucauaaaucuuugacccauucaucagacucugcccacucuaaagauaaaggcugugguguguuagucuuucugacugguggccuucugcagauugagaaacugaguaaugauuaacugugguaauggauaugcacuugcugguuucaccugguaucuuagugagcuuuaacccucugaggacaaccagaacagagccuagagucguuaaaacucaucauuuauccaugacuauuuauauguaaguucucuaugauagguaucuuauuaccaccuaccagucuucaccacugucuacccccacucacauacucaucauuuccacaacuuauacucaguagcagcacccuuugguacaauucuaaaaauuguauuauuugguguguguguguguuuguuuauguguguguauguguucgugugcgcgcacauguguguguguauguauguguguguagagauaaaauguauucuuuggcauauggaggucaaaggacagcuuucaaaaguagguucuuuccuuccauugugagguccagagauugaauucaggccuucaucaggcuugcucaguauguaccuguauguaucuaauugcccuguuauaauuuaucaguuuuacacagucaaggccauuuucuaacuaauuccuaaagaguggaagucccacacuuaagcugcuuguugagauaaauaaaugaaggcauagugaaauggcugucauagguaaguaaccaugucuuuuacauuaguuggauucauuucuggaucugggggcugccucugaagugucaagagugauugugucacucaguugaguaccaacaucuacccgaguagaaaggagggggaucuuugaacuuuuaucuucgauucuucugugauacuaucaaguguaguaaugcuacaaauaugaauaggucuuaaguugaagaaggguuacaaacuuguaaggcacaauugaauauauaacgguaugugggaaugaaaugaauaggcuuggauucaguucucuauaguugugugaaguaacaagacagcccaagaaacagcagaauggaaaaauaaaaucagaucaguggaggagcucauugggaaagagcaguguccugaaacuaaggaacagagugucucagugagaguacuaugaguacccauuuggcaauuuggacuuuguuauugucuuaauagagauagaagugagugucagauuucaagauacugagaaaaugcuaagugaggacacagagcaggggaguguuuuacauucuuucuguauaucuuggagauaugcgcgugcaucuuacagccagcauggcccuuagguaagccaacuaggacuuucuggguccuguauuggggaguggggaugaaucugggcucuacuucccuaaacauuauucagcaguguucaucauauuucuaagagcguaggaaagaugcaggugccaggcagguccuugcucauugugcugcuuacacuuacacaccuccuuucugcugacaccugcuuugaauucugcagcauuucucaucucucuuugaugaucaucacuuuaucuuucccacuauacuguaaacgccuucauuucccuuauuauuguugauuuuuccauugcuagcauaaugccugacaagucauuuugauuauuaaauaaauuaauacauaucuauuuuuuaaaacccaaaauaauuuuauuuuggugaucucacagaauuaaaaauguagacuguuugaggaaaggguugauaaacaguuacaaauggcaauaaggugaggacugaaaauugacguuugauggaugugucuguuggaagguucuccauauugaaggcauuguggcaaaauuguugaaauaggagacaaauuuaagugggcugaaggaaggggacaaagaagcaauguagaacuuuguuuuuuccuuuaacagauucuaggcuaacgggaagaaaccauuagagaaggauaccgcaagguccaggagaggagaguggguuacuuuuaugccuugauuugcuauguaaguguucucuugcucucuugauagcauuuugaagguuuuugcagugcuauuuggagccuccuuguggugaaucuaauaaugacauauaaauuuaaaaaaacuuaauuauuuucaugaggguuaaaugaagguaggcuuugugguugugauaagaaugcuuaguucucugguuuccaaugauuuauaauaugauaccuaaaauugcuauaacuuuguuucuauaguacuuuauugcuauacauuuuagcuauuugaaaguuguaguauauuuauuuuaagcccuaauacuuuucuuaaacacauuuuaaaaaauucauuuauauuuuuauuuguaugugugugaguguacguguauguguaugcaccagaagguaugggauuccuaggaggauccuauggaguuagcacauggugaacccgcugauaccggugcagggaaccaagcuugguuccccuagaagagcacuaugcacuguuaaccacugagccgucucuccaggcccuuagcugauaaauuuuaguagcugcuaucacuguacucaccuuucauaguaaauaucagcaauagaauaauugcucuauauucuguuugaagacugugaaaaaaaugccugaaugacugaguaaaaaagaacuggcuuuaugaaaauaauacauauuaaucagauaucauaaaaauugaacauagaaguauuuaaagcaauccuauauaaucuaggccuuuuaugaucccuuugagacagagucuagcuuuguauucccaagcuggccucaaacuuaugagccuugcugcuuuugaucuaaaauauuggauuauaaauguacgcuaguauaccuaggcaauccugauccuugaugcuuugcuuuucuguauuuuaaauuuuaaaugcuuuugaagauuuuaacaaauaugccuguaaucauauccagcucuuaaaaaugaaacuucaccaauauagucguugccuuaugaguauccuuaccacagucccauuacugcuugccaaggucagcuucaaccuuuguuguuuuacuuuguguguuuauguguauguguaugaaugcacacaugugccugaguguguguguguguguguguguguguguguaagucagaagccacucuucacaugcuguucuuagguagccauccaccuuauuuuuuuuuuuuuuuugguuuuucgagacaggguuucuccguguagcccuggcuguccuggcacucacuuuguagaccaggauggccucgaacucagaaauccgccugccucugccucccaagugcugggauuaaaggugugagccaccacgcccggcuuccaccuuauuuuuuaaaaagacauuucuugcaugcauguguggauggggagggggugucuucguggcaccuguguggaggccagaggacgacuuugcagucauuucuuuucuuucaccuccacaugcuguguuaguaacuugucuguugcuguagauaaaacaccuugaccaaggcagcuuauaaaaggaagaguuuauuuggucuuauggucugggagagguguggccucaggaauuggaggaucacaucuuaaacuacaagugcuaagcagcuccugaauggcuauaaacucucaaagcacuucuuccagcaagguuucauugccccaaauagcaccauggacuggggacaggagcucaaaacuguagccuuugggggacauuucucauuuacacuaccacacauugguucaaggaucaagcucaagaugccagcugcugaggcaucucucuagcccaugggugccagggacucagcucaggcccucauacucugccuccuaggugcugggauuaaagguuuauggauucuuauuguuaaauuuuccacuaagauuuauguguuuagaagaugcaucuauauuaacauggauuucuucuuuguauguuuuuguugcaaauccauuuucuucauggacuguuuuuguauuucuaguguaugcuuggaaagucugcuguugucacuccugaaauucucugcuuuaguaguguuaugacaguuacucuucaaaguagauguguuacaugaaugcugggacuccaggggauguaccagaaaugguggaggcuaggcuagccuagacagugacuuccggaacaacuugggcugcaggcuaagacucugucuuaagaucagucaguccaucaguccauaagacacccagacucaggauuuucuccuccuccuccuccuuuuuuuuuuuuuuaagguuuauuuuauuuauuauauguaaguacacuguagcuguuuuuagacaagggaaucaggucuuguuacagaugguugugagccaccaugugguugcugggauuugaacucaggaccucuggaagaguagucagugcucuuaaccacugagccaucucuccagcccgacucaugauuuucuuauuccucccugccucauucauuuauucauuaauucauccauccauccauucauucauuuucucccccucccauucccuuucccuuuccuucccucccucccaccuuccucccuucccccccaaccccccucuuuuuccugugguacuugagaucaaacucaaagaguuguucaugguaggcaaguguuccuccacuaauuuauaucucuaguucuuugcuauuuccaacacgcacagguaaguuaauggaauugucaugugugucauuuaucuuguucaaccauuguuagcacacagccugacugagaucugauaccagagugaagaagagacagucuugcauggaaguaucagauuucacuuggcuggagucagccccuuuuucuuuuaagcaagaggacaugaguucagauccguggccacucauauaaaagcugcacauggccuguggguaacccuagugcugugagagcagagacggacugcuccugggagcuuacugaccagccagcuuacuuaccuaagcagaaaacuugagauucagugagagacacugucucaaaaaaauaagggaagagcaguagaggauacucagugucuuucucuggcuuguuaaugugauuuuacgcaugcgcgcgcgcgcgcacacacacacacacacacacacacacacacacacacacacacacacacacacacacacaggagugugugaaaguucagccacuacaggaagcuaggagagaaucuagaucucauggaguuguauugguaaaugucaaggaaaucaguaauacggucauuuauuguaugugaggacugggagaagauacugaagauuuagagggaagagauauaaaaguuauuucaaaaggaauuauguaugugggaucaggauugccaggaauuaaugguaaugaauuuaaaacaagaccacuuuucagccuccagccagagcccaguuuguagucagaguaaguaauguuucaaucuguuugauucuuuaccagucaauaggaucgauuuacuuacaccaggugccauaguuaauggagaaacaguuuaaaugaugaguuuauuuuuauguguuuauauauuccaugaacaacucuuugaguuugaucuugagugccauaggaaaaagaaaaaaagaaagaagagagggagggagggggagaggaagaaaugaaugaacgaacgaaugaggcagggaggaauaagaaaaaggaaaaauuguuuguauuauagaaagauagagcugggcauaguaguauauccuuguaaacccagccuuugggagguggagagaagggcaggauucuaggacaucuuggauguguaguaagcucagggccagccuugacucauaagauaccccccaauaaagaaaaaaaugaaaacuauagaaacagugauuuucaauuauuacacugaagugcuuguacauuuuacagagagccucacuuaacaaacaaacaaacaaacaaacaaacaaaucccauguucuuuccuuuuaguuugagccuuguauguugguuuugaaauugaguucagaggaggagagaaucuauggcuauuuaaagguaauauaauacaguaauaaaucaugccuauucuuuaaaacuaaauuauucuuuacauggggcaggacuuacagcaugggaaaugaacauugaucuaaagaugugcugguuucaugcuuacuuuguuucucugaguauuuuaaaauuaaaauuaaguuuuaaauguauuaucuuuauuaugugagugugugcuauaugugguagugugggccguggugugccguggcguguguagaggucagagggugacuuugagaaucacuccucuccuucuacccugguuucagaacugaacucagguugucugucaagcgccauuucccacugagucaccucgcugucccuuuucucagccuuuaacugaagacuuucuugugacuaauuugauuuucuuauaguuucuuauuuauuaauuuuauaguugaauaaccaaccugcauguuugugaucaguaguuuguuuuuuagcagauaugagaauauacuaauauauuaauuuugaaauuuuauuuuuaucagaaauuaugagucaaggaucacaaguucacauuuuuuugggugcuccaguugcuccacugaaaacgacaguaucacagggaacagcuuccuuaauguccacugccaacgccugggaaaaaguccgacucuucuauaaacagcauuccuuguaucugaaggcuggagaucaggaguuuaaaaaucuggaagacugucaaguccccaaaggucuuggcccuccaggccuucuuaguggugacguuuugacgacuucugugaggaggucugcucagguggaugaggacuuuaaacauucugcuuccgaagcacagagugugaaaucccagguuaaccugagugauaugacuaguggacaaaugugugggcuuggggacggaguucagcauuuacccgaagaagaaaaagaucaaaagcuucaauguaaaaauaagaaaauuacagaugagcagucuaaaaaucagucagaucccugcguucggaacuuccaaagagauuuguuugcguuagaccuuaagugugcagcgaaacuggaucugggcuguuguacugaacagaugaguacagggacaaagccagagccgacaggacaucgugaaagacagagucaggagagcuucucugacacacggugugagccacaguccgagggagcagucaggaaggccucagaccagagacugucugcugaagcugaauuucucagcguacugaccuccagccaacgggcuuuucuagcucaagggaaugauaaaggucaggacuguauaaauaagagcacuguaaauauggaggcagaaccaacaggaagucagggagucagacgaacugaaggggauuuuaguaagccugguggagauuucgaagaagaaucugaaaaugagcaaagccaaguguauucccuggaacuuuuuaguccuguuuguccugaaucagaaagcagucacagucacauaaacccuggaaaaaaucuugaaaacacaagcucucaagaacuuuucaguaaugaagaaaaccugccaccaaaugaguuguguagcucccauccaaguaccgcuaacaggagcuggagcuguaaagaugauucccaccauucuaaagcucuuucugaaguccaucagguguccaagaagccaaggauggauucuaauauaagagaggcagccaaagcagugccccagagggucaugucugaauuaaaggacaguaaaaaaauaucauuaauaaaaaauugugauucuaaaaaucagaaguauaacugcuuagucauggugcuaaccccaugucauguaaaggaaauaacuauaaaaucuggaccaaauucugguucuaaagugccauuagcaacgauuguaguuauugaucagucagaaauuaagaagaggguuguucuguggaggacugcagcauuuggggcacuuacaguguuucuuggcgauauaauuuuacuuacagguaagaccauugagguauagugauagccuguuuuauaaagcugugucuucugguuaugauuuccuuugccacuuaucuucccugggugugacugaccugcuguagcauguguguugugcuuccucgggcuuuaggaccccucuuuguucugugaugccuucucauccauuuucuccucuaagaagccugccuugguugguuguaaucauccaucgugugucaguugaaguucuaucacugggcuccuuuaugcugccuuacagcuguguuugugucugauuaacucucuuacuuuacuagcaguguuauuaggaaagggcaacauuucugcuacuucacuccaguacauuaaacuauuccugaaggaacggacucaagaugcugauguuuaguuuguugcuauuuuacucagcugaggacggccuugcagucuuguuuuuuuuuuuuuuuuuucuuucucucuuucaguuuuuucuuuuuuuuuuugguuuuuugagacaggguuucucuguguagcccuggcuguccuggaacucacucuguagaccaggcuggccucgaacucagaaauaugccugccucugccucccaagugcugggauuaaaggcaugcgccauuacgcccagcgguauguguuuuaagacaggauccuaguaugugggggaaaucaguucugcuucagccucccuuugcugugauuuauauacaugucccaccacacuggacuaaaaucuuuaauauuuuuuuacuuguucuuaguuaauuuagaaucaauacaguagcauggcucaggccuguaaucccagcacuuaagaggcagggccaagagguucuggaguugaaggcuagcaucagcuauaaagaaguuugaggcuagcuuagcuacacgagacccugucucaugcaaacaaaauauaauauaaaaccaauacaguguuaguaaagcuagaagaaguuaguuaaucuuacuaacuuagcuaagaaaggaugugauggagcuaggcuuuguuagccucagcugagaaaaugaaaauugcgguucauacaauaucaaguuguuugcagggagcugauuccuuuaauuaaugugucuuggagcguucucuuuggauuguuaggaacaaucuuuauggaacguaaaugcaagauuauaacaaacagacuuaacaaagcacuuuuuauauguuguucuauuauuguuggagaguuaguuuaucuaacucauacucugacuuaguacuuucagaauuccucuuugcuuguaauauggcuucccaacuauagaucuauuuauaagaugagaacauacuguaaguacuguuucuuuggcaaauacuaccucacuguaaauaaaaauaaaaguucugguuuucuugucauauuaacccauuuaaugugaacuuauuccccagagcuaagacuauuuuuggaguaucaaagaaguuucccaacaguaaagaggugaaucgacccguacuguagucacuuuuaguuaaggacauucuaccucaagaucauucaccaugauugaaacaaaacaaauaacccuccccaaacaacaaaaaccccaaaccaaccaaccgaccagacaaacauaaacaagaaaagaaaagaaaaugucuaguuuguuugugaucuucuuggaggccuuuucuaggcacauagaaacaguccugcuaccucucugguuuuuccuaacaucccuaauguuguuuacaacuagguaagaucaagugacugcuggaaucuauuuacccauuuuucuacuauaagacaauuaaauuacuuuuaugaaugccuuuaaaaagguaucuuuguuggcgcuguauuauuucuuuaaaaaaacaaaaaacaaauaucgaagucuguguguaguggcacaugccuuuaaucccagcacucaggagauagaagcagguugauuccugugugaguucuggaucuucagagugaguuccaggacagccagagcuacagccagagauacacccugucucaaaaacaaaaaacaaaacaaauacucucccccaaacaacaaaaaccccaaaccagacaaacaaagaaaagaaaacaucuaguuuguuguuuucuucuuguggaacaaaugggaaauuugugagggaaaaaaagcuauacuuuuauauugucauaucuuuagcagugaauuauauucacauagaaauuuaugagugacauccauuuuuaauugauagcauucaacugugcacuauuauauuucuaccuuuaauagcucauuuuaccuacuuauagagaucucagagcugagauuucuguguaagagguaagcuguagaacauguucuauuuagagcaugguagacuuagcagcagaagguguuagaaguuugaauugucucugaguauucaguacuagaguuaaaaagaagagggccuaggacuuaaccuuggagaguccuaguauuuagauggaaguaaaggagcuaaaagcuggaccauagaagugaauggauaaaagaaccaggaggcaaggccugggccaccauuuugccuuucccuaucacccagugucucaugaguccaacauagaguuuaaaguuuucuugaaauuucucagauauucuugucuucuggacagcagguauucugagcaucacaucgugagaagucugguguuuuguuuuguuuuuugauguuguuggggaacugaacccagggccucacacauuaggagucacaugcccuuuuaaugacaguuuuugaaagcugugcuagcucuuucugguuagauaguagggagccacugaauauuagaguuaacuaauauacuacucguaauacuuuuacacaacaauuguaucuuacccaugaguuguuugaaaaguuuauacauguauacaguauauuucuaucauaacuucuuuccaaccccuccagaacucccaccccaguuuuuuuaaccuguuggguauguuaauucccacuaaauguuuuuuucucuauagcuuuuucuuuuccuuuuuuucuuuuuauuuauuuauucuauuuaugugaguacacuguagcugucuucagacacaccagaagagggcaucagaucccauuacagaugguugugagcaaccaugugguugcugggaauugaacucaggaccucugaaagagcaaacagugcucuuuaccacgagccaucucucuagcccccagcuuuuucuuuuccauuugauguuucuuaacucuaaaguguuucacuuuuuuuuuuuaagauuuauuuuuuauuauauguaaguacacuguaacugucuucagacacucuagaagagggcaucagaucucauuacagaugguugugagccacaaugugguugcugggauuugaacuuagaaccuuuggaagaacagucagugcucuuaaccacugagccauucucuccagcccccguauuucacuuucaccaucuacaaaauaugauuagcaugcugcuuagggaaaaaauaauaggauaaauuuaaagacugccauauaugcauguauauucguaguacaaggggcugacacacuauaauuacuguuugaggcaacacugcuuuggaauugcuaaucugcccccccccccauuuuuuccccucaguaacaaaauugccuuuauuacaaauuuuugcaaacuagaaaaauccaaagaucuauuucaauuacuuucuaaaccaaaccacuccuaauucuauuuacauuauuucucagcccagccuugaggcuucuaaaguucuaagaauacuuugacucguucucgcuucuuuggguaauuuaagucauucacaugaagccaaacaucacacauccuauauaauuuaaagguuagcagguuagaagauucuccagcaccaggaaguuucaucuugaaaaacaaacaaaagacagcuuucacaucugcuguguggcaucauuaauagcaaagacagugcacaauuuaaacucacugucuuaauucuucccgauuuuagcauucucagaaggaucccaacuuugauaauggcagaaagugcagagacaucugaauggcucacuguccucuuuauacucauuucuuucaagcuuuuucucucucugcucaauccgaacaaauccucucauccuugcuauaggaucuugcagcaccgacaacaauguguggacccuucugggaaaggcuuugaaccucccucaauucuuucacuucuguucuccccaggucugcucucaauccggugaccuggggugaaccuggguuagcguuuucaugaccucuacuaguguuucugcuuguaggacuucugagucauuggaugcauccucuucaucuuuccucugaggagugucuggguccucaacugggccgacuuucucugauggcuccuccauggcgaugggcagaagccucaaaaacuugcucugaacaagauugcguagucuuugaaaagaccuagacccaacuagcagaggcgaagugagucgccgccucuaaucuuaauacugcuuaguagcagugcacuugucuagcauggcuauaacgcuaaguuauaucuguuaaaagcccaugucuuugagcauccauacauccauuuauuuuucccccuuuuauuuuuugaggcagucuuacucuagagccuaaguuggccucaaacucauggcagcuguccugcuucugcuuccugaguaauggauuacaggaauacaccaugccuggugaaaccauuuaguuucauugucacccuaagaacuuagggucacaccaugauaggcaaauaucuacuauuaaguuacaucccuagcccaucauucuuugauuuguaguaauacuugaacaugguauuugguauaucugacagaagaauaauacauccuccaacgugaaaugaaagcguuugggagccaggugugguggcgcacgccuuuaaucccagcacucgggaggcagaggcaggcagauuucugaguucgaaaagugaguuccaggacagccagggcuauacagagaaacccugucucgaaaaaaacaaaaagaaaagaaaagaaaagaaaagaaaagaaaagaaaagaaaagcguuuggcaauacagcuggucauugaagcacacaugugcuugauccuagcacucaggaggcagaggcagguaaaucuccgaguucaagaccagucuggucuauauaguaaguuacaggacagucagagcaacauagugagaccaugucucauauauauauauauauauauacacacacacacauacacacacacacacacauauauauauauauacauauagugaacauguaauaaugugauaguuugaauauuauauaucuaaaaucuauccaugauguaacuuguuuucacagugaaauccucguugguaaguauuuuugucaacucauacaagguagagucauuagagaagagggaaacucaguugagaaaaugcccccaucugauuggccuguagauaaaccugggaggacuuuuucuugauugaugauugacaugguagggcccaggcuguugugggugccaccugagcaggugguccuggauuguaaagcauuggagaggaagcuccagagagcaagccauuaugcagcauuccuccaugguuucugcuucaguuccugcucccagguuucugcacugaguuucugcccugacuuuccucagugaaaaacugggaaccgcaagaugaaauaaacccuuccucuagguggcuuuuagucuuggucuucaucacagcaaugggaaccaaaugcaagacaacaccucaguaagacauacuaagucauguagcagagcauugcaagcaggagcaacaugucuggaguugccugcaccuccacacuuacccuccacgagcagugagcaucaggcuucgcguucuucagcaguuggaugcaccgcacuguagcucaucggugucugagucagacaggcacugcagaauaugcuggaauccagacaucuugccucuguaguucagcucuugucuuuuucuuuuguucuucuuuagcuuuaauaaucaaucccuggaccagauuugcaaaauuuuccaggauuguagaauagcgcaccacuauuggcaaggaauagaagaugaauaaaaaguugacauuucuacagagugcguuccaggauagcuacggcuauacagagaaacccugucucgaaacaaacaaacaaacaaacaaaguugacauucucuaaacagaacaacaggucacauuuagaaauugguugccaaguauauuccaaagcacaaugcacugaaagauccaaaaagacugagaaaaguuguaacucaaacccaccaugcaguagcucuuuagugagugagacaagaaucaguauuuaggccuccuguaaguccaacccccaaauaacuaggaaagaggacccuagcauuauuuuucugacaaaauuucuuacuaacuuugagcuuucuaaggaaaaauguguuguauacuuugcuugcauugcuugugagugagcaaucauccacaugcuuuucgucuuagacaaauccagugcugacccacucuugauaaucuggcuccagcuuccagaagacuaaugacugugauauuugguaguacuacucaaugcaguguuugagugaugcuuaucaucaucauagaacuaaaacauuaaaagcaauguacuugaauguauaauguguauaggcuccuuacaucaaucggguuacuuuagucugacccaucauaucgacauuuggucuuuuugcugagauagaccacaaugauguaugcccaaacugaguggcccaauaaacauaccuauuauagauucucaaaucuaucaaugaagaaucucuaccauauuuuacuuuugguacagccauggauaaauuaucuuaucuuguggcccaaugcaauagugcugaauucaggucuucuccauguccagcaccuuuugaaacugcauaagccaauuguuauugaugguagcccaauggaagaguguaguucuuuuuuuuccuuugguugccauguguauaacuuguugucacaaauucucaguaguguucaucuaguguucauauuuucuaggcuucacuauguucaugugcuguaaguuccacccaaguaguucuucauauucaugauuuuaauggguuggguuugauuuccucuggauagaaaaggggggugcuucaguauuucacuagugcugguaugauaucauuccuaugcugcauguugggaaaaaguagugggguuuggggugggaaaggcaagcuuagcugaaagcaaugugaauguggcuuccuccucuugcccuagacuaggugaagccuggcuugcucaugccucagaaggcuaaggucuagggucagaaauuaaacuugcgggcuggugagauggcucagcggguaagagcacccgacugcucuuucgaagguccagaguucaaaucccagcaaccacaugguggcucacaaccaucccuaacgagaucugacucccucuucuggagugucugaagacagcuacaguguacuuacauauaauaaauaaauaaaaaaaaaaguaaaaaaaaaaaaaaaaaagaaauuaaacuugcuguuuuaucguuuugagccuuugggugggucuuucagccuaacaacuuuaguugccugguaugugagaugugugcaucaugucuugcuaugauugguuacuauugcuacuauguguuuaacaaguuaaccacagucuaaaggaguuuauggugugaccagauuucauuuuguuuuguuuuuagacguuguucuuuaugaggaucaguggauuggugagacaguacuccaaucaacauuuacaagucaguuacuaaaucuuggaaguuauucauauguccagccugaaaaauguaagacauauuuugaauaugcugaacuuaggauguuuuaauuuuugacuuuuuggccuuaggauaguacaaaaccaguaugaacauacuuuggauuuugaucuuuucugcauuugugaugcucccaguggcagcgauccauggcuugcagucagcaucugguuauaaggugaaucacugagaugucacacugugcuguguugcuaaguggggacagaugguagguuagguauauuuaacacauuuuuguuguaucuuuaguuuuuugugggguuacuguaauguuaccucauuguaaauccacuguaagucugcagacaaauauguuaggaaagauuugaguacaaaaaguuuuuuucuaaacagcuauuuucauuuguaagcugaaacuggaacucauuuguuuuauuuuauauuuugcaauauuaguauugaaaccagggccccacccagugcuauuuuucaaaaauauugaaaauagaacuuaaaaggauggcugugguagggcuacacaggggcuccuagcccccagguggcagcagcagugugccuagaagagaaaagagggagaaaaaaaaaugaacuuguauauuauaaaucacauaaaguauuguugcaguaaaucuacucccaaauaugccccagcaugaaaacaggacacaguuaauaugauuacaugcugugcgccuaccacuacacugccaucuugcacaucuuaugagaccccuaagaacuugccguuucuccaggcuucugcuccgcuuuucuucagcuuccuccuccucugugucaucucccucuuccauuuucuccuuccuuuuccucccuucugcuccaccuucccuuuuaucugcccagucaucagcucuccuuuauuuuacaaauuaaggugggaagcagguuuacaggaaaucaccugagugcugacucauuccuuguucucagucccucacuggagaacggaauuaacaccaaauauaauuagccccacaacacacuggcugaaggacauuugaguuauuucucuuuugagguuuuuaagaguauagauuuaaaaaaauuuuuauuagauauuuucuucauuuacauuugaaaugcuauccugaaaguccccucuacauuccccccacccugcuccccaacccacccacucccucuuucuggcccuggcauuccccuguacuggggcaagaguauagauuuuugugugaacauaaauguucagaucuuuggcacagauuucuagggugcauuccaaauacauaaauuguuuuauaagaaauuaccagccggggcaugguggugcacaccuuuaaucccagcacucuggaggcagaggcagauggaccucugauuuggaugccauccuggucuacagagcaaguuucaggauagccaggcuacacagagcaaccauaucucaguacaaacaaacaaaccaacaaaccaaccacacacacacacaccaccaccaccaccaccaccaccaccaccaccaccaccaccaccaccaccaaaaagaaaugacuaagcuguuuuccaucuggcuauacuauuuuaaagacuuugcauaggcuggaguguagcagcugauagaggaccugccuacucuaugcaaggcuuuguguuugaucuuuagcaccucaaaauacacaaauaaguaacugaauaaauaaauaaaccauguggaguaucacaugcuugaaaucauagcuacuugggaagcugauauagaauauuauagaggccagcuuaggcaaugacacuuaacaaaaauuggagacgcuggguuggucccuaacacuucaaaguaaguaaaagaaauagaccuucuuaguaggaauacauuacagcuuuaauggcauauuuuagaauaccuguaagaaaaauugugugaggugucuguuccacaguagaguggcuguaauaaagcuagaguuaaguauuugaaauguuuucaccauaaagaaacaaaaauuuauauggagagagauguaucuaacuuguuuuaaagguuuuaugauauauuuauuuuuugaagcauuacauggcaucacauuaauuucuauaauuuuuauguuuaucaaaaauagauuuuaguaaaugaauacaaucaagcugugcuguggcaguacacuggcuuauagcaugugcaucaccauggauuugaugcucgacaccacagaaauaaguaauauaggacucauaccaacaauaccuuucacucacuuuuacugucauccuaguuuuaaaaagcucaguccauucuaagagauguucugaguaauaaauucuaagaaacucccugagaagucauuucccuaauggcacaagacaauucuaauauacaaaauguaauuaaagagacagaaguucuaauugguguccuuaguagcuuaggucuguauguaaacaaggucacguagagcaugcuguaucuucagacacauuaauucuucccugcuuacucuuaccaagcauccuugguucuuuccucuggcuuauuggugcauggcucuuuuucuucacuccaaacaauucccucaaguaucuuuuguagagcugccucagugcucauuaauuccuuuuagccugccuuuauuaugggaaguuuuucuuccuucuuccauuacaacauauaucugugcaaauagaaaugcaucauuuucuuuuaaaguuuuuuuuuuuugaaguuuuuguugagaaaucugcaauuauuucaaugggcucaucuuuauaugugacuugguacuuuuuucuugcugcuuucaauauauuuauguuguuccauauaucaguaauuuaauuauaauaugaugagggaaguucuuugcugaucuugucuguuuaauguucuaaaugccucuuguguuuggacugacaucuuuuccuguaauugagcgauuuuuuucuacuauuuuguugaaaauauuuucuaugccuuuagaaugaaagcuuucuuuuccagugcccaugaaucuuagguuuggucuuuuuaaagucccagauggccugagagggccauuccugccuucuuauuaaugaaccuuugucuucuuuggaauauucaaauuuuuccucuuugccuuuaagccuauuugguccucuauuugaucuucucugcuggugagacuuacacugaauuuuaacuuacuguguuuucauuucugguauuucaguuuguuuuuccucagaaguucucaguaguuuuguuuaugggauuccucuuuucuaacuaguaugagguuccuuaguucauucaguucucucuuugucucccugucucugucucugucucugucucugacucucucucucauuuguguuguuuugggauucauucaggaauuuucuucuacuuucuaagcauacuuacuuacucuugacuucuuugggauuucaucugguuuacucucacuagaggcuauuacuuaaggauuggugauuuuuggaggaguuaugcugcauuguuuuauauauauauaaauucuguuuugcauugggauuuaugcaucuggguuuauuuuauuucuuggcuuuguuguuguuuuuauuuguugugucuuucaaagggagugcuuucaauguucaaguggagccuggcuauauguggcugaggugucagugggcaggccauuguggauuuggucacagguccugcuuaucccuccugugauccuucugggguuaggguaugcaugcuguucuugccuaggcuagaacaauugcuagaauuuuugcuagguugagguuugucucagauccugguucugucaguagguaguccuucacagguaagacuguaaaugcugguuauaccucuggguagucauuugggaguccuguugagaaggugaucccauuauugggcuguuauuucuguuguuuggauguuucuugaaaccucugacuauguuacucugcagguucugucuguggcuggaguccuuucauugagucacacaguuuguuugacuucuuuucuuucuuucuuucuuuuuuucuuuccuuccuuccuuccuucuuccuuuuuuuuuuuuuuuuuuuuuggagaaaggucagagucaauuauuaauuucucagagauucuuuuuuuuuuuuuuuuagauuuauuuauugauuauauguaaguacacuguagcugucuucagacauuccagaagaaggagucagaucucguuacggaugguugugagccaccaugugguugcugggauuuugaacucuggaccuucugaagagcagucggugcucuuacccacugagccaucucaccagcccucaacauaccuucuuaauaaaagcccuagagguaguuucuguccuuaucacugaggugcauuucuuguaugcagcaaaaugcugggucuugauuacauauccagucuguuagucuaugucuuuuuauuggggaguugaguccauugauauuaagagauaauaaggaaaagugauuguuauuuucuguuauuuuuguuguuagagcuggaauuauguuugugugucuaucuucuuuuagguuuguugaaagauuacuuucuugcuuuuucuaggguguuguuucccuccuuguguugguguuuuccaucuauuaucuuuuguagggcuggauuuauggaaagauauuguauaaauuugguuuugucauggaauauuuuguuuucucugucuaugguaauugagaguuuugcuggguauaguagugugggcuggcauuuguguucucuuagggucuguaugacuucugcccaggaucuucuagcuuucauccucucuggugagaagccagguguaauucugauaggucugccuuuauauguuacuugaccuuuccccuuacugcuuuuuaaaauuuuauauuuauuuauuuauuuauuaaacaauuuuuuauuggauauuuucuucauuuacauuuuaaaugcuaucccgaaaguccccuauacccuccccccgcccugcuucccagcccacucacuucugcuuccuagcucuggccuuccccuguacuggggcauauaaucuuugcaagaccaaggaccucuccucccaaugauggcccaggggguacugguuaguucauauugcugucccuccuauagaguuacagaccccuucagcuccuuggauacuuucucuaucuccuccauuggaggcccuguguuccauccaauagaugaccccuuacugcuuuuaauauucuuucuuuguuuagugcauuugauauuuugacuauuaugugauggaaggaauuucuuuucugguccagucuauuuggaauucuguagauuucuuguauauucauggguucucuucuuuagguuagggaaguuuucuucuauaauuuuguugaagauauuuacuggcccuuuaaauugggaaucuuuacucucuucuauaccuauuaucuuuagguuggucuucucauuguguccuggauuuccagcauguuuuggguuaggaagcuuuuugccuuuugccuuuugcauuuuuuuuuuuuuguuuuacuuuugugucaauguuuucaauguuuguaucuucugccccugagaaucucucuucuaucucuuguauucuguuggugaugcuuacaucuaugacuccugaucucuuuccuagguuuucuaacuccagggcugucucccuuuguaauuucuuuauuguuucuauuuccauuuuuagaucuuggaugguuuuguucauuuccuuugccuguuugauuauguuuuccuguaauucuuaaagggauuuuguguuuccucuuuaauagcuucuagcucuuuaccugcguccuccuguauuucuuuaagggaguuauuuauguccuucuaaaguccucuaucaccaucaugagaagugauuuuagaucugaauuuugcuuuuccggugugaugguguauccaggacuugcuauggugggagaauuggguucugaugaugucaaguaaccuugguuucaguugcuuuuguuuuuacacuugccaucugguuauugcuagugcuaccugcccucacuauaucugacuggagccuguccuuccugugauccugguugugucagaacuccucagaauccagcuguuucugugauccugugauccugggcgugucagagcuccuggagucaaguugccucugggacccugagauccuugugugaccaagccccugggauccuguuauacugugcuccugggauuagagcuuccucuggguguugugggacuggcugcagaguuugggcccaagucugcucagggcucugucccagacugaaaggaaccggugccaccagucgggcgggguuccugcuucccuggaucccacuggucccaguuacuccugguaguaaugggacagauguauccuccucaccuuugauacuguaugcaauuuuucuuuuucuuuucuuuucuucuuuuuuuuuaagacuuucauuuucuauguaugaauguuuugucugcacaacacauaugugaucuucccauagaggccagaaaagggcauaggauucccugaaacuggaguuagacugcugugagcugccaugagggugcuagaauugaauauguguccucugaaaaagcauccaguucucuuaaccacugagcccucucuccagucugagcagggaaguuuaaauaucaugcuuuuccccuuaauuggaaguauucuccuggccaggauucagaaucuacucccaugacauuugcuccgauaggugcuauccaacucucuccacuuuauuccaaggagauucuagccaacuguuuucuagguaguuccuuuucugucucuauuuucaggacauguuucucccuuuccaugacugucaccccccccccccccccccgccacuucuaucccuccugaccauuuaugguucuagggauaaagcccaguaccacccaagugguagguaaacaauuuaccgagagucaacucuguccucaguuuacauuccacgcugaguguuuguugccggcugucucuaggucaaucauuaacucuuucuguguugagauuguggugauguaguuuuucucugucucauuagcaccugguauagugccugucauguagcagacgauccucugaugagugaguaaauacuuagguguugguguagcagauggaguggaugcagaugaucauguuaaugaggggaagaacaaccaaauuuggccauaagucugucauauauaugaacauaucuuccuauccuucagaaaaauuugaauuugaucagcaaauuucaccaauccauucucuuaaacauuuauuuauuuauuuauuuauuuauuuauuuauuuauuuagugggggugggguaccuguguggaauucagaagacaacuugugggaguuaguucugucccacgaguuagaacucaacucaccagguuuucuagaaaauuccuuuagcugcugaguaucuuguggguucagucaaugcuuauaaauauguuuauuuuauuguauauaaaguuguaaaguuugucucaacaauuuaaaacagggucuggaaaauugacucaguggcuaagaguauauuuugcacagaggcucugggugugagucccagcaccuguugguagcucacaacuaucuauaaauccaguaucugacacacugugaguaccaagaacacaugugguacauaguaaaacaucauauacauaaaaucauccaaaaaauucaaauaggaagauaaaaucauuuaaauaguauuauaauugaauaauugaguggcuguucuuauaaugaaaagaaauguuacuauguaacaggugcuaaagugaggauuaggggaggaagaaucuugagugugugugguugcuaugcuguguggaauguggcugaggaggagugugaccugacucuacagcaccugaagugauaaggaagcauccuaacugugugauggaggcggggcagguucaggagagucugguagguggcugguaggauauugcaaaagugaugcgcuaaggaacuuguugaugaagaacguuagcuuugcugggaaagaugggaucaaauuagacucuggagauuggggagcccacuuacaagugucaagagcauuggaagaguaaaaauaauucugggccuaauuauagauuggaaacagaguugauuucuugaagaugauaaguuucuauuguauaacaguaucaaccuguauuuuuuuggucuaaacuaagucaagaauaagcuacauauugcauagaaauuaaguaguguuucauauguauuaaacauuaugugggcuggagagauggcucagagguuaagagcacuagcugcucuuuccagagguccugaguucaauucccagcaaccacaugguggcucaaaaccaucuguaaugggaucugaugcccucuucuggugugucugaggacagcuacaauguauucauauaaauaaaauaaguaagucuuugaaaaagaaagaaagaaaacauuaugcaugaugugacauaaguuuugaaaagaggcuguugucugcagagacugacugacuggaauuucaaaacuguggugcuggagagauggcucaauuguuauaggcuaggcucacaaccaaaauauaagaauuucaguacuggggaggguaugggggacuuuugggauagcauuguaaauguaaaugaggaaaauaccuaauuuaaaaaaaaaagaauuucaguacuaugaagauauuggaacacugcaaguccagaggcuaauuacuuauuuagggcuagggcuaguuuuagcccucugaaauagccuuuccuugaacauuucuguuucaaaacuaauauuuuuuaauggaucaauuaaaaaaacccuuuggaaucuaauaauuuaauagaccacuagcuuuucucaauccuaaagcugaucaugcuaucagauagcauccuggccuauagaaaagcuuuccccaucuugcuguacccgcuuuuucaauguacccagcaauguauugcaucuuauuauauuuuaaaaauuuaucuauguguauagguguuuugcauauauuauauauaauauugauuauauaauauagauuauguauaauauauauuauauaauauauuuacauauauaauauauaugcaaaacaccuauacacauagauaaauuuuaaaaaauaauaaaacacauauauauguauauauaauaaaauauauguguguguauauauguauguauguguauauauauauauauauauauauauauauauauauauauauacacacacacacacacacacacacacacacacacacaccacguaccugaggaggucagaauagggcauugaacccucuagaacugaaugaaguuauggauaguugugagccaacauguggguucugaaagccuaccuacguccucuacagagcaaacagugcucuuaacuacugagccaucgcuccagccccacaaccaauauguuuuaaaauugccuugauuuaugaauuuaugacuuuuuuugugugaaacuauaaaacuucaugaaacugcuucuauguuggaacauggaauuugggauccuaaaucuguguuccuggaucaucacucaaagauggccccauaacuaucucuuacucucuuaagaugagagcuguuguccuagucaguguucuauuacugugaagagacaccaugaccauggcaacucuuuuuuuuuuuuuuuuuuuuuuuuuuuuugguuuuucgagacaggguuucucuguguagcucuggcuguccuggagcucacuauguagaccaggcuggccucgaacucagaaauucgccugccucugccucccgagugcugggauuaaaggugugugucaccacgccuggcgaccauggcaacucuuacaaaaugaagcauucauuuggggcuagcuuaaaguuccaagcccauuauccuuagguagggaucauggcagcacacaggcagucaaggugcuggagaaggaguggagaguucuacacccagaucugcaguagcaggaagagaguguuauugggccuaaugugggcuuuugaagccucaaagcccaccugaagugacacacuuccuccaacaaguccacaccuucuaauccuuuuuaaguagugccacuccugaugacuaagaauucaaauauaugacuauaugagccuaugaggcauucucauucaagccaccacagcuguggcuuuugcauuugugauuaccgacaaaauaugaugccauccuuugucuauguuuuugcuuccuuagauuccaauguaauugccaauguuauacuucaggacuuauugacauaugugucuacaaaacauuccuaucucaaagaucugccucagaggcagccucagaaaaugaacacuguagaguuuguggaguuggagcaguugcagccugauauauuaguccaugcaguacucagaguaguggaugucacuguauugacaggugaguguuuugagugccucuuuaauuuuagcuuauaauuacucauauacaagaccaucucgauuaucaguugguuaccaugaugcauuuaccaugagguacuguggucucucccaagcagaguaauaccaaguaggauguuccuuuuccuuuucuagaggcauuauauaguuauagaggacagaagcaaagaaaaguuguguuaaccguggaacaggcucaaggucaacacuaugugcuuguauuaugggguccuggagcagccugguauacucagcuucaaaggaaaaaagguaaauacacugaagaaagcauuuaaccuauuuauauuuugguaaaugauuaauguuuauuugucugagguacagagacucugaagagauuacagcauuuggaauaauaauaauugaaugguccucugaaaauugcucuugccauaauuuuauacuugcaauuuaguuaucuagaaggccuuuguaauuaauauaauuuguaauuaaugguaacaaaagaaaggcuugaauuuuuucauucuuacuacaugaggacuuuuuuuuuuuuuuuuuuuuuuuuugagacaggguuucucuguguagcccuggcuguccuggaacucacucuguagaccaggcugaccuugaacucagaaaucuguugccuuccucugccucccgagugcugggauuaaagacgugcaccaccccugcucagauauuaauuuuuaaaaaaaugauuuaucuugaaauuauuuuaaaauugcauucacacgugcaugcguguguguguguguguguguguguguguguguguguguuugugcgugcaugcgugcgugcgugugugugugugugugugugugugugugugugugugccugccucaggaguccagaaaagggcaucaaauucccuggaguuggagcuggagcuuccugauguggguguuggaacguuuggucuuuuguaagagcagugcaugcucuuaacugcugagccgucuuuccagccccucagagauguucuuuaaaauuuuuauucuggaaagguaucuguaguuuaaguuucuuuauuuggagugcccuuauaaauaaauuccuuucugucagacggcagauguuauugggauauauuaagucuuuucaagucauauuuccuauugaaugaauuacuauguucuggacuuuuauucuaguucaaaauaugaguucuuagccauuauagaaugguugcuuuaaaaauaugacucaguaguaugcauguuuuuuuaacagcacaaguuaauaauuuaugguauauuaaauuaaaaggaguguuuuaauaaauuaguacaguaccuaccuucacuacugugaaauucugaucuuaacaaugagagauaguuuaguguuuuuugaguuaccuuacucugcaaaauaauuuagacauugauuaacugauucauuauuucagacuuggaugaguuaauguuacauuccaaacuucugccuaagugcuuaucuguaggugggaucugucauauugucucuuaaucauuaauagccuguaacuaggauuugagauaagucugacuuuuauguuacgauuaaauagugacagauguuuguccaguugugaaauuuggcaaacauguauugaugacagacauucuaugucagccgugaucacgaguacaguggaugcuaaacaaaauguaggucagagguagacugguacgguagcagaaaacacugcucuuuucuuaauaugacuauuucuuuagaguuaagaauuaugugguaauagaagagaauuuauuaauaucucuagauaauccuaugacuucuuaguuaauauugaaaaugaacacaggaauuuugauauaaauuguuuuugcugaauuuacuaauuaagccaaauuuauuuauaccuucaucauuuuaaaguuucaacaugugcuuuaauacucaagacaauuccuuuuaauagaaaaauuacaguuuugaaggaucauuuaagugauggagcuuccagaaacuauuagucuucuuuuuuauucaguuaguaguucuuggggcaggcuccauaucagcuucuguaguaggcacuggcuuucgcaugcucuuaagauagcaaaccuaguuucuaugaucagaaaugauuaccaaguaguuauuauucacuacuaaagauaauggaauugaugcuuuggaaaagaauaggaagaaaucccaaaauuaauuccuuugaaauaugucuugcuagcagguaugcaacaggcauuggucaugguuuagauuuuaaugaaggcacacuagcaacagaaaccauauuucuugagaauaauuguuuauaauuucaccacuaugagcuagaggcacaaggauuaggaguucaaagcuaucucuggcuacauggauauuuugaggccagccugagcuacaugagauccuguuauaaacaaacacaagaauaauuaggugaccauaaaauaauuuauacagaaucaaaugccaucuucaugcaguuacuuuaaaaugcaguucaccauuucaaaugcauaacaaguuaagauaaaguacucucauaacauagcuaauuaagcagauaaucccaauuuauauuuagauacauauuuggaaauaauuuggauaaucauauauuaucuaaaguuaguuaugucuacauuuguaaugugauaauauccuaaauccacaauucauuuuauuuugauuaaaauuuuuucuaacauaacuuccucaaguuugccauaagccauaguuuacugauaaaacagcuuagcugucuaaccuaacuucccuagaacccguguuuagacacaguagcaccuauucugacaaccucaguaaggccugcuuucucaguuacugagacagggccuagcgcaggcuggccucugcucacucaguaguuaggaaugaucuugacuuucugacccuccugcugguacucuccagagggugcauuacaggugugcaccaccacgcucagguuagacagugcugcgguucaaacccagggucccaugcaugcugggcacucugccaacacaccagcaccucugacuuuuaagcaauagccguagagacuuucuugucaaacagucauauuuuuuucuauauucaacuuuaaaauuacagugaagcaaagggagauuucucaguucaacuuuuuuccaguaaccagcuguagacuguuggcagaggaccuguuuaaguucccagcacccaccuaauaucuaaugaugccaucuguguagacuaguugacuuacuagucaauucugaacaaaaacaaaacaacaaaaguuaguucuuaaugagggaaucaaaacguucauuucaguguccuuuaaacaaacucaacuagcuaaaaaaaaaaaaaaaacuuuauagcugucaagauuagaaugugcuguccuaaaaggcaguuguuuaggggcccaagacaucauuagaaaagaucacaaagacggcaucuagauaggugugguggcacacaucugcaguuccaguacuuggaggcagaggcaggaggaaugagagucagagaagccuggacucuagagagauacucuuagaaaucuuaaagucuguagcuuuuaaauucauuuccuuuaacacaugguuauauuuugucuuucuuucccaaauucuuuagugaaaaaguuagguuuaguugauuuaauuagguuaguauauuuaaucugauucugaguguagacccuuuauuuuugugacuuuuuuauuuguuuuuguucaagauucuauuugggaauuuauuuuggugacuuuuuauuuguuuuuguucaagauucuauuugggaauuuaaguaccuuuuuguucagcggaacagcauacuagaaaacuuagaauuacauacaacacuguggucuuccugugaaugccuauuugaugaugacacaagagcaauuucauuuaaaacaaaauuucaaaaaaauacauccuccuuugucaagauaucagacuuagcgacucaccuagaggauaaauauucagguaagaccuuuauacauaaaauguugcugguuucacuguaagcaaagaggcuaccacuuguaagaaaauauauaauuaaauaugaaagugaaauguagaucucuacaaguagcugaacagauaaugauuucucagucuuuugaucacuuaguguuuuucauguauucuguuuugccuuuacguaucauuauauagcuuauccugauuuccagcucaugauugucuugcucguagccacuccauggcuaggauuacagcuguauaccgccgucucaggcuuugaaguuuucacuguugaaagguuuuaaauaggaauucaucguauuuaaauaaauacagagcuauuaagauuaucuacuuguugaaugaauuuugguuucuaguuuucaggaaauuuguucauugaaauuauugauguagcagggcugaagagauggcucaaugguuaagagcacugacuguucucccagaaguucugaguuaaguucccagcaaccgcauggugcucacaaccauuuguaaugggaucugaugcccucuucuggugugucugaagacagggacaguguacucgcauacauaaaauaaacaaauuuuaaaaaaauauugacauagcaaaaauuauugauaugaagucauuuuuuaaacuaucuuuugaauauuuauagaauagauaaugcuauugauuuuaucugauacuagcaauuugugucucuuuuuuucuauuuuuauucauuuuauugauugcagucaucuauuggugauuuuuucuccuguuuucuccuuuauuuacuucuguucuaauuugcauuauuuccuucuucuuaccuacuuggcuuuuggcuuucuuauuuaagauggaaauugagacaauacucccagccccugccaccaaugugccaugaauuuccugugaaguaaauaaagugucuggguuugccagugcucugugaguuguaaaauuuccugcucuggcuugugguaaagacacucuuuccaucccuaugggucucuagggguuguucuuacucuacuucuauggucggacagcacgauagccaagugcuguuacccaagucagcucagauucuggcauacaaagaauauucuuaccauucugagauaguaucaggaaccaagaugugggggcauuauacaugguggugguaauucuagaccuuccucugcuuuggucaaaugauagaucaaaucucaauagucauguuaauucauacauguauuguguugauuaauccucauugucagcuugacuggauguagaguccccuaggugacauaaccucuggauauaccugugagaguguuuccauagagguuuaacuaggagggaacacacaaucugaaugugggcagcaccaugcauccuauggucucuaguccuaacuagauagaaaugggaaagggagccagugaucuggacaccagcaaccaucuuccagaggauucaguguguaaacugccucgauccuauuauauuauucaaacuaugaaucaaaauaaaccccauggccuccagugacagugugggccacucagauuaccaugucaccacaccccugccaacccccacugggagcacagguuucagacuuucacauggucucccgucucagcccagacauggcccuuggccugggccaggaccucaccacagccuucucguauccuccuguuccucacugccagggccaucgagucuccagucccaccuuucuccacagaguacaaaccccucagcuucuccucucuucuaucucuucacugaggacuuccucuuucccaucucuccaucacacauucucccaucauaguggcgccugcugcuggcacauggaugucuuucuucuggcuuccccauuugaaaccuagaauuagacuuaaaaauagaaauaaacaaucucacagaagucaacaaaauagaacacaggaccccagugaucaauggcagcaaagagacagugucacuagcuuggggaugacaccaagcacugugaauaugcuuggaaauuuuagggaugugcuuuccaugugguaccaaagcuguacuguuguagccagucugugauagguugcauucaaaaagccccuaagcuuagcucuuuucacuaucuuauggucaacuacaaggauggaacucauaguuucugucauuguuuguuuuaaauaggaaaauggaaagagaacaugcaggaacaaauaacucuuccuacucuguugcuauuaugauuauuauuauuauuuaaguuaaauaagggcaagagaaaggggcuaucacacuagggagaguucccaaaagggucugcuuggugacaaaagcuggagaaggguggcucuuguaaagagcugaagaugcucagucucuccuauaagaagcauaauuugagugccuagaauucuagauugccccugaaaccaaaguccauuuuagaauggccucuuuugaaagaaguauccaaauaucuaaaaugacagaauuauauggacagucuucugaaauaauugcacuucucauuaauuuuguguguuauugaacguaucuguggaaaagggcaguguugugucugcuauagcuuaugaaauaugugaccacuuauuaaauacccauucccacuaagccauguagaaaugugugccugaguagaagaaaugaugaaagcauccuagucaagacuaaggcaaauggaagacaucaaggagagucgccacuguugaacuccuaaagagauggucagaaaauagaacccgggcuaacaggaugcagccuugccuauccuuuguaagaggaccaugacggcuacucuugguugcugacuuguuuggauuaaaaaggaaauuagugaagugcaacucuucaugagucugcgggguauuuccaaagacaauaaacuaagggggaggccuguuccgagugugguggcagcuuugcauagauuggggucccagaggguagaaaagggaagggaaaacuccagcuagccccagcccccucucugccuccuggcugcugugaugaaaacugccuugcugugcugucccuucuaccauggcuacccugacaccucugaaaccaggagcccaaauauaucgcucugcuuuuauuauguuaugccaaaaucuuuguuuuagugacaaaaagcugguuaacaaaagagcaaagaauaaaucugaaggcuuaaagaaaccuuaaaugaguauggagaggagagucauauucagauagauucguaggcuuuguuaguaugcagaaaggcaaaaguaagguaggaucaaagaucauaguagauguuguagauacucaauauauguuuaguagaugaauacauuguuaguuaacaugcuugagguuacaguuaaugacaaaagaaaccacauccgccaccuugcucuuaauuccuuuuugaaugggaacccagaacucacucagcugcaggcaaguccuccauuauauucuuuauggaagcuguaaguaaguugagauccuguaggcagggaugaauuccaagagcaagaccuuggugcagcuuaucgugugacuguaaaugaaccauauugcuagcuguguuugucaguuaaaguuauuguugaaucaaauaauuauauuaucucucucuuuuuuuuaauguaggagugguucugauuaaagccaagguuucagagcugguguuuucugcugcagcagcucagaagauagcuuugaaugcucgcagcacucugcagagcaucuucuccucucuucccaguauuguguaugcuggcugugcacacugugggucagaacuagagacagaugagaacaggaucuacagacagugucugagcugccugccauuuguugggaaaaaaauauucuauagguaagauguaaagaaugauauuucguuggucugauagaaacuaccuauugcauaaaacaggacaugacuaagaacauagauaccaacccuuuauaauauaacuaaccaagaacuuaagaggagaauaaaauuucccuaagugacaaauaacuauuuaugaaaccaagaauugccaguaaugagucagacuauuuuaaagaauuaacuagaucuuaauuucuuugaacaaccauccugaggacuguuuacuuguaaccaacaucugacaguuuauccagaacucauuuccccaucuugguauauaacgacaauguaaagguuaaaguguugugugaucucucccggguuguuugcggaggcugggaaauguuuguuuagccuucagugcuuccguuuccaccuuuacuuuagaagugaaugauaagcuggucaguguauguucucuggugaaaguguuaaccagcucacuccgugaagagcacgcugcuuucagaucaguguucagagucuugaauaauugguuuuuagaaucauaaaauugcaguccuuuacaaaggacuggaagugacucauguuuuauguccuuuccuauuauuuauaaauauuuaaaugucucaagaggaagcacauguguauucaguauuuuuguuuuaucuauuuauuuuuguguuguuuuagacgaggucuuguuaggcagcccaggccggucucaaacuaauaguccuaugucagccugauguucacgcaccuccacguccgucugcauucagcaguucauuuguuguggcacacauacagacgaugcagagaggcaaggacaggaaaccuguauguggugcagauacugcguuuguuagagauaagggagugaagcugggccuggugcugcuugugggccgccccaguaccaggaggcuaaaguaagaccucaagcucggggccagccaggagacguagcaagaccuuguaacuacaacagaaugaguaaaguaaacaaauaaaaacaagggaguaaagcuuaccuuuuuucuuaguuuucaauccagaugauugaauguaaggccuuauucuaggcaaaugcucuauguaauucuuguuuuuaccuuuuguguugagacaaggucucacuaaauuacccagguuggccuccuugaacuuacuuuguagcucaagcuggccuuaaaguuugaucuuccugugucagccucucaaugaaccaaaggccugcgccaccaggccugaucagaaguucacuauugcuuuguggauugcugaagauugaauuaagguucaugguauacaacaaacauaaugaaauggacuuguuaguaguuaaagaccuucaaaaugaaguauugauucauuuuauguaacauauuuaggggugaugggacaaggucuugcuauguagcccaggcaggccucagauacaugccuugcaauuuguaguuaauuguacacuaucuuuuaaaaacauuauugagcaauaaguccugugccaucauauuaacucacacauaguaugugcacacauguccuccauacacacacacaauaaaauauuuaagaauuuuaacuauagggcuggugagauggcucagugguuaagagcaccgacugcucuuccgaagguucugaguucaaaucccagcaaccacaugguggcucacaaccauccguaacaagaucugacacccucuucuggagugucugaagacagcuacaguguacucacauauaauaaaauaaaaaaaaagaauuuuaacuauauaauucaaugauuauauguauauauauauucuaaucuuggaguuagauguaaagaucaguggugcagcauuugaccaacacacaugagcucuugaauuggaucccuagcaccaaaccaaaaaaaaaaaucccaaccagccagccaacuagccaaccaaccaaccaaccagcuagaacaguagcaacaacaaaauaaaacaaaacaugcacacacacacacacacacacacgcgcgcaaacaaaccaacagacaaaacccccuuuccuaucagguucccaaguuccauggauggaagaaccagauuuuucuugucaugaguguacaacagcauuagcauauaauagagacucaguuuguauuuguucaaauaaagaguggaagagagcaagagagagaauaagagcagaugagagacagacacagaggcagagguggacagaaagagacuggggucuaggguaagagagccuggaguuaugugggugaaggugugaugucuguagucacauuuugucuuuacuacuuaugagucugauucuaaguuuuguuguuuauuuuguaggccggcuuuaaugaccauaguugauggaagauauaauacuuguguccauguugggucaaagaugauggagcagauucuucucaacauuucuccagauugccucaacagaguaauagguaaaacagcaacaccauccauugguguucuaugaaaccauucgcaggagcagucggagcaccaagaguacagugcuguacauaaagcuguuccccgucaguauaaaagugggaaguugaguuugagugagacauacaagcuuacauaaguuagaaggugagagcucacuacaucugucucauacaugaauaaaguaagcaccugaucucuuuagccuaaauuccuaauuggucagcaaagauacaggauucuagucucaucauaguuaaaaagaaacaaagaaguguguagcuccaugcauugaaaugaauuuaugacuggauuuuuuaagaucuucaacugugaugccagggccagucagggccagaagaaggcagacggaucccaccucucagauggucaugcugcauguguguccucguuagccccagacuccuuacguggacaagcuaaucucggucuuuuguuugcuuagcuucauaauaguggguagcuuuuuguguuaauuaaaaguugagcaucuaauccagaaauaggaaacaaugauguuuauauuugagucuuaucccuaagauaccuuauuuuguauauacaaauguuugggguauuuguuuuuuguuuauuuuuaaaucuaacaucccaaaacauuccauuugcaagacccucagcucagacauacucaguuuauauaugcaccacuaugauuaaaacuguaaagcaguaaguaugaggcccucuuuaauauggacaugcaauuuuuaaaauuuauuuuuauauuuauuuuauguguuugaguguugaauugaguguaaacagucaaacaccagaagagguucaaagagggcauuagauucccuagaacuggaguuaggaauggcugugagcugccaugugggugcagaaaauuaaauccagguccugcaagaacacguguuccugauugcucccaagacacggccgccuuacuucaggcgggagcagaccucaguuccucagguauuugggagcugauggcuggggcugcugucagucugggugucgcuugugcuugcuuucgugcucagugggaaacacaccaucuuccuagacucccuucaacaauuggacgcuggaaagagagggguagaacaagaacugaaagauguaagucugugaagcuugaggaaccaagagagacaggaaaccuucagaauguguuucugugcagcuagugggguccugagugucgugugugcuuuguucuuccucagugccuuccucagaggucaccuacggcauggucgccucagaccugcuccauuccuuguuggcugucagugcugagccuugugugcugaagauccagagccuuuucgaguuggaugagaacagcuacccacugcaacaggauuucucccuacucgauuucugcccugacucacguaagcuguggagcccaggacuuucucuaagggcagagggcacaggaggcauuccugggaaggagugaugaaacaaucugucuuuugaagaugcauuuauuuuuauuauauguauguaaauguuuugccuguguaugucuguguaccauguauguaccuggcacccacagaggccaggagaggguguuagaucccgagacuagaguaauagaugguugugagccgccguguagauuuugagaaaaugcucuuaacugcugagccauccaacccuaugaucuaucuuuugaaaugaaaugacagggauuuugcuuagaguuuuuaaaauagguaauuuauuagcauaauauaauugugcuaaauacauaauuuuuuaaagaaaauucugugaagcuuuuauuauuuguuuuucuguugguauucuccccagcacugacuuucugcuauaaacugaauugcuuuccuucauuauaacugugucuacugggcuagggaugcagugcuguugcuauggccucaggcguggucguauccauccuugccugccacugacacuuuacuguggggcucuuggccccuggucuguccuguaaguugucagcacuguguggaguuuccuucugggagacaagcuuccucuuagacuaggguaccaccuuuucaucuuuagcaggagacuucaggagagauuccaauuccuuggcaccgauugucucaguauagccaaagggaggggcacaaaugcuucuauuuagaguacugggacuccugccaugauauuuaaguuaauugacugaauuaguaucaugaaaauggcuguagcccugaaagcaagcuacaauauucaauguaguucuuagcacaaucccagugaguuucuucucagaaauagaaaaaacaauccucaaauuc

SEQ ID NO: 7366 - RNA, 34962 nt, Mus musculus
uccguccucccgguggggcgacaagcggcgcaggggaggggacagccagacaagcaggaagccgcggcuuaaaagggcagcucgcgcccagcccuuccuccccgcgguccaggccugcgagcuccggucuuuacagcucccgccgcacucgccucagcccgccgccgccgccauguaccgccgucugggcgaagcgcugcugcugucccgcgccgggcccgcugcccugggcucugcggcugcagacucagccgcgcugcugggcugggcccgcggacagcccuccgccgccccgcaacccgggcucacgccggucgcccggcgccacuacagcgaagcggccgccgaccgcgaagacgaccccaacuucuucaagaugguggagggcuucuucgaccgcggcgccagcaucguagaggacaagcugguggaagaccugaagacccgggagagcgaggagcagaagcggaaccgggugcgcggcauccugaggaucaucaagcccugcaaccauguguugagccucuccuuccccauccggcgcgacgacggcuccugggaggucaucgaaggcuaccgggcccagcacagccagcaccgcacgcccugcaagggaggugagcgcccuccggccccuuucuguccucccuccccuccagacucccguagcccgggccgcuacucggcccagcccaguucugcaggccgugccccgcuucgggcucccccgccucggguguggcagccuuagaggauacugauuuuuuuuuuccgcccuaaaacuaccacguaauaugccagccuuuuuacugggcaagucuucaccccaagccucugcuuguguugaugcugacuucacugaggacacuguacagcuuuucuuuagccucggugccugucaugucauagaccgugaacccuuaacgccagcagccgacgauacaagaacagagaaaaauuaucuucuuuuuggaguuggaaucuugaaaguuugauuaaccagcgcagcuuacuaaucuucuaaauuauuauaauuuuacacugauggcuuuuuguguugugccucuuuucuccccuuggaaaauguaaaauaucgagcagaguaaggucucugacaaacagggcgaccugacauuaaaucuaaaggguguagacuacagaacugccugccagccaauagaaugaaauagcccuggggguguguucuuguccuggcuaguaccagaauugagccuaggcaaaagguagaguccuuagggaguugaaucaguuagauuugguaguuaccaggguauccugugguuuaaacuuuugggauguguguagauuggcuuacagccuuuuuuuagggaagaaaaauacguuuuucauuuucucuccacuacaguacacaaucauacagcguuaaaggugcuuuaaaaaaaaaaaagacuauuaaaagaaaaaccaccuuuuuucuguugcuuaaacuuaauguauugaguaggagucuugauggagguugaauuggcaagugagcagagguuagacuagaacagugauucauuucauugcaacuucauaacuguaauuuugcuacuguuaggaguaguuauguaaauaucuaauaggcaggauauuugauaugcaaccccuucagggguuacgggggacccacagguugagaauugcaggacuagaccuuugucugccucgguucuguccaguagucuuuuuacuaccagcugacuaaaaacuauagaaauguuucugcacuggaaaaacuggggcugugaugguguucccagugguggaacaaagguuguggcaaaagguuuaaugauuuaccaaauucgcauugagucuacccaagucuaggaucucccuuuggagccuaauugucccuuagcccuguaguucccucugcuagaagccauuggaaccacuuugaccucugauuucccaugcagcucaaaauuauauaaaagggguagucauucuccuacaccucaccuuccucuuucuuccuucccucccucccucccucccucccucccucccucccucccucccuccuucccccacaagccgggaacucaaauucuaccccccuccagaacaaacaaggaugucugucgagccagaggcauuguauugcaaaugcuaaacuguccuugucuuuacagagggugugcauccugugauuugguggguuuuuucugucuuguuagucauuaaagcaauuugaguuugccguaguuuuauuauuuuaagugcucuugucacagaaguuuuaauagcaaaauauugagccuagcaacaaauaucaucagccuuaccagaucacaguaaccaaagcacuugcucaaaguggagugaacagagcagaaauagagaaacccguuuguaguuaguuaacaguaacagcauugcaugaugauacagcaagauaaaguaacguucuacaaaguaaaccauuacauuuauuuaacaucacacugccucuucgcccccugucccaugccuaagugaauugucuucucauaguguuuugggaauuuuguucuugauccuccugccucaucggcucucccaguguuuauuacgagagaccucaucuguuccuugacaucccuuucccagccuugagcccucucuaucuaaccuuuccuccacagcgaccuuacaccugaguuuccuaaaauaaagcccucgaggcugaaccaggucuggugacuugcugcaauccuagcucugagagcugagccacucaguuagacccuaucucaaaaaacaggaauaaauccuguacugaaucaauacaauagucuaaucuauagugaaaagagauaguuuaaaguaaagaccaccuggaagugcuggugaguacuuuauuucaaguaaauauuuaauaaaacuugguuuugugauuuuuuuuuuccuaagucauauuuaacugaggcuacuagauuugccucugguaaggauuuacagaggaccagagacuuagauaagagcuggaacucaaagccuggauucugucaguagcccgguauggccauaugcguaccugauuuucuguaacacaggaaaaucugaaauucagugccagccuggacuacauagauaagauccugucucaaaaaaaaacaaaaaacaaaaaaucuauuuuuguagcaaagauggauacuguaauaaacaauugauuugacaagauuuguucaaagguucugacauguuuucaaacacagcagagauuguucccgguggacaugauauucuggguacaucaucugucauccaguuguuugcuaggguaaaucuguguuuguggugggugccuucccucaccucuccauuuguaugugucucuccugaagcaucuguucugaagagaacaacuuucucaacagauuguucugcuaccaguuuuaguguaaaguucuuagaauucaguguagggaggggcuggagagagcacugugguuagggcauaggcugcucuuguggauuugauuccuagcacccaguggugaugcagagccauccagaacuccagggccaguggagcugugccugcucugcccuccucaggcaucgugcacggauguauauucauacaggcaaagcauucagacacauacggugaaaaguuaaaaagguucagaagggagcugggcgugguggcgcaugccuuuagucccagcacucgggaggcagaggcaggcggauuucugaguuugaggacagccagggcuacacagagaaacccugucucgaaaaccaaaaaaaaaaaaaaaaaaggguuuagcgaucaacugacuauaggagccacuuucuuuguuuucuaucuugccccucagugucuucaucucauauuuaguuaaaguuuucccguuagugguucuuucuccuguguuagaacuuccucaaaucauuagaugaguaucuuguguaacuguguuuugcugcuacgaaaugcaauacaaaaguuaacuuguuuuauaagccauauaauucauagauccuuuagcacucagcugugaaguaguguuuguaauacauuuuaguuaaaugcagaauuguuugucuuuauacagacaugucauuucguaaaagccauguguccccaguccuuaugugcaaacaaaugaagagcucugaaaccugccacaguguauacuacauauuucccuucucccauucuguaagcauugacacuuaacuaguaguuaugggugucucagcacaccguguagaaucugcaagucauaaucggaaacuaagcaccagugcacauaacuucagaaaaguggguaaugauuaauaggcccaugaaagaacugaacaggugagauuuuuggcuuaagaccagaagaaauugaauuuaccacuguaaucauuuaaauucugagaaaaucagauuuuauccacuaauguugcagauguuaagaacagaaggagaaagaacucuuaguuuaauguucugcuagucuuuagagauuuucaggccagccaggacuacacagugauccuggguccucaaaaagacaaaagaugaaaugauaaugagagguucagaaagcuagcugcaugguaagcucaucuuugugccugggggaugguaugccccuccuuggggaaagaaacuucccuaguugaauccuuaguuauauguaagguauuuaaguucuauaaggcaugauagcauauuacugaaccagaggagggacuguagaaaccaccaguuuauauccgagucagacccaguccuuguaacuaauuucugaaaaagguugaucuugugagauuguugagcuuuuauuuaaccugugagaugaagcuuucgaugguuaguguuagaugggaauuaagugagggaaugcccucucugugggcagagaacuaaaaaaggugauggacagagaguuuuccuguuuuagcguuguugaauacguaaugauaaaccuaauggauuacagaaaauaacaucagaacuaagaaugaagguaauaggaauggaaaggaagggcuggagagaugguucaguggcuaagagcacugacugcucuuccgaaggucgugaguucaaaucccagcaaucacaugguggcucacaaccauccauaaugagaucugaugcccuccucuggugugucugaggacagcuacaguguacuuaaauauaauaauaaauaaaucuuuaaaaaaggaauggaaaggaaaagaggcaaacuaaaguauuuugaaacaaugguauucuucagagauaugggaugaagaugggaaggaucagagauaaaguuuucagucuaagggaauggaaaaaaauaacacuacuaaggacuauagaccccaucugaaagccguucaacagcagucuaaauaggaaauuccaggaguaggucauuaaugaucuuaacugaugcaacguucugggaagugguauaaaauuaaagaauaagaauaaaauaaaggcucaggagaugucuccaccauuaagggcaccuguucuuucagaggacccagcuucaguucucagcacacagugcuuuguuuauuugaaaaauaauaguuuauacagauauguauauguguacaaaagaugcauaguauuuaauguauuauugugaaugcuuuagaucauucaggagauguuuuaggacagcaaagagaauaggggugucaguaauucaucagguugaucauguaaaugaccugauuuccaucccugggacccacccaguaggagagaacuagguucaggugguccucugcacacaguccccucuugauuguugcuuuccuagacagucccucccuuuccucuaugguaauucugcucuuauucuccgaagacccauugaaacuagauagcuucaguccuuugacccuuuucauaacaaguuaggauaguuacuguugccuuuuugucuuguuaaauguugcccaacuucauguggauaucagggguaccuuuuuuuuuuuuaacuauguagcccagacugcccuccguugccugugugcuagaauuacagucuuacacagccaugccauaccuaggucacccaacuuuuuuuuuuuaaagauuuauuuauuauauguaaguacacuguagcuuuauucagacaccccagaagaggacaucagaucucauuacagaugauugugagccaccaugugguugcuaggauuugaacucgggaccuucggaagagcagucggcgcucuuaaccacugagccaucucaccagccccaaguuguaauuuguuuaaaaagucauuuguaagaccuaauuuaaaauuuuaaucaagaagcuaaacuuuguuucccaagaagcuuaaguuuuucucuuccaaguggguuagcaguucuuuuguuuuguuuuguuuuguuuuuucgagacaagguuucucuguguagcccuggcuguccuagaacucacucuguagaccaggcuggccucagaaauccaccugccucugccucccaagugcugggauuaaaggcgugcgccaccgccgccuggcauguuaguaguucuuaaaaccuauguuuccugaauucucagacaggaguuccuuggcaccauagaguaaguuaauugguuuucuuccucccuccuuuucuuuugcuuucuuugcuagggaugaggcccagagccuuacacgagcccucuaccccugagcuacagucacagccuaggacuccuguuuauuaaguagauaguuuagaacgccacugggauuugaauucugggugaguaagccaugccucauuaaggagaucccaguucaaguaauuuuuaaaaacauuuaaguuuccaaaaauguugaguuacuaauucaucauagaaaaggaugguagcuaaggaguuuacgugaauguauguuugguuuugauucaacuagaaacaggaaaaugucaagcugucgguuguggcuuucacuuagucuuuuuuucuaaguaaugagcugcugguuuguuuuucucuaucaccauggcaauuccagcuaguuuugaagagguagaagauuugguuuguuuugacuuuguuuucauuuuugugagacuuaauuuauuuuacauuuacuucauuuuaagauuuauuuauuauuauauauaaguacacuguagcuguagaugcgccagaagagagcgucagaucucauuacagauuguugugagcuaccaugugguugcugggagggauuugaacucaggaccuucuggagagcagucagugcucuuaaacacugagccaccucuccggccccuuacauuuaccuauuaugugagguuggggcguguacgugggaguuuucuuccugggguuuaccuugagauguuguguuaucacuguugggcccaguaguccaguaguuagagcaccuguguacuauugauuccuuagaaaguuugcaaagaaaaccuucucacccaggucacacaaccucauuaccuucugcucucuucuuacccucuugucugcuccaggucugauucugcucugacagccccuccccuagcucacuccaguagaaguuuuucauuaguucauagucugcagaaaaaugccuguggugugacuaauauuuccacauggguguagcuagggaaauuuuuuuccacaaacaaaaaaguuaaucuauuggaaacauguguuuugguuuugguuugcuuuguuguuuuucaagacaguuucacugcauagcccuggcuguccuagaagucacucuguagaccaggcugcccuugaacucaaagauccuccugccucuucuuccugaguacugggauuaaaggugcaugccaccacuaauauuuuuuuuaagauuuaguuauuuauuuuaugugugugaaugcauuguugauaucuucaagcacaccagaagagagcaucagauaccauuacagaugguugcuugccaggaauugaacucaggaccuuuggaagagcagucaguauucuuaaccacugagccaucucuccagccccccacuaauauuuuuuaacguugaguuuguagcuccucaguggaaacuuguauuguuauacucuacauuucuagcuguuaucuuuccaguaagagaacauuaauaaguuuuuuauuugguauugauugauuugucuguauguuggguaccacagcacauguguaucaguuaucuacuaccagauaugucccaggaauugaaggcaaguaauuacgcuuaguggcaaauauugucaccugcuaaggcaucucacuggcaugcauuuguuuguuuuugcaaugcugggugucaggaugagagccuuuugaguacuaguuguccuuaaauaucuaacaguucuuuuuuuuuaaaaaaaagauuuguuuauuuuauguauaugaauacaauguugcugucuucagacacaccagaagaagguguuggauuccauuacaggugguugugagccaccaugugguugcugggaauugaacucagguccucuggaaaagcagucagugcuuuuaaccacugagccaucucuccagcccucuaagaaaucuuucuaagcaaaaacuaaucuucauggccacucuuggcuaucagaauaaauuaauuaauucgguccccauucuguaacuaauuuugggugucuaauuagcagcuuuuccuuuuuacccuuuuuuaaaaaagaauuauuuauauauuacauauauauguguguguauauauguaugugugugugugugugugcauacauauauauauauaagcuuuauucagacacaccagaagaaggcaucugaucacgguacagaugguuccgagccaccaugugguugcuaggaauugaacucaggaccucuggaagaagagucaguguuccuaaccacccgagucaucucuccagccccaccuccuuuuaccuuuuaugguguccuuauacauaaaauaccuagcucagcacaggguucaaggccaaccugguguacagagcaaguccuaggacagccaggacuacacagagaaacccugucucauaaacuuuaaaaagaaaaaagguauuucaguguauauaggaauagcuugucuguaaaauauaagaggcauggcguuuucaauuuauagcuauuuuguuaacuuagcagaaguuguggauguaauucugucuucccuccuuuucuaaaugaaucucccagguauccguuacagcacugacgugaguguggaugaaguaaaagcacuggcuuccuuaaugacauacaagugcgcuguggucggugaguggcccucucugcugaugccugacgacucuuuggggaaauguggcuaugcacggcuacuuuuuaaaauucuccuuauuaccuuguuuauaaugauguguguggaagucagaggcaacacuguagaggugguucuuaaucaaacuuagguugucaagcuucuaagacuguuuaccugcugagccaauucauuggcccaaugguuacuuuuaguaugcuauaaaaauauuuaacaggccgggcagugguagugcaugccuuuaaucccagcacuugggaggcagaggcaggcggauuucugaggucaaggccagccuggucuacagagugaguuccagauagccagcacuacacagagaaacccugucucaaaaaaaaaaaaaaaaaaaaaccaacaacaacaacauuuaacagaacuguuuuguuuuuugaaagaacuuuguuuguuuguuuguugauaguaucauacgcacacacacacacacacacacacauauauaucccuggcuggcuugaaacucuaugaucagucuggcauuggacucagagaucuuccugccucugccucccaaaugcugggauuaaaggugucuaucaccaaaccugaccugauuuuuuuacuuucuuucauagucuucuccauuucugaauuacaacacaugcauuuuguugcuuaggaucucucuaagggcuaugggaaguaaagacugguuucccuccuuauuuguguguuugcauuauaguuguaugucaguauagauuguaacacauagguaauagaauauauaucaccaaggagaacaugguaauuaaagaaauaagaacuuugucaucauuuccaaacuuaaaacagugaaauuuuuauagaagcuaacugaauuuucuugaagcauacacccuuguuuuaaaugcucauccauggucuaaauaaaucauaguggaaggaaagcaaauacaauauucucuuagaaguaauagaauacugauuaaauacaguuaacaccuggcuggcauuauauaugauaccuguucaguaagauuucauuucaaguuuaacaucuguguuuucuugugaugcugagaauuaaauccagggcauuuuucauccuaggcaggcacuccaccaacuaagcuacggcuucagcacuggcuuuaguuugggaauuuucuagaauuaaagcagucauguagcuggguggugguggcucacgccuuuaaucccaguacucagguauagguagguggaucugugaguuccagaacagccaggacuacacaaagaaacccugucuugaaauaauucagaaucugaaacuauaugagcaccaaaauagugcuccaaguagaaaacuccauaccugaacuuaugaggugagcuauugucaaaucguagguaucaggcugcguggugguggugguggcggcgcaugccuucaaucccagcacucugcagacagaagcaagucagucuguggucgaggccagccuggucuacagagugaguuccaggacagccagggauacacagagaaacccugucucaaaaaacaccaaaaacaaaauguaggcaacaguaaaauguccuacaucauuaccaguacauuauguacauaggagacauaaaauucuugucuaggguuggacuccauccuccagauaacuaauuguguauagguaaggaagaagaugaaauacuugagaaacauacuugaugauauuugcucucucuguauuggcaauauuuucuguuuuuauguuuuuuaagcuuuuauggaacaauaucuuucacuauucucucucagauguaccguuuggaggugcuaaagcaggcguuaagaucaaccccaagaacuauacaguaaguauccagcuggcacuguccauguagggccuaaaguugugcuccucaugccagugagguuaauggugccauugcuuuccuggaggaauuggaaaacagcuaaugguugacucagcuguaaauuuccuaauguaucuugccacacuugcuugcuguugauggcugugcuucucauguuaauagacauuuacaucugccacagacaaucugggucccuggucugugaagaacgggauuucuuaggcagauggacaaagauuccggaugaaaaugacagacagauacacgaaagauguguugaaucugaauguaauguucugguugagcuucagacuuauauuacaacgaauuaucagaggauacaaaucacaaaaagacaagauacacugaaauucaccaguuacagcagaaaggaauuuacagggacuaauuaaauguuuacauuagggauaacaagcccugccuuuggaucagccuaaugccaggcaagaauuucacacuuuaagguuaaaagcaucaggggguuguuaacucuugacaggccuuaagaguaaugugcuaucacagagcucuaaauucuuaggucuaauaaaacuuaucuugucuggagaguuuccccuuaucaggguaguauaucaacuuauacuugacauggaaguagccuguaguaaaagauuucuaucucagugagacuuuuagucucuaucuguaaacagcugaguaaaauggcaagugcuuaauuguuuacuaaauggguuaagcuccuugcugcuaucuggaaucuaagaacacugggaaaaggcuuuagcuauguuagaauacaaucuuaaaaggcauuuacuauaaggugaugcuuaauagagugcacgugaaucuauacacuagauuaaugugguggaaauuugaauauaauggguuaggguaagagaugccauaacucugggaggaaaauuucccuggacucuuauccucguaaaacagcuuccaggcuuuucgccugacaaaccgauccaaacuggagaguuggcuuucgccagaauauccaggaggagaguccuagaaauucauuucucaugagcagcuuuuuggcauuucugccucacaagcugacuccaccagaguccgugacauacaucuaaauuuuuuaauuuuuaaaaguuuugaucuuaaguuuugugcccagcaugauggcacacacuuuuaauccaagcacucagguggcagaggcaggcagaucucugaguucaaggauagcuugaucuacauaguaaguuccagaauagcuagggcuaccagagaaguccugucuuggaaaacuaaaaauuaaaacaugaauaagauuuugaucuuaaguuuuaauaccaagguuuuauucuagcaacaaacaacuuaucuaguaaaaaucauguuuauucuguuaguuccaaguuaguuaaaacugguugcuacaguaguuaguugugugguuucauucucugaaauucaccauuugaugacuccuugaacacacugucacccauacuugggugucuuguuuaucucuguaacccuuucaagaagcccacacccacgcacuuggauauauaugucuucucuuuuuuaacugcugcucucuuaacccuuaugccuauauuaagcaucuguguuaaaccccaacucugucucccuuuuugcaugugaucuuguuuuguuuuugagauagggauucacgaccuaacccagauugaccucauucucagcuguccuccugagacuuaggguuacaggcacagccgccacacccauguuaaaacuuuacauuuaaaugaaaguauaggaugacccauggagucugcccuaggguuuuacugcuaugaagagacaccuugaccccagcagcuuuuauaaaggaagacauuuaauugggcuagcuaacaguuucagugguuuaguccauugucaacauggcaggaagcauggcagcaugcaggcagacauggugcugcagaagaagcugaggucuacauccugauucacagucagcaagagacugccacacuaggcccagcuugagcauagaaaacuucaaaccccgccuccacagugacacacuuccuccaacaaggccacaccuccguaauagugccauucccuaugggccaagcauucaaacacaugagucuauaggggccaucccuauugaaaccaccucaggauccauauaguuauaacuguuuugugugaguguaugagagagaacgacagaaaccgaaaagaggggggauugaggauguuauuacuuugaagcccuggcugaccugguacuuguguguguguguguguguguguguguguguguguguacucacccuaggauggcuucuuuuaccuccuagguacugggauugcaggacgcacugucauguucugcauuaugcacacacacauacacauuuuagacaaaguuucccuuuauagccuauaccuauauagccuuauuuguuuccacauucuuuugccucgguauucccagugauggaguuacaaacaccacgucuggcagguguagguggaucucuaaguucauagccagucuagacuagauagcaaguucaaggccagccaguaagacucccucagucaugccuucucugaaccaagacucuaguccucacaugcuaggcagaugcucucccguugagcuguaucuccccaacccucucuuuacuuuuuauacugagacagggcuucacgggguugccuugaauucucuguaguccaagcaggccuuuugaaaucuuuuuuauuuuauuauuuuuuuuaaccaggcaguggugguacaugccuuuaaucccaggauuuaggaagcugagguaggcagaucucugaguuccaggacagucaggacuagaaagagaaacucugucucaaaaaacaaacaaagaaaagaaaggaagaaaaaucauuuuucugagauacauagugaauuccaggucugccuagucugcuacauaguaaaaccauggcucaaaaaaguaacuagacagggccuagcaaacacagaaguggaugcucacagucagcuauuggauggaucacagggcccccaauggaggagcuagagaaaguacccaaggagcuaaagggaucugcaacccuauagguggaacaacauuaugaacuaaccaguaccccggagcucuugacucuagcuguauauguaucaaaagauggcuuagucggccaucacuggaaagagaggcccauuggacuugcaaacuuuauaugccccaguacaggggaaugccagggccaaaaagugggaguggguggguaggggaguuggggggaggguaugggggacuuuugggaaagcauuggaaauguaaaugaggaaaauaccuaagaaaaaagaaaaaaaaaaguaacuaaaagugccugcuccacaagugguacugggagugucuuuccagccggggaggugagggaaggggguggcgcaggccuuuaaucccagcacuugggaggcagaggcaggcggauuucugaguuccaggcuagccuggucuacagagugaguuccaggacagccagggcuauacagagaaacccugucucaaaaagcaaacaaacaaaaaauccucuuuccauuugaucuuuauaucaaaaauguguuucucuguguguuuguuuguuucucucuguaggauaaugaauuagaaaaaauuacacggagguucacuauggagcuggccaagaaggguuuuauugguauguauugcccuauguauuucuguauagagugaaacaccuacuaaguaaugaucuugaagaaacuccugcuuuuauaaaccuuagguauaguuguccuuuuccuucuagaaaccagguuuuauuauagaucucauagacacagcuuagcuuguuuuuaacaaguucagguucucgcugcaguguggaacaaggacacuaaggagagaucuuuccugccuuguucacacccuuuucugaagcauggaaagggaugugacuacuaaauacuggauuuauaacaguauuuuuaagaugugagaaaucugaugucauuuagaagcuagugguuuuaauguguauuagcuguuccuuuaccucacuggagguggcggugaggcugaugucaucaacucgcuacuccauucuccuucaaucucugaggagugcucgggucaguuagaggagcuuuugugagcgugcuccauuucuaaggauacuucaccugcuugauauucuuauugccuaguaucuguguuaauaaguucuuugugagauaggaauauuucuugugauguguacuuguuuacucuucaguuucuaaguaguuuugucuuaauaguucuuggucuacaggcucugguuaacuuaaauaaguaagguuacucaguagaauguuaaagggagacuggcugggaugggguugggcacagcauccucuuaacucugcuuuccuaugccugagaguucccuccguguucccuccacaagugacaagcuccuaugcaauuaagcugcauauugaaacuuguucuguuguuaggaaguaagguauaaaauaaaugaaugaauacaggagugaguauaggaaaagcucgacuguuauaagauuuugucugaaguccuuaggguucuugacaugcuucauaugaucacuacuauggauuuuacaugugccgcauugcccagagacagucugccaucagaaguuaaugagcaccucacucuugccuacaggggugcuuucugauuucaagauggugaauucacauuccagccuggugaugccuuugugguuauuugaauugcauguuugcuuuuagccuaaaaucuuaguuauauuuuacccuugaguuuuucagauuucaugcagucauauuuauugccauauuuucauacguuuuuuccagcguaguuguaagucuugaaaguuccaaaagugacucacuggaacucugaaggacagucugaguaauuuggccccuuugcuuguagaaggcaaaugaaagcuuaucucuugucuucucacuucccuuucuacaggguucaccaucagacuugagucugaauucuuaccguuagcccugggaguuuagggucagauauggguggagugggauagaggaggaaaagucagauuuugauaggaauuguguugaauauagaggccaugggggggggcauauuuaccaaauuaagccuucuaacccauaaacaugggcaucuuugugcuuauagggcuuauuuucuucauacuucucaauacuagaaacaacuacagaguccuuuugaugcuauuguaagggauaaugauauauuaggggguuauuuuugaguuuuguuagcauacuuaguaauuucuauaaucaaacccauaugggcaagauguugcauauuuaauacaguguguugucccuauacaaaaggaaauaaaugaacuuuaacauuuguaggccagcauggcuauuguuucuuacaguaucaacuuaaacuuagauauugcuuuuucccuuuacaauuauucuguguccagacuuggcaauaaaguaauaccagccucacagaacaaauugaaaacuacucccucuucagauucuuggaaaagccuagaaauguuuguguguaugugagugaguauguguguguguauguauguaugugugugugugugguaccuaucaacuguaacuuugcccugcagguuucucauguuccuuugucuccauacaccagaacuacccugaccucaaccccucccuuaugugcauguccuguuagaauucuguagugcagagauuacuuguaaucuguacauccuuugggaacauaguaggagaucagucuuacccuuagccugauccugugggaacauaguaggagaucagucuuacccuuagccugucaggcuaauuuuucauugauuuccccuugcuucccuuguugaacuugugaaaugcaagcuuaucagccaacagucacgucuuugugguuuuuauuaugucuuuuugauugacaaacugcuuaccucagacuuaccaguucauauuuauuguuuugaagcagguaauguuacuccauagauauuucuaaacaggucuuauagcaauuuguccuuagcuuaggaaauaaauauguauuguaaauuggcaaaauugugcuaaccuguagcccaagcauaucacuuugagaaauagaaaguuugcaaaccagacaaguagacucuuucaucaguggaugaggcuagaaagccuuuccuucagaucaggguucuauauggaaaucaggguuguggagguuaaccauucugagagugaaagaugccuaaaauacagagacaaggguguggagagacagacuuacuggggccauaaaacaugaaccugacuuaaagguuuauagaaaauuauaaugcaaaauugcaggaacauaguaaacaaguuauugauaccuaucuuacucuaacuguauacauguauguaaauauauauauagagagagaaagagggacagagacauguaugugcaaagaguagaaaggagaggaaaaaggguauagaguuuugugacuauagagugagaacaugugacuauaugaaaccugccuuuuuccacauagugaauuugaugauaauuccaagucauuaaaucaauauuuuuaauggcuauuuaguacuucuuuguguagcuaugccaagucuuacuuacuagcaucuuuguuaguaauugucuuuuaucuuucgguuuugagagcauucuacguaguuuucccuuuacaguggagugagcuucacugcacgcauugcccaguaaguucaccauacccagcgguguuagaagcaacacaguuaccauuauuacucaggagccauuguuauucucagccuugcuuuguaguuugcugugcucuggagaacuaaaugcugcaccugacgggcacuggcuaauagucagaagugcuccaugagggaaagugccacaccugcuucagcagugucaccuccucaucccuuccuacuuagugagaagaccucagccaacagggagcuaacucuuccugccugucuaucagugaccaggaugguccuguuauagugcucaaaugauacauuaucucugauuacaguucaggacacugaagucugagaggucaaacuuuugcuggcaucauacccugaaggccaaggaguaacuugaaucuauugucuguaguaacuuccagauacagcugaguaaauucuaacagaagaaguagugacauaacauuguguguacaaguuucauagaaaagagacauuuaaugaauauuuuuauaacuucaguuuguuauaccaaaaugaaauauaaaguuuucuagcgacagugacauuguucucuuagagaauugcaagcaucuuuauguuugggauaaguuuaucuuaaaaacuagcacacugcccuuucccugugcucccagguccuggcauugaugugccugccccagacaugagcacgggugagcgggagauguccuggaucgcugacaccuaugccagcaccauagggcacuaugugaguauccacugaaacccaaggcuuccugcauugcuguccacagaaguaaugagucaucugacuuaaugagaaguugguaaucgcuggguucaucucccuuuauauacauuugguaugcguauuacuugcccccucuguucugacgguaagcauggugagcaugaacuggguuuugcucagacccuuagcaucagcucgcuuguuagggcaauagauuguacauucaguucugccuucgccucaaaagugcuuucacugaaagaggagcuaagacaugugagcuaagguauggaaaugguguaacauaaagauagacuucugaguucuuaaagaaggccuuuuugaagggauauuugggcuggaccuguaaaaucugguugaaugucaacaucuggagcuuugggggcuaagaggaagagaacagcugagauuacagguaagacaugcauguguaaaggugacggaagagagguaagugaacacacagaugucagguccuagugaagugaagagacugcuaugacaaauccugcaggaagaguagcuguuugugugacaccagccccaucuucacagugcaggaacccaggguguggagaacagcuucauuucugagagcuguggaaccuuggggaaccauguccauaaacuaagaaagggaaucgauggcuauucucccuucccuccuccagacaagguuucucugcacagcccuggcuguccuggaacuagcucuguagaccagacuggccucaaaaucacagagaucugccugccucugccuccugagugcugggauuaaaggcguucccagcuuauuuauuuuuugagaggaaagagagagagaacacaacauaaaguugggugaauggguuagaaagggauuuggggguccaugguggugcccaccuuuaaucccagcacucuggaggcagagggagaugggacuugaguucaaggccagcccagucuacagaguucuaagacagccaggacuauagagagagacccugucucaggaaacuucauuuacacuaaguagaaaucaggugcacacuacaaauggcauaaauguggaagcuguuucaaaacuauagaaaaggaaagcagugccugcccaggaccauuggaauauggucugagcccugaaagacugcuguuggggagaagagggagggagggaggcaaaaagaaguacuagaaaguccuaaaguacagaaaacagugagcuugaaacgcaggggggucaguguuacacagucauuaggagaggagggugggacaaaagacuaaagaacuccugccaggucacugucuguuaaggacagccaagacaucaagcuuuguccugaaagauggagaagccaugagaagcuuauaaugaguguguuucacuguguauagcggagauggaauuggucagggcuagauagaggaucccaaacagcaggcgugugaaagagggaaugggacaugaaguaaagccuccggcuaaaaagaguaccauugaagagaagcaaagggagacaggcugaacgguaucugcugccuggaagaagagucuuguuuggcuguuaguuagcuggauaugcgccacagaaucauuggugugcaaggcaggccguguaggagaaauacaguccuuccagggaguaagaggcuggguagucaaugggggugggggggucuuuccagggcccuacugggaagcuaggcuuuggaggagaggcacguuuccugagcggugcuacacacuggcuuggaccacgggcaguccugcucucucgcccaccagcuuugagucucugucuuagcuuccucauauguaagauaacaauaucuucuucccaagacuguuaggaugaaggaaagaaggaaggaauaaauagaauaauguacugagaacaauccacagcccuuauuaaguaccaaaaaaaggucuucugucugaagugagaugcagcaguguuagguguggccugccacucucauagcuuuuuuuauuuuuuuuauuuuuuuagauuuauuuauuuauuauauguaaguacauuguagcugucuucagacacuccagaagagggagucagaucucguuacggaugguugugagccaccaugugguugcugggauuugaacucuggaccuucggaagagcagucgggugcucuaacccacugagccaucucaccagcccauagcuuuuuuuuaaugaaacaaaauuuugcuauauagccaguguaggcagagacuuagagcuauccugcuucaggcucccaaagagcugaguuugaccuucacugucacaucugacuuuguaccaccuuuuaaugcugagaaagcacuagcugagcucuugcucuugaacugggcucugugcugaccacugcaagcugguaggcagugcguuguuacucuucauuccuacacaguuguggcagcaugaaguuuuaugaggcucugccaaagaaaccuuggauggagcugguuaaagcucuucuguccuuaacugauaggaaauccaaagacucaaaccaagguuaaaagaaguuagcucaucuaaccgaguucugcuggucaucuaaccauacuggcaauauaguguuggggauaugaucccauaccuccauuagguaugcuagggaggcaguugguuggcgccaggccugaccucacacaguauuuccuucagccccagccagcauuugcauuuccacaauuuagaaccauuuggcaccaacuuugcaauuuuguguugaugguguuaauuauucaugaaagagaacugugggaaaacuacuaagggcuuuuacuagauugccuaauuuucaaacgggcuuucauuccuuuuguugguaaguauauaacuaauacaauuccaaguucucucuguaaaaaauguaaauucauguuaaauaauaggaauaaaaaccaggugacuucuggguaggguguaauaugaaguugaucacuuuauugcaguggacaacuuaauucacuuagcagacauauuuugucacugguuuaacauuaucguucaucuucuguuggauuuuuagguaugagcauacuuccucucauuucuucuguucagugaugugucuguuucacagagaucugcuugcuguguuuauagugugcucccaagcccuuuuuuccgcuuuuguguguguaugugugugugugacccaaggucggcacuguccucugcagcugcuguccuccuuacuucuaaggcaggagcuugcugaagcuggagcucggugcuguggcuacacuggccagccagcaagcccaggggcacucaugcuuacacagcaagggcuuguccaagugagcccuuugccugggugccagggacccugcuuuuucuaaccaugccucuuuguaagcaaaaagacgugcauagccuuaauugaaagaugguaaaaaggcaggcggugagauugaaaucaccccuccauccacucugcaguucuauuuauuccugcgggcaguaguggcgcaugccuuuaaucccagcacuugggaggcagaggcaggaggauuucugacuucaaggauagccuggucuacagagugaguuccaggacagccagggcuauacagagaaacccugucucgaagaaagaaaaaaaaagauuuauuuauuccauguaugugaguaguauacuguugcucucuucagauacacgagaagagggugucagaucucauuacagaugguugugagcugccaugugggugcugggaauugaacucaggaccuguggaagagcaguuaaugcucuuaaugcugagccaucucuccagcccgagggucuuucuuucuuucuuucuuucuuugagugagcaagauuuuacugcguagcccuggcccuccuggagcgcacuuuguagagcaggcuggucuugaauuugaagauucuucugcuucugcuuuuaacccaagugcuaagauuauagguguguguuaccaaucccagucuuuuuuuuuuuuuuuuaaugauguguuaaaguucaaaaugaguuuugcagaauacaauacagcaucuuuccauccaagaaaauuaccucuccucuuuugguucugcauuuuguggguuuuguuuuuuguauugauaaucuuaaggugcuuacgaguggaaugugcacccuaacuucguauggcuuagguuuucaguacaggaguaauagcuucuagcugaauuacaucuaugcuuaugguauuguuaguuaugcuuaacacugaauaacauaacucacacauacucagagauuuguacagucuuguggauuuuguguuuugaaauagucuuacuauauaaccagagcauccuugaacuugaacuucugccucagcaaacgcuggguuacaggcagugccacaacaccaacaugcacacacucuuaauuaaaaauaugcuuaguuagcaagaaugugcuguuguauuggcuugaucauagaaacagagcuuugcguuggcugugguugcguuggcugugguggcacgugccuguagucccagcacucagaaggcugagacucgggucacagcuaaggucagugaccugucccagaagagaccucaguccuuccuuuaaauggugauucuuuacucucacaggauuuuuuuuuuuaacauggcaccaggguugaaccucaagccuugcucaggaaaacgagcacucuacuugugagcuacaucucuagcccucucuuacaggauaucaaugcgcaugccuguguuacugggaaacccaucagucaaggaggcauccacgggcgcaucuccgcuacuggccggggugucuuccauggaauugaaaacuucaucaaugaggcuucuuacaugagcauuuuaggaaugacaccaggcuuuggcgauaagacauuuguuguucagguaaaacagcuuugacucugucugcuguguacauuuauuuaugugagaggacacaugcugcaggguggggagaucagaacaggucaggccuugcaccauguaaaucccaaagagucagcucaggccugggcucggcgcagugcuuuucucugcucguccgucucaccagccccaggcuuuguuucacaauaacugauaugcauuacaguuuuaaagauuuuucaguuaauagcacuaacauuggacucuuugagaauucauuacauuuuuagaaugguuguuuucaaagugaaguuuuuuuccccuuaacuuugauaugauuuauagaauuagacccaauuuaaugugucuuaauauuagauaauaacgugacugucaccaacuucuuuugguccucauuaaagcauaaaacugcauucagaaggggaaaaggcuucaacuauaaagcaguaguaagcaugcagaaauauucucacauuggucuaaaucugucucuuguuagcauguauuucacuucgagguuuggcuuugcuguuaccuuaaaauagcacuauaccuguauacacacagucauaagaccacugggcugggugaauaugguuguccuaaacuacuccagggcucaguuucagagguaacagaaaguuuggcuucauauuuuugaucauagaaauuuguuauugaaaaagcugccuaauauauugcuucauuuaaaaaaaaaauguguaaugugucugugugucacagcacacagaggccagaggacaaguuaugauaguugcuucuccccuuccacugucuggguccuuaggauaaaacugggaucaucagaagacacuugguggcaaguaccuuuaccaucaaggccaucuacugucccagaacauugcuucuuuuagcaaaaggauuuugagacuugcuucuaaaccaguagaauauggauuuauguuggucaaaacgacucaugcuaucugcacuaagucgguaucaugcauaauuguucuucucagggauuugguaaugugggccugcacucuaugagauauuuacaucguuuuggugcuaaauguguugguguuggagagucugaugggaguauauggaauccggaugggauugacccaaaagaacuggaagacuucaaguugguauguuauucugauauagucgugugcuguggcauacaguuggggguuagacccaacugcaggucaggccugcaggagucucuucucuccuaccauaugggucccaggguuuaaauucaggccauugcuugauggcaaacacugagccaucucacccuuuaaaacaaaauucuuugcuuguauuuauguagugccaccauguacauaugaaggucggagggcaacuugcaggaguuguuucuccuacugugcagcccuggguggcgaacucagaucaucgggcuugguggcagaaaccuuaggucuuauuucuucucccuuuugguuuaucuuugaguggugggauugggugucuuguuuuguuuuaauucaagcuuggguugguuaguuagccucugccuuccaagcauugauaggguguuuuugagagaugcucuuguguguacgcuuuguuggccucguauccccuggcugcccagccugguuucagauucacggcacucuccgugcuucagcaucccuaacacagggauaugagucaccauaccugguuuucaaagagcucuuacaaaacggacuuuguauaguagacacuaaagcugacauuuaaacucuguugugagccauuaauucugauucccaaucaauuacagcaacauggaucaauucugggcuuccccaaagccaaggucuaugaaggaagcaucuuggaggcugacugugacauucugauuccugccgccagcgagaagcaguugaccaaauccaaugcacccagagucaaagccaagguaaaaaccaucgugaagccagucagcaguauccgugugggagggcaucgagugucuuaccagugaucucuaccaccaucuccaguuucaaaacacggccaagaaaauuagagaauagacaaauaaaaggcaauuuuauacacuugguagagugauuuaauuuuaacuaaaaugauguucuuucuuuuagcucuuuacccauacauauaucucuuuccuaugaguauuucccuagcaucugugcauguucccaauucucuugcagaucauugcugaaggugccaaugggccaaccacuccagaggcugauaagauuuuccuggaaagaaacaucaugguuauucccguaagucaccuauguucuucagguuuuauauguucugggauucauaauuuauuuugcuagaaacuggcaggaaaaugaaccacuggugugacaaguuauaguaaauucuuuuuuuguauuguuuuauuuugucuuccaagacaggguuucuuuguauagcccuggcuguccuggaucucagguuagguuuccaggguuagacucuguguaaaacaggcucgccugaaccuaaaagacccacuuaccacugccucuccaguacugcaauuaaaggcaugcgccaccacugcgcaacaguugugguaacuuccuaguuuucaguuacuuuuuaaaaauauaauggcaacaggacugaggccaggucucagugguagggcucuugccuaagcauacaugaaguccaagguucaauccccagcaccucaagaaacagagagagaauuggaagugugguuaguauaacaugccagccacuucuccuguaguccugaacaccuccucuggcuuccaucaguaacuugaguguauuuacauacccucugaaagucuaguuauguuaaauguauacugugcuaagaauacaauucuacauuauuauauuuuuuuaagaauuuuuauuuuauuuauauaaguacacuguagcugucuucagacacaccagaagagggcaucagauccuauuacaguugguugugagccaccaugugguugcugggaauugaacucaagaccucuggaagaguaaucagugcucuuacccacuaagccaucucuccagccccuguggagacuuauauucuuaaguuuuguuacccuugcuaacuuuaugcauuuugaaugucucuuccuguuuuacugggggaagaaaaagaaaaaaggaaauaggguuagagagaugggauggcacagcaguuaaaaccuauagugcaaguucagagcuccaacguuggguagaucacagccugccuauaccuccagcuucagggaauccagcaccucuucuggccucuauggcacccguacucaccuacccccacagaagcauuucuuuuuucuuucuugauuugcuacugcaaguaacuguguucagaguuuggggugaagcagagggguuaucgggacugaauguaaacccugaagagcucucuuugcaguuagcaucugaaaaggaaagaaaaaucucacguaacugaaauaagcugccuuuggguaguggcaaacuaucuucuggugaggcgccaugcauguacugguuggugaacagauaguucagucugagaucaugguaagaauaaguuagcucuaucuccaauaucauccagugaucucuaagauacauuugugcuguuugaucuuagcuaagauuacuguugcuauggugaaacacaaugaucaaagcaacauuuccacagcacuguucauccucaaaagaaggggcaggaaccuggaggcaggagcugaugcaaagcccaaggaagaaugcuguuuacuggcucccacggcuuacgcagccagcuuuuuuaucuaacccaggaccaccagcucaggguuggcaccacuuacaauggacuggccccuucccccaucagucacuaauuaagaaaaggccuauaguaguguuuuccagccuguggguaccccuuugacaaauaucuaucuccaaacguauuuacacuaaaaaucauaacaguagcacaauuacaguuauaaaguagcaacaaaaaugguuauuuuggguugagagucaucacaacaugagcaacuguauuaaaggauugcagcauuaggaagggugagaaccacugcgcucucugcaggcuugccuacaguugcauuuuaugaaggcgcauucuuaacugaggccccuccucucaggugacuuuagcuugugucagguuggcauagcacaacuguucagucuaccuugguauuuaucaaaauugaguuccuaagccugacaaaauggcugagaagcugaaggcacuaaguuuguccagcauucugccccugagauccacauggcggaaggagaaaccugaaucucagaaguugucccugaccuccaugugugcacauagucucaugcacauaccugugggugugugaguucacugaguucuaaucaguuuuuauuaaagucauccuuuuauauauauuuuuucugugucacauuuuuuguauaggaucucuacuuaaaugcuggaggaguaacagugucuuacuuugaguggcuaaagaaucuaaaucaugucagcuacggccgauugaccuucaaauaugaaagggacucuaacuaccacuugcucagugaguuuguaaagucuugucuaucuccaaacauuguccuuugggucaaagaaagaacugggaaaacauacacacuuaggaaaucuauuccugauaauccuagagacuuugccuaagaacagaaaacaguuguugugccuccugggccauagagcaaaaguacacauuuuuuaauaaaugguccacauauuauuaggucucaaauguuuauagucaaacuuuuuuuuuuuaaagauuuauuuauuauauguaaguacacuguagcugucuucagacacuccagaagagggagucacuuguuacagaugguugugagccacaaugugguugcugggauuugaacuccagaccuucggaagagcaguugggugcucuuacccacugagccucucaccagccccuauagucaaacucuuauaauguuguuuucaccacauauaaucuaucaauuaguaguacuguaagaagucuucucagacaugaacugcaccacugaucuuucugaucugucuuuaguugcucucagagaaguccuagcuaacauuuaugaaaaugcuaaugagaccaguucuuucugcacuaauuacagaagaccuaccauguguagaaacccuuuuuuugaguccucugguaauacuuuuuauuugaccacauuaaacucagcuguuagaauuugucauccagcugagauaaagccaagaccuccaacugugucccaguacucugcugcucugagaauguuccucucuguucuuucucuucccucaacauuucuuuuuaacaaagccagaggaagaaaacccuagugacggguguuauggaaacagggcagugaccuaaauucacauuucuauaggaauuuggcaagguucuccuugcuggguacuuaaugauuaacccuuguaugacauuggagguacagaugucuaauacacugguuuugggguuacacauauauagguuagagaaacuuuuaaguucucccuuuauuucuucccuguucuauuaacaguaucuuaccuugauuucuuggcuuuucacagugucuguucaagagaguuuagagagaaaguuuggaaagcaugguggaacuauuccugugguccccacagcagaguuccaggacaggauaucggugaguguuggaacacagagugcccuuuacacaagcucccugcccugucuuucagacaagccagguagaugaaguagaguauuaucaggauguuaaccauaaugcugucaugugacaacaccucaccauucauuucauucuaaaaaggguggcaauaaguaacucugucucgggugcuuucugcaguacagcacauggcuuaacauaaucaggaaggauugaaaagugacccugagacagaauucuaggaaaauaggagauaauuauuuggauaguuuuaaaagauuacaaaaaauaaccaguucuuugaaguguguaucaauaguguguauacauuacaaagaaaacuuaaucuauaauccuagaacucaggaggcacaaauaagaggguugauaagaauuuaaggccgggcuggugagauggcucaguggguaagagcacccgacugcucuucugaagguccagaguucaaaucccagcaaccacaugguggcucacaaccauccguaacaagaucugacucccucuucuggugugucugaagacagcuacaguguacuuacauauaauaauaaauaaaucuuuaaaaaaaaaaaaaaaaaaaaaaaaaaaaaaaagaauuuaaggccaaccugggcuacugagacccugucucaaaaaaaaaaguccaaaaguugcacaucugcuuagcauccuaguuccaagucuguauauauguguugcauguauggacacacacauacauccacugcacacucuaaacacaggacucuuuuuuuuuuuuuuuuccauugcugugucccuaaugguuaaacaugcccagaacacgguguuuucgcucaaguguuugauuaaugaguaagggaaacaucgcuauucugccguuagcaaguuuauuuuaucucccuaauuuuauggaucaaaacaaauauaaugcaagugucuuaaucagggauucuauuccugcacaaacaucaugaccaagaagcaagcugggaaggagaggguuuauucagcuuacauuuccacauugcuguucauuaguaaaggaugcaggacuggaacucacgcauggcaggaagcaggagcugaugcagagccguggagggauguucuuuacuggcuugccuccccuggcuugcucagccugcuuucuuauagaacccaagaacuaccagcccagggacggcaccacccacaaugggcccucccaucuugaucacuaauugagaaaaugcuuuacagcugaaucucauggaggcauuuccucaacugaugcuccuuucucugugauaacuccagcugugucaaguugacacacaaaaccaggaguacacaaguguuguagaaauaugaauuauaagauauucaguguagaucauggggguggggggaaaaaaaaaaaaaaaaaaaagauauucaguguaaacaacugguuauuugcaacagguggccaagguccuguuccucuucccuccacuucucauguucuggacucacaggcaugcaccaugugccgggccagagcaguacacuuuuuugguaaccuacuucaaguuuucaucuggcaccuuaggauauauagcuguauugugucacauuaggagcaauggugacuuauuuuuuuuagcagucccgcccaagaaaccaauugaauagcgucuguaacaacaaaaagaucuuaagacccuccagcuuugaagcugcuagugaguccacaggcaaggucuucccagagcugccgacagcuucagccauacuccuuucuguaucuggccaccugcaggaguggugagcaaguuuggacagcaucgggaguggaccgugcuaaucugacuacugccugcccucuggcuucuuuucugugguuguuuucaugugcucuuauuucaccaguuuugugguugucaguaucauuaaaacuaacuugcuuuugaagacuguguuuugucuagcuuguuaguguacauugauacaguacagacauuccaugucuuuucugauuagcugcauaucagccugaucguggguacucuuccagagacacgaagcauaacuuaaauguguguuuguuaacuugauguucuuuuuccucacagggugcaucugagaaagacauugugcacucuggcuuggccuacacaauggagagaucugccaggguauguguacagaugguagcugccuuuguguuaauagcaugaaacacagauaaccguguuaucuugauaggagcaggcagauugcauuuuguaguacugugucacuggucccauguguguacagcagaacaugugccuuuuuagccgcagguggugacuacuguacauuuuaagcauuuaccaagcuuuaggaagaaaucaugcugaaugaggcaguguauuguuaccaagaagguaguuagccaaccuagaaugcuaaucaauauuuaacagcccaaaagcugauauuacuauagaaucugguuuaaauaaggaauuuggggguuuugguuuuuuaccauuugaacuuucuuacaucggagccuuaacuguaagaguuuggauacaguuuuuuuguuucuuuauaugcgacacacacucuuauuguagccuuggcuuuucuggaacucuaaguguagacuacgcuggucuugaacacaaagagaucucucugccucugccaaguguugggaucagggcugguuucuucuugaucagauucuguccacuuggauuuccagguugaagcagcauagacagauucuacugaagaaggugacacuuguuaguggauguuguuugguuuauuucaaagcaggaucuccuguguccacggcugaccuuggacuuccuaaguaucugcgacugugacuggacucuguauucugucucuccuaccuaccuacugcuagaauuauaagcaugugcugcuaugcuugguuuuuuuucugagggguuugggguuuaguuugggaguuuuuuaucuuuauuuaauugauauaauuaaaaugcuauaaugagcuggcaagauggcucuguggauaaaaacacuugccaccaagucgacuaaguucaauccuugagacucacauaguagaaggagagaaccaacucucucauggacaagcauauuggcacaugggaguacacgugcacagaacacacaauacagcaaaugaagaacuaugaucgucuuuuaaaguauacaguuuaucagccugcagcauagucauaaggcuacggagaugucaucauuguagaguguucccacuucccuauuucugguuauuugaaacagucauaaguaugugcucugagcucauuacagauaauagauaacagaaaaguuaaccgccagagaaaccauucacaucuguaguucugaggaguaaggucuugcuguucccuggacaguagcaacuuacauuaauuccagagaauuaguccuuccugcuagaaacauugcugcuguuguggucuuuugucauuggccaucuguguguuaccugcucaugggacagaugaccaggacucacaugcgccuuguguuaauagccugcuacucagucaggugaucucacugccuuuuccccuuuguuccagcaaauuaugcgcacagccaugaaguauaaccugggauuggaccugagaacagcugccuaugucaaugcuaucgagaaagucuucaagguguacaaugaagcuggugugaccuucacauagacagcucacagccgacuucuuuaccaccucuucaccuauaauuucugcagaccugucacaaguuuccauauaaccauagaaaucuguucuugugacucauuaguuaacggacacuguucugaacaagucaguuggaaucagccccuuaagagaaagagauuaaguuagaggaucauguacaagcugaugguauaaaaguaggaaucacguguauccaagccaguuaggugguuugcuuuuagguaaagucuugcuccugugcugucuugcucugggcccuucccagcagagucagugcuguugccagggaaggagucaggagcagucagucacuucuugacaugucugggaacuccgacacauauaagaaguagguguguggcguuuuccaaagguggcaugguccucaaaugaguuauugugguuuuacaucaaaaaaaaauaacucaguuuucuaaguugcaaacaaaaauaaaagcuaugucucauguauuuuauucucucagaauaaaccaguacaugcugcuguaauaaauugccuucaaccacuuaagccuaaccuuuacucaagcagugaacaccuaaaauagaagaaauggaagaagcuaguuuuuuauacuauaaaacaguaucacuuguagcuuauuggcccugcaucauuguccagcagaaauaaaguagcacuauggggcgcucuccucagaccugcaagggacaagggacucuugggaacugguaaugcaguccagagaguacaguaaccacuuuaccaugaaaacuacuuguucuucccauuugaaggucuauucuguugaguaauugaaccauaauucaaaucgagugucccagaaaaaaagacuugggcucccuguuuggagucuggcaggcuucgagcacgagccaguggccaggcucaaccuguguguccccuuccaaggcuuugcauucugcucaccgcuucaccagcagcaggcuagagacugccugccugggcuugacuuuuguuugggggguuauuggccagggcuuuugaacaggaaugucccacagaaguaccagacauuauuuauauaaggaugaacgcuuuuuuuuaacaguacccuuucagaaauuucuaacuacuuuguaacugcaugauuaacuuggugauaaaagcaguuauuaaaagucuaccuuuuccaaaauguauguuucuuuucuguguuuucauauuuaauaaucuguuaguaaauauaaaacgguaauugagguucagaaauuuucauaacugucuaugucacugcuuucuguuaacaagcucuucaaauuuuauuccuggaauuuuuuuuuuuaccuuccugggaagaggcuguaguguguaaagcuaauauacuauugugauuucuggcacuuuuuguuugaaacaaggucuuacauaacccaggcugccuucaaaguuauuagcugaggcuacccuugaacgccuccugauccuccugcuucuugcuccagugugccuuuuucugguaucuuagaaauaaaagcauggaaguuuuuucagauuagaaguucucuauggggacgccccagcccagccgcccuggaucaccaacuggacccccagaagugauuacugaagauacucagcccccacaauugggucaggagagagauccaggggggacaccugcaggcgguacugaugaacccccaaagcugaccaaggaggagccuguuccagaauugcuagaagcugaggcccccgaagcuuacccugucuuugagccagugccaucugucccugaggcagcccagggugacacagaggacucggagggcgcccccccacucaagcgcaucuguccaaaugccccugaccccugagaagccgccugccuccuguccuguugcuccaggggccccuuuggcuuuuuauaaauaaagacccuuuuguaaaaaaaaaaaaaaaaaaaaaaaaaaaagaa

SEQ ID NO: 7367 - RNA, 34962 nt, Mus musculus
uucuuuuuuuuuuuuuuuuuuuuuuuuuuuuacaaaagggucuuuauuuauaaaaagccaaaggggccccuggagcaacaggacaggaggcaggcggcuucucaggggucaggggcauuuggacagaugcgcuugagugggggggcgcccuccgaguccucugugucacccugggcugccucagggacagauggcacuggcucaaagacaggguaagcuucgggggccucagcuucuagcaauucuggaacaggcuccuccuuggucagcuuuggggguucaucaguaccgccugcagguguccccccuggaucucucuccugacccaauugugggggcugaguaucuucaguaaucacuucuggggguccaguuggugauccagggcggcugggcuggggcguccccauagagaacuucuaaucugaaaaaacuuccaugcuuuuauuucuaagauaccagaaaaaggcacacuggagcaagaagcaggaggaucaggaggcguucaaggguagccucagcuaauaacuuugaaggcagccuggguuauguaagaccuuguuucaaacaaaaagugccagaaaucacaauaguauauuagcuuuacacacuacagccucuucccaggaagguaaaaaaaaaaauuccaggaauaaaauuugaagagcuuguuaacagaaagcagugacauagacaguuaugaaaauuucugaaccucaauuaccguuuuauauuuacuaacagauuauuaaauaugaaaacacagaaaagaaacauacauuuuggaaaagguagacuuuuaauaacugcuuuuaucaccaaguuaaucaugcaguuacaaaguaguuagaaauuucugaaaggguacuguuaaaaaaaagcguucauccuuauauaaauaaugucugguacuucugugggacauuccuguucaaaagcccuggccaauaaccccccaaacaaaagucaagcccaggcaggcagucucuagccugcugcuggugaagcggugagcagaaugcaaagccuuggaaggggacacacagguugagccuggccacuggcucgugcucgaagccugccagacuccaaacagggagcccaagucuuuuuuucugggacacucgauuugaauuaugguucaauuacucaacagaauagaccuucaaaugggaagaacaaguaguuuucaugguaaagugguuacuguacucucuggacugcauuaccaguucccaagagucccuugucccuugcaggucugaggagagcgccccauagugcuacuuuauuucugcuggacaaugaugcagggccaauaagcuacaagugauacuguuuuauaguauaaaaaacuagcuucuuccauuucuucuauuuuagguguucacugcuugaguaaagguuaggcuuaagugguugaaggcaauuuauuacagcagcauguacugguuuauucugagagaauaaaauacaugagacauagcuuuuauuuuuguuugcaacuuagaaaacugaguuauuuuuuuuugauguaaaaccacaauaacucauuugaggaccaugccaccuuuggaaaacgccacacaccuacuucuuauaugugucggaguucccagacaugucaagaagugacugacugcuccugacuccuucccuggcaacagcacugacucugcugggaagggcccagagcaagacagcacaggagcaagacuuuaccuaaaagcaaaccaccuaacuggcuuggauacacgugauuccuacuuuuauaccaucagcuuguacaugauccucuaacuuaaucucuuucucuuaaggggcugauuccaacugacuuguucagaacaguguccguuaacuaaugagucacaagaacagauuucuaugguuauauggaaacuugugacaggucugcagaaauuauaggugaagaggugguaaagaagucggcugugagcugucuaugugaaggucacaccagcuucauuguacaccuugaagacuuucucgauagcauugacauaggcagcuguucucagguccaaucccagguuauacuucauggcugugcgcauaauuugcuggaacaaaggggaaaaggcagugagaucaccugacugaguagcaggcuauuaacacaaggcgcaugugaguccuggucaucugucccaugagcagguaacacacagauggccaaugacaaaagaccacaacagcagcaauguuucuagcaggaaggacuaauucucuggaauuaauguaaguugcuacuguccagggaacagcaagaccuuacuccucagaacuacagaugugaaugguuucucuggcgguuaacuuuucuguuaucuauuaucuguaaugagcucagagcacauacuuaugacuguuucaaauaaccagaaauagggaagugggaacacucuacaaugaugacaucuccguagccuuaugacuaugcugcaggcugauaaacuguauacuuuaaaagacgaucauaguucuucauuugcuguauuguguguucugugcacguguacucccaugugccaauaugcuuguccaugagagaguugguucucuccuucuacuaugugagucucaaggauugaacuuagucgacuugguggcaaguguuuuuauccacagagccaucuugccagcucauuauagcauuuuaauuauaucaauuaaauaaagauaaaaaacucccaaacuaaaccccaaaccccucagaaaaaaaaccaagcauagcagcacaugcuuauaauucuagcaguagguagguaggagagacagaauacagaguccagucacagucgcagauacuuaggaaguccaaggucagccguggacacaggagauccugcuuugaaauaaaccaaacaacauccacuaacaagugucaccuucuucaguagaaucugucuaugcugcuucaaccuggaaauccaaguggacagaaucugaucaagaagaaaccagcccugaucccaacacuuggcagaggcagagagaucucuuuguguucaagaccagcguagucuacacuuagaguuccagaaaagccaaggcuacaauaagagugugugucgcauauaaagaaacaaaaaaacuguauccaaacucuuacaguuaaggcuccgauguaagaaaguucaaaugguaaaaaaccaaaacccccaaauuccuuauuuaaaccagauucuauaguaauaucagcuuuugggcuguuaaauauugauuagcauucuagguuggcuaacuaccuucuugguaacaauacacugccucauucagcaugauuucuuccuaaagcuugguaaaugcuuaaaauguacaguagucaccaccugcggcuaaaaaggcacauguucugcuguacacacaugggaccagugacacaguacuacaaaaugcaaucugccugcuccuaucaagauaacacgguuaucuguguuucaugcuauuaacacaaaggcagcuaccaucuguacacauacccuggcagaucucuccauuguguaggccaagccagagugcacaaugucuuucucagaugcacccugugaggaaaaagaacaucaaguuaacaaacacacauuuaaguuaugcuucgugucucuggaagaguacccacgaucaggcugauaugcagcuaaucagaaaagacauggaaugucuguacuguaucaauguacacuaacaagcuagacaaaacacagucuucaaaagcaaguuaguuuuaaugauacugacaaccacaaaacuggugaaauaagagcacaugaaaacaaccacagaaaagaagccagagggcaggcaguagucagauuagcacgguccacucccgaugcuguccaaacuugcucaccacuccugcagguggccagauacagaaaggaguauggcugaagcugucggcagcucugggaagaccuugccuguggacucacuagcagcuucaaagcuggagggucuuaagaucuuuuuguuguuacagacgcuauucaauugguuucuugggcgggacugcuaaaaaaaauaagucaccauugcuccuaaugugacacaauacagcuauauauccuaaggugccagaugaaaacuugaaguagguuaccaaaaaaguguacugcucuggcccggcacauggugcaugccugugaguccagaacaugagaaguggagggaagaggaacaggaccuuggccaccuguugcaaauaaccaguuguuuacacugaauaucuuuuuuuuuuuuuuuuuuuuccccccacccccaugaucuacacugaauaucuuauaauucauauuucuacaacacuuguguacuccugguuuugugugucaacuugacacagcuggaguuaucacagagaaaggagcaucaguugaggaaaugccuccaugagauucagcuguaaagcauuuucucaauuagugaucaagaugggagggcccauuguggguggugccgucccugggcugguaguucuuggguucuauaagaaagcaggcugagcaagccaggggaggcaagccaguaaagaacaucccuccacggcucugcaucagcuccugcuuccugccaugcgugaguuccaguccugcauccuuuacuaaugaacagcaauguggaaauguaagcugaauaaacccucuccuucccagcuugcuucuuggucaugauguuugugcaggaauagaaucccugauuaagacacuugcauuauauuuguuuugauccauaaaauuagggagauaaaauaaacuugcuaacggcagaauagcgauguuucccuuacucauuaaucaaacacuugagcgaaaacaccguguucugggcauguuuaaccauuagggacacagcaauggaaaaaaaaaaaaaaaagaguccuguguuuagagugugcaguggauguauguguguguccauacaugcaacacauauauacagacuuggaacuaggaugcuaagcagaugugcaacuuuuggacuuuuuuuuuugagacagggucucaguagcccagguuggccuuaaauucuuuuuuuuuuuuuuuuuuuuuuuuuuuuuuuuaaagauuuauuuauuauuauauguaaguacacuguagcugucuucagacacaccagaagagggagucagaucuuguuacggaugguugugagccaccaugugguugcugggauuugaacucuggaccuucagaagagcagucgggugcucuuacccacugagccaucucaccagcccggccuuaaauucuuaucaacccucuuauuugugccuccugaguucuaggauuauagauuaaguuuucuuuguaauguauacacacuauugauacacacuucaaagaacugguuauuuuuuguaaucuuuuaaaacuauccaaauaauuaucuccuauuuuccuagaauucugucucagggucacuuuucaauccuuccugauuauguuaagccaugugcuguacugcagaaagcacccgagacagaguuacuuauugccacccuuuuuagaaugaaaugaauggugagguguugucacaugacagcauuaugguuaacauccugauaauacucuacuucaucuaccuggcuugucugaaagacagggcagggagcuuguguaaagggcacucuguguuccaacacucaccgauauccuguccuggaacucugcuguggggaccacaggaauaguuccaccaugcuuuccaaacuuucucucuaaacucucuugaacagacacugugaaaagccaagaaaucaagguaagauacuguuaauagaacagggaagaaauaaagggagaacuuaaaaguuucucuaaccuauauauguguaaccccaaaaccaguguauuagacaucuguaccuccaaugucauacaaggguuaaucauuaaguacccagcaaggagaaccuugccaaauuccuauagaaaugugaauuuaggucacugcccuguuuccauaacacccgucacuaggguuuucuuccucuggcuuuguuaaaaagaaauguugagggaagagaaagaacagagaggaacauucucagagcagcagaguacugggacacaguuggaggucuuggcuuuaucucagcuggaugacaaauucuaacagcugaguuuaauguggucaaauaaaaaguauuaccagaggacucaaaaaaaggguuucuacacaugguaggucuucuguaauuagugcagaaagaacuggucucauuagcauuuucauaaauguuagcuaggacuucucugagagcaacuaaagacagaucagaaagaucaguggugcaguucaugucugagaagacuucuuacaguacuacuaauugauagauuauauguggugaaaacaacauuauaagaguuugacuauaggggcuggugagaggcucaguggguaagagcacccaacugcucuuccgaaggucuggaguucaaaucccagcaaccacauuguggcucacaaccaucuguaacaagugacucccucuucuggagugucugaagacagcuacaguguacuuacauauaauaaauaaaucuuuaaaaaaaaaaaguuugacuauaaacauuugagaccuaauaauauguggaccauuuauuaaaaaauguguacuuuugcucuauggcccaggaggcacaacaacuguuuucuguucuuaggcaaagucucuaggauuaucaggaauagauuuccuaaguguguauguuuucccaguucuuucuuugacccaaaggacaauguuuggagauagacaagacuuuacaaacucacugagcaagugguaguuagagucccuuucauauuugaaggucaaucggccguagcugacaugauuuagauucuuuagccacucaaaguaagacacuguuacuccuccagcauuuaaguagagauccuauacaaaaaaugugacacagaaaaaauauauauaaaaggaugacuuuaauaaaaacugauuagaacucagugaacucacacacccacagguaugugcaugagacuaugugcacacauggaggucagggacaacuucugagauucagguuucuccuuccgccauguggaucucaggggcagaaugcuggacaaacuuagugccuucagcuucucagccauuuugucaggcuuaggaacucaauuuugauaaauaccaagguagacugaacaguugugcuaugccaaccugacacaagcuaaagucaccugagaggaggggccucaguuaagaaugcgccuucauaaaaugcaacuguaggcaagccugcagagagcgcagugguucucacccuuccuaaugcugcaauccuuuaauacaguugcucauguugugaugacucucaacccaaaauaaccauuuuuguugcuacuuuauaacuguaauugugcuacuguuaugauuuuuaguguaaauacguuuggagauagauauuugucaaagggguacccacaggcuggaaaacacuacuauaggccuuuucuuaauuagugacugaugggggaaggggccaguccauuguaaguggugccaacccugagcuggugguccuggguuagauaaaaaagcuggcugcguaagccgugggagccaguaaacagcauucuuccuugggcuuugcaucagcuccugccuccagguuccugccccuucuuuugaggaugaacagugcuguggaaauguugcuuugaucauuguguuucaccauagcaacaguaaucuuagcuaagaucaaacagcacaaauguaucuuagagaucacuggaugauauuggagauagagcuaacuuauucuuaccaugaucucagacugaacuaucuguucaccaaccaguacaugcauggcgccucaccagaagauaguuugccacuacccaaaggcagcuuauuucaguuacgugagauuuuucuuuccuuuucagaugcuaacugcaaagagagcucuucaggguuuacauucagucccgauaaccccucugcuucaccccaaacucugaacacaguuacuugcaguagcaaaucaagaaagaaaaaagaaaugcuucuguggggguaggugaguacgggugccauagaggccagaagaggugcuggauucccugaagcuggagguauaggcaggcugugaucuacccaacguuggagcucugaacuugcacuauagguuuuaacugcugugccaucccaucucucuaacccuauuuccuuuuuucuuuuucuucccccaguaaaacaggaagagacauucaaaaugcauaaaguuagcaaggguaacaaaacuuaagaauauaagucuccacaggggcuggagagauggcuuaguggguaagagcacugauuacucuuccagaggucuugaguucaauucccagcaaccacaugguggcucacaaccaacuguaauaggaucugaugcccucuucuggugugucugaagacagcuacaguguacuuauauaaauaaaauaaaaauucuuaaaaaaauauaauaauguagaauuguauucuuagcacaguauacauuuaacauaacuagacuuucagaggguauguaaauacacucaaguuacugauggaagccagaggagguguucaggacuacaggagaaguggcuggcauguuauacuaaccacacuuccaauucucucucuguuucuugaggugcuggggauugaaccuuggacuucauguaugcuuaggcaagagcccuaccacugagaccuggccucaguccuguugccauuauauuuuuaaaaaguaacugaaaacuaggaaguuaccacaacuguugcgcagugguggcgcaugccuuuaauugcaguacuggagaggcagugguaagugggucuuuuagguucaggcgagccuguuuuacacagagucuaacccuggaaaccuaaccugagauccaggacagccagggcuauacaaagaaacccugucuuggaagacaaaauaaaacaauacaaaaaaagaauuuacuauaacuugucacaccagugguucauuuuccugccaguuucuagcaaaauaaauuaugaaucccagaacauauaaaaccugaagaacauaggugacuuacgggaauaaccaugauguuucuuuccaggaaaaucuuaucagccucuggagugguuggcccauuggcaccuucagcaaugaucugcaagagaauugggaacaugcacagaugcuagggaaauacucauaggaaagagauauauguauggguaaagagcuaaaagaaagaacaucauuuuaguuaaaauuaaaucacucuaccaaguguauaaaauugccuuuuauuugucuauucucuaauuuucuuggccguguuuugaaacuggagauggugguagagaucacugguaagacacucgaugcccucccacacggauacugcugacuggcuucacgaugguuuuuaccuuggcuuugacucugggugcauuggauuuggucaacugcuucucgcuggcggcaggaaucagaaugucacagucagccuccaagaugcuuccuucauagaccuuggcuuuggggaagcccagaauugauccauguugcuguaauugauugggaaucagaauuaauggcucacaacagaguuuaaaugucagcuuuagugucuacuauacaaaguccguuuuguaagagcucuuugaaaaccagguauggugacucauaucccuguguuagggaugcugaagcacggagagugccgugaaucugaaaccaggcugggcagccaggggauacgaggccaacaaagcguacacacaagagcaucucucaaaaacacccuaucaaugcuuggaaggcagaggcuaacuaaccaacccaagcuugaauuaaaacaaaacaagacacccaaucccaccacucaaagauaaaccaaaagggagaagaaauaagaccuaagguuucugccaccaagcccgaugaucugaguucgccacccagggcugcacaguaggagaaacaacuccugcaaguugcccuccgaccuucauauguacaugguggcacuacauaaauacaagcaaagaauuuuguuuuaaagggugagauggcucaguguuugccaucaagcaauggccugaauuuaaacccugggacccauaugguaggagagaagagacuccugcaggccugaccugcaguugggucuaacccccaacuguaugccacagcacacgacuauaucagaauaacauaccaacuugaagucuuccaguucuuuugggucaaucccauccggauuccauauacucccaucagacucuccaacaccaacacauuuagcaccaaaacgauguaaauaucucauagagugcaggcccacauuaccaaaucccugagaagaacaauuaugcaugauaccgacuuagugcagauagcaugagucguuuugaccaacauaaauccauauucuacugguuuagaagcaagucucaaaauccuuuugcuaaaagaagcaauguucugggacaguagauggccuugaugguaaagguacuugccaccaagugucuucugaugaucccaguuuuauccuaaggacccagacaguggaaggggagaagcaacuaucauaacuuguccucuggccucugugugcugugacacacagacacauuacacauuuuuuuuuuaaaugaagcaauauauuaggcagcuuuuucaauaacaaauuucuaugaucaaaaauaugaagccaaacuuucuguuaccucugaaacugagcccuggaguaguuuaggacaaccauauucacccagcccaguggucuuaugacuguguguauacagguauagugcuauuuuaagguaacagcaaagccaaaccucgaagugaaauacaugcuaacaagagacagauuuagaccaaugugagaauauuucugcaugcuuacuacugcuuuauaguugaagccuuuuccccuucugaaugcaguuuuaugcuuuaaugaggaccaaaagaaguuggugacagucacguuauuaucuaauauuaagacacauuaaauugggucuaauucuauaaaucauaucaaaguuaaggggaaaaaaacuucacuuugaaaacaaccauucuaaaaauguaaugaauucucaaagaguccaauguuagugcuauuaacugaaaaaucuuuaaaacuguaaugcauaucaguuauugugaaacaaagccuggggcuggugagacggacgagcagagaaaagcacugcgccgagcccaggccugagcugacucuuugggauuuacauggugcaaggccugaccuguucugaucuccccacccugcagcauguguccucucacauaaauaaauguacacagcagacagagucaaagcuguuuuaccugaacaacaaaugucuuaucgccaaagccuggugucauuccuaaaaugcucauguaagaagccucauugaugaaguuuucaauuccauggaagacaccccggccaguagcggagaugcgcccguggaugccuccuugacugauggguuucccaguaacacaggcaugcgcauugauauccuguaagagagggcuagagauguagcucacaaguagagugcucguuuuccugagcaaggcuugagguucaacccuggugccauguuaaaaaaaaaaauccugugagaguaaagaaucaccauuuaaaggaaggacugaggucucuucugggacaggucacugaccuuagcugugacccgagucucagccuucugagugcugggacuacaggcacgugccaccacagccaacgcaaccacagccaacgcaaagcucuguuucuaugaucaagccaauacaacagcacauucuugcuaacuaagcauauuuuuaauuaagagugugugcauguugguguuguggcacugccuguaacccagcguuugcugaggcagaaguucaaguucaaggaugcucugguuauauaguaagacuauuucaaaacacaaaauccacaagacuguacaaaucucugaguaugugugaguuauguuauucaguguuaagcauaacuaacaauaccauaagcauagauguaauucagcuagaagcuauuacuccuguacugaaaaccuaagccauacgaaguuagggugcacauuccacucguaagcaccuuaagauuaucaauacaaaaaacaaaacccacaaaaugcagaaccaaaagaggagagguaauuuucuuggauggaaagaugcuguauuguauucugcaaaacucauuuugaacuuuaacacaucauuaaaaaaaaaaaaaaaagacugggauugguaacacacaccuauaaucuuagcacuuggguuaaaagcagaagcagaagaaucuucaaauucaagaccagccugcucuacaaagugcgcuccaggagggccagggcuacgcaguaaaaucuugcucacucaaagaaagaaagaaagaaagaaagacccucgggcuggagagauggcucagcauuaagagcauuaacugcucuuccacagguccugaguucaauucccagcacccacauggcagcucacaaccaucuguaaugagaucugacacccucuucucguguaucugaagagagcaacaguauacuacucacauacauggaauaaauaaaucuuuuuuuuucuuucuucgagacaggguuucucuguauagcccuggcuguccuggaacucacucuguagaccaggcuauccuugaagucagaaauccuccugccucugccucccaagugcugggauuaaaggcaugcgccacuacugcccgcaggaauaaauagaacugcagaguggauggaggggugauuucaaucucaccgccugccuuuuuaccaucuuucaauuaaggcuaugcacgucuuuuugcuuacaaagaggcaugguuagaaaaagcagggucccuggcacccaggcaaagggcucacuuggacaagcccuugcuguguaagcaugagugccccugggcuugcuggcuggccaguguagccacagcaccgagcuccagcuucagcaagcuccugccuuagaaguaaggaggacagcagcugcagaggacagugccgaccuugggucacacacacacauacacacacaaaagcggaaaaaagggcuugggagcacacuauaaacacagcaagcagaucucugugaaacagacacaucacugaacagaagaaaugagaggaaguaugcucauaccuaaaaauccaacagaagaugaacgauaauguuaaaccagugacaaaauaugucugcuaagugaauuaaguuguccacugcaauaaagugaucaacuucauauuacacccuacccagaagucaccugguuuuuauuccuauuauuuaacaugaauuuacauuuuuuacagagagaacuuggaauuguauuaguuauauacuuaccaacaaaaggaaugaaagcccguuugaaaauuaggcaaucuaguaaaagcccuuaguaguuuucccacaguucucuuucaugaauaauuaacaccaucaacacaaaauugcaaaguuggugccaaaugguucuaaauuguggaaaugcaaaugcuggcuggggcugaaggaaauacugugugaggucaggccuggcgccaaccaacugccucccuagcauaccuaauggagguaugggaucauauccccaacacuauauugccaguaugguuagaugaccagcagaacucgguuagaugagcuaacuucuuuuaaccuugguuugagucuuuggauuuccuaucaguuaaggacagaagagcuuuaaccagcuccauccaagguuucuuuggcagagccucauaaaacuucaugcugccacaacuguguaggaaugaagaguaacaacgcacugccuaccagcuugcaguggucagcacagagcccaguucaagagcaagagcucagcuagugcuuucucagcauuaaaaggugguacaaagucagaugugacagugaaggucaaacucagcucuuugggagccugaagcaggauagcucuaagucucugccuacacuggcuauauagcaaaauuuuguuucauuaaaaaaaagcuaugggcuggugagauggcucaguggguuagagcacccgacugcucuuccgaagguccagaguucaaaucccagcaaccacaugguggcucacaaccauccguaacgagaucugacucccucuucuggagugucugaagacagcuacaauguacuuacauauaauaaauaaauaaaucuaaaaaaauaaaaaaaauaaaaaaagcuaugagaguggcaggccacaccuaacacugcugcaucucacuucagacagaagaccuuuuuuugguacuuaauaagggcuguggauuguucucaguacauuauucuauuuauuccuuccuucuuuccuucauccuaacagucuugggaagaagauauuguuaucuuacauaugaggaagcuaagacagagacucaaagcuggugggcgagagagcaggacugcccgugguccaagccaguguguagcaccgcucaggaaacgugccucuccuccaaagccuagcuucccaguagggcccuggaaagacccccccacccccauugacuacccagccucuuacucccuggaaggacuguauuucuccuacacggccugccuugcacaccaaugauucuguggcgcauauccagcuaacuaacagccaaacaagacucuucuuccaggcagcagauaccguucagccugucucccuuugcuucucuucaaugguacucuuuuuagccggaggcuuuacuucaugucccauucccucuuucacacgccugcuguuugggauccucuaucuagcccugaccaauuccaucuccgcuauacacagugaaacacacucauuauaagcuucucauggcuucuccaucuuucaggacaaagcuugaugucuuggcuguccuuaacagacagugaccuggcaggaguucuuuagucuuuugucccacccuccucuccuaaugacuguguaacacugaccccccugcguuucaagcucacuguuuucuguacuuuaggacuuucuaguacuucuuuuugccucccucccucccucuucuccccaacagcagucuuucagggcucagaccauauuccaaugguccugggcaggcacugcuuuccuuuucuauaguuuugaaacagcuuccacauuuaugccauuuguagugugcaccugauuucuacuuaguguaaaugaaguuuccugagacagggucucucucuauaguccuggcugucuuagaacucuguagacugggcuggccuugaacucaagucccaucucccucugccuccagagugcugggauuaaaggugggcaccaccauggacccccaaaucccuuucuaacccauucacccaacuuuauguuguguucucucucucuuuccucucaaaaaauaaauaagcugggaacgccuuuaaucccagcacucaggaggcagaggcaggcagaucucugugauuuugaggccagucuggucuacagagcuaguuccaggacagccagggcugugcagagaaaccuugucuggaggagggaagggagaauagccaucgauucccuuucuuaguuuauggacaugguuccccaagguuccacagcucucagaaaugaagcuguucuccacacccuggguuccugcacugugaagauggggcuggugucacacaaacagcuacucuuccugcaggauuugucauagcagucucuucacuucacuaggaccugacaucuguguguucacuuaccucucuuccgucaccuuuacacaugcaugucuuaccuguaaucucagcuguucucuuccucuuagcccccaaagcuccagauguugacauucaaccagauuuuacagguccagcccaaauaucccuucaaaaaggccuucuuuaagaacucagaagucuaucuuuauguuacaccauuuccauaccuuagcucacaugucuuagcuccucuuucagugaaagcacuuuugaggcgaaggcagaacugaauguacaaucuauugcccuaacaagcgagcugaugcuaagggucugagcaaaacccaguucaugcucaccaugcuuaccgucagaacagagggggcaaguaauacgcauaccaaauguauauaaagggagaugaacccagcgauuaccaacuucucauuaagucagaugacucauuacuucuguggacagcaaugcaggaagccuuggguuucaguggauacucacauagugcccuauggugcuggcauaggugucagcgauccaggacaucucccgcucacccgugcucaugucuggggcaggcacaucaaugccaggaccugggagcacagggaaagggcagugugcuaguuuuuaagauaaacuuaucccaaacauaaagaugcuugcaauucucuaagagaacaaugucacugucgcuagaaaacuuuauauuucauuuugguauaacaaacugaaguuauaaaaauauucauuaaaugucucuuuucuaugaaacuuguacacacaauguuaugucacuacuucuucuguuagaauuuacucagcuguaucuggaaguuacuacagacaauagauucaaguuacuccuuggccuucaggguaugaugccagcaaaaguuugaccucucagacuucaguguccugaacuguaaucagagauaauguaucauuugagcacuauaacaggaccauccuggucacugauagacaggcaggaagaguuagcucccuguuggcugaggucuucucacuaaguaggaagggaugaggaggugacacugcugaagcagguguggcacuuucccucauggagcacuucugacuauuagccagugcccgucaggugcagcauuuaguucuccagagcacagcaaacuacaaagcaaggcugagaauaacaauggcuccugaguaauaaugguaacuguguugcuucuaacaccgcuggguauggugaacuuacugggcaaugcgugcagugaagcucacuccacuguaaagggaaaacuacguagaaugcucucaaaaccgaaagauaaaagacaauuacuaacaaagaugcuaguaaguaagacuuggcauagcuacacaaagaaguacuaaauagccauuaaaaauauugauuuaaugacuuggaauuaucaucaaauucacuauguggaaaaaggcagguuucauauagucacauguucucacucuauagucacaaaacucuauacccuuuuuccucuccuuucuacucuuugcacauacaugucucugucccucuuucucucucuauauauauauuuacauacauguauacaguuagaguaagauagguaucaauaacuuguuuacuauguuccugcaauuuugcauuauaauuuucuauaaaccuuuaagucagguucauguuuuauggccccaguaagucugucucuccacacccuugucucuguauuuuaggcaucuuucacucucagaaugguuaaccuccacaacccugauuuccauauagaacccugaucugaaggaaaggcuuucuagccucauccacugaugaaagagucuacuugucugguuugcaaacuuucuauuucucaaagugauaugcuugggcuacagguuagcacaauuuugccaauuuacaauacauauuuauuuccuaagcuaaggacaaauugcuauaagaccuguuuagaaauaucuauggaguaacauuaccugcuucaaaacaauaaauaugaacugguaagucugagguaagcaguuugucaaucaaaaagacauaauaaaaaccacaaagacgugacuguuggcugauaagcuugcauuucacaaguucaacaagggaagcaaggggaaaucaaugaaaaauuagccugacaggcuaaggguaagacugaucuccuacuauguucccacaggaucaggcuaaggguaagacugaucuccuacuauguucccaaaggauguacagauuacaaguaaucucugcacuacagaauucuaacaggacaugcacauaagggagggguugaggucaggguaguucugguguauggagacaaaggaacaugagaaaccugcagggcaaaguuacaguugauagguaccacacacacacacauacauacauacacacacacauacucacucacauacacacaaacauuucuaggcuuuuccaagaaucugaagagggaguaguuuucaauuuguucugugaggcugguauuacuuuauugccaagucuggacacagaauaauuguaaagggaaaaagcaauaucuaaguuuaaguugauacuguaagaaacaauagccaugcuggccuacaaauguuaaaguucauuuauuuccuuuuguauagggacaacacacuguauuaaauaugcaacaucuugcccauauggguuugauuauagaaauuacuaaguaugcuaacaaaacucaaaaauaacccccuaauauaucauuaucccuuacaauagcaucaaaaggacucuguaguuguuucuaguauugagaaguaugaagaaaauaagcccuauaagcacaaagaugcccauguuuauggguuagaaggcuuaauuugguaaauaugcccccccccauggccucuauauucaacacaauuccuaucaaaaucugacuuuuccuccucuaucccacuccacccauaucugacccuaaacucccagggcuaacgguaagaauucagacucaagucugauggugaacccuguagaaagggaagugagaagacaagagauaagcuuucauuugccuucuacaagcaaaggggccaaauuacucagacuguccuucagaguuccagugagucacuuuuggaacuuucaagacuuacaacuacgcuggaaaaaacguaugaaaauauggcaauaaauaugacugcaugaaaucugaaaaacucaaggguaaaauauaacuaagauuuuaggcuaaaagcaaacaugcaauucaaauaaccacaaaggcaucaccaggcuggaaugugaauucaccaucuugaaaucagaaagcaccccuguaggcaagagugaggugcucauuaacuucugauggcagacugucucugggcaaugcggcacauguaaaauccauaguagugaucauaugaagcaugucaagaacccuaaggacuucagacaaaaucuuauaacagucgagcuuuuccuauacucacuccuguauucauucauuuauuuuauaccuuacuuccuaacaacagaacaaguuucaauaugcagcuuaauugcauaggagcuugucacuuguggagggaacacggagggaacucucaggcauaggaaagcagaguuaagaggaugcugugcccaaccccaucccagccagucucccuuuaacauucuacugaguaaccuuacuuauuuaaguuaaccagagccuguagaccaagaacuauuaagacaaaacuacuuagaaacugaagaguaaacaaguacacaucacaagaaauauuccuaucucacaaagaacuuauuaacacagauacuaggcaauaagaauaucaagcaggugaaguauccuuagaaauggagcacgcucacaaaagcuccucuaacugacccgagcacuccucagagauugaaggagaauggaguagcgaguugaugacaucagccucaccgccaccuccagugagguaaaggaacagcuaauacacauuaaaaccacuagcuucuaaaugacaucagauuucucacaucuuaaaaauacuguuauaaauccaguauuuaguagucacaucccuuuccaugcuucagaaaagggugugaacaaggcaggaaagaucucuccuuaguguccuuguuccacacugcagcgagaaccugaacuuguuaaaaacaagcuaagcugugucuaugagaucuauaauaaaaccugguuucuagaaggaaaaggacaacuauaccuaagguuuauaaaagcaggaguuucuucaagaucauuacuuaguagguguuucacucuauacagaaauacauagggcaauacauaccaauaaaacccuucuuggccagcuccauagugaaccuccguguaauuuuuucuaauucauuauccuacagagagaaacaaacaaacacacagagaaacacauuuuugauauaaagaucaaauggaaagaggauuuuuuguuuguuugcuuuuugagacaggguuucucuguauagcccuggcuguccuggaacucacucuguagaccaggcuagccuggaacucagaaauccgccugccucugccucccaagugcugggauuaaaggccugcgccacccccuucccucaccuccccggcuggaaagacacucccaguaccacuuguggagcaggcacuuuuaguuacuuuuuuuuuucuuuuuucuuagguauuuuccucauuuacauuuccaaugcuuucccaaaagucccccauacccuccccccaacuccccuacccacccacucccacuuuuuggcccuggcauuccccuguacuggggcauauaaaguuugcaaguccaaugggccucucuuuccagugauggccgacuaagccaucuuuugauacauauacagcuagagucaagagcuccgggguacugguuaguucauaauguuguuccaccuauaggguugcagaucccuuuagcuccuuggguacuuucucuagcuccuccauugggggcccugugauccauccaauagcugacugugagcauccacuucuguguuugcuaggcccugucuaguuacuuuuuugagccaugguuuuacuauguagcagacuaggcagaccuggaauucacuauguaucucagaaaaaugauuuuucuuccuuucuuuucuuuguuuguuuuuugagacagaguuucucuuucuaguccugacuguccuggaacucagagaucugccuaccucagcuuccuaaauccugggauuaaaggcauguaccaccacugccugguuaaaaaaaauaauaaaauaaaaaagauuucaaaaggccugcuuggacuacagagaauucaaggcaaccccgugaagcccugucucaguauaaaaaguaaagagaggguuggggagauacagcucaacgggagagcaucugccuagcaugugaggacuagagucuugguucagagaaggcaugacugagggagucuuacuggcuggccuugaacuugcuaucuagucuagacuggcuaugaacuuagagauccaccuacaccugccagacgugguguuuguaacuccaucacugggaauaccgaggcaaaagaauguggaaacaaauaaggcuauauagguauaggcuauaaagggaaacuuugucuaaaauguguaugugugugugcauaaugcagaacaugacagugcguccugcaaucccaguaccuaggagguaaaagaagccauccuagggugaguacacacacacacacacacacacacacacacacacacaaguaccaggucagccagggcuucaaaguaauaacauccucaauccccccucuuuucgguuucugucguucucucucauacacucacacaaaacaguuauaacuauauggauccugaggugguuucaauagggauggccccuauagacucauguguuugaaugcuuggcccauagggaauggcacuauuacggagguguggccuuguuggaggaagugugucacuguggaggcgggguuugaaguuuucuaugcucaagcugggccuaguguggcagucucuugcugacugugaaucaggauguagaccucagcuucuucugcagcaccaugucugccugcaugcugccaugcuuccugccauguugacaauggacuaaaccacugaaacuguuagcuagcccaauuaaaugucuuccuuuauaaaagcugcuggggucaaggugucucuucauagcaguaaaacccuagggcagacuccaugggucauccuauacuuucauuuaaauguaaaguuuuaacauggguguggcggcugugccuguaacccuaagucucaggaggacagcugagaaugaggucaaucuggguuaggucgugaaucccuaucucaaaaacaaaacaagaucacaugcaaaaagggagacagaguugggguuuaacacagaugcuuaauauaggcauaaggguuaagagagcagcaguuaaaaaagagaagacauauauauccaagugcgugggugugggcuucuugaaaggguuacagagauaaacaagacacccaaguaugggugacaguguguucaaggagucaucaaauggugaauuucagagaaugaaaccacacaacuaacuacuguagcaaccaguuuuaacuaacuuggaacuaacagaauaaacaugauuuuuacuagauaaguuguuuguugcuagaauaaaaccuugguauuaaaacuuaagaucaaaaucuuauucauguuuuaauuuuuaguuuuccaagacaggacuucucugguagcccuagcuauucuggaacuuacuauguagaucaagcuauccuugaacucagagaucugccugccucugccaccugagugcuuggauuaaaagugugugccaucaugcugggcacaaaacuuaagaucaaaacuuuuaaaaauuaaaaaauuuagauguaugucacggacucugguggagucagcuugugaggcagaaaugccaaaaagcugcucaugagaaaugaauuucuaggacucuccuccuggauauucuggcgaaagccaacucuccaguuuggaucgguuugucaggcgaaaagccuggaagcuguuuuacgaggauaagaguccagggaaauuuuccucccagaguuauggcaucucuuacccuaacccauuauauucaaauuuccaccacauuaaucuaguguauagauucacgugcacucuauuaagcaucaccuuauaguaaaugccuuuuaagauuguauucuaacauagcuaaagccuuuucccaguguucuuagauuccagauagcagcaaggagcuuaacccauuuaguaaacaauuaagcacuugccauuuuacucagcuguuuacagauagagacuaaaagucucacugagauagaaaucuuuuacuacaggcuacuuccaugucaaguauaaguugauauacuacccugauaaggggaaacucuccagacaagauaaguuuuauuagaccuaagaauuuagagcucugugauagcacauuacucuuaaggccugucaagaguuaacaacccccugaugcuuuuaaccuuaaagugugaaauucuugccuggcauuaggcugauccaaaggcagggcuuguuaucccuaauguaaacauuuaauuagucccuguaaauuccuuucugcuguaacuggugaauuucaguguaucuugucuuuuugugauuuguauccucugauaauucguuguaauauaagucugaagcucaaccagaacauuacauucagauucaacacaucuuucguguaucugucugucauuuucauccggaaucuuuguccaucugccuaagaaaucccguucuucacagaccagggacccagauugucuguggcagauguaaaugucuauuaacaugagaagcacagccaucaacagcaagcaaguguggcaagauacauuaggaaauuuacagcugagucaaccauuagcuguuuuccaauuccuccaggaaagcaauggcaccauuaaccucacuggcaugaggagcacaacuuuaggcccuacauggacagugccagcuggauacuuacuguauaguucuugggguugaucuuaacgccugcuuuagcaccuccaaacgguacaucugagagagaauagugaaagauauuguuccauaaaagcuuaaaaaacauaaaaacagaaaauauugccaauacagagagagcaaauaucaucaaguauguuucucaaguauuucaucuucuuccuuaccuauacacaauuaguuaucuggaggauggaguccaacccuagacaagaauuuuaugucuccuauguacauaauguacugguaaugauguaggacauuuuacuguugccuacauuuuguuuuugguguuuuuugagacaggguuucucuguguaucccuggcuguccuggaacucacucuguagaccaggcuggccucgaccacagacugacuugcuucugucugcagagugcugggauugaaggcaugcgccgccaccaccaccaccacgcagccugauaccuacgauuugacaauagcucaccucauaaguucagguauggaguuuucuacuuggagcacuauuuuggugcucauauaguuucagauucugaauuauuucaagacaggguuucuuuguguaguccuggcuguucuggaacucacagauccaccuaccuauaccugaguacugggauuaaaggcgugagccaccaccacccagcuacaugacugcuuuaauucuagaaaauucccaaacuaaagccagugcugaagccguagcuuaguugguggagugccugccuaggaugaaaaaugcccuggauuuaauucucagcaucacaagaaaacacagauguuaaacuugaaaugaaaucuuacugaacagguaucauauauaaugccagccagguguuaacuguauuuaaucaguauucuauuacuucuaagagaauauuguauuugcuuuccuuccacuaugauuuauuuagaccauggaugagcauuuaaaacaaggguguaugcuucaagaaaauucaguuagcuucuauaaaaauuucacuguuuuaaguuuggaaaugaugacaaaguucuuauuucuuuaauuaccauguucuccuuggugauauauauucuauuaccuauguguuacaaucuauacugacauacaacuauaaugcaaacacacaaauaaggagggaaaccagucuuuacuucccauagcccuuagagagauccuaagcaacaaaaugcauguguuguaauucagaaauggagaagacuaugaaagaaaguaaaaaaaucaggucagguuuggugauagacaccuuuaaucccagcauuugggaggcagaggcaggaagaucucugaguccaaugccagacugaucauagaguuucaagccagccagggauauauaugugugugugugugugugugugugcguaugauacuaucaacaaacaaacaaacaaaguucuuucaaaaaacaaaacaguucuguuaaauguuguuguuguugguuuuuuuuuuuuuuuuuuuuugagacaggguuucucuguguagugcuggcuaucuggaacucacucuguagaccaggcuggccuugaccucagaaauccgccugccucugccucccaagugcugggauuaaaggcaugcacuaccacugcccggccuguuaaauauuuuuauagcauacuaaaaguaaccauugggccaaugaauuggcucagcagguaaacagucuuagaagcuugacaaccuaaguuugauuaagaaccaccucuacaguguugccucugacuuccacacacaucauuauaaacaagguaauaaggagaauuuuaaaaaguagccgugcauagccacauuuccccaaagagucgucaggcaucagcagagagggccacucaccgaccacagcgcacuuguaugucauuaaggaagccagugcuuuuacuucauccacacucacgucagugcuguaacggauaccugggagauucauuuagaaaaggagggaagacagaauuacauccacaacuucugcuaaguuaacaaaauagcuauaaauugaaaacgccaugccucuuauauuuuacagacaagcuauuccuauauacacugaaauaccuuuuuucuuuuuaaaguuuaugagacaggguuucucuguguaguccuggcuguccuaggacuugcucuguacaccagguuggccuugaacccugugcugagcuagguauuuuauguauaaggacaccauaaaagguaaaaggagguggggcuggagagaugacucgggugguuaggaacacugacucuucuuccagagguccugaguucaauuccuagcaaccacaugguggcucggaaccaucuguaccgugaucagaugccuucuucuggugugucugaauaaagcuuauauauauauauguaugcacacacacacacacacauacauauauacacacacauauauauguaauauauaaauaauucuuuuuuaaaaaaggguaaaaaggaaaagcugcuaauuagacacccaaaauuaguuacagaauggggaccgaauuaauuaauuuauucugauagccaagaguggccaugaagauuaguuuuugcuuagaaagauuucuuagagggcuggagagauggcucagugguuaaaagcacugacugcuuuuccagaggaccugaguucaauucccagcaaccacaugguggcucacaaccaccuguaauggaauccaacaccuucuucuggugugucugaagacagcaacauuguauucauauacauaaaauaaacaaaucuuuuuuuuaaaaaaaaagaacuguuagauauuuaaggacaacuaguacucaaaaggcucucauccugacacccagcauugcaaaaacaaacaaaugcaugccagugagaugccuuagcaggugacaauauuugccacuaagcguaauuacuugccuucaauuccugggacauaucugguaguagauaacugauacacaugugcugugguacccaacauacagacaaaucaaucaauaccaaauaaaaaacuuauuaauguucucuuacuggaaagauaacagcuagaaauguagaguauaacaauacaaguuuccacugaggagcuacaaacucaacguuaaaaaauauuaguggggggcuggagagauggcucagugguuaagaauacugacugcucuuccaaagguccugaguucaauuccuggcaagcaaccaucuguaaugguaucugaugcucucuucuggugugcuugaagauaucaacaaugcauucacacacauaaaauaaauaacuaaaucuuaaaaaaaauauuagugguggcaugcaccuuuaaucccaguacucaggaagaagaggcaggaggaucuuugaguucaagggcagccuggucuacagagugacuucuaggacagccagggcuaugcagugaaacugucuugaaaaacaacaaagcaaaccaaaaccaaaacacauguuuccaauagauuaacuuuuuuguuuguggaaaaaaauuucccuagcuacacccauguggaaauauuagucacaccacaggcauuuuucugcagacuaugaacuaaugaaaaacuucuacuggagugagcuaggggaggggcugucagagcagaaucagaccuggagcagacaagaggguaagaagagagcagaagguaaugagguugugugaccugggugagaagguuuucuuugcaaacuuucuaaggaaucaauaguacacaggugcucuaacuacuggacuacugggcccaacagugauaacacaacaucucaagguaaaccccaggaagaaaacucccacguacacgccccaaccucacauaauagguaaauguaaggggccggagagguggcucaguguuuaagagcacugacugcucuccagaagguccugaguucaaaucccucccagcaaccacaugguagcucacaacaaucuguaaugagaucugacgcucucuucuggcgcaucuacagcuacaguguacuuauauauaauaauaaauaaaucuuaaaaugaaguaaauguaaaauaaauuaagucucacaaaaaugaaaacaaagucaaaacaaaccaaaucuucuaccucuucaaaacuagcuggaauugccauggugauagagaaaaacaaaccagcagcucauuacuuagaaaaaaagacuaagugaaagccacaaccgacagcuugacauuuuccuguuucuaguugaaucaaaaccaaacauacauucacguaaacuccuuagcuaccauccuuuucuaugaugaauuaguaacucaacauuuuuggaaacuuaaauguuuuuaaaaauuacuugaacugggaucuccuuaaugaggcauggcuuacucacccagaauucaaaucccaguggcguucuaaacuaucuacuuaauaaacaggaguccuaggcugugacuguagcucagggguagagggcucguguaaggcucugggccucaucccuagcaaagaaagcaaaagaaaaggagggaggaagaaaaccaauuaacuuacucuauggugccaaggaacuccugucugagaauucaggaaacauagguuuuaagaacuacuaacaugccaggcggcgguggcgcacgccuuuaaucccagcacuugggaggcagaggcagguggauuucugaggccagccuggucuacagagugaguucuaggacagccagggcuacacagagaaaccuugucucgaaaaaacaaaacaaaacaaaacaaaagaacugcuaacccacuuggaagagaaaaacuuaagcuucuugggaaacaaaguuuagcuucuugauuaaaauuuuaaauuaggucuuacaaaugacuuuuuaaacaaauuacaacuuggggcuggugagauggcucagugguuaagagcgccgacugcucuuccgaaggucccgaguucaaauccuagcaaccacaugguggcucacaaucaucuguaaugagaucugauguccucuucuggggugucugaauaaagcuacaguguacuuacauauaauaaauaaaucuuuaaaaaaaaaaaguugggugaccuagguauggcauggcuguguaagacuguaauucuagcacacaggcaacggagggcagucugggcuacauaguuaaaaaaaaaaaagguaccccugauauccacaugaaguugggcaacauuuaacaagacaaaaaggcaacaguaacuauccuaacuuguuaugaaaagggucaaaggacugaagcuaucuaguuucaaugggucuucggagaauaagagcagaauuaccauagaggaaagggagggacugucuaggaaagcaacaaucaagaggggacugugugcagaggaccaccugaaccuaguucucuccuacugggugggucccagggauggaaaucaggucauuuacaugaucaaccugaugaauuacugacaccccuauucucuuugcuguccuaaaacaucuccugaaugaucuaaagcauucacaauaauacauuaaauacuaugcaucuuuuguacacauauacauaucuguauaaacuauuauuuuucaaauaaacaaagcacugugugcugagaacugaagcuggguccucugaaagaacaggugcccuuaaugguggagacaucuccugagccuuuauuuuauucuuauucuuuaauuuuauaccacuucccagaacguugcaucaguuaagaucauuaaugaccuacuccuggaauuuccuauuuagacugcuguugaacggcuuucagauggggucuauaguccuuaguaguguuauuuuuuuccauucccuuagacugaaaacuuuaucucugauccuucccaucuucaucccauaucucugaagaauaccauuguuucaaaauacuuuaguuugccucuuuuccuuuccauuccuuuuuuaaagauuuauuuauuauuauauuuaaguacacuguagcuguccucagacacaccagaggagggcaucagaucucauuauggaugguugugagccaccaugugauugcugggauuugaacucacgaccuucggaagagcagucagugcucuuagccacugaaccaucucuccagcccuuccuuuccauuccuauuaccuucauucuuaguucugauguuauuuucuguaauccauuagguuuaucauuacguauucaacaacgcuaaaacaggaaaacucucuguccaucaccuuuuuuaguucucugcccacagagagggcauucccucacuuaauucccaucuaacacuaaccaucgaaagcuucaucucacagguuaaauaaaagcucaacaaucucacaagaucaaccuuuuucagaaauuaguuacaaggacugggucugacucggauauaaacuggugguuucuacagucccuccucugguucaguaauaugcuaucaugccuuauagaacuuaaauaccuuacauauaacuaaggauucaacuagggaaguuucuuuccccaaggaggggcauaccaucccccaggcacaaagaugagcuuaccaugcagcuagcuuucugaaccucucauuaucauuucaucuuuugucuuuuugaggacccaggaucacuguguaguccuggcuggccugaaaaucucuaaagacuagcagaacauuaaacuaagaguucuuucuccuucuguucuuaacaucugcaacauuaguggauaaaaucugauuuucucagaauuuaaaugauuacagugguaaauucaauuucuucuggucuuaagccaaaaaucucaccuguucaguucuuucaugggccuauuaaucauuacccacuuuucugaaguuaugugcacuggugcuuaguuuccgauuaugacuugcagauucuacacggugugcugagacacccauaacuacuaguuaagugucaaugcuuacagaaugggagaagggaaauauguaguauacacuguggcagguuucagagcucuucauuuguuugcacauaaggacuggggacacauggcuuuuacgaaaugacaugucuguauaaagacaaacaauucugcauuuaacuaaaauguauuacaaacacuacuucacagcugagugcuaaaggaucuaugaauuauauggcuuauaaaacaaguuaacuuuuguauugcauuucguagcagcaaaacacaguuacacaagauacucaucuaaugauuugaggaaguucuaacacaggagaaagaaccacuaacgggaaaacuuuaacuaaauaugagaugaagacacugaggggcaagauagaaaacaaagaaaguggcuccuauagucaguugaucgcuaaacccuuuuuuuuuuuuuuuuuugguuuucgagacaggguuucucuguguagcccuggcuguccucaaacucagaaauccgccugccucugccucccgagugcugggacuaaaggcaugcgccaccacgcccagcucccuucugaaccuuuuuaacuuuucaccguaugugucugaaugcuuugccuguaugaauauacauccgugcacgaugccugaggagggcagagcaggcacagcuccacuggcccuggaguucuggauggcucugcaucaccacugggugcuaggaaucaaauccacaagagcagccuaugcccuaaccacagugcucucuccagccccucccuacacugaauucuaagaacuuuacacuaaaacugguagcagaacaaucuguugagaaaguuguucucuucagaacagaugcuucaggagagacacauacaaauggagaggugagggaaggcacccaccacaaacacagauuuacccuagcaaacaacuggaugacagaugauguacccagaauaucauguccaccgggaacaaucucugcuguguuugaaaacaugucagaaccuuugaacaaaucuugucaaaucaauuguuuauuacaguauccaucuuugcuacaaaaauagauuuuuuguuuuuuguuuuuuuuugagacaggaucuuaucuauguaguccaggcuggcacugaauuucagauuuuccuguguuacagaaaaucagguacgcauauggccauaccgggcuacugacagaauccaggcuuugaguuccagcucuuaucuaagucucugguccucuguaaauccuuaccagaggcaaaucuaguagccucaguuaaauaugacuuaggaaaaaaaaaaucacaaaaccaaguuuuauuaaauauuuacuugaaauaaaguacucaccagcacuuccagguggucuuuacuuuaaacuaucucuuuucacuauagauuagacuauuguauugauucaguacaggauuuauuccuguuuuuugagauagggucuaacugaguggcucagcucucagagcuaggauugcagcaagucaccagaccugguucagccucgagggcuuuauuuuaggaaacucagguguaaggucgcuguggaggaaagguuagauagagagggcucaaggcugggaaagggaugucaaggaacagaugaggucucucguaauaaacacugggagagccgaugaggcaggaggaucaagaacaaaauucccaaaacacuaugagaagacaauucacuuaggcaugggacagggggcgaagaggcagugugauguuaaauaaauguaaugguuuacuuuguagaacguuacuuuaucuugcuguaucaucaugcaaugcuguuacuguuaacuaacuacaaacggguuucucuauuucugcucuguucacuccacuuugagcaagugcuuugguuacugugaucugguaaggcugaugauauuuguugcuaggcucaauauuuugcuauuaaaacuucugugacaagagcacuuaaaauaauaaaacuacggcaaacucaaauugcuuuaaugacuaacaagacagaaaaaacccaccaaaucacaggaugcacacccucuguaaagacaaggacaguuuagcauuugcaauacaaugccucuggcucgacagacauccuuguuuguucuggagggggguagaauuugaguucccggcuugugggggaaggagggagggagggagggagggagggagggagggagggagggagggaaggaagaaagaggaaggugagguguaggagaaugacuaccccuuuuauauaauuuugagcugcaugggaaaucagaggucaaagugguuccaauggcuucuagcagagggaacuacagggcuaagggacaauuaggcuccaaagggagauccuagacuuggguagacucaaugcgaauuugguaaaucauuaaaccuuuugccacaaccuuuguuccaccacugggaacaccaucacagccccaguuuuuccagugcagaaacauuucuauaguuuuuagucagcugguaguaaaaagacuacuggacagaaccgaggcagacaaaggucuaguccugcaauucucaaccugugggucccccguaaccccugaagggguugcauaucaaauauccugccuauuagauauuuacauaacuacuccuaacaguagcaaaauuacaguuaugaaguugcaaugaaaugaaucacuguucuagucuaaccucugcucacuugccaauucaaccuccaucaagacuccuacucaauacauuaaguuuaagcaacagaaaaaaggugguuuuucuuuuaauagucuuuuuuuuuuuuaaagcaccuuuaacgcuguaugauuguguacuguaguggagagaaaaugaaaaacguauuuuucuucccuaaaaaaaggcuguaagccaaucuacacacaucccaaaaguuuaaaccacaggauacccugguaacuaccaaaucuaacugauucaacucccuaaggacucuaccuuuugccuaggcucaauucugguacuagccaggacaagaacacacccccagggcuauuucauucuauuggcuggcaggcaguucuguagucuacacccuuuagauuuaaugucaggucgcccuguuugucagagaccuuacucugcucgauauuuuacauuuuccaaggggagaaaagaggcacaacacaaaaagccaucaguguaaaauuauaauaauuuagaagauuaguaagcugcgcugguuaaucaaacuuucaagauuccaacuccaaaaagaagauaauuuuucucuguucuuguaucgucggcugcuggcguuaaggguucacggucuaugacaugacaggcaccgaggcuaaagaaaagcuguacaguguccucagugaagucagcaucaacacaagcagaggcuuggggugaagacuugcccaguaaaaaggcuggcauauuacgugguaguuuuagggcggaaaaaaaaaaucaguauccucuaaggcugccacacccgaggcgggggagcccgaagcggggcacggccugcagaacugggcugggccgaguagcggcccgggcuacgggagucuggaggggagggaggacagaaaggggccggagggcgcucaccucccuugcagggcgugcggugcuggcugugcugggcccgguagccuucgaugaccucccaggagccgucgucgcgccggauggggaaggagaggcucaacacaugguugcagggcuugaugauccucaggaugccgcgcacccgguuccgcuucugcuccucgcucucccgggucuucaggucuuccaccagcuuguccucuacgaugcuggcgccgcggucgaagaagcccuccaccaucuugaagaaguuggggucgucuucgcggucggcggccgcuucgcuguaguggcgccgggcgaccggcgugagcccggguugcggggcggcggagggcuguccgcgggcccagcccagcagcgcggcugagucugcagccgcagagcccagggcagcgggcccggcgcgggacagcagcagcgcuucgcccagacggcgguacauggcggcggcggcgggcugaggcgagugcggcgggagcuguaaagaccggagcucgcaggccuggaccgcggggaggaagggcugggcgcgagcugcccuuuuaagccgcggcuuccugcuugucuggcuguccccuccccugcgccgcuugucgccccaccgggaggacgga

SEQ ID NO: 7368 - RNA, 3555 nt, Mus musculus
gugguaggcauauauaaaaagcacgcucuuccagucugaggagcaagcuuuaccugucacugucugcugccauacgaugcugggaggccuggggaagcuggcggccgagggccuggcccaccgcacagagaaagccacugagggagcagguaagggccugggcuuucuaucugcccagaaguuggcagcagacuccucccucugggucuguugagagcugauuccagcaggcaggcaaggguguuuggguaggcuaagggccaucaggaaacuugaccugcuggccccaccaggagauagcaaagucagaggcacagaggcugggguaguugcucagaaaagagucacagccuucccacuagggauuugcuucaugacccaggcugaacuugcuuggaggucaggaggaggccaaccccagggguggggggugggggugggauccaggaggccagcaggaaccgguggcuuggguccuucuuucuggaagccuagagugccuuuuaugucaguauugcuuauuucagggccugagguuguagcucggugguggaacauuugucuaugcaagguccuggauuuuugcaagaacccuaaagcaaaacgaaacaaaacuccugccuaguuugaucaguuuaugcaaaaaucuaggaggguggauuuucauuuucaccaugcuuuaaagcuucaaagguucuuuuauuaugaaaccauggaggcugauccugcucaaagucuaaaaggacguuuccauuucuuccaagaaccuagaacaggguucugccggccaaggccuccugguacauggucguaugacuccuacuucaggacacagauaaacaccugagucaaguuggcagucucuuuggacauggcugcagcagacacaucagcacuuacuucauucuuagcccagcagcuggaucugacccucuucuucuucuguuuuuuuuuuuuuuaagauuauuuauuuuauguauaugagugcacuguagcugucuucaggcacaucagaagacggcaucagaucccauuacagaugguugugagccaccaugugguugcagggaauugaacucgggacuucuggaaagagcagccagugcucuuaacugcugagccauuucuccagccccugacacuucuuauuccuucagccuucuuaguugugagggacacagcagaggaaggugguauuagaagcaguucuggaucugaaauuuggguucaagcucccacaaaaccucccagaaccuggagguaauuagggguauccucuuccaggaagggcugccuugaggagcuuagcuucucugaggguguccagguguggcugaagcaggacagccagcucuuccuagcuaacaaacuagcuagcuagcuaacuaauugaccaucaaaccuacuuuggcucaggccuccaguuggcagaggcuggcuguucuagguauccaugccuuuccuggcugaggggaggggcauggagggcuuuguacaucuccagcagccaggggucuugaggggcuaugaagagaggcagcuagggguucuuuuaaguugucugucaugacuggggguagcaugccagagucuuauugucuagaggcacccaggccaucaugagggaagcgggcuuacauauaccuucacucugaauuuguccucucuuuccaguucacgcaguggaagagguggugagcgagguggugggccacgccaaggagguuggagagaaggguaaggcugagguugcuuggagaugggagaugggagcauguaagaaggagagaagcggggaaggaaaggacagagggcugcauguaggucuacaguagaguacuuaccuaagugguugaguccccagaaugggaacagaaguagggagggagagaaugaaguaggcaggcagggagccagggagggagggaggaagcccuugugcuagccuuaauccuuuucuugcucaacuagaccuagcccugccccagauguagcacccucucagcugggaugcaauuaucuguacauucuccccauaugcaauuaucuguaggcuguaccuuguguuagggcuccauccaggcuguuuucucugccgaauguuaagaagacaauaccgcaaaaaagugucauggcaaucauguauuuaaauauguauuuacuuaaaacuuuacucuguacguguuacgccaugaauagaacaguguaccuaaauguuaccuccauucucuacaaccagcggaguccagcuggacgaagggcuuacacuuaaauauaugaauauauuaaacaguuaggcuguaauucuuuaagcuaaacagcuagaaugaaaugucaggaauucaucggcucauaaacagcagaacucgcuguuucuguagccaguggaggagcuugccuaggcucccagaaccugggagaaugaggcaggaagauugugagcuugaggcuagcuuggguuacauagcaagcauuaguccagccugaacuauagagcgagacccucacucaagaccaaagaggcaaaauaaggaaaagaaagaacuguguugcucugggcccugaagucuggaacccccaguggcagcagaggagcgccuggugaaguugccuccuggcucaugcaugguaccuuucugucauguccucauguggcagaacuagcuugcucucccggguggugccccucuugcucacgaggcuccgccugcccaucccacuaagcuaaccagagccacgccucccaccucuucaugggaagaucaugaggaggauuacaacauggacuuuugggaacagugucauagagauguuaauacaaucuuagagaggggaaacucuuuuucaccgagauuaaaaaaacaaaaaacaaaacaaaccccaaaacaucccaguagucauaaagaaaauauuagauaaguuugucaauaugaaacuuuauuacuuuacauaggaggggugggggcgggggaaugcaagaagcagagcaaaccggaaguuaggucaaaagaaaggcuacagacugugagaaaauaacagaaacaauaaucuaauguagccaucaacauaaaaauagucaaaggauacaaaccuguaguuuccagaggugugaguagccaguauacccaugagcuguuagugaugccucauucaaauauuaagagacgguuugaaagcuggcggguggggguggggguggggguggggguuagaaugauggaagcacuuuguccuuuguguguggggggaggugcuguugcaggguugaccccauaagauggccucaccucacaggcagggcucuccugcuggaagcccacaauuuucuuucuuuuuuauucuguucuucuccaauagccauuaaugacgcccuaaagaaagcccaagaaucaggagacaggguggugaaggaggucacugagaaggucacccacaccaucacugaugcuguuacccaugcggcagaaggccugggaagacugggacagugagccugccuaccagcauggcuggcccuuccugaaggucaauaaagagugugaaacgugaacagag

SEQ ID NO: 7369 - RNA, 4518 nt, Mus musculus
gugggaguggggcucagguuuuauuuggaaucauuaaaaaaaaagaaaucacagcagcaucugauuggugaucagaggaccauaggguaaaaggagccagcagggggugcuggcgcuggcaguagcguguguggacuuguggcacugggcuagggacagagaacuugggcaaccugcagggcacucuaggcagggcauucagugugccagguugagacaggguccaaggcagaggggugucccuugagccucugugguuggcuggcagccuucuagucuucuccacucuuggccuggcagagaagagagggcaggaagaagagggggagggcaggagggagggaggaagggaaggaaggagggagggaaagagacuugcacccauuuccaggcccacaauucuccuugaccaccuggaaauggucacucauggagcggucaggcacucgggucccugacugcccuacccacggcacugugggaagcuguggaaggucucccaggaccaagaaaugaaagcagggccucucuggcucaggucucuauggcagaacuuucuggugcacccugggaaccccucuuaccucuucauucuccucuugcucuuuggcuucuugguccugugcaggggguuccaaguccuccuacaggggagcaaaggagacacaaggcuaugggaagagacacgggcccucaguugccauagcagggucuccccugucaggucucacagaugaacagaggccuuccaucauguuucugugcuuagagggucuggaggugccagauacccuccaagccaggcaucaucuccugcaagcacaucccaagucaugggcaccuggccccuacagacuuaggcuccuuaagcgaggaagccuggagugugugcaguaaggagagacccuugagucacacaaaccccucccucaggcuguaugagcaucgaaugccaucacuguucacagagauccugaggauaggggucagggccuagauacuauugcauggcuucagaguucaaaguaucagggcuucaggucccucucagguacucaggagugugggucacucuuccggccuuccggauggacucuuggcucaggccugucuuccaucuccacagcauuuccuucacggucaugacggcaguggguuuggaacuagacugauggucagucuagagucuguucucagaacguaucuguguuaacuugggguuaggguaugaugucacaacuaguucaugggucaacagaaaauggcaaagccccaagggcucaguagcaucuucuagguuagcaaggguagccugaacuugcucccaggauccuucuugccaguggcuugggaguaagcuuccugggaugacugcugugcugggaacagugguaaugaugaugacaggugcugucuuaauuaggguuuuacugcugugaacagacaccaugaccaaggcacuucuuauaaggacagcauuuaauuggggcuggcuuaaugguucaaagguucaauccauuagcaucaaggugggagcauggcagcauccaggcaggcauggagcaggaggaacugagaguucuacgucuucauuugaaggccacgcuaggagaaggcuuccaggcagcuagggcaaaggucuuaaagcccaggccuacaaggccacacccacuccaacaaggccacacccacuccaacaaggccacacccccuaauagugcagcuccuugggccaagcauaaacagaccaucacaggcacuaaccaugugccuggcagaauugcauccuaguaucacuucucugccuccucccaaagcccuaagguguagcauuucagaugaggaaauggguauaauccagagaggaucuucucaaagucacacagccugcagaggugcaccuacacacuccagugacaggagacccugugcuggcccuggaagcagguguuuggggugagugaccccuccccuuucuccugcuccuuacaguagucuucuguggcauuggcugugugggaagccuagggcugcaccauugggguugccugcuguaguguguguggcugaccauaacaggucuuuggaauuagcuuccuucccaaccuccauucuggaauccccauucaugcacaguccauacucagucuuucaaggguguagcucagaaacuggccacucacggaaccuacgugcuggcagagaccagccaugugaccguggugcaucauaucaccuaaucucucuaggcccuuccuuccauaucugguuugguggaauuuggggccccauuaaauagguuaguaaguguaaaagacuuaaagcagagcuuacucuuuggcaagugcggagacagcuccuacuucuggcaucuauccccagagagccugaugccccuguuuuauccacugccugccacaugcguacauacacaugcgcauccauucacacaugcauuccacgcauaugcguucacacacaucucuacccuaccaauaaugcacauacaacccacauguucacacaaagaccucagcagaggguggagucggagcccugccacuugcccaccacaagugggcaguguugccauuacugcuuccuugggagguggaagcuagacccugggaugagggaggguuggauaaaagauaaaagguagcucuggugguggcuuucagcuuuagccugucaccauacacugcccuugugauauguauuuccugcaugccaaggggauggggcuggccauggucugcaugucgcuuuccuugugcauaaaaugaaucccaaguccccacucuuggagugugauggggauuccugauaugaacagguacagagauaccaagucgccccagcacacaguggguacugucuguaaaguuaagcagugucuagugcuauuuacccguguguucacgagggcagaauugccuccuauugcuggggagccuagaaaaaggacaugaaccaggcuuaccuugcgcaccaccccgguggugaccacgauguuuucagccuccuccacggucuuguuggccacuguguugacgcugcugaccacagcuucacucacggcauuggccugcuccuuggucuucucagccacugcagaggauucugguuggacucagcccuggcccccuccacugcugccuacccaagcugaggagagcaaccccuucccagagcccagaugccugaugccugacuucuaguuacuucgaucccuuugucugacucuagggcagaacaaugugauggucuaucuucagggcauguagugguuugggucaccaagggcuuagggcuccaguugguacaaagaggacuucagguauggacccuggauauagggcaggauuugugggguccccaguucugggucaucuuaccugaggugacacuuuguaccacguucuccuugguuuuggugccuauuggaggaagagguguacaagcggucagggcaaacagcuggacacaaugugggggccaggaggggaugaggauggcgucuggggacaguagccccuucaaaaggccauuuccugcugugucugaaggacagaggacagacgggaaggagacaggacaggaagaggggacaaaauagaccaggccugagguacuguuacugguagggcuauggcccuugcaugggcguggccccggccucagaagcagcagcugaacagggcagagaaagcugagucacaggauuagccaccccuguccccucuuuagaaagagcccagaaugcuggggguggguugaacacuaaaugggacccauuuucacagacuacccuuccccucuaagccaggaguggccuggcucagaugcagcaacucccauuggagaaagcgggguccaccugagcagaucauuaccucagggucuccagguuaggagacuccaggcaugugugugcaugcuuuugagugcccacacguagguguggcacuccgguccugucccacucagagucccuucccccagaguaucaaagacaauuagauacuaccauauucuccagggugugcgacccugccucaacaaucagaauuucaucucaaaacgcuuucuagaagcugggggaaucugcagagggaggcaucugcccuccauuagggaccccuccacccugccccgccccgccccgccccaccuaccacacucacccacauacauaacccccuccuuggucuucucagcugccuccguuacucccugcuuggucuuuucuacagcacccacaacaccuuccuuggcaauggagaagccuuucuugaagacguccaugguguuugcaaggauggaaccuggcugcugcaagcuauggacuggagugcugccgcagccgcugucucugcugcuacugccucuuauugacgcagaugaaauauugaugcuguggcugcuggcuggagcccagccagcccgggccagggugggggcagggagggcgggccagagagaaggcaugccucacggggauaccagcgagcaggg

SEQ ID NO: 7370 - RNA, 4518 nt, Mus musculus
cccugcucgcugguauccccgugaggcaugccuucucucuggcccgcccucccugcccccacccuggcccgggcuggcugggcuccagccagcagccacagcaucaauauuucaucugcgucaauaagaggcaguagcagcagagacagcggcugcggcagcacuccaguccauagcuugcagcagccagguuccauccuugcaaacaccauggacgucuucaagaaaggcuucuccauugccaaggaagguguugugggugcuguagaaaagaccaagcagggaguaacggaggcagcugagaagaccaaggaggggguuauguaugugggugagugugguagguggggcggggcggggcggggcaggguggaggggucccuaauggagggcagaugccucccucugcagauucccccagcuucuagaaagcguuuugagaugaaauucugauuguugaggcagggucgcacacccuggagaauaugguaguaucuaauugucuuugauacucugggggaagggacucugagugggacaggaccggagugccacaccuacgugugggcacucaaaagcaugcacacacaugccuggagucuccuaaccuggagacccugagguaaugaucugcucagguggaccccgcuuucuccaaugggaguugcugcaucugagccaggccacuccuggcuuagaggggaaggguagucugugaaaaugggucccauuuaguguucaacccacccccagcauucugggcucuuucuaaagaggggacagggguggcuaauccugugacucagcuuucucugcccuguucagcugcugcuucugaggccggggccacgcccaugcaagggccauagcccuaccaguaacaguaccucaggccuggucuauuuuguccccucuuccuguccugucuccuucccgucuguccucuguccuucagacacagcaggaaauggccuuuugaaggggcuacuguccccagacgccauccucauccccuccuggcccccacauuguguccagcuguuugcccugaccgcuuguacaccucuuccuccaauaggcaccaaaaccaaggagaacgugguacaaagugucaccucagguaagaugacccagaacuggggaccccacaaauccugcccuauauccaggguccauaccugaaguccucuuuguaccaacuggagcccuaagcccuuggugacccaaaccacuacaugcccugaagauagaccaucacauuguucugcccuagagucagacaaagggaucgaaguaacuagaagucaggcaucaggcaucugggcucugggaagggguugcucuccucagcuuggguaggcagcaguggagggggccagggcugaguccaaccagaauccucugcaguggcugagaagaccaaggagcaggccaaugccgugagugaagcuguggucagcagcgucaacacaguggccaacaagaccguggaggaggcugaaaacaucguggucaccaccgggguggugcgcaagguaagccugguucauguccuuuuucuaggcuccccagcaauaggaggcaauucugcccucgugaacacacggguaaauagcacuagacacugcuuaacuuuacagacaguacccacugugugcuggggcgacuugguaucucuguaccuguucauaucaggaauccccaucacacuccaagaguggggacuugggauucauuuuaugcacaaggaaagcgacaugcagaccauggccagccccauccccuuggcaugcaggaaauacauaucacaagggcaguguauggugacaggcuaaagcugaaagccaccaccagagcuaccuuuuaucuuuuauccaacccucccucaucccagggucuagcuuccaccucccaaggaagcaguaauggcaacacugcccacuuguggugggcaaguggcagggcuccgacuccacccucugcugaggucuuugugugaacauguggguuguaugugcauuauugguaggguagagaugugugugaacgcauaugcguggaaugcaugugugaauggaugcgcauguguauguacgcauguggcaggcaguggauaaaacaggggcaucaggcucucuggggauagaugccagaaguaggagcugucuccgcacuugccaaagaguaagcucugcuuuaagucuuuuacacuuacuaaccuauuuaauggggccccaaauuccaccaaaccagauauggaaggaagggccuagagagauuaggugauaugaugcaccacggucacauggcuggucucugccagcacguagguuccgugaguggccaguuucugagcuacacccuugaaagacugaguauggacugugcaugaauggggauuccagaauggagguugggaaggaagcuaauuccaaagaccuguuauggucagccacacacacuacagcaggcaaccccaauggugcagcccuaggcuucccacacagccaaugccacagaagacuacuguaaggagcaggagaaaggggaggggucacucaccccaaacaccugcuuccagggccagcacagggucuccugucacuggaguguguaggugcaccucugcaggcugugugacuuugagaagauccucucuggauuauacccauuuccucaucugaaaugcuacaccuuagggcuuugggaggaggcagagaagugauacuaggaugcaauucugccaggcacaugguuagugccugugauggucuguuuaugcuuggcccaaggagcugcacuauuaggggguguggccuuguuggaguggguguggccuuguuggaguggguguggccuuguaggccugggcuuuaagaccuuugcccuagcugccuggaagccuucuccuagcguggccuucaaaugaagacguagaacucucaguuccuccugcuccaugccugccuggaugcugccaugcucccaccuugaugcuaauggauugaaccuuugaaccauuaagccagccccaauuaaaugcuguccuuauaagaagugccuuggucauggugucuguucacagcaguaaaacccuaauuaagacagcaccugucaucaucauuaccacuguucccagcacagcagucaucccaggaagcuuacucccaagccacuggcaagaaggauccugggagcaaguucaggcuacccuugcuaaccuagaagaugcuacugagcccuuggggcuuugccauuuucuguugacccaugaacuaguugugacaucauacccuaaccccaaguuaacacagauacguucugagaacagacucuagacugaccaucagucuaguuccaaacccacugccgucaugaccgugaaggaaaugcuguggagauggaagacaggccugagccaagaguccauccggaaggccggaagagugacccacacuccugaguaccugagagggaccugaagcccugauacuuugaacucugaagccaugcaauaguaucuaggcccugaccccuauccucaggaucucugugaacagugauggcauucgaugcucauacagccugagggagggguuugugugacucaagggucucuccuuacugcacacacuccaggcuuccucgcuuaaggagccuaagucuguaggggccaggugcccaugacuugggaugugcuugcaggagaugaugccuggcuuggaggguaucuggcaccuccagacccucuaagcacagaaacaugauggaaggccucuguucaucugugagaccugacaggggagacccugcuauggcaacugagggcccgugucucuucccauagccuugugucuccuuugcuccccuguaggaggacuuggaacccccugcacaggaccaagaagccaaagagcaagaggagaaugaagagguaagagggguucccagggugcaccagaaaguucugccauagagaccugagccagagaggcccugcuuucauuucuugguccugggagaccuuccacagcuucccacagugccguggguagggcagucagggacccgagugccugaccgcuccaugagugaccauuuccagguggucaaggagaauugugggccuggaaaugggugcaagucucuuucccucccuccuuccuucccuuccucccucccuccugcccucccccucuucuuccugcccucucuucucugccaggccaagaguggagaagacuagaaggcugccagccaaccacagaggcucaagggacaccccucugccuuggacccugucucaaccuggcacacugaaugcccugccuagagugcccugcagguugcccaaguucucugucccuagcccagugccacaaguccacacacgcuacugccagcgccagcacccccugcuggcuccuuuuacccuaugguccucugaucaccaaucagaugcugcugugauuucuuuuuuuuuaaugauuccaaauaaaaccugagccccacucccac

SEQ ID NO: 7371 - RNA, 833 nt, Mus musculus
ccgcgcgagacgacgacuguacggccgcgcgaggggcgaccgggcccgggccgcugcacgccgagggcggaggccgagccgggccccgccgccccgcggcuguccgugcccgcccgcgccgagcgccggaggaugaguuucucgggaucccggugaguuggcggguggcgacggagugcgggugcgccgcgggaggccggcgaaguuugggggcgacgguggcggcgcaggggaggccgcgacgcgccuccgcggggccugcgggagagaccccccggccccgcggcccggcccgcccgcgcuugcccuuuuguucgccuucgcaccacuccggggacgcuucuggaagccuuaaaugggaacggugcucugcucccgcuccggagcugcgcggcggcugcugcggggacugggucucgggacccugcuagagaacgagaacgaagcguguucagugcggggacggaggccgggcgaagugcucggcccgcccgccaacuuggcugcgggaaggcgccggguuucccccuccgucccugcgaguugguucaccuguuguucugcgcggccuccgcugccaugucuguugugauucugcacuucgauuucguaaaacuuugugcuggguugcguuacauccccccaacccccguuucagacuccuagcggaaagaucuggcaaagaaaaggaaaauuaaaaauuaaaaaaaaaaaaccaaaaccaaaaaucccaaaccuccaacgcggcagggaagaaaaauaauaacgccguguguuagucgugccuggcguuuuugugacuuguaagucgugguguggaucuuuuucauuug

SEQ ID NO: 7372 - RNA, 1214 nt, Mus musculus
ugaacacagugggguucagaagaaggaaccugguguccuggacuaggguggugugucugugaggugaacuuccagaggaagcuggugcuacaggucgggaaaaaggggaauggguuaggguuagggcagcagagaugaaggggaugccaggccucacacaggggauuucagaggaaagaugaacugggguggagggcggcauacagagucugaacgucaagaguccaagagucugaggauaucccaaggauuauacugaaaacagccuaagacuacuggcuccuuugggguaugguccuugagaagcaccacccucucuggggugugguccuccagaagauccaccccuuugggggugugguccuugagaagguccacccccaaccuugaccacaaccccucccuucccacaguuccuuucgcuugucaauguucucaaauaggaaaagguuuuaggaggcccugugagacacuccuagagacggacagaucuguauuauuuauuuucagaccaagggacaccuccccagucuggaucucgggauguaggaugcccacuggcccucccuuucuucugguacuugcccagccccgucaccuccccaucccaugcacagacccaggauuaugucacaagccuggaagcuuugaagguguuccugucacucgugccacacuggauacgaaucuccggccccuuuccacgccgcgaagcacagucugccgcuacucagcucagcagccacacugggccccgccugaagcacgaaccccgguuuuucccgcuccccuuccagcagcgguugccucuccccagacgcuguaugugcugcgauuguccagacaaugacaauggcgauggcacuggggaacacaucauuuauuuaugagauaaacaucuuggccagcuuucacaaccaggccggacaucucauugguucagaaagcccuuccccgcguccagggcucaaaagcugaacacagacuuuacuuugugcacugggaauacuuuuuugccucuagcuccucccauagcauucucacuguggcccacacucacauguacaugggcacuggcaggcacagagguaccuauugcaugcacaccaagcaacaagugugcacacccugccccuacucguuccauguuagcgguccaaguuccuuccagauguggaucugacaaggcacaggaaaauaaaaacaaacaaaca

SEQ ID NO: 7373 - RNA, 1299 nt, Mus musculus
ucucuuccgcaagguccuggugucuaaagcccgguuccggagcuggcgaacgguauagguucuggcuaagggccugcuggacuucaccgacuccggagccagucccaguuccuagccacgcgacgagacgcaggugcagcgcgggaaggcucgcggcacagugcaggcagcugugucaaucguuuccccuccagggacccuccggugucuagggacagagacuugugcagcugcgccgagccugcugggccaccgcccggaccuuggaggcggggaacuuggggccgccuuugaccuggucugacggugcgagagagccaacgcagguaaacgagcagcgaaaccuggagcagucgggugcuggucuccucgcagccgggauccgcuucagccggccacuucauccucucucuccuuucuuguucaguccccacuacggaguucuguccccuaccuguuagcaaugacaccccacacccccaccccacccccgcuccccgaguauuuuauguuacuaaggaauuaucgucauccuuaucgaacgugcuuacgguaauguggcuuuaaauuuaaaacacacacacacacacacacacacacuaaaguguugauagguaaaaugauccaauacguuuauuuuguuuuagacuaagccucuggaaacugggaaagaagggaauaaauuaacugaggauguccuucgauguuggagcugugggauauguacacauaugcuaucauaccaguauuuaugucucaaauuguucauaauaaaguuuugguuugggggggacggauuguuuguuuugguuuggguuuucaacuaacuagucccggacaagaagguagugaaugauggacggaguauuuuuaaguuuucuucugcagagacuuuuuuucaugucagugaaucaccugguugagaaacuuggagagguuuuauuuuaaaccuucaaugagaaaauagcuuucuaaaacaguuucccuuaggagaagugaguggucagucauuggccuugcagcuaauggagacucaucugagaaauuagaaaacuacuaauugcuuuuagugaaaagacaaccucuucugccagauuugcuuuuaaagacuccucaaauuucaagcucccuccacuguagucaauggauuuuuccaacaaagcuaaaaaggaaaaauaaaaacuucugacugagaggauaaguuaauaguagaguuuuucuccagcaugcccuugguuagaugcccuuggcacucccuucugccacccucuuaaaaauaaaaaacaugagcacuuccca

SEQ ID NO: 7374 - RNA, 74090 nt, Mus musculus
ccugugggaagcggagugacggagcgagcggcuguuggaggaaggagguggggggccgggagcgcaaauggcguugagaugguucagggcccuguucaaacuccagcgcugaccauucaccggcggaggcggcggcgcagaaggcggcggcggcccagcgggggcacguagcgggcucggcaccggcggcggccgccagggaggccuaggcccuguccggccggcgcgccugagguggggagggaaguugcggggccgccgcucaccccccacccccccugucgcccgagcuuccuauuuaccgaagcggagccgcggacugugacggcagcagagccccucgccccucucgguggcaccggucggcacuggucucucgcgcggggcucccgcgcccgcccgcgggccguugggagccggagaggcggaggcggcccgaggccaaagcacccgccaggcgccgaggguaagugaggucucgggcggcugccuaggcccggagugaguuggggcggguggaggcggcaggggcggcgcgaggcucguugcucaccuggcuucuaaggaaguugggcaccggaggaucgcaagaaacucuuucccuucccaccucuuaauuuugccuuuugaguucuucuccggcuacuugauuugacuucucuuuuccaaacccgguccgguugauuugagucccgaauucuuuuuccccgucgucuccuccgccucuagccgucaccgagaggccuugcuucggggacucgguagcagaagcuuccggggcguccgaagcgacaucccuuuccuaggcuguggggguugggaggagaaaaguugcgugaguguccagcccgaggggugucucggcuccagccuccgggcgcacucgcagccucaggugaggguuucuguuugcccauuccacucuccucucuuuauugaagccccccuaaugcauuaccuugggugucuuuccuggaaguggcuagguuucuuuacagcuucaguguaaggagguugguugguuguuuuguauacccuuucccuaauuuaaaucgcagugcacuuccaucaaaagucagcugggcuuugggaugaagcgaaggccucccaaaucgaaaacaaucaguugugaaccuucuuuuccuuuuuaguuaggacuguuggugaaauuugaagccagaacaagauagugugucugaaaugugcguaaaacgucaugccaaauauauaugcugaauuuguacauauguuaagcuuagauaaugccaucgcaguagucugcugacuuuuuaaaauggacguuauggaaaacaguaaaagcaaucacguaacucuuguacucauaucuccuggauucuguacauaauaacucaaccauauuuucuaaucaguacgcuccccauuccuuaauauuaaaaaaaucacugauauuucaucaauauuuaaugauguuaauacaucagcgaauauuucugagacgugaucuuuuaaaaauacaguugucuuauuacuuagcucaguaucauauauucauuugcagaucuuaaucuugcacagugaaugcuuuacuguuuuuuacggugaguuuuucagaugucauaaagaagaucaagucuagauuuuuuuuuuuuuuuggcuuuagucagcauuuuuagaugauugccauguaugugugcccaaaacauuccaacuuuguuggaauguauauauguguguaggucugcgugucuguagucagcuuaaagaaaugacuuuucuugccuuuggcagcugcccaauuacacuugguuuuguuuaauaggcuauacuuaacaagaaagacaaugaagcuuguuaguguucagaacuacaaaauggaaacucucugaggaaagcuaaaauuucuuuuagcacagauguguacgaugacuaaauuauuauuuuaucugaucagaguuguuuuccuuucaaacauuagggugguggugaguugucuucugaauauuugcugaacuaaauuggauagugauucguuaaguuauaagaacuuaauagaaauacuaaaaguguagcucaaaaauauuugaaaauauaaguuaaauauuauucuuauuguaaguuuccaaguaaugaagauuuuccaagcccuuaaguaauugcuuaccuucccccuagaauugauaaauugauauuuaaacugcagaaggccaaaguguuaagaaauggauaaugauugauugugcuauaaaagcacuauaccuuauauuuuuuaaaguguuugauuuuuuuuuuugacuuuucuuguaaaauuuuuucaguauauuuuuggguaaaucagguaaaugaguuuguaaauugaagaggaaaaucaaggcuauauauuucuauuuuauaauaauaaaucauguaccuuuguaaaauggaguucuccaacuucagaaagauguuacucagcaaugagauacaggaaguagaagaaugguuucuugaguuuagggagaugaccauugaaggagcuuuuuaaagucaguuaaaaucacuuuagucuaagaaucagaaucuuuaagcuuggguagaagcuacagauuguacucuaugagaaaauaaguuuuucuaacccuuuaugaggagcuguaaaaaugucaaagaacuaaguuuggccaacugacauuguuuagauccuggaaaacuuaauauauugugacuaaagauuuuguuuuuggguguuuacacuauucugauuaaguuguguaugaagauauggaauuugcauguuuuaaguuagauuuguagguauugcauugugaguugguuaguaguaagcuuuuuuuuuuuaaacauuguaaguuucauaugaauauguccuuauuguaaaaacaagccaaaacaccaccaaaccugauguauggaaguaaaggauggaaaacgaaccucuucagcucacuuauucagacuaguuucaaaguuugugugcugaauguugaaaacuauauaaggaaguccuagggucuuauuuuuauagagugcuuaaaacuuguuaaaaauuugcugauuauauuuucuuaaauuucuuuucacagggaauaugaaacaggugucaaaaugacauccagauuuggaaaaacuuacaguaggaaaggaggaaauggcaguucaaaauuugaugaaguuuuuuccaacaaacggacuacucuuaguacaaaauggggugagaccacauuuauggcuaaauuagggcagaagaggcccaauuucaaaccagauauucaagaaauuccgaagaaaccuaaaguagaagaagaagauacuggagaucccuuugguuuugauagugaugaugagucucuaccuguuucuucaaaaaauuuagcccaggguaaggguucaucuuacucagaaucuagugaggcugcucagcuggaagaagucacuucuguauuugaagcuaauagcaaauguagucauguggugggugaagacaguuuugcuuccgacagaugcuuacuuguggaggauacuuuaauugggaaagagaagagcauaaguagaauuccagaagacaacgcaaacaaaaguaguugcacuaaguugcuaacuucagguaaguuuugauguuccuauaagccaagaaggccuuuuuaaagcuacuuuugugauaaugaaauucuaauuuauuacuugugugcauggaguguuuggaaaaaaagggcaacuuuguauaguuguuucuuuccauguuuuuguggguucuagagauaaaugcagguugcuaggcuugcguugcaagcaccccaacugagccaucucauuagcacccuaaaagagccaagugcuugaugggcauuguagugcuugcuuuuaauuccagcucuuagggggcagaggcagguggaucuacuagaguuagacaccauguguguacugggaacugaaccuggguccuuuggaagagaagccagugcucuuaacugcuauauuauuucuacaguccccuuguaaaagagcuuaaaacuuuaaagaguuggaggccagccuggucugcaaaaugaguccuggacagcuagggcuguuaacaaugagaagccgggucuuaaacagccccaccccacucccuucccccaaaaagugugugugugauuaccacuuguuuuuuuuuuuuccucccugcauuuaugauuaguagaggauauugauaaguuuguuuaguguguguguguguauguauauauauauguauauauauauauauauauauacauacauauauguauauauguauguauauauauguauguugccugcauaccaguuugugugcugugcaugccuggugccuucagaagcuaggagcuacuagaguuagacaccauguguguacugggaacugaacccagguccuuuggaagagaagccagugcucuuaacugcugaauuauuucuacaguccucuuguaaaagagcuuaaaacuuuaaaagagcucaaucauauuuaaauuuuaauuaaaacaacaucuuagaaauuuaguauauuuugggaacagucuuuuauaccuuauauuuauuggauaguguuuuuauaauacuguaaauugguuggcuaccuagggggaauuuguuacagucuuaauguaagauagaucaaauaauauaauggagugugacuugcauagccuuguuaaaaaaaaaaacgcugagcuuuuuuuucuacuuuucucaccuuugggugagagugagcuagcuuuuguugucauucccuugauccucugggcuaguacucauuugguuguugccuuguucauauuucuccuaaagcauuguucuuaaguuaagcuuagauuuucauaggaaaacaagucaaaagaagccuaaaauuguuuccaaaugagcuucuaaaauuuaucauauaagcccggucugguuuugcaugccuuuaaucccagcacucaggaggcagaggcagguggauuucugaguucgaggccagccuggucuacaaagugaguuccaggauauucagggcuauacagagaaacccugucucgacccccuccccccaaaaaaaguuaucauacagauaaaauuucugagcucaacugaauuuuuacucaacucuccucacuuuguaaaguuugcagagauuaugugacuuucuaagaucagcuaguagcaaaauuggaaugaauuuuuaaaaauuacuuuuagguuuauuauuuuauacgaguucugcgugcauuuauguauauauaccauaugcaugcuugcugaccaccaaggcuagaagagggcaucuaauuccccuggaacuggaguuauagacaguugggaacuacaauguggguucugggaacuggaccagguccucugcaagagcaaccagugcacuuaaccacugaaugagauuuauugauugccaagauguugagccuacuauuugaauuguguaguauuuaaauugcugguucuuacugauuccagauaguuguuuuacauaggagguagguggccuguagaagaagaguguagguggcuaguuguuaaauuguccuggaggaccaagggauuauggggaauaauacugcagaaugaguuuguuuauucauuuuccccuuuucauugacuuucugaagauggaaccucuggcaacuccuauaggguaggaagcaaacuugaagugucuuuaauuuuaauuuuuguaaugcuguuagccuauucuaaaugcguacaaaucaguuauuuuuauaagccauguauaaguucauguauuuauaaguugguucuguaauagagaaugcuuuugggcuuuuuagauuuucuuuucuuuuuuuuuuuuuuuuuuucauuuuuugagacaggguuucucuguauagcccuggcuguccuggaacucacuuuauagaccaggcuggccuugaacucagaaauccaccugccucugccucccaagugcugggauuaaaagcgugcgcuaccaugcccggcuagauuuucuuuucguugccuuuucaucuaaacuuuugguuuuuuuuugguuuuuuugagacaggguuucucuguguagcccuggcuguccuggaacucauucuguagaccagguugcccucgaacucagaaaucugccucccucugccuccaagugcugggauuaaaggcguucgccaccacucccaguuugggauuucuugauuuuugcauuuuugucauguugucaguguccuuaauuuuacucugaaaacuauuaaaaauuuuaucaacaacuuguucaaaguauguagaugcacuuguucaacgugugcagguuuaaguugcauuguaacuuuucagugagauauuuguucaauuacugguuucugcagaggaauuauuucacaccaaugagaaaagcuuauccaagcuuaagaguuuuaucauuuuuuucuaauaguacauauuaaguacauguuuucuucuguaaagaauuaugucauuuuuuuaagauuuauuuauuuaucauauguaaguacacuguugcugucuucagacacaccagaagagggcgucagaucucauuauagaugguugugagccaccaugugguugcugggauuugaauucaggaccuuuggaggagcagucagugcucuuacccgcugagccaucucaccagccccuuaugucauuuuuuugauuccaucucugggaaccacauaguaggagagaauggacuccugcagguugucuuuggaccucuguacauucaauguguacaaugacuuguguguccccacaugugugcuuacucacauagaaauaaaugaguaaguguaauaauaaguuuuaaaaacaucagcaguugccauuuuguaaguagaugcuuaauagauaaggaaaagaguagaaaguacuacaaacuaugucuaagaacucuagggaaagguugaguuauuaaaguacucaaaacaagaccccaaauuuuccacuuucugaaaaauagugaaagaaccuuggguauucaguaguugauauauggcaggacuuguugucucuccuugugaauguuguggguuguucugaugcuacuuguauucugauguuaauucuacguccucagaagagguugcccaggagcugugugaucucuccugaaccuuauucccauuuuaacuggucaauaaaagcuagagccugugauugggcaguggcagggaaggaggaggacugaagaagagaugaggaagccaagauggaccagaaccacguggccaggagaaagcacagguagcaaagggucuuauagcuggggaauaaguuaguauaguguuagaucugcccaaucuaggcuuauagcuuauaauuguaauaauuggauuguggugguuuuuuuuuuuuuuuuuucgagacaggguuucucugugucacccuggcuuuccuggaacucacucuguagaccagguuggccucgaacucagaaauccgccugccucugccucccaggugcugggauucgguugguuuuuuaaacuagucaauucuuagacagguguggcauuaaaaugacugaacaggagcuagaguucaucuuuuugagguaucaguauauuaugaaucauuuuacuugaccuuuuauauuuuauuaugauuuuuaaaagacacagucucacuauauagcccuaguuguucugguaaucacugcguagacuaggauuuggccucugccuucugaauguugggguuaaaggaagcacauccaugccuggcuuaagauuuaucuuuaauuauguuuaugugucugucugucuguguuguuaugugcacaugagugcaggugccagaggcauuggauccuuuggagcuugaguuauaggcaguugagcuaucugacacagauacugggaacugaacucaaguccucugggagaguaauagucaccuuuccagacuccccccacuuuuuuuuuuuaaacauaaauauguuugugugugcacaugagcauuagaauauggaaguuagaguacauuauuuuggagucaguuccgucuuucaaccauguauuccagcaaauguauucacugucaggcuuguaugacaagcacuucaacaagcuaacucgucuuacccacuggagugagggguuguuuugcugagacaggcuuuguauauccuagacuggacuuguggacacugugaacaaggauggccuugggcuucugaucuccagcccccacuuuuuguaaaugugaagauucaaggcgcucuccaccauaccuggguuuuuuuugguguugguuauugaaccagagccuuuuguaugcuagcaggcacuauacuaccaauuccugcuaguauucaaguuuggaauccgggacugugcauuaaaacguuauuuauuauuuauacuggguggugugcaccuuuaaucucagcacuugggaggcagaggcagguggauuuuugaguucaaggccaggcuggucugaaugagcuccaggacagcccgggcuauacaacgaaacccugucuagaaaaagccuauguacccuaugugggcagugucuguagagagcagaauaggguguuggauccccugggacuggaguucuagucgauugugggugcuggggcuucuggaagaguaaccaguaccucugaaccauuugcuuaccccaaagauacuuuuaaaaagguugcuuuugcuuuuuaugugggguuacuucuguuucuccucuuuguuaaucuggacucuugaaaaaauuauguagagacuuaaauuucugcuuggcauacuuucuaugccagccagcuggaauucagucuacauauccugccaaauauugagauaaccauagcauaggcucuuaauuugcaugguugguuucauagccaauaaauuuuuuucguuugcuuaaagcuguauugagugugugagcuuucugggggguauuaucaggacauucugagauuugauuuuagaaccaaagguguuuuucaggaaaggggaaugaauaguucuacuuuugacaguuuuaaagugggcugaagagguggcucagggguuaaggaugcauauggcucuuggagaagaccuguguagcuuccagcaccuaccagugauuacagucccaggggaaccaaacaucucuggccucugugagcaccugcacucuuguuuauuuacccacacagaaggauauaauaugaacauauuuuuuuaaagaaacaugagcuacaaacuuaucugaggugauagucuuaauaauaucaggaaguuaguuauuugccuauagguagugaguguuuguauaaaauguacuugucauuuuucaaguuuuaugaaaaguaguuaagaaaucuguuucuaguuccagcuuugugcuaagccuuuuauauuucauagccuuguaaagcuggcuuaauucauauuauauaaaguguaaagcaucauucagaaguuggauaacuugaauuaaauggaauaguugugaaacacccaaauugcucuuuucauauuauagucugguauuguuauauucugguagggaugaacuuaacaggauuuuagaauaaaacagcugucauaagauagauuuuuaauuuaaaauuuauuuuuuauuuuuuauuuuugguuuuucaagacaggguuucuguguguagcccuggguguccuggaacucacuuuguagacgaggcuggccucaaauucagaaauuugaggccagccugugccucccaagugcugggauuaauggcaugugucaucacugcccaguucauaaaauagauuuuaucuugauguugaagugaauuacaaguucucauuuuuuuucuauuuaaguaauuuuuaaaaaaagacuuauuuauuuuauuuguguggguaguuugccuggcauauacaugugcaccguguguuugccuggugccauggauucccuggacuacaguuaaagacaguuguaagcuaccaugugagugcugagaauugugccuggguccuuuagaggaacauccgguguuccuaaccacugagcuauuucuccagcuccuauuuuuuugggggagggggcaaaauaaggccagaguuuuuaauacuuaccgaauaaaauggaucuuauuuauguaguuaauaaauaccuuuuuuugugugugcuguauacaaacaacaguaugcaaauuuugugguagauuuuuacaugcuuuuguuuguuuuugcaguugcuggagauuguauucaggguccucuacauccagccacauccccaguugcccucauuuacuaaguagauuuugaucucugucuuauuucugucucgaggcuaguacaggcuguccucauauugaagacauaccugaaaaugauccuccugccucugccucccaaguacaaaggauuauagcaggugccaucauccuuuuauuucuuaucucugccaucauuucucccagcccuucaaggaaagccaagguuguucucaaaggucagacaggagugcaggaggccauuagcaaguuuucccucacauccaagagaauacccgcuuugugguaauuaaugaaauuguaaacauaacuguccuccuguaugcuuuuuaggagguguaccauggacuugugcuggucaugaauaacuacuuuuagcacaaugagauuuuuuauuauaguacuucacaggacaauugugcccccccccccccauauauauauucuagucccuuagacuuagagccaugaacaaccacaccugguuuuugagagggagaucaaggauggagcuuaaauaagcagcauugauuugaaauaauacaugugagacuacguauaaaaauauuugaacaugaagucauuaaauauuugaauugagcugugaaaaaaguuccuauaccuauaggguggagaaaagaaacuaaaaaagaaagauaauaugaaacagccagagcuauugaaggcucaacuuaguugaauuggauuuguugauauaaaaguuaaauaaaugaggguuucacagaaugguuguaguggccugaggauugagaaaauucacauauguaaguguacauguuuuaaacagaggaacugggacagcugggaacagauggcaugcucaaauuagauaauaugagaaggguuuauuuacaaagguauaggagggauauaggaaaaucaugggagaugaggccucauccuugguucuucaaagugaagcuauuauuacccugacucaaaugaauuaggacuugaagaagccugcuuuauaaggagcugaaucuuucuguugaggaccuaauuauguugucucagggacagcagcucccuccugauagaacccugugucagccuaaagauaagggcuguuuuguugauuggaaugauaggaaguuggucuaauuuuagccauucuguauaguaggccugcuagugguugugcugguaaugugguggugguggugguggugauuauaauaaugauaacaauaaugauauaauaaauuuuauauguaauuccagcuccuaagugcuggauuauagauaggcuguuuugcucaguuuuugagaaguauuauugaaaugacuuuugguuucucuaccuagagccuguuguuacgcauuguacauugaguuacaucucuaauccucauuuauuuacuauauuaucuuuaaaaugacauauaaucuuguguuucacuagaguauuucauaugcuaguuaaaagaagaugcuuuaccuuucaaauuuugauguaaagucgauugaggaaauugggagguuuuuaauuuuuuugaaacagucucuaaccaaggcugacuucagauuccucuauagcagaaaaugaccuugaauuucuuauccuccuauccccauccggagcgcuaacauuaaacucagguaccacucugccuguauugauucagugcuugaacuugaaccaagggcuugauacgugcuaggcaagcuaucaacuaaguuauauccccagcuccuaguucacaaauaauaguucauucucugucuuuuuagguacuuaugguugauauauccacauguucuuuccacagugaaaaguguuuuccuucagauuucaugaauacuuuuuuuuuuaauuagguauuuucuucauuuaccagauuucauauauacuuucuauuucuuuuuuggaacuugaaccuaagaccuugcauucugucauugaacuauuccccuaaccuuagcuuguauacuguguaugacccuaaaaaccuaaauaugugcugccuguaguagcaugauuauaaugcuagcauuuaggacagcaaggugggggcaaucucuaauuggaaauuaguccagguuacauaguuccucggcagucuugguuacgcagugaggucuuguuucaaaaaauacacacaaugugagauauaaaauacugcaauguggggcuggugagauggcucaguggguaagagcacccgacugcucuuccaaaggucuggaguucaaaucccagcaaccacaugguggcucacaaccaucuguaacgagaucugacucccucuucuggagugucugaagacagcuacaguguacuuacauauaauaaauaaauaaauaaauaauaauaaaauacuggaauguauaugcauguguauguggaucaugcuuuuaguacauuaaaguacuacauuuuaguacauuaaaggauacuuuuaggaugugcauugcucaguauuuguagauagauacacuuuguucuuuuuagcaggcucauaguuucccauuguguagguguacuugaacugcccuguguuuuuguuuucuuguugcaaguaaauguugcauugaacaucuuuguaaguuuuugaguaccaugucaccuguguuaguauacugguaggaauuauuucuuaaaguaauuuuggaagggcauauauguuuuauuaaaguuuuauuuuuauuacuuuaaauuauauguagguauaugugucugcauuuggguuuggguaugugcauauaaguacaagugucaaggaggccaaaagcauaggaccccuugcaguugaaauuagaggugguucugagucaccugauuuauguugggguuagaauuuggguccuuaggaagagcagcaagggcuccuaugcuggaccaucucucuagcccuggauguauacagcuuaaauuuuaauugauaaugccacauuucuugcuaauaguaugcauccucuuucccaaacuugguaucacccuucuccucucaaacuuuguaccuagcuauguaaagguagaaaaauagcugcuacuuguuuuuguuguuguuguuuuauguuggauuguuuucacuuuagaauauauaguaucuuuuacacauuuuuacuugcccuuguuuuauaauaguauuggcuagaaucuuccuacuuagccccuuucucagccagccacuacagcucucccuagaaugacaguauauuguuaauuguuguagcuuuuuauguauauacuguacaguuauauuguaaagaauggauuugguucaauuucugagcauaaaauuuaagauccuagaaucuuauauaguauuaucuuguaaugaacuaaaggcugacuguuguuuguuuuguuuguuuuuuggguuuucaaggcaggguuucucacuuuguagaccaggcuggccucgaacucagaaauccgccugccucugccucccgagugcugggauuaaaggcgugcccggcuaaggcugacaguuuuuaaggagcuuuaggauacauaguguuuacuagguagaugcaaccaggauuagaggguugagacuuucagagauacuccuaccugaaaccucuuaaagaagggaagagggaagccaggaagcagaggcccgcggauuucugaguucgaggccagccuggucuacagagugaguuccaggacagccagggcuauacagagaaacccugucuccagaaaaaccaaaaccaaaacaacccccccccccaaaaaaaaaaaaaacaacaaggaagagaagagggaacaagggcuaaguugauuacuuguggcagaagagccaucaugaaaaccauaaaggacagcuuuuuagagcgcuuccagauaacugaucaugagguuuccgggaggaugauacagccuuucccuuaugccuuguucauuuuucuuucuggcucuauuuacuuguuuacuuacuuaggguuuaugagacagggucccauguagcccagaaggcucuggaguuuguuauguugccaaggauaacuauaaacuuccaaucauucugucuucaccuuucaggugccacuauacccagcaacuauuuucuucuccuaauggaugauuuguuuagaaacaggacuuccuguauaaaauuaagaauuuguuaaguaaaaguggucauuuaauuucucuuagagaaugugagaguugagacagagucuauguaacaugcuggcuuugaauucauaauccugguucauuugcccagccuugugaggguuagugacugguuuuuuuuuuuucgagacaggguuucucuguauagcccuggcuguccuggaacucacuuuguagaccaggcuggccucgaacucagaaauccgccugccucugccucccgagugcugggauuaaaggcuugcgcuaccacgcccggcuuuagugucugguuuuauuguauuguguuacauaugccuuguucgguugaugacccugggaggaggaggugguggguuugugggguggaccuggaaggagauguaggaugaagggacugagagaaagggaaggaggggaaguugcagucaagauguauuguaugaaagaauaaaauaaaauaaaaaaaaaaccaaaaauaucuagccgucauacugcccgccccaaccccuuugguaaauggauauucucuacaaauggguuuaucuguuaggaaacuggguuuugaugugggagggcaguugaaaagcaauuguaagccgggugggguggcgcacgacuuuaaucccagcacucgggaggcagaggcaggcggauuucugaguucgaggccagccuggucuacaaagugaguuccaggacagccagggcuauacagagaaacccugacucuaaaaaaacaaaaaacaaacaaaaaaagcaauuguaauauguaauuuuggauaagauggugauaaccuuucaaaagcaaguuaagauuuuuuugcuguuggaaaguuaaguaauagaggauaggacacaauaaaaugcuguggagacagcauuaaaauguguccuuggucaguuuuucuuuuguagaacucgguugauuaaauucgcuuuucuguaaaacuaucuacuguuuuagaaguuuaaaaaauguacuugaguaauaauucacuuuugcuuuugcuauauauaauuuguggauuguuugcuguuacuguauacuauuuccuuacugaauaaugcauacugaaacuacucccuuacagaacuccuuaucacucuuccuucuuacaaguuuacaaagauaggcuacagcagcaguuacugcuuaaaucaccugaaagguacuucuaaaauguauaacuacaacacacauaggagaaaugagggcaauaaacuuaaaauaguaaacuauaaugaaguuuaacuuuagaucuguuuuguuguuguuguuuuuguucuuuuuuuuuuuuuuuuccugauacgguuucucuguauagcccuggcuguccaggaacucacuuuguagaccaggcuggccucgaacucagaaauccaccugccucugccucccgagugcugggaucaaaggugugccccaccacgcccggcuagaucuguuuuuaaauuagaauaauguuuacaccuaaaacagaaagucauuuuugagaaauuaagauaguagaagccugcuauuaugcacaugaagcaggaagauuacuaguuugaggcuaucuuggguucaaaagggaacccuguuuaggaaaacaaaaauaagcuguguguguuagcaugucuuuaauuccagcagaggcagguggaucuauaugauuuuagggccagcaugauuuauagcaaguuguaggccagucagugcuacauagugaaaaccuuucucaaaaugaaaacauacuacaaccccauuaacuaccccccuccaaaguccccucaguggaaggcuauacagcuauaaaaaugaguugaagauuggagaggugguucccagcaucauggaacauguguacccacguauauacuaauaaauaaacaugagguguaguauagcuuaguacaucuuagacauguuagguaagugcucuaacuagaguuaaauuaguucacuccucucuuuucuuuuucuuuuaaaucagugccuuaaguuucccaggauuguaauuaacuuuguaucuucuugcugagauuacaggccugugacacaguuaaauuauauuuaaacucauugaguagcaucaaaaauuauauagugaauuuauccauauaaaacauugcuuuuggcuguauuugcaaguguguucuuuaagacuuguaaauaaggagaguguuguggcauaugacuuuaaucucagcacuuggaaggugcaggcaggcagaucucuuguaaguuugaggccagucuggucuacaucaugaguuccaggauagaguuacauagugagacccuaucucaaaacaaaacaaaagauuuauuuguaaauuguuuuucuuagauuuagauguauuuuucuugaggcaauauuuuauuuggcauagaguaaauauuugccagugcuuacccauuaauuaauguucagggaauccaugauauuaguuugagucauauugcugccuuuuacuuggaggguaaaaaaguaauuacuuaaccgggcagugguagcgcaugccuuuaaucucagcacuugggaggcagaggcaggccaacuucugaguucgaggccaaccuggucuacagagugaguuucaggacagccagggcuacacagagaaacccugucucgaaaaaccaaaaaaaaaaaaaaaaaaaaguaauuacuucugauguuaaaaaauuuaaggcaacaaaaaugaaauucucacauauaaaguagucauuuuaaguuugcaguacucguugauauucauaaauaggcacuauacacuacauagguaccagauccacuguuaagaaauuauguggcuuuuaggauuauaugaaauauagaaauaacuagaaaagcuugugguaggcagguuucuagacaaaauuaacauacuguauaaacaguccuauuucagguaaguacaaaugccccuuaaaggcaugugacucaauguuaaauauguuugaguucuacuaaauuuaagcauuguuacuugaaagcauaaaugucauuuaauguuauccucaguugauucaguuucuuaauuguaaaaucucuucugaguucagcauaacaguuuuaagaggcuuggguguccagggacaggcuacuagaagacauggcagcuguaccuacugacaguaggagagucuaauguguaaacuuuuuuguuuuuuauuucaagauuauuuuauacuggggcuggugagauggcucaguugguaagagcacccgacugcucuuccgaagguccggaguucaaaucccagcaaccacaugguggcucacaaccaucuguaacaagaucugacgcccucuucuggagugucugaagacagcuacaguguacuuacauagaguaaauaauuaaauuaaaaaaaaaaaaaaaaaaaagauuauuuuauacuacuguucagauagcccugcuauuuguuaauuugcauagugaugacauuuauguuuuuaaccggacauauuuuucauuuuuguagauaaaguggagaauuuuagugaagaacaugaaaaaaauagucaccacuuucacaaaaaugcugaagauaguacuaagaaacccaaugcagaaaccgcaguggcuucugaauauaaagcugaugaaacuaaagaaacaaaugauacuuggaacucccagucuggaaaaagaacagagucuccaucugaaaguuguccagucaaaggaucuguaagaacugguuuauaugaaugggauaaugauuuugaagauaucaggucagaagacuguauuuuaaguuuggauaaugagucucuuuuggagaugaaagacgaggauuuaaaaaaucggauuggaggauuggaaaaucuaaaugaaaccuuugaagaagauaucauacaaaguguucuuaggccaagcaacuguaggacguacuguagggccaauaaagcgagauccucacagggagcaucaaauuuugauaagcuaauggauggcaccagucaguccuuagccaaagcaaacagugaaucaaguaaagauggccugaaucaggcaaagaaagguagugcaaguugugggaccaguuuucgaggaacaguuggacggacuagagauuacacuguuuuacauccaucuugcuugucaguguguaauguuaccauccaggauacuauggaacggaguauggaugaguucaccgcauccacuccugcagauuuaggagaggcuggccggcucagaaaaaaggcagauauugcaaccuccaagaccacuacuagauuucgaccuaguaauacuaaauccaaaaaggauguuaaacuugaauuuuuugguuuugaagaucaugaugagacaggaggugaugaaggggguucuggaaguucuaauuacaaaauuaaauauuuuggcuuugacgaucucagcgaaagugaagaugaugaugaugacgacugucaaguggaaagaaagaaagacaaaaaaagaacuaaaacagcuccaucaccuucccagcagccuccuccugaaagcagcgacaauucccaggauagucagucuaguacuaauaaugcagguaagaauuguaagauguauauauaauaaaaaauaauauguauuuaauauauaaaauuuucucaggcuuuaauuaaaggguaggcucuuuccuaaauauuccauuuuaguuugaaauauauaaaauuuauuuuuaauuacauguugaugugugugccugcauguggcuauaugcaugugaguucaggguuccaaacccaauucaaauugcauguaaguaagcucucccacugaaauauaacccuaggcuagcauaugguaauuuaugugauaauuuuauacuauugagucuuugggacagagauaccaaacaucuuguuuuaguuuugaaaauccaaauguaauacagacauaaggauugauuuuuuuaggacauuuagaacuguacugauaacagaugguuuuaugagggaaauacucaaaagaaauuaauuaaacccuuuggaaguagcacaaaacuugaaaaaaauugaaacauucucaaagccucaaauuguggucucauaggauuggaaaguacuaguagguaaggauucucucaguucucucaauucucucucucuuugucucucucuuucucucucuuuuuuguuuucgaggcaggguuucucuguguaucccuggcuguccuggaacucacucuguagaccaggcuggccucaaacucagaaauccgccugccucugccuccugagugcugggauuaaaggugugcaccaccacugcucacaguauucucuuuuaauaauaaaauuugucucaagauuguaggcucaaugauaagguccucuuagugguugagucucuagugagagcuaggucuauuuuuguaucuuggagcaauagaacuuaaauucuggaguaugaaacguuaagacucacuuugagaaaugaaguugauauugaauaacauuugaaaacuauaagacuacuugaaugagaaacaccaaguuacaggucagucuugauauaacgugugaaccagcagucauuuuuagaagaugagguucucuuccuucuaaauuagaagaaaauguuuauaaccauuugagaaguaaucuaauccuucaguaguuuuuaugugaagacucacaggucauugaacuacauuguacuagccaaggauagcuaucuugguuguuucuuugccuccugacucagccucccaagugcuaggauuaggacugugcaccacucccaaagauugugcuuuuuaaaauuuuguccucuuuggaacuggagagauggcucagugguuacguguguuuguuguucuuaguucccagcacccacauagugguucauaacuucaguuccagagaaucugaugccuuaccaucucugcagucuccccaggcaggcucauauaccuauaccggacgguuuugugcacuguguauucagaugcugauuucuaugccuagacaucugcagucuggacaauggcauggccaagcaucuccggucuuaauguuauguaaaaguuguuucccaucaccucugauuggguaauaaagagcugaucagcuaguuagcugcucagaaauagggcaggacuuccuauuccaguccuggaaagagacuagagaggagagagggagaagauguggagagaccauguggauaaaccaggaggauucuccauugaggucucuugagagagcagccaugaggacaaacauggacuagagugagccaaggcaagacucagauguagguaaaggaccacauagcugggaaguauacagcauaaccagguuagauagaauagcucugaaccugcccagcuuagugcuugaagcuuguuaauaaaaauaccaggucucucugucuuuuauucaggagcuaaaaugggcuagagugggcccugcaguuauaugagaacaaaagggguguaagaacauccccccaaagaauuaguuaugcaaaacacucauauauaaaucuuuaaaaaacuuuuuagaguaguuaucuuuguuuagaagccauccagugaauuccaggccagcuaauuauaagcacccauucucaguaaaagagaaaauguuugauuuuuugcugauaguacaaaaauacaacuagaaaagauauguaauagguuuugaaguaagagaauaggguuagaguacuucaucaaccacuacuauuuuuaauccuuuauuauuuucuccaacauuaauguuuuuaaaaaaccuuguguuuucugauaacuugaaacacuggaaagcuagcuaguuuugauuaccauuucagaaaacuuggauuuuacagaggacuugccuggugugccugagagugugaagaagcccauaaguaaacaaggagauaaauccaaggaaaauaccagaaagauuuuuaguggccccaaacggguaaguaaagcauuaacacugguguuuuuuuuuaauaaaaauguguguguguguguguguguguguguguguguguguguguguguauguauacauauauuuaucauuagagggcucaacccuuaacuuuuuauugggaaguuaccaaugagccauugugacauuguuuaucucaggauaucuguaaaucuuuaaaaaaaaccauauauauauuuuuuuuacgaugauauauauacauauauauauauaucauuguaaaaaauguaaucauaugucuaaauauggcauuaaaaauaauuuuucugggcuggagagauggcucagugguuaagagcaccgucuguuuuuccagagguccugaauucaauucccagcaaccagguaguggcucacaacuguuuauaaugugaucugaugcccucuucuggggugucugaagacagcgacaguguacucacuuacauaaaauaaauaaaucuuuaaaaaaauaauuuuuccaugcucuaaaauacugguuguuuaaacugacaugaggcugguugggagcugagacuuuuugcuuuucugucuuguaauaguauucugccacaugucacuagucuagaaaaagaccagaauuacaaaauacaguuucuacuaaauucuaguugcuuucaugucauccucagauugaacauuuguaagucagggaucuucuguguaucugucuuuuugacuuuuuccaguucuuuuagcuauauaccuacagucauaccauuugucaagcuugcucaguaacugggaacuguuuugcauuccauuuuauauucucaucagcaauauaggcucuaucaauuucccucaugucuuggccaacauuuacuacuagacaaaaauuacuauaggcuuguugugaugguucaugccuuuaaucccaggcagaggcuagcaagucuuugaauuuaggaccaaccuugucuauauagugaaugaguugaaggccagauacguagugagauccuguuguaaaaaaagaaaguucccacaauaguuauagaguagucaugcuuugaucuucauuucuauaaugaccacugaguuagaaacuuguugcacaugcuuucuagucauuagugagucuacauguuuguguauucuguguguguguauguguauguguauauauauauauguauguguguguguguguguguguauauauauauauauauauauauguuuguuuguucugcaugugccuguggaugucucaagacccuaugaggcaucuuccucuauuguucccuaccuuauuuuuugagacaggauuucacucagccuggaguucauagauucagcuagacuacuacuggccagcaaagcccagggaaucuuccuguuucuacuuuucuagaguacaggcauguguuacugugcccaguuuuuauagaagugcuggaauugaacugagguggucaugccuguauggaagugcuuuacugacugagcugucucccuaacccuauuugucuguauuuugagaaauugcuaauugaaucuuuuugcccuuuuuaaaauuaaggguuauuuuuuuauguuuaguuguaggaguucaguagauuuuucaaaaaauuaaaagaacuaacauaugagccugcugucucacuccugggcauauacccagagaacuccauaccugcuguggggauauuuguacucucaaguucauugcugcuuuuauuguagcagagaauuuguaaugagcauaguuguccaucaaaauaugauugaauauuugguguguguauguauguaauagaauacuauucaguuguaaagaaaacuaugauaaaaaauuucaggaaaauagauggacuuagauuaaaauacauaauauuagccuaggcuauccacucucagaaagaaaaaaaccacauucucuaaagucuagccaauuguguguguguguuuguaaacaaugugggcacauaguauaacauguaagaaagaaaaagaaugcuaaauguuaggggaugagaaaagacugaguuucuauucuauuuguauaaaagagcacuucccugaguugaauaauguuuggggcuacuuuuucuguguuuuauauuuuuuguuaauuggcaauguuuuguauaauguaaaauuuaguuaaaaaaggaauuccuuauuagauacauaauuugcaaauauuuugucugcuucuuaauguuacaccuuccucuuugccaaguuuaaaauuuuuaauuauuuuuuucccuuuuguugucucugguuuugaugucacagccaagaauucauugccaaauuuaauauagguuuucaaaacuguuuuucacucaggguuuuauaguuuuauucaggauuuuggucuauuugaguaauguuuguuuguagauaggguuuugguucucucuguguaacaguccuggaacuugcuuuguagaccuggcuagcacugcacuggcaaagauccugacuccccagugcugggacuaaaaauaagugccaccacuaccuaacuugagugaauuguggugugugcuauaacguggugauugugguccaccuucauuuuuaugcauugcagcauauaauaccuagcacaggcacagaauguuucuugcauuuaaaaagucugcuguguuuuguucuugaacuugcagcuaauaguuuuguacuugcuaauuuuauguagcuagaauguaaacucuuuuuauugucuuauauuucucuuccuuuuauuucuguaaaagcucacuggguaucuucaaaguaauucuagcuguuuagaugcacuuuuaguucuuacauacaaagugguuuuugauauauguuaguuuucagagcauuauuuaucaacaggugugggggggucucaaucacuacuuuuuuuuuuguuuguuuuuuuuguuuuuuugagacaggauuucucuguguagaccaggcugacaucaacucagaaaucugccugccucugucucccaagugcugcccugcucaugacuucuuuacuuacugauaaagaaaaugacacacaaaauauguauguaaauuuaaaugucuugcuggguccuuuagauuugcucaaauguauauguguuuaggguugguuaauuuacauucuuuuuauuuuuuuacgauuuacuuauuuuauguaugugaguacacuguagcuguauagauagaugguugugagccuucaugugguuguugggaauugacuuuuuugugaccucugcucccuucagucaacccuacucgcucugguugguucugcucgcucugggucaauuccguucgauccagcccaaagauuuauuuauuauuauauauaaguacacuguagcugacuucaaaugcaucagaagagggcgucagaucucauuacgggugguugugaaccaccauaugguugcugggauuugaacucaggaccauucagaagaguagucagugcucuuaccggcugagccaucucaccaguccauacuuuacauuuuuaacacguauucagaaccccaaaggacuuguaauuacauggucacuaucaguauguauuggguuagauagaaucaaguggcauacaucuaugaucucagcaacugggaaacugauacaggagcauuacaaguuacaccuugggcuggugagauggcucaguggguaagagcacccgauugcucuuccgaagguccgaaguucaaaucccagcaaccacauaguggcucacaaccauccguaacgagaucugacucccucuucuggagugucugaagacagcucaguguacuuauauauacaauaaaaauaaauaaaucuuuaaaaaaaaaaaaaaaaaauuuaaaaaaaaaaaaaaacaaguuacaccuuuaugauuuugggccacauaacaaaacucugucuuacauaaacgugguaaaaaagaaaaacaaccaaacaaccaaaauacacugaacagauuagaaaugaaaaacaaauuuguauugauuuacgauuuucuuuuuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcuuuccccugauuuacgauuuucuaaaaugauaaacuaaugauuuaacuauuuguaugaaaaauuauuuucaaaccaaaaaaguagaagaauaacaauacuaaaccuuuauuuuuguaaaucucuguagaggcaggguuuaaaaaaaaaaaaaagacacuugaaggcuuggugugguagccaugcauuuaaucccagcacuggggaugcagggguagguaaaucgcugaguuugaggccagccaggacuaccugugacuugggggagaacaauuguauuuuucuaucuuuguauucaguauauuuauugugcuauauugguagaaauauuugaagaaaaucuaacauaaauacgcuauaugguuacauuuuuagguaagcuuuugagauguauuuuauauuugguucaguacaccaaaacuuaaauuuuaguuuuuuaaagauuaaccuaugucuguaagccuuucagacuguuuacauuagaauauugguucuccuuacauuuugaauauacauuuuauccaugcaugcuuuaaaaccauauauuuuauccauuuggaaaauacuagccacccugaguugugcaaacuuucuaaggugacacauuuuguuaaugcucaaucaaauauucauguuaauaucaagccaaaaaauuuugucaguacuaggaagcagucaagauucacaguaguagaugaagguuuccagaauuuuaguuuuugcuagaguugauauuuuuuucucauuggcaucaaaugccuuaaagggauuagcugacagugauagucucauuuuauuccuuuacagaaauauuuuugccagauaccaaagucuuaaucaggauguuugucagucuuugaagagugauguuucugauaaacguagauauauacagcucaaaaaguuguuguaugcaaaaguauuuaaugcacauuugccacacagaacauugagauuuaauaaauugauaauucuucuuaggcuuuauauggagcucauggauaugguuuguggcagugaugagaagugguauaauuuguaggucauacagauucuugccaagacaacaucaaacuggcuucagcaccauccacaggaauuucaacacugacaaaggcaaauaacaucauacuguaauuaugaaaauaguuuugaauuuguagucuccugaaagaguuugauaaaucuuuaguguccauggccuauacuuugagaccugaugauugauaguauuacuuuauucuguuuucaaaauuuuuauugugaaaacuucagauccaaaaagaaauaugaaaccccucuacucuuggcauguauuuauuuuuagcuaguauuuugcuaucauguauucuuccuuucuauauaacaaguuuauuauacaguaguaucauucauauauauauauauauauguauauauauaguguaguauuaaaauaauuucauuguuagcauaaauauuucuuuuauuccuuuuuuuuuuuuuuuuuuuuuuguaaggcuuucuuuguguagcucuguccuggaacuuucuccagaaaucaggcuagcuuaaaauucagagauccucugcuucucagugcugggauuaaaagugugugccaccacucccagucuaagcgcgucucucucucucucucucucucucucucucucucucucucucucucucucucucucucugucucaaauuuagugauuuauuuaauguauguugaguauacugucuucagacacacucuaagcauucuuuuuuuuuuuuuuuuuugguuuuucgagacaggguuucucuguauagcccuggcuguccuggaacucacuuuguagaccaggcuggccucgaacucagaaauccaccugcuuucugccucccgagugcugggauuaaaggcgugcgccaccacaccuggccacccuaagcauucuuaagaaaaaaaauuucaggcuggagagauggcucaguaguuaagagcacugacugcucuuccagagguccugaguucaaaucccagcaaccacaugguggcucacaaccaucuguaaugggaucugaugcccucuucuggugugucugaagacagugacacuguacucauguacaugagauaaagaaauaaaucaaucuuaaaaaaaagaaaaaagaaaaaaaaacuuccuguuuacugauaagauuaaaaccuauaagaaaauaaauguauuaaaaauaauucuuaaugcugaucauauuguuuucaucuaaaguccucagaagucuuuaguuccccaccccuuuuaacuaagacucuuguagcaguuuuguauguuuuguuuuuauauagaccguuucuuauuuacaaagaauucccuuucacaccccccccccccuuuuuuugugguuuuugguuuuuucgagacaggguuucucuguguagcccuggcuguccuggaacucacuuuguagaccaggcuguccucgaacucagaaauccgccugccucugucucccgagugcugggauuaaaggcaugcgccaccacgccugguguuuuuuguguuuugcuuuguguguguguguguguguguguguguguguguuuuguuuuguuuuguuuuuguuuuccuuucacuuauuuuuauuaggaagcugugauacuuguuuuuagggcuguuccacauguagaaguuaucuaauuauuuucuugauauuauuugacuugcucuucacuauuggcuuagaaagcuguacauuaauaaauucuggauuagauuuaaguuaauuuuuuuuccagagccagagagagcuucauuuuugauaauugcucauguuuccuuauccguauguguagcaagugcuuuuaccugcugaaccauuuugugagcccugucuggugugacguuuuuuguauuugguuuauugcuguagcccaugcacacauaaugaccacauuguaauggauuagugauuguuacugggaaccauaaauagugagugagguuuaagcuauguuugcaguuuuuuuuuuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacacccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggguaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucacucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugaugcccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccugccgggugggcaccuguccuccgguccggaagguggccggcuguccccggcccacacagggugcugccucagcgccucugugcuuccgccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccucugguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccucugguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggccgccuccccagccgggcgggcaccuguccucugguccagaagguggccggcuguccccggcccacacagggugcugccucagcgccucugugcuuccgccuguuccagaagcugucagguucucuggcgcacccucucaccuguucagacuaauuuccuaaguucggcgggucucggaccaagauggcgaccgcugcugcuguggcuuaggccgccuccccagccgggcgggcaccuguccuccgguccggacgguggcuggcuguccccggcccacaaagggugcugccucagcgccucugugcuuccgccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccucugguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagaucuguuugcaguucuuuuggcccuuaaauuguaucuuacuaaggaugacuggucagaaagugggcaagguggcacauguauaauaauaacuagcacucaggggcugagacaggagacuuggugugaguuugaaguuagauugggguacauagcagagacccugucugaaguuuuuuuaaaagccaggcaugguggcacagaccuuuaauucuagcagaggagcguggaucucuaugaggucaaggccaguuagucugcaaagcgaguuaggcccaucuaagugaaacccuaccucaaaacaaaacaguuccuuguuaauuuuauggguuuuuuuuuuuuuuuuuuuuuuugccuauauuacuucaguaugucaauuaguugaguucauauuguaugcuuauuuguauuuaauuuuuugguaguguuuuguuuuuacagucuuagugaucuaacccaaggccucauacauccuaggcagguacguuaccacugagcuauaccaacagcccuguguucaguuuuuaaauuuaguuuuaaacuuaaucuugagagauuuugcuuugcuauucagagagcuuguacuugaccugauuuugaaauaauuuaccuggccuaaaguaaaucaggucauggaaaacaaguuggcagcagaccuauuugcugcuguauugauggacacaauauuauagugucaggaaaauuaaggaaaugacugcugauuuguuuaaacuuaaaaagcuacauaugggauugcacacacuuuaaguauauguugugagcaaaacguucuuguaauaguagcugucaucuucuauucccugaggaggcuuagaugcucccuacuaucacaugaggaguuaggauucccgaaaacuaaauucuccaagggauuuuuauguagauuaucuuccacacacccuaggagagaagugggugugaguggauguagaaaaucuucucagcaguuguagaguggugucaacuuauauuugucuagugcuuccucuaaaucaguuuaguuaugguuuugguaugaacacuagggaagauacugugcucucauuccuucaagacccuguuuaaguacagagaacugugacacguuaaaaaacaaagaaaaaaugcauagacuuuuuuguuguuuuauuguuaaagacuaaagacuuaaauaaugacguuguucuuagggccucguucaugcuaggcaaucccucucuacuucuauccuauagaucucuauuccaucaugguguguuuuuacauaugauuuccuaccuaauuuuauggaaccuagaauucauauugguacuuucugauccaacaccaggucuauuuugcccuucaugccuuuguauuuuauuucucuuuaacuacagugagaaaucugguggucauuaucuucaauauguucaaccauuuaguuaguccuaguaauauuugucaauaaguuucuugaucacacaggucaucuucuugcuuuagugauauagacagccuagcuaagaguuuccuuuucuuuucucuacuuccucauauuuacuuucuuuaaaguuuuaaaauauuuaugcaugaguuuuuuacuugccaguauguauauacauccacuuguaugccuaauugccuaaagagguuagaagaguuugucagauucccuugaauugaguuaaagauggcucuaacccacucaccgugugguuagugggaaucaaacuagguccucuugaagugcuuucagaugcuggccagccccacauaacuuuuuuuuuuuuuuuuuuuuuugguuuuuugagacaggguuucucuguauagcucuggcugucuuggaacucacuuuguagaccaggcuggccucaaacucagaaauccgccugccucugccucccaaguuauuaaaggcgugcacuacuacgcccggcucccacauaacuuuuaauaaacaugucuucaauacaguuucuaagcucaccaggaacauaggcaggaguuguuuauagcaggauugagagcugccugggaggcuauaugcuucagaaaaugagcagcgugaaaaaaacaguuuaaauaauggcuuuaaaaagucauuugcuggacucagugcuuaaaagcauuauuguucuucuagaggacccagguuugauucccagcauccacauggguucuuaguucauuaauucuagcgaucugauacccucuuugaccucugcaggcuccaggcaugcauguggugcauauaaauacaugaaugcaagauauucaauauacauguuuuuaaaaaaaaaaacaaaaaaaauaaagacuuuuuagaaagucauuugcuaguuaggaaaauaaagggauuuuuaggaauuagacuugaacauaacugaauuuaaguaaccuugguuaaguuuuaagaauugaucauuugagcugggcagugguggagcaugccucccgcacuugggaggcagaggcaggcggauuucugaguuugaggccagccuggucuacagagugaguuccagaacagccagggcuacacacagagagaaaccgugucucgaaaacaacaacaaaaaaaaaccaaccaaacaaacaaaaaaaaaaggaauugauauuuggaaauugugguguaaauucuggugaaaugacaaccuguuucugauuucuggauaccaauuucucugcuucccacuuuuugcagcugucgugccugugcugaaucagagagaacugcuugcucugccuacuuuacacucaacuccuccuuaccccugucuguugcuaaggcaguguuuuuauaauaauuagccaaacuuaccuucaaugcuuggaagguugcauuuuucuuggaauguuggcuaccuugauuugcaauuaagauugcuucugggucuuugaagaaacuaauguaagauuaguugugguuucaauuuugaaauauuucuaccacuacuuuucaguguuccuuuguaguuuaaaacugggcccaucuggcccuaucuuuugucugacuuucuaaggaacauuuuggacuuaauuuuuuucuuuccuucugucauucaauaugacacuucauaguagcuucuaggcaguuggauuaaaauaauguucucuuuauaagucaagaguacauauggcuuucuaguauaagauuguaauuguaugagcuuguaauuuuaaaguuguauagauuuauaaauucuuuuuuguuuucugaauuaguuuauauagguuguuaauuuaaaaacagaaucucguaacugaagagacuuuaaaggacaaguacucccacaucucacccaagaacaaauguucuuccacacagugcuuguuuuagcaguuagaauucacucucccaaaacagcuuguuuuuguccaguguauuuauuuagugaguguugcuuuucuauuugaggauuuaccucccauuuuuggauccagacaucuaggugguggugauuucuaaaaacuagacaccugugauguuaaugcacgugaagccugaauaaaaggaagaccggaaccggcauggugaugagguugaggaguguaaaacugcaaagucauggcuggcuggcuguauuugauccagaguaguuuuauuaagaguugggggauggguucuacucuggcuauggaagaaagucaguucaguuggcuuucuuccuuugucuuuagguaauguaugcugcucugugugcaagcugaucaggcauaccagaagaaauuuaaaaaaaaagucuuuaaagcucacuacaauguuucuccaaacuggaauuuuaaauaguuuuagcauuaucuuucucuuauaggaauaauauuugaacacuaaacuaggcauucuaaauuccugaugugugcaaguaaugagguaaaauacuuaggaaaguuaaaauauuuuuucuauauaauccuuuucuucauugucuuauuuaaaauacuacugaaguauuacuacuuuuaguuuucauuaguucaguguucuuuugucuuugaggugugugaauguuuuugcaugcguguaaagccauuuugugcaugcucggugcucacagagguuagauucucuagcacuggagguacagguaccugugagcccucgugugugugugugugugugugugugugugugugugugugugcugggaauggaauacaaguucucugaaagagcauccagugcuguuaacugcugaaguaucucuccaaccccaguucaggugcuuuuaaaauuaaaaauaggaccuggagugauuguucagcaauugagaguacuggcugcuuuuuugaguaccuggauuugauuuuuaguaucuacauggaagcuccagccacugguaacuccaauuccauggcugccuucuggucucucuggcaacaggcauguuuggucuucaugacaggacucucauucuggagaaauuccucucuuucugaauaacauagguucauuuuauacuaucugcuaagguccauuucugggaauugguuggagaguccuuagggaucagguuuuaugcacuagguaugcuuucauuaauuuuggcccuuuuaacagagauagggaacaugcauauauagucacauaugaaaugcauacucauguagauucaaauacaugcacaugucuugaucauagagauaucuucagcuucaacccauuuccacaauuuuuucauccuuuuuauugacggugagcauuaguauacguuuacucaaacuuguaauauuucuaaaaaaguauuugcuuauuucacuguaguaaagucauuaaaguauucaggauuuggggcugaggagauggcucaauggguaagcacuuauuucuccccuccccucuucuccccuccccuccccuccccuccccuccccuccccucccuccuuuccuuccuuucuucuuuucuuuucuuuuuuuguuuuuugagacaggguuucucuguguaguccuggguguccugaaacucacucuguagaucaggcuggccugaaaucagaaauccuccugccucugccucccaaguccugggauuaaaggcgugcaccaccacugcccaguagguaagcacuuucugggcaacuauaaggauuagacuuugaauccccaucaucugggaugggagaggcaugcaugguagugccuauaacccccuagcacuguggaguuagaauuuggguacaucccaggaauucaguugacagccaaucuagucaauuguugagcucccgguucaguaaaagaccuugucuccuguaagauggagcuauagagaacacauaacauugauuuguggucucuauaaacaugcacacacaggcacacacacugcacauauacucacguuauucacaauuuguuuacagacauacacuugccuuuuccccacuaagaucaaugguguaaagucaaacuguacacaaauuacuugggauuaguucugucugucugccuuuugaucaguuagucuguccuugauuuauuuggaauauaaguagguuucuugguucuucuuugcuuuaaauuuuaauuuuucccuuuguuuccauucuuagugaaugauauaaauaacauuaacauuuuuccuaaaguaaaaacuauaaaaaagguaaauuuaguuaaagaucaauucauuuaagaccuguuccacccaauuuccuaccacuuguagggaacgcacacgcacaugcacacacgcacgcgcgcgcgcacacacacacacacucucucuugcuuucuauucucuucuuucuuucuuucuuucuuuucuuucuuuucuuucuuccuuuccuuucuuaccuuucccucccucccuccuucccucccucccucccuuccuuccuuccuuccuuccucucuugcuuucuucucuuuucuuuucucuucuuucuuuucuuucuuuugcucuuucuuucuuucuuucuuucuuucuuucuuucuuucuuucuuucuuucuuccucuucuuucuuucuuucuuucuuucuuucuuccuuucuuucuuuucuuuucuuuccuuucccucccucccucccuccuuccuuccuuccccucucucccucuuucuugcuuucuuccucccccccccucuuucuuucuuucuuucuuucuguaaaauuuuagccaggcauugguggcccacgccuuuaaucccagcacucgggaggcagaggcaggcagauuucugaguucgaggacugccuggucuacaaagugaguuccaggacagccaaggcuauacagagaaacccugucucgggaaaacaacaacaacaacaacaacaaacaaacaaacaaacaaaaaacaacaacaaaaaaccaacaacaacaaaaaguaguaaaauuuacuuuuuuuauuuuguuguguaauuuuugcuuuucuuguucacuggguagccuaagacuuguagagcucuuucugccuuugccuuccaagugcugggauuaaaggugauagccacuacugccuggcuguuugaauuuggcgcauauaauucuucagaaugguaauuguguaagcaugugacuguagagugugcuuuuacuuuaguaauuuauguguaugaguauuuugccuguauauauauauauauauuugugcacuguauacaugucuugcuccuguugaggccaaaagagagcauaggaucuccuggaacuagaguugcagaccuuaugugagcugcuauaugggugcuaguaaucaaaugugggucuuuaggaagagcagccaguauaaucuuuaccuaugagcuuucuuuccacacccaguuguugcuaaauaauuuaucuguucagagugauccuaaccucaaaggaauguuauuuaaaauuauuaucuugagcuuugauaugccugcuuuaaaguagaucauaauguacauuuaaguggguagcauauuuuucuuugaguuccuaauuuuuguuuauguagacauccuccgcaauguuggcuucuuuuucucccuuucuuccccuucucuuuuuuucuguugcuaguaaggcacuauaccuagacacacacaguuacuauguauugcaacucuuugaacauuauucagauggacuuaugcugguagaguuacauuacuuuguucaugaaauccuuguagauaagacugugugaaguauagccaguucacuguuucugucaucacuguagucuugaguugauuuuguaaaaacacaaaaucauacuauaaaaauggugggaauccuccccucccucccccaacaugcauacuuuuagaggccuacucaguggagaagagcacaauggucuuauucuuugcuauucaggaaggaacuuuacuuaagggaaaaaaaaaaaagauuuauuuuuaugugaauuuguguuuguuagaucaccuggaccuggaauuacagacaguugugagcugccaaguggguguugggaguugaacccaguuccucuagaagagcagccaguuuucuuaauugcugagcugucagaacucuauuuucuuucauuuauaauuguaauucagugaauuggucugcuaaaucacacucuugagauugucuucauacaaaaaccuuguauuuauguuuucauugacagucacucauguauaauugacccacauagauugaucaugggcuuauuuuuuauuuuuugguuuuuuucgagauaggguuucucuguauagcccuggcugaccaggaacucacucuguagaccaggcuggacuggaacucagaaaucccccugccucugccucccgagugcugggauuaaugaugugcaucaccacugucuggcaggcuuguuauuuuuuuuaaccguaguaaauuucugcauguaaaauuuuuguuuguugcauauauuccuggagaaguaaauaagaaugaacauaggauguuguaagguggcuguuuugaaacaugcuuacuugguuccagcucuugagaauguuagcauauucaugugagcuguccacuccuuguucugcguauucuguagauuagagagcaaacagaaagcagaaauugucuaacaagaaguacauuaagaaaagugaccaggcaguaguggcacaugccuuucauaccagcacuugggagguagaggcagaggcagaggcagguggacuuuugaguuugaggcuagccuggucuacagagugaguuccaggaagccagggcuacacagagaaacccugucucgaaaagccaaaauaaauaaauaaauaaauaaaaauaaauagaaagaaaagaaaagugauuaaugugcuauauaucuacuuuuuaaacuaaaaaaagauggaaguccugguaguccaguauaagugaucuaauuaagacucaucuagagggggcuggagagguggcuuagcaguuaagagcgcagacugcucuuccaaaggucccaaguucaaaucccagcaaccacaugguggcuugcaaccaucuguaacaaaaaaucugaugcccucuucuggagugucugaaaacagcuacagugugcuuacauauaauaaauaaauaaauauuaaaaaaaaaaagacucauccagauuucuacauggcauuuaugauccuauuuuucuugaaaaguugacugcucuuuuuaaaacuauuuuuaguuacucuacaaaaucacuuguacuguguaaaauuagaaaguggccuaucagaugcucugguguuuacauacacaauucauauuggagcaagucgaauucuuguaccauuauuaggaugcuauuaugagcucaggggucaguucacuguucucuccuucucuccuucccuaucuaacacucauauguuauuucuuuagaugcauuuaucuuuaguaguuuuccuaccugauaauaagcccugcaacuggccagagagauaauggcucaguaguuucaucguggcucacaaccauucauaacuccaguucagaguaucuagcaccguuuuuuugcccuccaugagcacuaggcauccacaucauauguacacauacauaaaggcaaauacuaauacacauaaguaaaucuaaaaauuuuaaagcauuaugauuuuguaaaauuuggaaauaaaagucaagagaaaguucuaauuuucuuuaacacuagcauuaaaauggcaagcaucuaaaacuuuacaagucuaggcucaucaaguucaugcuaaagauaguguacuaguugguuuucucacugugacagaauaccguacagcaagaagcaguccauggaggaaggguuuguuuggcucccacuuugaagguacaguuguccauccuaguggacaaguccuagcagcaggaguugaggcagcuugcuagacugcauccccguucaggaaucagaaggacacaugcuagugcuuagcuuacuuucuccuuuucaugcaguccuacacuccaguccuuggaauugugcuacucauauucaaggugggucuuuucacuuggaauuagugccucacugcuaugucugguggcuuguuucuuagaugauucuagauccugucaaguugguggcauuaaccaucacacagaauacaaaauuuuuuugcuuugguuuugagaaaguucauuuagcccuggcucaccuugaacucuguaggugagacuaauuuugaacucuuugcuccucuaucuccugaguguuaagauuacagacaugcuaacuuuaaaaaaaaaguccuucuccugauucuuauuauaaaacacuuuagugccggcauucccuuugcuggucugagucccuguaugauggauucucuuuuuuaccugaaggugauggacuuggguagaccaguacuaaaauagcuauaguacuuaaaauaauaauuaguguuuugccugaucuuacaguguuuuaguuaagaaucuuguauuucgggcuggugagauggcucagugguuaagagcacccgacugcucuuccgaagguccggaguucaaaucccagcaaccacaugguggcucacaaccaucuguaacaagaucugacuccacucuucuggagugucugaagacagcuacaguguacuuacauauaauaaauaaauaaauaaaucuaaaagaaaaagaaaauucuagcuggaauuaaaaaaaaaaaaaagaaucuuguauuucccuguuguuuuggucuguggagaauuagccuuuuucuuaacccaaagauuauuaccuagaguuagucccagcuccuacauggcaacucacaacugucuguaauucacacauaugguucacaugucuauaagaaggcuaaacaccaacucauaaaaaauuaaaaauuaaaaaagguaaaaaucaguagaauuuuugcacuuugaaauacuuuucucugucuuugacuuuauuucaaugcuagcaauggaaucagggcccuuguucaugcuagguaggugcacuaccagccauacuuacacacaggacacagauuuauaccaaaagcauggaauugugccuuggacucugaguguacaugagguguuagaaguugcucaaauaaaggguuuaaugaugaacaaggauaaaacuuguauggugcuuuucugagauaacacgaauaaagaggcuaguuuuuagaauuuguuaaaucuauugugugcacaugugacccagaaaaccugaucaagucauugcaugaguucauaaauuauuuagguauaauaaugaaucauuaauuaauguaaaucuaguuuauaagauuaaugggaggggcuggagagauggcucagcuguuaagagcacugacugcucuucugaagguccugaguucaaaucccaccaaccaaaugguaguucaaaaccacccauaaugagaucagacacccucuucuggagugucugaagacagcuacaguguauuuacauauaauaaauaaaucuuuaaagaguaaaugggaacaggaguaauuuggccauucuugaaguagguuuuugugcaaguacuuauuuuguauguguagcauaaaaaggaggaagauuaccaucauaaacagaagcauuagucagaucagagacuugaggguuagagugaggacaguuagugucacaucuucuuugaagaauagaaaugguguuucucuugucauucuuuuuugaaaucaguuuccuuuugaaaauaaaguuucauuuuuuuucuuuauacaaauguaguccuaugcauuugaauuggcagguuuuacuauucugguucugaaauucagaauguuaaaacugagagacuuuuucauaauuuuaaguaaauugguuugcuaguacaauagccuguauuaaaaauucaagacaguuuaugaucuaugcacauucgauaugaaugcuuuuauauaauuuugguauggaauucacaaauguuaguacacugaguuucuuuagacuauugugucuugugaggguaguucaugucuacuuuuauaaaauuugaacaacuuucaguguuacaguguauaauugguuccaauugguucacucacaugaguuuggaacuucuuucugccugucauaaacugccugaucccuauuguuggaaaguuacgaagcaugaaugacuagugccaggaguaaaguuuugguaaugaauaugcugaauuaaauauauuaaauccuagauuuucuuccuuuucuuuuucuuuccuauuuuuucuuuuucuuuuuuuggguuuucauuuugguuuuucaagacgguuucuguguguagcccugacuauauggaacuugcuuaguagacuggccucaaacucagagaucuuccugucugucuccugagugggauuaaagguguguaccaccacauccauucuauauuaggcuuucaaaacauuuacuuaucuugugugggggcguguguguguguguguguguguguguguguguguguguguguguaaaugugggcacauacaugaaggggcaaauguggaggucagagggucucuuguuguuacggcuguaccauuuacucaagguuugcuuauuauaagcuucugggcaguuuuuguuguuguuuuaaagaaucauuuauuuaccuuuugugaguacacugucacugucuucagacacaccagaagaggccaucaaauccauuacagaugguugugagccaccauguaauugcugggaauugaacucaagaccuggaagagcagucagugcucuuaaccacugagccaucucuccagcccugggcaguucuucuauagaaauaaauaguagggcuccagaugcaguuuuuuauguggguuaagucugagacuuaacuccauuugucaggcugguacuacuagaacuuguauucaaugagauauuucuuuauccccaaggaaguacuuuauaacaaacaaaaaaaagguucacagugcugaaauuuguuaccauuacuuuaggaaguuagacucccauuaagugaugauuuguuauuagucuaaauaauuuaugaauuuaugcaaugaccuuauuagguuuucuggguaauguguauaguguagaugaaacauaaacucucuguuuuuauguuccucuuagaaaacuguuguauauagucuguguguguuggcaauuuuaagucuuuuuuuucuucugguuaauugguuucacagaagaguaguuacugguucugugcuaaaaaccaaagugauuauguccagcauaggcaugguaauagcacucacuguuuuuggucuaagaauguguguuuaugcauuucaguuauuuuauauaaaugagaccuuuuuguaagggauacaaagugaaauggaagcaguugauuuuuuuuuucuuugucauuucacuagucaccuacaaaagcuguauauaaugccaggcauuggaaccauccagacucggaagaauugccuggaccaccaauagcaaaaccucagcgugucacaguaaguaaauauuuuuucuuucucuuaaaauaaauuagaaauuaaucuagauagcuauuaucuuaauuuuuguucuuacaagauuauaauggaaagcuuuacaaauuaaaacuuuguaguagcucaaggccaauguagguuuuauacugagacccaaucucagaaacuaaacaacaaaaaaaccaaaccagagcuuuuaaucaugacucauguuuuauagaauuuauaguauuuagggcuuaagaaaaauuauuccuuauaugaaguguuaguacugauaugugugugugguauuauguauguuuuuguuuuguuuugguuuuuguuugguuuuuucgagacaggguuucucuguguagcccuggcuguccuggaacucacuuuguagaccaggcuggcuucgaacucagaaauccgccugccacugccucccaagugcugggauuaaaggcgugugccaccacacccggcuuuauguguguauuuuugugaguguguguacagguguguauguacucaguagaggauaacuuuuaugaguaauuucuucuagcauguggguucugucaaucaaacucagcaggcauccuuaccugcuaagcagucucauuggccuuggccuucaaggucaaggucauuaaauuuggcuuauuuagcuagauuggugagcuccaaguauccaccagucuuuauaccauaaacugcuguggugcugucugucugccugccugccuuucuuucuuucuuucuuucuuucuuucuuucuuucuuucuuucuuucuuucuuucuuucuuucuuucuuucuuucuuucuuucuuucuuucguucuucuccucccccccuuuuuuuuuuugguuuaagaguauagauaccaaguauccaaacccucauauccuuaugcuugcauggcagacacuuuacuuacucucagcuuauugauccugagaauuuauaauaaaucuaggcaugauggccaauaccuguaauuguaguacuuggaaggcugaaguagguaucaccaccuugucacuaacaagugcugcauagcacgaccucacucuuucucccaaagcuauauauagacuauauucuacaacuuguggaccuuuuuuuuuuuuaaaguuuggggccucugccuuuuuaagaauuauuuuguuuuuauuuuauauguaagaguguuuugccugaauauuuauuauuguauagcuccuuuuuuguuugguugguuuugguuguuuuuguuuuuguuuuuuuuggagacaggauuucucugugguaucuuuggcuguccuggaacuuauucuguagaccaggcuggucuugaacuuaaagagcauucuaagugcugggauuaaagguguucuucacuucugccuggugacuauaucuguauaucuuaaagugacuuucauuccuuaauuugauuuacauagagcuaaaauuacauucaauuaauacuuuccaaaccuuuuguaaaauauucuugcuagguaugcuacccacaaucuaggcaacuaggagaugaagcccuuggucaucuugaaguaccacaggaaugaguucuuagaacaguaacaaaaaugugaggcucgagggucauguguuuguguugcuaaugacugaacccaggcccugugcacagaccuaauguucauccucagcucuaagaauggaggagcucuuuugguuuuuugacaagguuucucuguguagcccuggcuguccuggaacucacucuguagaccaggcuggccucgaacucagaaauccgccugccucugccucccaaguaucaggauuaaaggcgugcaccaccacugcccugcuagaauagaauucuuaauaaacacuauaauguuuuuucuuaaguugauuaugaagucaccaucauauauacuaguaauuauuugugauucugacacacgcuuuguucuuuuuacaacuuacuauuuuuguucuguguugcuuuaguuuccuaugcuucugugauuccuuugucgucguuuuuugaagcccugucuuaacugcuuaucaaugcuacuuaugcaugcaguugugguucuuuauucuguuaacuguccuggaagcaaagaaaugauaggaaaugugaaguuuuuaaaaaaccaaaaguauuucucaagugguucuuuuggguauaaaucaaaauuuaagucuuaguagugcauggaauuuaaauuauuucuuaggaacuuucagcagccucccucuucccccuuuaaaaaauuuucauuuacuuuuuuaaagcuaaauuugucacauagacaagauguuaccuuuuaaaauauauuugcuuagaacaacuaauuuaauaccuuuauuaauaggugaggcugucuucaaaggaaccaaaucaaaaagaugauggaguuuuuaaggcuccugcaccaccacucaaagugauaaaaacugugacaauaccuacucagcccuaccaagaaauaguuacugcacugaaaugcagaaaagaagacaaagaaguaagcagccauauacuguuucacugcacguggauagauuucuauguguaacaauuagccuuuugucuuaaacaaauaucacuacauugcuagccacauuuugaaccacaaacguaccuuauucuacuuguccaauacuagugauucaaaaacauuuuuuuuguugccaucgaaugagugauuuuauaggcauuuuauuaaauauaaugagccuauagauuuaaauaugcuaaaguuaccaagaggcgggcuuauguuuuucuuggcaguuauauacuguuguucagcacgugaaacacuucaaugaugugguggaauuuggugaaaaucaagaguucacugaugacauugaauacuuguuaaguggcuuaaagaguacucagccucuaaacacacguugccuuagguaagaucuuaauuguacuuucuauaauguugugcaugcuaugucauuaaguuuuucaacuggauggguuuaaauuuguuaauaaagcuaggcauguaaaaaaucuugguguugauaauuagccauaugcuuuucaguuuccagaugcuacaagauuaaauaauauauacuaaguaaucugagauggguuuuuuguuuuuaaucucagaauuuaagccacugacugauagauugauuugaguagugacgugggucaucuuuuauauauggugauagauugaauauuguauacuuuuugaguugguuguauuaucuaugaucaguugaaauauauccaauaaaauauaacuacuucuaguuuuaaaauaauagcaguauuaugacuaugaaaaggaacuagaauuggugauuggagaaauacacuacagaaacugugcuaaucauuuuuauaaauuuaugcccauucauaaucuaagccuugguacauguuuuaaaauuuugguuugcccgugguuuuuauauuuuguguugucaauauuuuaagccuucuacuucuuucuuguuuggaauuauggaaacuacagcuaaugucuuagcaguuuuuagcugccuuaacauagucuguuuccuucuaguguuaucagcuuagcuacuaaaugugccaugcccaguuuucggaugcaucugagggcacaugggaugguugcaauggucuuuaaaacuuuggaugauucccagcaucaucagguagguauuuuuuaaguuucugggguugagaaguauuauuaaaaaaauuacaguuuuugucuauaucagaaaauacuuucacuagacauucauauaagugaauuaaagguugaguuuauuuuauuugcuugauaaguagagaugauagccauacauuuuugcuuuauauaucucauuuucuugaagacguuuuucuuaagaaaaguuuguuuauauuaaaauacuauucauuugucaguuagcauauuauacugaauauuuuauacuauaaaaugauuuccuuuauucagaaguuuuaaaauauuguuugauaguaauugcauagaaaaggguuuugaauuacagccauggggcuggagagauggcucagugguuaagaguacugacugcucuuccagagguccugaguucaauucccagcaaccaccugguggcucacaaccaucuguaaugggaucgguugcucucugcuaguauucggguguacaugcagauagaacacucauauacauuaaauaaauauaaaucaaucucuuuaaaaaaauauagccauaacuuuaaaguacuuagcucauuguuggauccggaaaaaagcugcauucucaaaaguaauaaaugguaaagauuaacgaaccaaaguuaauucuuaaugucaccauaaguuagaaaaaaauagucauuaccaaaccugacagugauauauugagguggccuucuaugaaaggaaauuacuuucuaaauacaaauugaguggcacaaaauuaaucuaauaccaauucuucugaaacuaaaaguuaugaaauuaaagugagcgaacauuccucuguacccagguuguacuugacacagaauaaugaggacaauaaggcacaaggaauguguuacuugcuuuauugacuaguuagguauagucuuaagauaaaacuuuuucuuagugacuucuuaaggucuuaacugugacauucuaauuuccagaaauacacuuuauaaacguuuaaucagggggacugaaaagauaauuaagcaauaaagauccugauuugguuuuuacccauguaagggagcucacaaccaccugugacucuagcuccaaguuucuggucuuuuugagcaauuacaccuauauggugugugugcauauuucucucucucucucucucucucucucucucucucucucucucucucucucucucccucccucccucccucccucccucccucccucccucucucucucucucucucccucccucucucucucucucucucucucucucucucucucucucucucucucacacacacacacacacacccuaaguuuuaagagaaaaacaaaaaacauuguuuagagagucuguauuuuggacaauucaaagucaaaaucaggugguuaauuauauacauuauauugaugaacauaauaauacagacuuaccucaaaugcucacauaucccaaaugcacaguauuacacagccaucccuugauaucagugggagacugguucuaggacaauaugacuaaauauuuaugcauuucuauaucgccucccuuacaauguaauuucuggauuaucuuuaauaaaauuuaaauguuauguuaguaguuuuuauaguauuuaaaaaauaucaggaagagguuuguauauauuaaauacaaguauaaucucuaugguuggaugaauuuuuuggauauagagugcauucuuaggauauuugucuaucaaagacugauuguguuaacauuaaucuaagacauaccaucuugaguauuuuaagcacauuuuguuaauguuuuauuaaaaacaguuacuagguucuaggaauguugcuuaguuuaugugcuugcuuaaugaacgugaagcccugggucugaccccuagcaugacauaaaacccgguauuaugcaggccuguaaugcuagcauuuaggaaaagagaccagaguaccaaaacuucaagguuauccucaacuacuacauaaugaguucagggccagccugaguuauaugagaucuugucaaaaaaaaaaaaaaaaaaaaaaugaaauaagccuggaguaguaugucuuuaaucccaggacaugagaggcagagacaggcauaacuguacagguuccaggcuacccugaccuacaugguuuacacaaugaguuccaaugcuacauagugaaacugugucucaagaacuccaacuacacaccuaacaaagaugugucagguuugguggcacauaagcaaguagaucuccaugcugauuuggucuccauagcgaguuccaggccauccggacuauguugugagacccugucuuuaaaaaaaugucguugaauuaaaacauuuuuuaaaaauccagccuuuaaguccagcacugaggagggaggcagggauagguugaccucugugaguucgaggccagcuuugccuaaauaguggacaggaccaccagagcucugucuugaaaaccuuaaaaaaaaaaaaaggguaugcuuguuucuuuuuaaaaguuaguuuaugaguguuuugcuugcuugugugucuggugcuugcaagaggccaauagaguuagaaauaguugucagugagccacccugugggugcuuggaauagaacugggguccccuggaagaacaacuaaugcccacucuuucugcugagucaucuccucagccuccuaguuaaauuuauuucaguccccuguauucugauggaaggcucaaauugucuauauuuuauggagggaaaauuguguuuugauacaaaguauaaacauauuuguuacuuuuuuuuuuuaaagaaaacaaaacuugacauaccuuuaugcacaaagaacauuaaagguauauugcaaaaggaaauauuuauaaauuacauaauucauaaaaauguuccauauguaccucauuuaacaaaacuguucaaagaaauggguagcgaaggaugauagagaggaaagcacaacuuuaaaucagaguuuuauuuaucaaauagcuauguuucccuaggcuauuuugaaagagcaguaaaucaaggauuaucagggucucuaucaaaaccaucuauaggaauauuagacaauuuagcuuauaagugucaguaauguccuuguuucugaaguuguuaguaauugcuuucaugaauauuucucuuuuggggucuguugaagaaucugucccucuguacagcugcucucauguacauauugaguagagaccguuugaacauggaucuugauagggccagccuagaucucaugauucggcuuuuggaguuggaacaagaugccucuucagcuaagcuacugaaugaaaaagacaugaacaagaucaaagaaaagauccgaagacucugugaaacugugcacaacaagcaucuugaucuagaaaacauaacgguggguuguaaaccuuuuauuuuuaaguaauauauauucuguuucaaauauacaugacaagguggaaacuucucucuugaaguguuuaaguuuggguuggguuugggggacagauaaaaacuuccuuuaagucuuugcuaauuauucuuccuagauugcaagggauuagcaggcugaaggauaacuaacuaaaucacugccuucagcccugcugauuauuucuucuauuagggcuaaacuuccuuuauuauaucaagaauuagauuacucucuguugagaaguggcuuuaggcuuuuuucuccacuucucugcucauuuuuuacuuucguaaaguuggcucuuuuuuaaucauacuuugccuuaaacuuuauacuauaguguggcucacugauaaguaugugggaaaauuuucauguuuacuauguucugaaacuauaaauccagaugguuagcacucuaacuucaggcuguugaaacuaaugaccguugaguuugaacauuuagggccacugacguucccauacuuuccuccuugaaguuuaucuuacuacauucuuuuugauaggucaauccaauauauugauuuauagaaaagaaagucggguguggugguugcaagccuuuuaaucugagcacuugggaggcagaggcaggcagguuucugugaguuuaaggucagccuggucuacaaagugaguccaagacagccagggcugagccucuguauugccauuauauauuauaugaaacuaacaaaaaguagauuacuuuuaaaugaauuuuuuucaugaaagcaagcuguauaguuaaaucaccguuucuuuaguguacacugauuaaaauuaguuuauucaccuauaaaagcacauacuguucuauuuuugacuuacugaaucuuaauaaagaaaaauaaauccuaaaauuaaugcaucagaauuauucuaaccuugugguggcgcacaccuuuaaucccagcauucuggagagagaggcaggcggaucucugaguuugagguaagccuggucuacagagugaguuccaggacugucagggauacacagagaauccugucucgaaaaaaucagaaaaaaaaauuauuuuacaccucaguauucauuaaugguauuucugaauuuuagacuggucauuuagcuauggagacauugcugucccucacuuccaaacgagcaggagauugguuuaaagaagagcuccgacuucuggguggucuggaucauauuguagauaaaggucuguauacauacaugcauacauacuguagauaaaggucuguguauguacaugcacacacagaguguuauauaacuugagucccaguacuuaggagacaggcagguggaucuuuugaguuugaggccagccuagucuacaaaaccaguucuaggacagccagggcuacauagaagagaaauacugucuuguaagcacaaaauuggagacacugugaucaaggcaauuuauagaaaaaguuuauugugagcucacaguuucagaggaugagucuagaaugagcauggcaguaagcaggcaagugcuggagcaguagcuaagaguucagaucuugccgggcgugguggcacacaccuuuaaucccagcacucgggaggcagaggcaaggggauuucugaguuugaggccagccgggugaaacaaagugaguuccaggacagcuagggcuuauacagagaaacccugucucaaaaaacaaaacaaaacaaaacaaaacaaaacaaaacaaaacaaaaaauauauaagcaccgaggagggagaugacugggaauguccugagugcuuugaaaccuuagagcccauccauauuacaggccuccucugacaagcaaauaucuccuaauccuuccuaaacagucacacagcuauugaccaagccuccagauacaugauccugugggguccauuuucauucaaaccauuguacuuaacuagcaucaggcauaaaauuauguucccauuccagcauauacguauucauagcauguauguagguaacguuugguguuagcuaagaaauaauuauugaacuuucauauacuaacuuuugucuauuuguucuugccuaguaaaagaguguguggaucauuuaaguagagaugaugaggacgaagagaaacuaguagccucauuauggggagcagagagauguuuacgaguuuuagagaguguaaguaugggcagcuggacggggaguuaucucuacuugagauuguaugaccacuugauguuuuaaauaucccggggguuuuuuaccuuugcuuaucugaauuaaaguuguaaggauucuuuucaaaaccaacugucaguaaaugggcauuuuaucauuuuaagaauguauuguuuugcuguauaugcugauaaauacuugugauccuaaaguuggaaaggaagauugugaguucaaggccagcaugggccacauaaauaagacccugucucaaaccaaaagcuuuuauuuguauauuauugcuuuaaaucaaaggugcauacaaguuuuuuuuuuuuuacauguaugugacuauaguuuucuuaauacagaaaucuguuuuuguuaaaacacgaacuuguuuaucaaacaaacacagucaugucauggcuuuguuuuaguuaguacgcuuuuguuuguuuaguuuuuaagucagauuauaagcacagcuaaaaauguuuauuugacuuuggaaaauaacacuguugggugacaguacguauguuuuggucuuugauuuuaaaugacuuaaccuaguucagcacaggcuacaauuuuacuaacagugaauuuuagaauuuauaauugcugauuaaguagauugguuagguacuuuuaaaaacauggaagagcucuuggcauauauaaauaaaauugcuccuuguagggugcuguuuacuagguuauacauuauuucuuuauuuaaaauacuuaaaugacuggcuaaauuggcacacaucuuuauucucaacacuuggaaggcgggugaguuucugugaguuaaagaucagccugaacuucauaguaaauuccaggauagccagggcuauguagagagaucauaucucaaauaaauaaacagacauuaaaaaguaaaauauuucaaauauauuuaugaauuuuaaaguaucaaaucuguauauuggagguuuucugcauuucaaaguacuugacaguuauguguaaguuauuaugagaguggugucuuuauuguaugauaaauuaguaguuuuuaguugggaucgcacuguguaacuuuagcucacguguaguucacuauguauaccaagauguuuuugaacucacagaugagccugccucaugaguguugaaauuaaagaugugugcuacauucugguuaguaguucucuuauuuuaaauauugaagcuauagguuguacagguauuucucugcaucagggcuucauaaacuuugccaucuauagcccauuuuugcccaguaaauuuuaaugugacccccaauauauuggcaauacuaaauagguacauaauacaaaaaguuuuaaaauuaaacccaagacagaaucaauaaauagcaauuugguuuuaguuuugguugguugguuuguuaguuuguuuuuugagacagagucuuuauauauaguccuaacugcccuaguacuugcuauguagaccaaccuugucucagacucagggaugcaccuaucucugccuccugagugcuaggauuaaagcucguacuaccaugcccagcuauuaaacaguaauuuuuaaagucagucauuuugacacaguauauaacccauggguauaccaguuugauacauacugaggaaaccauuaagucuuuguuauauuuaaucaagugacucauuuuauaagaccagauaauuuuguguauauuauaauauauagcauaaaacagacguguuucuuagcuguuugagcaguguuuguuggugugugacaugacaacacacaugaugcaaaauguucauguugugucguagaacuaagugaauucauuaaaugagccaugggugauaagcauuucuaacaacauuuuaggauucauuaugcauuugauuuuuaaugaauuugguucauuaaaaaugagaaauuuucuauacugccugcuuuuucaguccucgcauuuaauuacaccucuguaggucagaacuggaguuuaagaaauugugcccuuagaugacaagaucuguuucaucuuuuuauauuuuaaguuaucagguaaagugugguauuauuuauauaaaugaaaauuauggauuguuagagucauuuuauauccaucccuucuagguaacagugcauaauccagagaaucaaagcuacuugauagccuauaaagauucacaacucauuauuucaucagcuaaguaaguuuuauaaacucucauuuauuuaaaacucaggaaauaaagauguauucuauuuuuucuuaaaauguuuugucuguugaguuuugugaauauguacauuauagguaaaaaguuaagagugaagauucuugaaguaaaaugguuuggugagaauuguacauccuuuauguuagcuauaauccaggacaaaugacuuguuacaagguguuugugggcagggcaagaagccuggguacuaggaugguuuucaucacuaaacaaguagauauaucuuagcauauacuaccauauauacauuuuuuacaguguauauauaauacaugcaaagaugauguuuguuaauacauuuuaagugauuuuaagguguauguacaauauauauaaaagaaucaaauucuuuaagccuacuagaacauugcuuaguauauugucaaugguaaauauuuuaggccuuuuguuugaaguggauuguaacuccauuucugccacguauuuauaucucauuuuccagaucuuugucuaucucccugacuagccuucacaauuaggcuagugcugccaccucagugcucugugucucuaguccugguucugucugauuacaacagcugcuucuugcuaucacuguccuagauuuugcuagcucuguccuaguucucuggccuuuaucuuagccauuaugccaccgggauuuaacuuucucuggaucucugcuuugaaaaacuaaucuuaaauugcaauucuauaugacccuuggcugucuuuguaaauuuccuuauagaagaacaacuauuuuagugugaaugguccgguuuauuuguguauuaaccuuuuauuuggagaguuucaaauuaagagacauauagacugaauaaugugauaaacucuuauacuuagcuugaauaauacaugggugaaccuuguuucugucuauaaccucaucuuuuguguuauuuugaagcaagcuauaucaucuccauuuccuguuuuaauguaauuuuguuaauuuuauagcacauuauuauccuuaacauaagcaauucuuccuuaucaaggaacuuccuugaagauuaaauauguuuugcauuguauuuuauuuggcggguggugguugggguugguugauugauuuguuuguuuuuuaguagcaguagaaauggaaccuaugcuuauaccagccaaguggucugucaguuaguccuacucccugguuuuuuguuuguuuguuuguuuuuucauuuaaaaauauuauucgugauuuuaaaguuguuuucuuaugcuucuuagucucugagaauugccuuaguaaagaaguauuuaaugugacauauuucaucucuugcaugggguuuucuugugaaauguuuguagaaguggugauaaaagucagaauuggguuuugggaaauagcauucaccuauagcuuucaagaaaacacuuauagauacuuaguaauauuuagcacagacaguuuaguuacuaauagcaacagggaaauguugucaacauccucaaacauuaaagaagcaaauuuuuuagguuugacaguaaaagaacaucuuucuaaccaagaacuguaaaauauuaggaaccuuacaggauuuccucauugcauauuaaaaauaagcuaggaauagauuaaauauguagaauuuuucuuuacggguuugaugugguaugcaauucaugaaaaauaaacugacaacgccaguuuacuugaucuguguuagacuugaaaaaaaaauaguggauuugauggucgaaagaugccuuggcagcuggagcgaugacucagcagguaaagaaacuuguaguauagacuugaccagaaaccaugcaaagcuuuaagacgugcaucuacucuacaaaguugucuucugaccuccauaugggugauauggaaucuuugcuuacacacauaucauacacacuuauuaaaaauaaucagaauuuacagauagacuuguguuagcauucuacuuccuuguuagugugugucagacuugggaaucauuggauguagcugccagaagaccuguuaauguuccucaauuaaaaauaaugauuugucuuaacauaugucaggcauuuauuugauagucaucuuuaucgaguaacuuuuuuuuuuuaaagauuuauuuauuuauuauauguaaguacacuguagcuaucuucagacacuccagaagagggagucagaucucauuacagaugguugugagccaccaugugguugcugggauuugaacuccagaccuucggaagagcagucgggugcucuuacccacugagccaucucaccagccccucgagugacuuuuauauaugauacucuaccugcuaagaaagcauucucuuauuugcuaaauaacaacuaacuggaaccgagaacuggcauuauuucuucaggguuuaugggcgggagcaucauggugauauauuuuguauuugagguaucuguaaaaugugacagcuccugugaguaacacguuuguuuugugagccccccccccccauuguuguggugcuaauuguuggugugagacaggauguuauucuuuugucccagcuaguaaaaguaaacuccuaggcuaaaacaacccuuugccuuagccgccucuauaguggggacuguaaacaugaugcacaaacauggaaugaacuuacaaccuuaacugucuuuagagagaaauuguaaugaucaaguauacuaaaauuuugcaguuagcaaaauuauuagcaugugugguacauuaacauuguaacuuuaaaaacaggaaaacaaaacaaacuuaguauuuuuuuaggccccaguuaauaaauuauaccauaauuauuuacauuuuauuuucucuuaagagcauuacagcauugugaagaccugauucagcaguacaaccgugcugagaacagcaucuguguagcagacaguaacccucugccuuaccagaauguaacuaaccaugugggcaaagcaguggaggacugcaugagggcuauaauuggaguauugcucaauuuaacuaaugauaaugguaaguaauaauuucuuauguugcauuugcagauaagcuauucuguuuuucauguacugauuuacaauauuccuuaauauaauuaacuugcuccuauagucauaagcuacuuuuagaacugccuaguaaauuagucuuugaauaucaaaacucuguauuucauuaaagaaauaguuauuuuaaaauaaaaauuuuagaugaauacuucguagccgaguauaguguuuacaccuauaauccuaacuuggggcaaggcaagggaggcucagugcaugagguuaaagucagucugaacuacgaagugagucaagcaggauuagaguaaaacuaggacuaagaaaagaaaggaagggaaaacaaaacaaaaaaaucauuuuaaugugauuauuaguguuaucaggaagguuuuuguuugcauucuucagaguggggcagcacaaagacaggagaacaagaaggacucauaggcacagcgaugaacuguguucuucagguuccaaaguaccuaccucaggagcagagauuugauauucgagugcugguaaguucaaguguggucacuuuguaauuguacuuaucaugucuuuagaugaugaaacuuuguuuuaauuuggauuuaagaaucugucauuuauuauaaucuguuuuguuuugguggauucuuaugaacaucuucauauuuuucuguucuuaaaacauuuuucauagacauagaaguauaaaugaaauggugguugauaacucagggagcuaaguggcuugugccuguccuccuagcacuguaaagaguagaguaggaggauggccgugagucaaggccaggccagacugugccaacaauaagacaggucugcgguucauggaagccagcuaaaagaaagaacagugucugucuuacauagugguugcaaauggaaaaaugcugcuugacauuuuauuuacacaaaguuauauauauuacauucauuaaguucuugugugugaugauuauauuuuuaaauguuuuauagggauugggucuacucauaaaccugguggaguauagugcccggaaucgacacugccuugucaacaugcaaacauccuguuccuuugauuccuccuucucuaguggagaaggcgaucauaguuuaaggcuagccggacaaguucaugcuguucaagcuuuagugcaggugagcagcagugacauaauugcauaucguauggauucuauaagguccacugugcacuugaagucagcugagcuccucagccugacgguccagauucccugacagggucccuaggaucuucagaggguucuuggaccaguuuugagaaauguucuuuuguuuugucaaaguuacuaugcuguacauacugucuucaaagucuguagauuuagcacaccuuuuaaugucugcauuugauacuuggauaauucucauuaguaacuugguacuuuucccaaauagugugauuggguauauuaggugcuuuuuguguugaacaucauagcaacgaaaagaaaaagucauugaagagaagggauuugguauguccgcuuguuuguauggauaccugauagauaguggacuaugaauagucuuccuuacacacuuccuccagcgauaagaaugcuaaggauguaaagaccuaguucuagagcuucuauauuuauuguuuauauuuuagcuuuuuauuggucuuccgguuaauucauccaguauguguagguuugucuauuucuuugguuuuuaauuuuagaaauggguagggauuuuuaaauuugcuuuuguuuuguuuuuguuuccccuuuaauuuccuuggaaauguuaccuggauuaaagauaauuaauggagacuuuuaaucuuggaauuacaauauaaaucauuacuagauuacuuaaaaacaguauuugugccaggcgugguggcgcacgccuuuaaucccagcacucgggaggcagaggcaggcggauuucugaguucgaggccagccuggucuacaaagugaguuccaggacagccaagacuacacagagaaacccugucuugaaaaaccaaaacaaacaaacagacaaaaaaaaacccagcauuuguacuucaguuuugguuuucaguaaauguaggacaaaagcuuuuuaaaaucagauaauucuuauuucaaacacuaucacacuauguacauguuaguacuugaugucuacuuuuuuuuuuuuuauaauaucuuucuagggacuccugugucccucucacuucuuuaauuauaauuguuguacauguguuucuuuaauuacaauuguaaguuuauaguguuguucauguguguuuagugcuaaccucaggauugacuaaccucguaguaucuuuuuaaugauuuucaaaaauaauuuuuaucagcuauuucucgaacgagagagagcagcacaauuggcagaaaguaaaacagaugaauugauuaaagaugcuccuaccacucagcaugauaagaguggagaguggcaagaaacaaguggagaaauacaguggguaucaacugaaaagacugauggugcagaggagaagcagaagaaggaggaggaggaugaagaacuugaccucaauaaaggcauguuaaccugaaguaguaauagagucacagugagaauaaugguuuuugaguucuuuuuuagcauuugauucgcauauuguuauaauuuaguuaaugccuuuauaguuugucuagguaagcuuuggaauuacaguaguucuucugucuuugagcauggugugucagugagagaucacuuuucuuguuuggugcuucuccuuuacucuguacagagcagcagcuaaguugggcaugagagugcacagcuuaauucuagcaugagguaggcugaggcagaggaaugccacuuggaggucagccuggguuuuuucaaugagacuauguuucuaaagcagaaggguaugaaugucugagguucuuuuaucugccucaccuuaaacugaggcguuccaucaaaauuuacaggaguaguucucagagcuuacuaggcaaagaguaauaacauccuagcuagaggcaauaaauauccuuacuagugaauuuauugacuaccuacuguuuuuacgaauuauauuugcuguauauauguacauucugcauaauaacuuuuuguaacuaaaccucugagauuuuggggguuucuuguuugauuuauugagacaaaaaucucuauauagcucuggcugucuuagaacuuguucuguagaccugucuggcuuguaauguccaagaacucccucauuaguauugggauuaaggccugugcuaccacugccccauaaggcuuugaaauuuaauauauucaacacuuuccacuuagauugaugcugagccuguuuucuuucuguucggcuauuccuucccuaaguucugauacucggucucuuacuugaagaccugugguucaaucuaucuuaucaacuuauuucaguuggaugcauuuuauggcauuuguuagaacuauguuucuuguuuuuauagucacauguauguauguguauauauauauaugcauaugacugcauauaggcacuucauagucauuuuguuuaucuguuugugcauugaugaaucccuuuggguuguuuuaauacuuuuucacuaguacagugauauuaauuguuuuccagugugguagcaccagcccaucaacaauaugugaggguuccaguuuauucacaccuucaggacuaccuugaaggauauuuuucuuagucauuuuauuugaugaagaacuuuuuguuucauuuacagcucucuaaaaacugauuguuuguaacaucuuuguuuuuuggucuuuuuguguauuugaagaaaugucuauuugggucucaugccuacuuuuuaaucugguuauuggucuuuuauuaugaaauugaaagaauucuuuauaaauucuaaacaucuuaccagauuaauguuuauguacuuccacguugugaacugucuuccacuuuguuauuggugaccuucuaaaaaccaaucuuuuaaguauguugcacuuucguuuuuauauuugggucacuuauucuuuuuuuuuuuuuuuuuuuaauuugagauacugaauuguacaugcaucauuuuuaguagcuuuuaaggugauaacaguauaauugauguuauggggucuauaucagcuuugcacuguaauaacuacuuauuuaacuguuuucagcccuucagcaugcuggcaaacacauggaggauugcaucguagccuccuacacagcccugcuucuugggugucucugccaggaaaguccaguaaguagauaauaguucagaagugccucuuguaucuuugaagauuuuuugcaacagcuucaugccauuaauuaaccugaugcacuuaguuuaaaacuuucccuguucauacaugcuuuuuauuucagaagagcggcugacuguuuagacaguuuuauuuauuucccuguagaagaaaaugucaagaauauuucaauaacuuccuagugguuuccuuuaaacuuuuuaaaaauagaaugugaacaucuuuauuuccuuugcauuacaggcuuuuauagaaagaucggagauguaguggcuuguuuguuggucuuuaugauuuuuuagaacugauauaucugucauacucaaaacuguuuaagauguuaaaaagcaagcugggggagggggccucaggauguaacucaauuacuaaugugcuugauuagugugccugaagcccuggguuuagacccuucugccacguaaacugguuaugacaguuaugccuacaacccagcauuugagagaugaagguaguuggaucagaaaaauuauucuuggcccaccugagccuagagaccuggucucacaaaaacuuaauuagauacuuuuaaugucauaccaaaggauuuacauacaagaaauuaaaauaguuugggauguuaaagacuuuaaaauauuucuugaccuuuuuaaggauacauucuaaagaaagaaugauuuuuguuauaacagggaaguucuugguauggaugauuaagucccugcuguuaccuguaguugauguaaaagaagggaggguuuaaaaccuaugcucagcuggccaagucaaauuuggcucauuuuaguggcgcaguggaguaacuuguccugcacagguuuuauuguccuuuuucuugguuaaaagcacucagcaugggcuggagauucgggcgcagcucuuaaaagcacuugaugcuuuucagaggauugggaguucgguuccuagcacucaugucaaguggcuuauaaccauuuaugagaucagcuccaagguauccagugccucuggccucuaacaacaccugcacuguaugcacaaacccacaugcgcacauauauacacgcauauacacauauauacacauaguuaaaaaccgucaaaauaaaauauuuuuaugucuauaaaagcacuugucauggucauaagugaucauacuuaagguccaaucuagucaaauaaugucccacaggaccuccuccucauuuucuuuuuaagacaucauccuuggacuucauaaccaucuaucuggcuaagcauugggccacaugcuucaggcuaggaauauguugguagcuuauguucaucaggaauuaucccugagaaauaugugucuauuuaacucuguagucacacagaaggggagguuauagguauugggacagucuguugccauuggaaaaaacaaauuugaacaucaaauccacaaugugaacaggaucuuggaagcacuguuaguguucccuuuggaauaugugccacagguaguaguagguaagugaaaggucaguaguaguugccuuuauuucuaauuguugugauuaauacauugggacagucauguuuaaguguauugauaauagaucuugaaguuguauuagucugaugugugaucauuauggauaaucuguagcuuuugugucccuaaaaagggguuucugaauuuguugacaguauuguggaguuguuacagccacagauaugguauauuauggcauauuaguuguuuugucaauccuuauaauuagaaaacuagauauuaccacaaguacaaagugaauuggcuuucccauuguggaaguggaagagauaaagcacacauauaauuacgggcaguaagcugucccuguucuguggccccaugcuuaggaaguguaagaacgucugauaccauuuucuguuuaccuaccuugacuaccaauuugcacucacuaccaauuugcacucacuaccaauuugcacucccugcuguuguugguucuugccucucuguauucuuugacucuagcacaguuucacaagaucuagcuuucuuaauuuaucucugucuugucaacggcaauggaaugguggauugacuugucacuuuaagaacauacaguuacgccugcuucucuuguuuaccaaugccagcaugccuuuuggauagcuguuaugcuuuucaaauaguccaugcuauauuuuuccucuuugaaccuccuguacuaugaauguuguaauguccuuuccauggccacuauaaaugucuaguucuauauccaaguaaagaggaauuugaacuaaugaagugcuuucauucacaucaugggagcuauuuauuauuguagagacauacuuuuuuacugagcagucauucagaguuaccucaaccauucuuuucuccaccauuauggauguuuacaugugaugaugauuggacuacuuuuguagaucaugguuauuuuagcaggccuuuaaauuuaaacuucuuuggauggauguuuugucuguauaauaguuuucuuuuuauugcuguaaaaagaucaugaccaaaaggacuuggagaggaaaagguuuauuucaucuuacaguuuauaguccacuaugaugggaaguugccagaaacuccuaggaauccugcuuacuggcuugcucaacuuuuucuacaaucuaagaccaccugccuagaggugguugucugccccaucaguuaucaaugaagaaaacaccccauagacuuguguauaggucaaucugauggaagcaauucaauugguguucuuuuucucaaggugacucuaguuuguggcaaguugacagaaaacuagccagcauauucuacauguaagucuguacauggagugucuugugccuggaggccagaaggguauuagauccaauggaacuggaguuaaagacaauuaugagccauuauauauauguagaugcugggaaucaaacccagauucucugguaaaacagcuaguguucuuaacugcugagccaucuuuguagccccuauuuuaggaguuuauuauauuuuuuuucauacauaaacacacacacacacacauuuuuuauauauauauauauauauauauguguguguguguguguguguguguguguguguguguguguguguguguguguguggaggggcgcugguuuugcuaauaaucaaauaaaaaaagucaccuuuccuggaauuugccccauaauuuaucacaaaugauaaguuuuaaagauuuaguuaauuuuugucuucuaauuuaccuuuguagcauggagaauuuucuuucaucuuucuguuuuauaagcaccucuguguguagagucugucuauauauuuaauuaacugugcaguuuauuucaaaccuuucucugcauuuucaaaacuaaauauucacagauguuucuuuguaccuuuggcuuuggcuagcuuuguuguuuccccuuuguuucuguggguagggugguauggaguggggaauugacccgaauguuucugcacaauagguaagugaauguggacuggaaaugacguaugaauuuugggguccuuuguagaugacuacgggauauguagcagagccaacagcaucaagugaguuacaguaucauuuuuuaccagcuugacuguuuuuaaucuguuucuucagaucaauguaacuacaguaagggaauaucuuccagaaggagauuucuccauaaugacagagaugcuuaaaaaguucuuaagcuucaugaaucuuacgguaaguaacuuuuauuguauauugcaguuuauaugaguuuuugauuauuuuccagacaaagucuuaacacuguagcccaggcuggcaauccacauguuucagccauuggaccagugggaccuggcuaguuuauguguuuuucaauuuaaauguaauacaucgaaggugaaaauaauaaucccauaguguuguucuucccuguggcaaaauaguuaacauaagcagcuuacagaagguacauuuugguuuauaguucuaaauuuuuguguguguguuuuuuuuucuguuuguuuuuguuuuuuugagacaggguuucucuguguagcccuggcuguccuggaacucacccuguagaccaggcuggccucgaacucagaaauccgccugcuucugccucucaagugcuaggaucaaaggcgugcgccaccaccaccaggcuaguucuaaaauuuuuagucauguguggcaagagcagcguggaagagcagaguggccagcuaauagagaaugccuguguaucugcuuucuccuuuuauuccagcugugcuucuaggcugugggaugaugccacccacaaacagaaaacuauuguggcagaauguuauauuacuaaggcaaugauuuaauuucaguguacucuuuacuacguagacuuugauacuuuuuuuuguuuaccauuuuguuaaguauuaacucuaauuucucuccuuccccucuuagugugcuguuggaacaacaggccagaagucuaucucuagagugauugaauauuuggaacauugcuagcugcuuuaccuuugcuucaggugcuugguaaugcugaagcuauccuuagacaaagaaaagacaugaaagaaguccuugaagauauaccaagaacauucaucaguaucauucauucguguuuggauuuuuaugaucacccgauuucuucaucaugcauucugcguuugcuaaaugacaguuacuacaucaaucugcagcuaucaaaaaugagggaaaagguucaggcuguuaacaaucccaugcaguauuuaaauacacuuacuuggcagagucuauaccugccccuguuuccuugcuguauuucaggcaagguuuaaagagggcaauuugugcugcuguuagugcaacugcuguguauguugagccacuguugucaugccagucaggugcaaaggcagcuuagcuacugagguauugaauguucugaggacauucuagacaacagcuuagauccuuuuucaggcucauuugcuuuugcuuuuuguugaaugauuccaaucguaaauaaagcuuuuaauaauuuugugaauuuuuugguuguuguucccugaacuacugucuauauuuaaaaugagauggaauccaaagacacaagggauuaauaguauauuuuuuuauucuugauuagguuuggguguugaacuauuuuucacuucugagaccaugaccauauucaaugucauaccauuaugugucauagcuauaggcacaagaaaacaaauagcaguuugagggaauauuauguuauauaagauaaugugcccuguuaaaggauuaagcaaaaauagacaaacccaggguaguuuacacuuaaugcuggggaggcucuugaaacauuguuacguuuugagggacguucucuagauauauuuucuaauguucaguucaguaaauauaauaaggaagcuaaaacaccaauguggaauccguuuuuccagauagcguguauauucuucuauagagugacaggaucaauugcauaagcgcaaagccuuaaaauugcugguguagagaagacccuuuuuuauucagauucuauguucauagagcaauuguuuagaaaaugguuguggaacacacagaacaugguuuauaggguaaauuucauagauuguuuuuucuuuuuuuuuuuuucuuuuuuuuuuuuguauuguucagaccacugguuauacauuuucuccuuuuuuuauuaauuggccugaggacaggcuuuccagagauguuucauuaauacuuuuaauuaccuuucagauaguuacaucauguuucuucauuggauuuguaaaacuuaaagccauaaaaauauuaguuugguguguauuggggaaaauagcuaaaagucuaacuuugacucauuuuagacuuuguuauuuccuuguauaaaguaacaaaccggggcucuuguauccgugccagcuguaauguuuuuaaaugcaguggcugccuucuauugucuuccuauuuuugauaaugcagauuguugggaaaucuauaaggaaguaacugacucuaggcaaauuguuuucuuccuccuacccgcccaacccccuacccguccgucaccuuuuaggaacacaguaugccaguguaaugugggaaccauugagacuguauuugcccugaguaccaaacuaauuuagugaauuuuuuuuuaaacauacugguaaaugauguccacaaauuuccuuagauauauuuuaauuaauugucuuaaaauacauugauauuuauuaaucauuggauuuggggacagauuuuugacuguggcagaugguagggaacagaacaguaaacaguuggaugagaucaaucagggcgaauuacauuuuucuguuacacuggugaucauuugagaauugauuuaccucaguguuuaacaguuuuuguuuuguuuuuaaaauacuaacuaauugucaagcacugaugagaugcagguuugguggggugggcugugaggaagaccucaccuuaccaacugcagugcgucucuguguuuuagccucagagaacucucauucuaggguacuugaggcugacuugcaaagugacuaaaguuuuaagguaaccuuuuuuccauuguaaauacuucuguaaauacuaccaguuggauauuagaacaguaggauacuuuucugaauccaauccuauuuuuauuuuauacaguauuucucagcugugaucuuuggagcaaaagccaacggcaggaaaaaauaguuuguaccaguuucaugaaguaugucuuuggguuuuuguaaauaauuuuaacucaaauaaaauugauacuuuaaauacac

SEQ ID NO: 7375 - RNA, 616 nt, Mus musculus
uuuacuuuaucugcauuuauuuuaugcugaauuuauuccugggccaugaguuuuuguuucuucaguuucuucugggauaucuuuuucuucugugcagccuccucuucuggcuuuggaacgaucuguuccuucucagugaggaucaucucacuguggcagggggagcucauguguggguuaaucccgaccacgagcucuguagguucgucggugcauuuuaggugccuuguucaccuggauguguucaaugacuagagaauccauaucuaaacccuuaaguucagcauugcaucugcauuuuuaaucaugugcagcaaaaauucagcacucuuuuuuggcuaccaucccuguguccagccccacuguuuagccugggugcaccuaccaacuguaccauuauaccaccagaauggcacacacuacuucuuuaaagugacauccuucagauacuugguggcuuugcggauaugcauacccuugauggccugggcaguuucccggguguucuuaaagugaacacgaagguuugacacucuugauuugcaugauuuugugggguuuucugggucaagagaguagcgaaccaucuucacaggucaccucuggccgcuuccuu

SEQ ID NO: 7376 - RNA, 616 nt, Mus musculus
aaggaagcggccagaggugaccugugaagaugguucgcuacucucuugacccagaaaaccccacaaaaucaugcaaaucaagagugucaaaccuucguguucacuuuaagaacacccgggaaacugcccaggccaucaaggguaugcauauccgcaaagccaccaaguaucugaaggaugucacuuuaaagaaguagugugugccauucuggugguauaaugguacaguugguaggugcacccaggcuaaacaguggggcuggacacagggaugguagccaaaaaagagugcugaauuuuugcugcacaugauuaaaaaugcagaugcaaugcugaacuuaaggguuuagauauggauucucuagucauugaacacauccaggugaacaaggcaccuaaaaugcaccgacgaaccuacagagcucguggucgggauuaacccacacaugagcucccccugccacagugagaugauccucacugagaaggaacagaucguuccaaagccagaagaggaggcugcacagaagaaaaagauaucccagaagaaacugaagaaacaaaaacucauggcccaggaauaaauucagcauaaaauaaaugcagauaaaguaaa

SEQ ID NO: 7377 - RNA, 15239 nt, Mus musculus
cuauuuaccuuuuguccggauauugcgugacgcugugagucgcgcgguugcggaggagcgggcagagggaggucgcacacucugaguuucggugacccggaagggagccccgugguagaggugaccggagcugagguacugccucgcgaggccugagaauuccaguccuugugacgggcgucggcacagcgggaucugggcuggcugcuacgggcggggcgggaaggccgggcucguccucgcucuucaucucccugggcagagggaugcugagucagccgcucggggacccgcgcgggggcccuagcugucggcgaucgggugccguggggguggugcguggacgcggaggcagcgggcuagcggugagaggggaggaccgggcgcauccgaacacucaagcucaaggaagcguuaggaagggucgccacuaguucguagagacccagcccaggagccgguuucagacguccagaaucugcacuuaaauauauggcagauaacccucuuggcuguuccacgacauaaggccacgcagacuagguaggcucuguucgggucaguaagcugaagccauagguugagaugauguaauggcaugaaaguaccaaaagggcuccggguuuuuuccgcaaggucagaugccuagagcugugugcacuucguaguuccggaaauucuuaacuuuggaggugcuaguuaaaacuucuuuacauuccuauaguuuuaggguaauucaugggcgauuucaaagucccauuuuggccaaguuuucuuguauuuaaauauuuuacaaauggggagaaagcggaaauacaaaucacuugccuaaaauucaucacaacucauugaccagaaaugugccuuuagcaucgcagaaaggcguguacuuaacuauuuaucgauauagucuaacuggaacugagacaauucaauuuuagaauguugggggcagggguuacccuauuaagaauaccagaagguguuuuaacagggaaaccuagcagggcaauuuuguuuauuuugauugaauguuauguaguggaauaauuuaauuugaauguaucugucguaucuuaaagggaaguaacaucugaccuacuugguagacauuugcaugccuggcuuuuguucaugguuuuuagucucgagugguuuaguuaucuuuucucuggaugauguuuuucuugugcugaaaugucacacagauucuuuuacuuuuacucauugaaugauggaguaaauaucaggccaagcuauguuuguaaaaucugugauugugucaacauaauaacauugauucuguauuacauauaucuggucaaacuuggauuuauaucauuggcugcccauucuaaacuagauuuguugagucagaaggaacaagggaaggauacagcauuaaaaauuaaugaggccacuguucugauuuuuuucuucuauuuaaauuaaguuucuucugauuuuggcuacuauguuuccuucuuaauuaacuaaauuuuuccccccucuaccuuucuaacuagcauuucagaucugcuuaguaaaccgguguaucgcccaccauguuggcugcaaggcuugugugucuccggacacuaccuuccaggguuuuccagcccacuuucaucaccaaggccucuccacuugugaagaauuccaucacaaagaaccaauggcucguaacacccagcaggguaaagcaugcuuuuccaguauggauuuccgccccauucagauuuucuguuuuagaauuuggugguaauggugguugauuagugggcuguucugugaguuucacugcuugggaguagcuuacucuuuaguuaguuacuguaacagugauuuuucuaaagugacaguaaaguuuccagugagcuuuguccuugccacuucacaucauuccagucccuccuuaucacaaaugcuuuaagagggguccugcaccuuucccauaucuaauauauuagauaacuuuuauguccauacuacauuaguuuaaaaagauccuauguuuuauuguagcucugggugauaugucuuuuuuugucuaugucaggaauaugcuaccaagacaagaauuaggacucaccgugggaaaacuggacaagaacugaaagaggcagccuuggaaccaucaauggaaaaaaucuuuaaaaguagguggaaguuaaguauuuaaugugaagccugugcauguguuuaguccacaaacagccuccugaaaauacauucaaacauguauauauguauuuucugcaagaaaagucguacuucuguuuuuggggauccaauaacccaaaagagauuggugcuuugcauuggguuucaugguuccugguuauauuaagauuuacugguuuuagaaaaaccaaauuuauuaucauccuauuaucuaaaaugguagagccuguuuagggaguuuauuucaaguuauuuagaaucuucauucaagcacauguuugugaaugucaauuucuauuuagucauguguaugucugugugacugugccaggugugugcugaggccaacagaggcuagaagaagguaucuaaucaccugggacuaggguuauaggugauuguaugccaucugaaguaaaugcugggaacggaacugaaagaguugcaaagggcucuuaacuacagagccauaucugcagccccuuggaggguauuaccuuaaugaagccauuuugauucauaguuuggauuuuaacuuugaagauucugaaaccagacugccagguugcuaaucuugccuacacuauuuaaacagaagcacuguacuuaauaguuuucgaagugucacuguauuauauacugaggagaacccuaucaguaucaugaaaagcauugcuuuuugauaaaagucuugaccacagagaagaaaucaagauuuuccaguaacauuuuuaaugaacaaauuuaaguugaagagaguaagguguggucuuuaugagcaccugccucaguagaguugauacauuuucauuuuuauuuuuauuuauuuauugauugauuuauauuccgagaccaggguuucucuguguagcgcuggcuguccuggaacucacucuguagaccaggcuggccucgaacucagaaauccuccugccucugccucccaugugcugggauuaaaggcgugcgccaccacugcccagcucauuuucaauauuuuaaagcaagacuaucugccccuuuguugguacauaaacaguaguguuuuuguuuguugguucucuagagucacauaaagcuucaccuggguuaauaccuuaggcacaauauggaaugacugaugccauuucucucgcauuuuuccuuuucuuuacuguuuguugaguauuuauucauccgagauauguucuugcuguguaaauccaguugccaggcugaaacucaugaucuuuugcugagucucccaagugcuuuaacaguuguguggaccucuuuaucaaacugcuccuuuguucuuuguagugacuguuguacauuuguuucggaaguguccuucuggucugcucagguugagaacuaucuguauccccaaggugacuaccaugaagaaauaguuauaauuuguuccccuccugacuauuuugacucauuaccccagcacuuuaauuuacuugaauugugcugauucuagccuguguuucuugcugugcuugcagucgaucaaaugggaaggugguuuguugcuggaggagcagcuguuggucuuggagcgcucugcuacuauggcuugggaaugucuaaugagauuggagcuaucgaaaaggcuguguaaguaaaguguucccaaacaaccaaaaccuuuccuucaaauaaacgcuccuguuuccuucccauuccgucucuagucacuuuuggaaugcauugucugguuuucauuuguaaauaugcaagaauguauacagucucuuguucauuagucauagauuuauuuaagccuaaauaagaaucuuuuaccaagguuauauauucagacaagaagaaaauguauugguuuuuauguguuuugguuuuuaugugguuuuuuuuuuuuuuuuaauuuuuauuuuaugaguacucuaucucauauacacccaugugccagaagagggcauugaucccauuacagaugguuauuagccgccaugugguugcugggaauugaacucaggaccucugaaagagcagccagggcucuuaacugcagagccaucucucuagccccuaguuuuauguguuuuuauauguaauguaugguuuaugucauuuaaucuucaacagcucuaagaaguccauacuuauuuccgucauagacgagcaugguaaugcaugccuuuaaucccagcacuugggcgguagaguccaggcaggacuacauagagaugcccaucaucaccaucaccacuaccaccaccauuaauuacuauugccaucguaaauaagguugaaaccauuaaagugauuuaucccagagccuuuuguaucuaaugaaugauuuaaucagaaauuauacccauacuucugugaacuaaccuugucacauuucuugcagaauuuggccucaguauguaaaggauagaauucauucuacuuacauguacuuagcaggaaguauugguuuaacagcuuugucugccuuggcaguagccagaacaccugcucucaugaacuucaugaugacaggcucuugggugguaaguuagcuacuugcugucuuuguggggaaggugauccuggauguuugguugcuuuaguugcuuuuuuguaugaagaucaaaagauuucuuaaauagggucauuaguauauuucagcagcacuauauuaauuucuuguaacagugcagaaagcuugggcuuuggggacaggaauugcacacugaucugcaaggugauuuugcauuuacuuuauuuuucagcaaguggguacaaaauagaaguuguuuucuaucugcugcuaauuaggaagagucccucuaaguucaguuuccaacucauaauccuauugaaacauguacuuaaaaaugaugcaguguucuuccauuuaauggccucuuccuuucuuauaauauauuuagcaauauauuuuucuucccucuaucaagaacugaaccuauguagcucagugcauucuaggccagcucuuuuaucauuauuauuauauuauuuucuuuauuuacauuucaaaugcugucccaaaaguccccuauacccucccccugcccugcuccccuacccaccuacucccacuucuuggcccugcuguucccccauacugaggcauauaaaguuugcaagaccaaugggccucucuuuccaaggauagccgacuaggccaucuucugcuacauaugcagcuagagacacgagcucuggggguacuggcuaguucauauuguuguuccaccuauaggauugcagaccccuucagcuccuugggugcuuucucuagcuucuccauugggggcccuguguuccauccaauagaugacugacugugagcauucuaggccagcucuuuaccacuaacuagcauuguaugauuucagaugcggguugugcugcucugguggagauccagagugcacuguguaguaugugcaguaagaaauagacauuugaaaaugaaguagaaagucagcuugaaaaacugccuuggagcaucagggcaguucuguggaggagacuugguucuucaggguuggugcuggcuaacauguuugauugcaaaagaggacagagucaguccaggcugaccaagcagcugagcaaaggagaagagcuaggcagaccgaaugggaaaagugcuuuauaguccauuugagggaaaugccaaggcuugugaggucuaaagggugagagguugugguuagaaaggguaucuuucauuuccaagcugaggcaaaguacauaaacagagagcacuuguagagagugggguggcuggggaaaaugugguucuguugaguguuaagaacgaaugugagagagagacucauaagcaggugcaccagcugugccaugccucugcgcgucaaaaugacugaucagaacagucagucuaaugugugcugcagugauugugagcaaggcacgagauggaaaucaaacacuuguuuccuguaguugggaacccagaacuaugaguuuggaaucauauuuccugugccuugaacucuuaagacaagaaucauggggugcuggggagauagcucaggagguaagagcacugacugcucuucugaagguccugaguucuauucccagcaaccacaugguggcucacaaccauuaguaaugagauccuaaacacucuacugguaugugucucaagacagcuauaguguacucauauaaauaaaaauaaauaaauaauauuuuuuuaaaagagaauucguuguggggcacacuuuuaauucuaggaguuggaagacaaaggcagauggaucucuaaauucaaggucuuugugaucuacauacuauguucuaggauauccaggaacuugacucaagaaaacuacugccagccuugcuacaaacugaguucuuugacagugaggguugauagaagaccuuguucucaaaaaccaaccaacuaaauaaacauaaaacaaacaaaagaaaaauaaaucaaaccaacaaacaaaaaacauccuggcagagcagugagauaggucagcagauaaauuucuaacugagcuccaaaugcaaaccugaggucuuguguucaucucagaauccacaacaggaagaagagaaccaguuuucauaaagcugugcucucaccuccacaugcaagccauuacuguauauacauaucauaaaugcgcagagacacauucauacccuuccuuucuaccugaccgaaugacuuauugcaggagcuuuucggguaggcucuuugcgcaauagugacagaucugucccauccuaauggcacuucaagauguuaggucucaaaccuggaacaaauggcugaggugucuauuuaacauaucaaaauagaccagaccaccagguucucccuacaucucucaguucccaccuggcacugagcccuccuggcugacguacucucucaguacucucucaguacucuuaagcacugagccaucucucuagccccacagugacuucuuagaagcacaguggauacaguuaaggaagugugagguuugggaguauuuuucuaauccuacccauucaguaucacuaauguagaauguagaaagauaaaaagcaaaauacuaggaucuugaaagaaaaauauacaauugagauauacaacuaggaauuucuaugaacaaacggugugggaagcaguuuuuagucauuguuucuccauuagaaaacagugagguagaauccuuuauguuuuucagcaucaguuuguuuugguuuuugucuuccauaaaacccagcuguuuuauuuuccugucagguuggaaaugaugugucuguggcaguagagggcgcucuugcuaauguagucaaugcugaaaggaucuagaaacagaagccaaacugugcuggauaaacucacgggauucaguuuaguauucuucaaagugauuagcuguacuugaaugugugguccucucauuuaaggaucuguuucucuuaugugugucuuccagacaauuggugcgaccuuugcagccaugauuggagcuggaaugcuuguacacucaauaucauaugagcagagcccaggcccaaagcaucuggcuuggaugcugcauucugguauguucuguuaaauucuuauuaaauugucuuguauauuauucacuuuccuguuauuugucugacuuauuuuccuuuucaguuuuugagguaugccagacugcccugcaucuuccuaccuuccuguguuagucucuugacacagcagacuuuuaaauaguggccuuuuugaguggcucuucaguuuuaaaugacuuacuaaaccucauuuuuggaaaacacaauuucauacagucacugcugguacauuauugccaggccuucacuuuaaaaguauugguauugaagguugguaugaagauagcucugagguuaugcugugagauaaacuauguauaagaaaagagcugagaugccagcaagguagcucagcagauaaaggcauuugcugugcaagccuggcgaccuguguucaaccccuggugggguccccacauaaagauagaagagaaguagcccuacagcgcuguccucugaccuccacagcauuacauguauuucuccauacacucuaugcacaaaugcuuuuacagcaguaacuuaaaacaagagccaggucugguaguauaggccucuaguuauagcuacuuacaaggaugagucagggaaauuaaagacagccuaguaacacuggacccucucccaaaagacaggugcaggguauguagcucagugcuauuaggcuugcugcacacacuuaucgccugauuccuggcaucaugaaaacuaaaggaacaacuuuacauuauuccucuguugaaauaauuuuguaauguaggaucguccaguuggggagauuuuguugauguuugguaauuggaaauaauaugccacuguaauauuuugcuguuuuguuuuuucaagacagggucucacuauguagcucuggcuguccuggagcucacuauguagaacaggcuggccuccaacucaaagagauccgccugcuucugcuuuccuagugcugugauuaaagacagguaccacuaugccugccuacccuguaauccguaaggaagauuuuuguaaauccugacaacugagcuuucuucuuaaagguugaaaagagcuguguuccuuauuaggugaggcaaauucagugucugccugucuacauuucaguuccaccacacacuucccuuucaguucuucccuuugagcagcaggucugaccuucagcugucugcuuugugugaguucugucuuaauaauugugaaauccaguaguggucuaagaucaaaauaguggccuuuaguaacuuuuacaaacuuacuaaaaaugcaggcuacuguuggaauugugacccaguauugaugugguagagaguuuguauagucauauauauuaauuguauaauuuagaugguaauauagaacuaccuaaauguaaaauuuguuguguuuacauugcuuagcauaaggaucaccuucacagugagaucuucuccuugaugaucauuuaguagauauucaauaagacuuuguugucuccccaggugugaugggugcaguuguggcuccucugacgaucuuaggggggccucuucuccugagagccgcaugguacaccgcugguauugugggaggccucucuacuguggccaugugugcgccuagugagaaguuucugaacaugggagcaccccugggagugggccugggucuugucuuugcgucuucucuggguaagcugcuaugccuuaaaggguucagguacucugaagaauuaagauuuaguuuuuaaagcuauuuaaaagauuugauugggguuugauuauuucaaugcaucauaaaaucuuggcuuauaguuaacuauucuuuuuauuaaauuacuuggaaaugaucaagcugacuuggaaauugcucuaauguucacaaguaacccauuggagaaaugacuacccauaaaauguauaaguaccuacucaaaugucaagaaauacaaagguagccuuaaauaauggaaacuauaaauccaguuguaggagaauuuuuuuuuaagauuauuuauuuuauguagaauagcacacuguaacugucuucaggcacaccagaagaagacaucggcucccauuacaaauuguugugagccaccauaugguugcugggaauugaacucagaacgucuggaagaauagucagugcuuuuaaccgcugagccaucucucuagcccaggagauuccuuuuuauaaaauauauauauguguguguguauguauauauauauauauauguaauuuuuuucuuguuucagggucuauguuucuucccccuaccucuguggcuggugccacucuguacucaguggcaauguaugguggauuaguucuuuucagcauguuccuucuguaugauacucagaaaguaaucaaacgugcagaaauaacacccauguauggagcucaaaaguaugaucccaucaauucguaaguaauccuuauuguuacuacuguguuccaugguguuuuguauuguguguauuaguuucacaggguaccaccauaacacaguagcauaagacagguggcuuagaauuuauucucuucaguuucugaggcuagaguauuaggcaggauggggagcucugaaggcucugagagagaaucuguccucugucucucagcugcuuaugagugcuggugauccuuggcuaguagauagccaccucgaccuucaucugccauucuuccuugccaggguccagccccagcaugugguguuucuucuuucuugucaguucuucuugaggcugcagagggggaagaggguaggcggaggguaagacuuugucuuacgaguuucugggguaagacuuugucuuacaagaaauuuaagguugcuauauaauaaaaaguuuacuuaucuaagucuaaguuacuaugcuguuguagcugaccugccuucuguguuucucugaggccagaaacugcagucucaggcacuuaguaccccauccuaaaacagcaagagauuaaguaaaggauuaauugcuagagccuuuucccuauugcccagaugccucuugcuugucaggcuagagggaaguuuggagcaauaaacuucuauugaaccaggagaagagaauaacacucgcagaaggaaaaacuuuuacauaaacaaauaugcauaaugucacauaaauucauauucagcuucauucaugcucauuuauucauuuucauucaaacccaguugggcccagcuugcaugcauucucacaauuacacacaaacacacacguauucauucucacaauuacauacugccacagacacauggagcaaaagaccaagcacuggugcagaaagaacucacucauuuuggaugaaaaaugcgcuccaaucuuuauuacauagagaaagaaaaggcuucuaccuuuuuaaugcuaaaugaaucaaacccaugcuuguaagaaaacaagcuuuguuucuuuuuaguaagacuaaaccugccuuaugguuaaggagaagccugccugcuucucucugcaacaucaucuuuuuucucuuucucucugcauucugcacauugcucucuuaguauuuuauguuaccuauaauuucuaaguuacuccacucugcauucuccuucuaaucuaaaaaguguucugucuaaaaacuccucagcucaguugcucucucagcucaguucuucucaccuccguuccucucaccccagccccucagcucugacucuucucuuuguccucagcucuuaaacaucauucagaauacaugaucacguguuaaaauguucaucaaaauucacacagaaaaucaaaucauaaauugaaauagaaguuuacagcagagaauauuuacaugcguauccauuaggagugauucaucacuugucucagcuccacagauucaccaaagguuuaaaacuauaacuaaguuaagagaaguuuggcauagauaaacccagucaauauuuuaucuucuguccuagcaucuauaauaaaccauuauuucccuuuguaugaccuuugguuaauuguuuuacaaccucuuggaaugugcucugaguaugagaaagucugguuaccaucuaagagcagcuaacuggugacacuugagagacuggcagaguucucauugcagcuuugacuaucagaaaaggaccuaauagaagucccauuauaaaaaagcuuaauaaucacagauagaauuuuaggaauucuuauaggaucaucauuaagauuuaagucaucuauuugucucuauagcaucacuacaagacagcacaucucuguggaucugcagagaccugcuccaaagggaugugcuacuaagugacaguuauauguguguaauaauaacaggaaaagcauauugauagcaggaaucuuuccugaaaugagucccucacagccuugcuuaaugagagcucaccaguugcagguuauauaauccaaggcaggccacuucaggaugaucaccugcuaguuauuagcuugucccauuauggcuccugacacucccuauguuguauaucugucuuuuaauaaggccaccagacauauucuaguauaaugucauuccaaauuacauuguaauuauaucuuugaauaccauacuuccaaauaagcaaauaggacuaguacugggugucccuccagcaggucaaaucuugcuacuucuguuggaguagacaguagaaaacugaguacaaugcagcugacuagagcauuuaggggucaguuacguguccgaccuguuggaaugcacauaauuaacuggaauguguaaggaaggaaaacagcccugaagacacuucuccuugugcguguuuuagacggacucaacucguguugacauucaauaauauaaaauaguguucuuucuuuuuucuuggauucugccuagaguuucagagugucucucacauuuuuaguaacguuuuccuuuaccuaaaaauaauguaaucgcuuuuuuaaauguuaauauaacacuuguaguuuuguagcagcuuucuuaaaggggguaaaguggguauauuuauccuacuugaaaaugccagacuguguuugcaaguuuuuuaaagguguguuucuuugaacuuuuuugguuauuccauugucugacacccagguuugauagucacagcaggaugucagagaacagauaguccuuuaaaaauuguguccauaucuaaaaggugauugguucuacaagaaggaagucugaauguuaucuaguuuaggacuuuaacuaaccuuaaacauuguauuuuuaauuuccauuuaauaacuaacaauaggaauaacgaguguuuuuccuuuauauugaacuauauaacuauauaacuauauugucauuauuauuagaaucauaucuaucuguaauauuuuuucuaggauguugacaaucuacauggauacauuaaauauauuuaugcgaguugcaacuaugcuagcaacuggaagcaacagaaagaaaugaaguaaccgcuugugaugucuccgcucacugaugucuugcuuguuuaauaggagcagauagucauuacaguuugcaucagcagaauuccuugagguuuagaagauagccugucaccauguuuaaaaugugcaguaaugcgacccuucaggcaugccuuuucuuuuagaaaauaaaugcaauagaugucuuccaaauauauuuucaucucuuaugcuuucauacuuuaaaacugcuuugaugaaugugugaacaaauauauuuuagaagauuucaaguauuguuuuauguauuggauaaguaaaauuuagcaaauuugcgugucuucauauuguggaagccugcagaauauuucaguggcaucaugagugacaaguuuuuguauagaggucagagagauaaaaggcaccugcagucaguuugaaugcccaggacaacacugauuguggugagccagugaaagacaucagagauguggaacaagggaccaccaaaugugggguuaacaaagacacggauguuucuucugugcucuuaauguccuugagguugacugcucauugucaggacaguccagaguguuaaccauacagagaaucucugcuggaauuaugucuguguuuuacuaugaagucuuuagaacaagcagguuggugguggcgcacaccuuuagucccaucaucugggaggcagaggcaagcagaucucuaaauucaaggccagccaggucuacaaagugaguuccaagccagacaaggaccugucucuaauacaagcaaacaaacaacaacaaacacuacccgcuaugcucgguaugauguacuacuccaaagcucaagacuccuuugcugucagaugugugguguauaugcaguuggacaggauuuagguuuugguuuuugguuuuguuuuauuuugauauuuuucucagugucuaauugaaagcaugcuugcuuucucaucacagcuuugacagcugucagaaaagccucuuuguggcuuaugcuaagauuaggauugguuuuucuucuaaaacuguuggcuuccuccguucccucucagcuuaagcaugaacaaagcaaacuuaguugaccuugggaaguauuugaaugaaaacuggaauggggaggugcucagcuuccuugugacauaagauuuuaauacagaucacuuguuuguggugagggguucuucauugaagucuguauguauuuacaaaauaacuauuuuugagaaguauuuauuacaguaauccauaaguaauucuuuuaaucacuuuaaaguacacugaaugcuaauuucugaaauaaaaguuucagcuaaguggcuauugcuguacuuuuuucucccugauacguccaguccaucucagcagagucucggauacgaaagcagcuugagcuuuuccugugccugcauuccugcagucugcuaagacaggagaccagugacuagauggccggccuccauuugcaucuugacugauucuuauaugauccuagacaaaugaccuaaccuucccucaccuguaagauggagacaacauccuccuguggagugaaugcagacaugacugggcauugugugaauuuuagcuguugcuguucgguuuuuguuuuuguuuuccccugcaguaaaaaaaacucuaagugucuaauuucugucuuuagucuccauaaaguuucacugucaaauugaaaacuuaaaagaccuauuguuuucaguaacaguuuaaaacccaacauuuaaucauucauuuuuguauaguuauaaaacaaguaugauuucaacagugguguuggguagaaauuaauaaaaucgaggcuucuuuuacauuuguggguacacacaugucaugguauccugggggacaacuucccaccaauggaucucaaguuuucagcucagauuguugagcucagaguagcaagcaccuuuuacccacugagccaguuugccugcugugggcuguugcuuuauuuuaaugguaguauuuuacagugucuagcgucauugcuggaacaauaaagacuauaaaaugaguuauauaaaau

SEQ ID NO: 7378 - RNA, 1034 nt, Mus musculus
gaugccccagucacugagcugccaccuaggacucagcugccucccccucaagcccccucgcuucccgacgcuccucccaacccccuuccccgccuucuccugcagccaccuuccacaggccauuuccaccaaggaaaaggaauuguauuguaugugcgcuauccagaaccuccacucuuucgaucccuuugcugaugcaaguaagggugaugaccugcuuccugcuggcacugaggauuauauccauauucaacagagaaagggcaggaagacucuuacagcuguccaagggaucgcugaugauuacgauaaaaagaaacuagugaagguguuuaagaagaaauuugccugcaaugguacuguaauugagcauccagaauauggagaaguaauucagcuacagggugaccagcgcaagaacauaugccaguuccugauagagauugggcuggcuaagaacgaucagcugaagguucaugggguuuaagugcuuguggcucucugaagcuuaagugaggauuuccuugcaaugaguagaauuucccuucugucccuugucacaaguuuaaaaaccucacagcuuguauaauguaaucauuuggggucugcuuuuaacuugaacuaguguaacuccuucaugcaauaagcugaaaagagccauacuguguagucuugaagucccucauuuaaacagguugagcaguguccacccuggcagugucuacccugguacaaagcaauaacaagguuucagccaagccaagaaccccaagaucacaggaggcuaugucugaccagaggcuccuuggggcucccuggacagaguccccugcccuaggagaguggcaccacuugaacagcccaguugacugacacugccccagcuaugucacuagagggagucucuggcccuggugucugaccagguagaauucagaaagggguaccuuccagagaagucauggacauuuaguucaucaccaggguggucuuuugaagcagaucuauccuagccgggagguguugcaacauga

SEQ ID NO: 7379 - RNA, 6007 nt, Mus musculus
ugaugagagaaauuauguuugauuauuucuguguaaacaaagagaagcauacagaaaauuacacacauaauugguuucuucuuagaaaauaggggauugacugcuauacaguaaguuagauggucuuauauaacacauaugauuaaagucaaauguauuucaaauuccuaaaaugugcucuacaaacaccacaccuggaauucagccuacaugaggaacacuacuagaaagaucccugaaggcaaagccaggcuucccuacccuggggaagucaggagggcaccuggguuccugagcaggagaaaagcuuugagaguuucugagaggaaguguuaaagagaaggcacuggaaggagguugcagggauaugccccuccauacccccuuagauguacguaccucauacuggccuagaacuagcuguguagcuggggucccugaacaucugacccuuuccaaggauugaauuuacuggcaugugccaccacacucaguuuuaugagacuugugucggggcuuaagcacaucuccaacucugcuuuuaaaacaagucaaugcaugcuauuuuccugagcaaaccccaguuacuaaagucuaaacccggguccucacaggguucucaaaauccccagugaucugcacggauggccccucccaccagucucacugacugcagccugcuggccucacccugggccgaucacuaccugacuacucagugcacacaucaaacaccacaucccuagcaccucaauauuggcuuaucagucugccugggacccacuuggcuccuuagcgaauccgagucuugguucauaugaauccuguucuuucgccaugcuggaacucaaacccaggucuuuacguguaugggcucuuguauggaucuacguucucagaccagcucaguuuguucauuacccugcacucacggcucuccccacucgcuuccucugcucuguguuuuuccuuagcauugaacuuuguaaaccacuacuuuacuuauugauuuguugcuguauuuuugucugucucccugcuagauaauaagcaaccaccagcagguguuuucgucugcuucacgguguagaaggaacacugcugaguaguccuggauaaacauccauagaaaagaaggaaaggcuggggaggcacuucuguugucauuuuuuaaacacacacaaaauccugggcuugauacucaguaucauguaaaguaggaaugguguguugcgcacuuuuaaucucagaacgugagcagcgauggugggaaaaccaagaguucagagucagaguuagcuuuugucagguuugagaauggccuggacuacaugagacccugacucaaaacaaggaggcggggagaugaggaaagaacuucccagguugaauugagcagaguuugagcaaaugcuguggcguucaguugcugguuacuuggacccuguagucaagggaagacggaugaauggcccugccagaaacuacuugccuuggcuucucagucaucccugaacauauguccccaacaaggcagugagggcuagaggacuccaccauccuggccacaggcaagcccaugugaacaaccacugaaaggccaguggcaggacaguccugcuuacuuacuucccaccggcccuggaacaauggcacugaggaagcugcuuucaagaucuuacuuguacagacccagagcucugugaaagacaacagcaauuucuaucccaccgcuacuaagcauaguaacaguaacaaacauaagaaaccugaccaggcaacagggcgcaugacuauaaucccagcacucgggaggccgaaguggaggaccaaaagcuuaguccagucuagguuauauaaaagaccuugucuccacuggggggaggcaggaaaaucuucaauguuccuacaccuguauaugugcaaucaauacuuagaauauccuccgagaaaagaagauccuuccuacauaggaaccaugcauaaaacacaaaacccugggaacaacuuuaaccuguagggguggauaagcaaaguggacaucuucgacgauaggauaucuagcuacauuuaagggugccuagguauguaccacauucaucaucagcauugaacccgcuuugcagauuggcuccaaacccagugacgucacccacuggcgaucgggaccugugccucuauugccacggcaauugcaugcauuuccagaguccacuucccaccuuuaucugugagcacuucugucacaggcuaaauaaaaggcagagccuuccugaccuucgcuccucuuucuucucuuuuucccuuugucucugucacucccucuuugccucugcccccacaaucaaccucugccacaugaaacuacauuggccugguauggucugucaguuauugagcagcaauuccaacacaagcaugacccauuauuggccuggagagacgcaacagucaguaaaguguuugcuuuguaaacaugaggaccugaguuuuucacuccagaauccauaguauuucaaaaaaaaaaaaaaaauggagaugugguggcauguacaccuguaauuccaauucugggaagacagagacaagcagacccuugagggugaccagccagacuagcuuauuugauaagguccaggccaguggaacacuaucuugaaaacaaggaguauguugggaguagugaagaugauggcucaguguauaaaagcuuuguccccagcccugacaaccugaguucaauucccauaugguggaaggagagagccaacccccaaaguucacacacaaauuuuguaguaugcaugugcuaugcacauauauauagauauauagagagaguucaaggcugaaagccaaccagacuugcauagcccaaggccuccuaggcaguccucuuucguaacuuaguuuccuccacuguauacagguaagcagucaagucacucauuaacuggauggagauggugaguaugaggaagucgggcacacacagugaccuugugaauuuggaucuucugaugcacucugaagggccuggcuccuugauauguuaaaucagaauaaucagacgugggcugaacccaccagcucucuccccugagcaaaccccacauuguccuuguuaaaagaaagucuugugugcuaaaugggcaugugacucugauucagguccauccacgaacauuaggaaaaguugacuggguuuuguuugguugauuuuggguguuguuuuguuugcuaguuaccaucuguggcugauggccuucaaaauuccuugcagagcaagaaacucuaugcaguaggaaagacuggcuuguugcagagauaacaucaugacccucacuggcucccuaauuuacuaccccccacuauucuucccuacauaggaaaccuguaaacuacuuuuuccuuaaggaagaaucugaccuaggcaaccaauguguucugaccccagcugucuaccacagcuggaaucuggagaccccacgaucuuaccaugggguccguagagaaggucaggaaguggcacaaagaaccaggaacgugggccucuccuggugccguuucucccagggaauccuccuggccccuugaauucagucauccaacacuuccuugcuggauguagguucuacuggagauuaagcaggaauuccgaugccccaguguagggaauaccaagacagggaagcaagaauggguggguuagugaacagggggaggagaaaugggauagggggguuucggaguggaaaugcagaaaggggauaaaauuugaaauguaaauaaagaaaauaucuaauuaaaaaaauaaaagagagagagagaaagaaagaaagaaagaaagaaagaaagaaagaaagaaagaaagaaagaaagaaagaaaggaagaaaagacugugagagcccuuuuccuuugccacauugcggguagccagaaacagcagaaaaaaaaucauucuagaggaggaagugcauugucugcucaugggugauccuucaugccuguaccaguuuauggaauaggaagcccgggauccuugauauagaagccccugaaggugaaugucuugaauggugaaaagugagccuagcuccucucugguccgcacuccguuccuaaccagcaauaaggagacgcaggagguggagcacagaacagaaggagccuggguugucugagagguggcagagcagagcacucacaagcauacccuacaguaagaaauaaacuaucguuuuccaaauccacucaggucuuggagguguuuagugguuaaucuucucacucaaaucaugcaugacagcuuccaaacuucuguaucagucaccugaaaccugagcuccaccagaguaugacucuacaaaccugguggaccaucaaaucuguauuuuuuacaagcuguaauauuuguacuuguacaaguuguagugugaugcugaagcuacuaguguggggaucacauugugagcaucauugucuuauucccaguguugaaauuauagcauuucuucccccuuugccaaggacaggauucucacuuucugaccuuuauucacuuuauguagugccaacgucucccuccaaugcccgcugaugcccuuugaucucugauuguguccuaugagugccaccaauagggagggagaacaguccuuggagaggaaauccuggcuguaaaucgggaugauuuauacaacacuucccggcuucauggcauccacaaguucuguaaucugaaucugcuuccucucauauaaaaugaagaaagucaugucagugcccuccuccaucugcccccucaaaacucagggacaaucaugaaagagggacagaaagaccgugagagccagucacauauguagcagguggccuugugggauauaaaugagaggagaggcccccuugguccugugaagacucgaugccccaguguagggaauaccaagacagggaagcaagaauggguggguuagugaacagggggaggagaaaugggauagggggguuucggaguggaaaugcagaaaggggauaaaauuugaaauguaaauaaagaaaauguccaauuaaaaaaaaagaaaagaaagaaaaaagacugugagagucagaggucaggaaggagcagagagaaaaaugguaucuuuuggacaugacuggaccauugugaacucagcagugguugccuauacaagaccuccagaaaagcaagccaaucaacacugaugcauagugggaggaguucacaagcaccaccccuuacuuagcacuagucacagcuaauggcuucuucccuccagggucagcuuucauggaugguuuccgcuccugcuagauugauuacacuccacuggagugaccccacacucaugagaacaugagcagcacacaguggacucgguggauuaaagagaaguuggggaucugggaggaguggggaagauaugaccaaaacacauuauauaaaauuaucgaagaauaaaaacauacuuuaaaaugcaugucuuugcuaguucuaagaacugggcugcagggacggaagaggauucaccagccaggcugggaaccccuacaucugagauucuuugaacauucaaguccucacauguugacagcuugaagaaaccucaaaaugcagcuguguucgaaaagagauucuaccauggaugaugcagagucuucugcagaaacagcgcagaagggucgggggagggaugcucaagcgucccgaggggcagcguaaagcauuaguauaucucggggugacuuucagaccagguggcuugaccauuauaggagaagcacuuccuuuccagagucccacugauguaaaggucacuccuggauuuggccagauagggcugggaagaaaucuggaauaaacaaaguuucugguugucaccaaugaaaaccugugccuuucagggcauacccuaacagcugagucugaaucuagacugcuguccccuugagguauuuuauaacuaugcugcagaguuaacg

SEQ ID NO: 7380 - RNA, 1191 nt, Mus musculus
ggagggcaagaaaaauggcuuaggaauuaagagcauuuguugcucuuccagaggagggguuuagcucccagcacacacaggguagcucacaaccgcuuguaacuccagcacccucuugggaacugugggcacuaugcacacaugaaucgugcaauuacagaggcugugggcacuaugcacacaugaaucgugcaauuacagaggcaagcaaauugcccauauauacauaauaaauaaaucuuuuuuaaaaagaggcaaaauccugggagagcuuuaggagauuguuaagggaugucugugggggaugcucgcuucggagugagaggacacagcuacucccuacagagcucugagaauuauuucuucacuuggcuuucuucuauauucugugccucauuucccagcaggggcuucaaaaacauagcuuaaugacuaccacacuaaauuaucaccuuggaccauccuuuuugucaccucagacuuuuaaguuucauccuuuuuaacauaaguagaagcuaucuaaauggugcaaagugaaaaguauguuuucuguuacccgaagacaacuacaguuaaggauccuuccagaaagugucuuuggaucuuuauccaaaugggagucuuuuuuuucuuucuuuuauuuugggggggggggucaguuuucuguaguucuuuuuauguauugaucagguacguucacuugguuaagccacacaaguaaguggccguugcucuccaggggauuauguuugcaguuccagguaauagaaaacccuauuaacccaaccugaacaaugaguggaggguuuuagcuccugaaacuggaaaguccagaggcagcgcgaguuucaggguugcugugauccaagugacucagugaggucagcaggaucugguuuccuguucgcugucugccagugucuucaucgucggagauugggggugggggugaggaggggggcuccacuugagacugccucuagccuccgugaugggucaucacgguagugaggucaaggagggucagccugccuccaugucugcuccuucugcuucacgcacauguuaggaaaugaccuucccuguaggaugcugggaacgcugcggugugaguuucccgguauccuccugugggcuuugcucuuacaguguuuauuuaauaaauaaacacacagauuucaaaacaaaaca

SEQ ID NO: 7381 - RNA, 60890 nt, Mus musculus
cuccgcgccccgcccccgccgcucggacggcccgagucgcgcccucccgcucggagcugcugaacuugcucuaacuuccucggccaaccgggccgugcugccgccgcugcugccgcgcccggguaaguagaacgcguggccucgcugaagcgucgggccugucuuuauugucucgggccggcccucgugagcguccucucgggacagcggcugcuccccgcguuccugcucggccccuggacucccuuggcuggcgggggcggccccgcggguggcgcgggcuuugucugcugagaccgcccgcgagcucuggaggccgcggccgggaccccgcugagccgaacuggggcgcuguaucgagugggaggcgcggcgggcuacccggaaggugugucugcucccggcugcugccugggcucugucgguccucaccugcgaacccagcggaaggcucuuuauucagcuccggucccggaugaggggacggucgcccagcccccacccacccugaaugugcacgcugucgcggggucccacgcuguccggcaagaguuuaaggagguggcgauccuggcuucucggugcuagucgcuaaaggcuguguuugggagcagagcccgaccccugaccuagcccgagguuuggccaaguugugauucuggcucagccuagguuggagcuccuguauucccuucccucccgggcgugcagugcagagggugggcagagugcacauuuggggacuucggccccugaaccacugaaacuccugucuggaggacugaaacuuggucuccagugagaggcagucagaauccucagaacucagugucuucagccagugccugcccggagcugguugcagagccacggugacuguaucaggacacugguguucugggacaucgagauguguugggcagcgugugcaggacgcugggcuggagccuguagcaggugugaucucagcucucuagguggucaccccaacggacugguggauuuaggucaguugccugccaaauccuacacaguuguggcugucaagggacaguuuccacacagccccuuggcuucugaguagaaguuggugccugcugagugcuuccuuauuuaugaaaggaaaucuggggccccacauucuaacagcucagagguugcuggagacacccuuucucucaaaacuccuccugggcccuaaaacccuuagaaugaagcccagacuucugcucucuggcuccucccuuagcuguccccaagucuuuuuuuuuuuuuuuuuuuuuuuuuuuuuuuggugucagggucuuguguaacccaggguugccuugaauucaugauucuucucagucucuugagguggaaaccuaugucacuagauguauuuuacccuuacuguguguuuguuauacaccuuuaguugaugacuggcuugauagcaucccuuucugcauuucugggucuccuucuuggaucaccuaauguguuucagagacuggggugcucugggcuacagcccauacuuucugggcucacaucugcaagccuugugugcugggccuacaguaggugcucagugguaguuauugauaugcacuugaucuaggcuuaguugcuucauuuagucaaacauucuuagccacugcuccuccagagguuuguggcuguccccaaaaaaagcugcugagagggaaggguuggcugccaugggcagauucuccuaagaugucucuuaggacagcugugccagcucauuucucaggacaggugagggcuucuugucacauguuugcaauggaagaugaaacucaugccuugugugggugggggaggagcuugcccugcagguuauagaaaugaggugaaguuacaaagaggccagggugcagggaaaccuuggcuucucaaaccacuucugagggccuuauccuaggccaccaugugccuagggguuagaccuuguuuaacuuuaacuaaagaguuaaacacaguuaauuuuuacagugccuagaaaugccaguaugccagucuugaaagccccuugcuggcuuaaaacccagugaauuuaugagcaaacauacauguacauguuuguuuguucauaaauuacauggcauaaugguggguuuuucaaggcuucuuaguauuuauggaaacauaucaagcuacuaucccagccuuacuuuuaauuguuuaauccuugaaacaacugaaacaacccaaaugugguagacauuagcuaccugauuuuacaaaugagaaaacuauggcccagaaagguccgagugguuuccuggaagucucucauuuagacaguaccuucuucuuggaggugcuuaagcauagugcuuaagcaagccuggcagaacuacugaguucuucaguacagguuuccuuauggcccuguuuccaaagcgucuuacccaucuagcgugauagcuacaugccaacccugagucccugcuaauuugacugaugcucuggucucugccccacaaggccagaggauggcauggguggggguggugauggggaugggacuagagagcuuucuguagagaucaggguuugaugcgguuaagaucaaacuucagauuuuagaggcuuaaagcaaugagucuuuuuuguuauuguucuuuuguuuugauuguuuuugcugucuccacauagacaucacaaucugcuuuguguuaccauuauuguagggccaauucauauuucuagcccaguagaaauauccugaugagucuugcuuuuaaugcaucuaucuaccucuacguugcauuucauugguugcaccaagucacauggcugcagucacacucaacugcgggguagggguaggaauuuaaaaaaaaaaaagagucugaacagcaugaaugcccaucacuugccuguugcuucuucucaagcucuggguccugugccuccaagaacauuguugugaauugguccaagaagcccuguuggaagauguaguugccacucuugaaagauagaaguuuggucaccaagaaugagccuuagggagagguaguggucuuuaagggcauccuuuugcucauuggcuaguucauuccuuuauucaaaagcaggaagucccagccuagagccugugaauggaggugacaaucccuguuuccugcugccgggguguuagugccuuuaaagaggagugauucccaggggagaaggaaagcagguguggccaccuugucuccuggccaguggacuuugggcauguuggacuucccauccuugucuggagguggacuuaguuucccuagaagcugagcagguagaggugccccuaguugcugugcucuuaguaauuccucugguuacugagaccaagccugcaggacugggaguguggaauagaaugguaggagagugacaguuugguagggugacuguaggguagcuuccacagaaccagguagaagccuguuagauacgguucucucuagccacucuggcuuuugcuuucauguucuguugccugucuguacauccagccagagaccuauuuaggccugguugcagccuuugcuugcucucucucucucucucucucucucucucucucuuccuuuuuuuuuggagacaaaguuucucuguguagccuuagcuguccuggagcuugcuugggcuggccuccaacucacagagauccuccugccucugccacugcuggcauuaaaggcaugcaccacuaccagagagcuugucuacugcuuuuucaaggccucuguuuucccaccuguggaaugucaggaaguguaaaggacuguggcagcugcuacccuuggcuggucaccagugccuaguauaggcaugcuugguuguuugcagagucuuugggcuggugaaggcagcagcuugguuugccuucuccugcagcguagcagugcugucucuugacuaugagucacugugggggucucaugucuccuggccgcucuccgccauccuccgccauccuuguuuguaucgguucagacagagcgaguaguugcaguggcucagaacaggaccuggccucugggcaacaguuguuguaucugcccacucagcgugaacaugccuaacccagucuagcaugcagaugggcaguaaggaggccagcuuuugacugaagucuaauugcuagcuguguagccuagacugaaguugcauauuuucucaugugugaagcaggcagagucagaucugccacaguuauuugccuugguugcugagaagcugguccacacuucagguuugaggaacagggucucaggccccugggucgggccugacacuguuuggggacagcugcuaucuuucuggcaguuccccgcaagcgcuuaccaacagcugguucugggaacccugguuccuccacccuuggggauugggugggguugggugggauuggguggggcugagcagggcugugguuuuucucuuuggaaggaguaagccugguaaucaagguuaagugggccuggacuggcuggaguuggcaucgucaccucuuaagaccuauucugcuucgaucuuuaagcagccagcaccuacauuuaucagcuggauagcugccucuccuuggauucucuugucuuggucuguauacuauguggcuaaagcagcugcuggcaggcauccugguaggauuuagcucaugguggccaagacucuucagcaccccccccccccccccguuaucuuucagggcugaggugguagguaucauuugggaaagagccagaucagaggcuggugaaccuuuucucugguuauggguggaugggugguaccagcuauuuggucugugaucauguaugcuacagagcccgacacacaucagaaauagagguuugaggauuucauagcugugacauccaagaaaaggucuucacagcaucuagaaggaaugaauguccccugaaauuucuuuugucuguaucugaaguuggugugggagggaaaggggcuuagcauacucaagggagccccagcagggucucucuuaaagaaucacagaauaaagaaaacaguuuccucagcuuuagccccccaaaccugcugcaccaucagugcaucagugugguaguacugagucucagcaucagaacuggacagucucagucuugcugugguaguacuaagugguaguacugugguaguacugaggaucagaacuggacagucucagucuugcugugguaguacugagucucagcaucagaaccggacagucucagucuugcuguaggaguaccgagucucagcaucagaacuggacagucucagucuugcuaugguaguacugagucucagcaucagaacuggacagucucagucuugcugugguaguacugagucucagcaucagaacuggacagucucagucuugcugugguaguacugagucucagcaucagaacuggacagucucagucuugcugugguaguacugagucucagcaucagaaccggacagucucagucuugcuguaggaguaccgagucucagcaucagaacuggacagucucagucuugcugugguaguacugagucucagcaucagaacuggacagucucagucuugcugugguaguacuaagugguaguacugugguaguacugaggaucagaacuggacagucucagucuugcugugguaguacugagucucagcaucagaaccggacagucucagucuugcuguaggaguaccgagucucagcaucagaacuggacagucucagucuugcuaugguaguacugagucucagcaucagaacuggacagucucagucuugcugugguaguacugagucucagcaucagaacuggacagucucagucuugcugugguaguacugagucucagcaucagaacuggacagucucagucuugcugugguaguacugagucucagcaucagaaccggacagucucagucuugcuguaggaguaccgagucucagcaucagaacuggacagucucagucuugcugugguaguacugagucucagcaucagaacuggacagucucagucuugcugugguaguacugagucucagcaucagaacuggacagucucagucuugcugugguaguacugagucucagcaucagaacuggacagucucagucuuggugauguccagcucuacuccaucgugcugcuuugcuuuccugacugguuggaaaugcccucuuccugcccucucuguuuucugaccauccuguauuccugggccacguggacucagcuuucugaggcuggcaggagguggcccacaccuccuacaggaguaucaagugugggugguacuuucuggggaaagguaagaggcguccuggaagacagaggaacucuggucuuaaaggaaaaaaaauuaaucuggcacuucuuaagauguuaaggcagaguauuuaggacuguugcagcaggguuuuuaaguagcggaaagagacugggcucagcuccaaaauaacaagaaaaguaagaacuuauagccacggagcacuaugcccugaucuuagagaauuucugaagguagggaccuuucuagcugaauggaccugacagaauucuucccgaaggcaagccaaguggacagauacuauguggggauaaagaaggauaaggaauuugauaacauguuggcgauaaauugacuuagcaggauucuugcuagacgggaccuuuacaacucuuaagaucagagcuaauugaauggaaaucucagaggacuugacuaaagucuggugaaggacuaaauccucuucaguauucuguguuaaggcuuguaaguuuuuacauugacccaggcucacggcugcucacguuuguuuuucuggaguggcauuuucugcuguggguauuccucaucuccaggacacugucaguaaggcuucagaacuaaaggaagguggucgccauuucaagcaacuuuggccuuuuuauuucaguguguacugguucauugcaucuuaaucuccuuccccucugcacacaggaccuggugucccugcagcucccauuuccaaacuuugcacucuucuauuggcugucagaccacagccacucucuucucugaaguccuccacagcugcagccgaguuccuguccugugcucugccagucccgagcaaaccaugucaugucuguacaaaccccccccaccaccaccagcuuagaagacuuuauuauuuugucugcucuggguccauggaaggggucauauguggucccauccauuuccugggccuaaacaauuaaaaaaaacaaaaaacuggucugcauguucuuuccuucuucaagagggaggugccucuggcuuucuguuuggccucuuuuauuggucaucccuggugcaggugaccuacuggucugucaacaccugaagcugugucucagccagcuguauaggagcaaggcuccccucugcuuucaggaaaaccuguuggcugcagguaggggcuuacucacuuccuccaggggaaggucucauagccagugucuguccuugcagaggaagaauagagaccaugucuguucuuugcaggcauccugccucccacagucauugucucuugcuguccucauuguuuccugugaaauacaagcagugguguaaacaggauaaguuugggggagggggggcaguugccaagaaaagucagugguaguggagaguguucaugccucagggcucuggauggcuggcguagguauuguggugguggcccccucugaguucaagcagcccugaaguuuuccccugagaagaccagcauagugaaacgggauaugcccuggagacucagaaccucccuggggugggugaccuuagagaagggcuggucuugguccagugaaaguuugugggguuccugguaggaccugccuugaccuugcacugggcccugucaagggaacaggaacuguuuuuuagcuggaagguaugcaagcuccaagugcuggugugguccuaguagccuugagaucccauuuguacuauugcuuuuguaaggcauuuguugaacuuuacugucuggagaggaucuuagagaaaggggaaccaaacacacccugucccucccugccgggcacccuguucucugggcccuaggcaguuguaagcuugaggccauuacgaaacugccagcuguauugucccuagggcugaaauggucugcaggaaggguugagcucauggccacucccugcugcucaggucucucucucaauuccuuggccaccacuggcucuaauggccauuguguuauccccuugcagcaagagagacugggaugguuuuuauauuauuccuugggggcaaagucaugugaaggagauacaucagugcuuuugagugcagaguauuuauugacacacccauuacaggggggcuuuuagacaauaaauguaacccuuuagcaagaacaggcacauggaugcaagucucagcccugugcugcaguuucccucucuugaaagguauaugcagcuuaguggcuaagggguugagguuuuaagcugagauuuuggagaaacuguuuuuagcuuguccuuggagcagggccaggccuagaaaucuuuuggaauagcuuucuuuagcugcuaaaauggggaugggcucauaacgcuaagacuuagagccuuguuggcugcuggggaggccccaggagaaguguuugcucauggccacucccugcugcucagaucuuucuccuaauuccuuggccuccacugccucuaaucaccauuguguuagccccucgaagcaagagaggggcuucagccuucauuuggacagacagaaagacagacagucucucucucucuuucucucucucuccuucucccucucccccucucucauucaucuucgaccuugaauuucuacagguggcccuugguguggaaaagcuuaguuuucuuucugucauuaucaaaauauuuucuugcuuuucuuucauaggagaacuuucuauuggggguuagggugaaguuauaagccgagcugagugggcucagaggccuguacugcccuccccuggccuccuuagugucuucuuccuccccucccccacaacaucuuguucuaggaagaugccagaugcugccuaaagagagcuauucauaaaguauuuuuccucucccucuuucuccucccccuuuucuuucuuucucucuuucucucucucccuuccuuccuuucuuuucuuuuuuuuauucuuugagacaggguccuccugcauauccuagguugacgcugaauucaucuuucugccucauaucaccgaaguauugagauuauagaaguauauguaagugcaccugccuaugguaacuguauuuuugguaccucuagccacaaacuuuagacauuuuaaauauauugaauuaaguuuaacuuuuugucauuaaaaaaaaaauagauaaaauccacagaagaaauagaaaccuauacuuguaaccucuucagacgcacuccccaagcccaaagccuccaucauccgguguucagagcauagugaaguguggcuggagagcccacgcacagcccacccccaugcgugugcuuuuuccugaguacauacgagguggcuaguguggaggugaaguacugaggcgaucaucaggaacaaagcauggcuguuuuaauuccaagaggaagaggaguuucugaggcuugaugcuagggccaucuucuauuuuugcauugagaguugcccgggggaggaggggggguggcugcgugaugcuuucuguccucuucugcuagucacucagcuuguaccauccucuuuccaugacauguuuggaggucuugccuguguuguguccaugaggccugugcaccagacauguccugaggggucugaggaggaggccggugaggugaggugaggugggaggcgccaugugagaagcuggauagguuugaacugcaaagcucuggguaguguuuuaaacaaacuggaacugguuguguuauacaguguccagaggauugaggcagaggucacaggcuacuuaguuuuaagguuuucucacaguuuccuugucacugaagccaccgugucccacugaagucguaucuagccauagcuguccuguguagccuucccauaugagggcagugcaagacaggaagcagggagcgccagucuggugauucuguggccuacgccccuguccuaccagccucccgcagagaggacuccucaccaguauagucacaugcaguccccauggggacaugaguccccagagcuaccaaugcuggaggcucuguuguugggagccuaggcccucuguagcacagagguuccuauugugaucugguggcagcuaggccugaccugugaggcugagaaggcugggccucaggacugacaguggagcuauucaugggcucugcccugguuucccgaugccucccguuguggauuuggggguggggaagaaacugggaggaggaggagagggaggggccagagcugcuauuguuaacggcugcuguagcccauugugccuuguggaggucuuugcugagagccugagucaccggcccuacgguucucaaauugcagcccugccuuuuuccugugccuuuuguggguaccuguguuaggaucccuuucugcuuuuaugccauguggucugccuggagcuccuuggguaaccgucagaacagcugggaaggagcaggaugcccauucuggcuugucagcugccugcccaccaccuugggaaacauguucacagaacucucacugaccagcugcacccuugggugggggccaggcacgugccucagcugcugucagucuugcaggcacccccaucuuccuuugugcucaccccauaucaugucccucggcccuccuugagcucucagcugcagaaaaaccugcuuuccagccagcaaccacccccacugccgagccacgcucuugcucuucuucuuuguucagccaucucugagcucuuaaaagccggcagcaggcagcgugugcagcaggcagcgugugcacgggaccagcggaagccuucacagugcaagucuaccuacugggcaaaaggcuuggcagcucccuagcuguacugacaucucccagcaaagacaagcauucccuuuauucuggcacccucuuaccagaucacacagugacucuuagagugaagacaaggggugcucaucagguuuggguggaccagguaguguugggucauugcucuuuguguguguguguguguguguguguguguguguuaggauagguagguagguuggaauuggucaugugguccaaagaaaaagcaccuccugacaaucucguaagauuaccauugaaguccugucagaagaacucuuagccaucgcuggaagggggcuggagaaguggacaaauaguuuauuuuggucuuuaggguugugguuuuucucccaacugaaggaaacagccccugcuccuuuuccucuuacugucuuucuuuccucccuccccaguuuuuggugguuaaaagggagggccacucccaucacaggguccagccuuucucccugggguuuccucugccccagccaguccuguuuccuguguaagccacaccaggaucuguuacagacacuagccugugggauauuggcuugguuuuuguccagaacauuuccuuugacucuuuaagaaauuaccaucuucauauagagccugguuggcugucugacuugacuguugucagcugucuuucaaauuaagggaccacagucagccccagaagccuguauguuagccugucucugugucagcagcagguauaggauccaugagacucagaugagaaagugcuggccuuaauuauuaccuguguaaaacauggcucccaugugugguagaugcguccaaaugaucucugaaaagggcacaguccaggcugcuugguugugcuggacagcuuuuuguuuuuuaauuuaauuuaauuaaaaaaaauuuuuuuuuuuacuacuagggucaucugggaagagggaaccucaacugauuaaaaugucuccaucagauugcuuuguaggcaacucuguggggcauuuucuugauuagugauagacauggaagggccuccucgcccccuguggguggugccaccccugggcugguggucuuagguuaucuaagaaagcaggcugaaauaagccuguaagcaagagcaagcuucugcuucaguuccugcccugacuucccucuacgggcaacagugaccacccuuucuccccaaguuguguuugucuugguguguuaucacaacaacacaaaaugaugaugcuuguguucaggacaaaagcccaggaauuagaagguggggcuugaauccuagaggugcagugcuggccacugacaguucaccacauggaugguggagauaggccuucgacugggcaauggaggaaaggguuacucagacaaaccuugcaaggcucuagcugugaccguuuuaguuuugugagucuuaacuccaaaggguggaucacugucuugaaaguuucuugcucuguuaggaucuuacagaagaaaauccaucagauagauaagcuggacagaagguuucacucucccaguccgauuuucuuuacucucccuggcagguggugguaaugaaugccugugguuccuguuggagccacacuccccugagccccaauacacccugccauccugcucggucuuaggggcucuucagagcagggacaccagugccucuuuggugaggucguuuguaggcaucagcuugguucuucuuggucaugccaauuuacuccuguuuacugguguauucucucuugcgaaguuggaucugugaagaauaaagcuuuugguuuuaccccucaccaaagugacgucauaccagcaaaguaaaauacagaaauguagagauauaccuaaauaucuuuccccuacacuucuuagcuucuuacucacgaguguguguguguguauggguguauaggggguuuacauuuuauuucuguuugauuagcaagaggcaaaguauucuuuccuuggcaucuucugggugggauucuggcauuuuaucugccuuugcccauucagccuuacacuuaguccccuaaccagccuugccugcucccuaccccaucugcuguccugcucuuuccucccuugugggcgggacagguacccccagcucuggaagucuuaagagccucagaggaggcaggcuucacucauuugcuuagagcugcuuucacagcugugaaaugggaauaaaaauaacccgagagggcugggggugugguucaguggaguagggcuuacccacugugcaggugucccucuagcuuccuucucuagcuccacaaaaacagaggaaaaaucccuugaucagcuggugagcuacacuaaaauacuaauucauuccacgguggaggcguuucuccaggaaagcguauuggaucccugcaaguccauacacagugaagguacuugugccguaaaggccauuugcccuccccaguaccuguauauggcuugccagcucaggcugcucagcguccugcuucagcagcaucagcaucaccugggagccuucgagaugcagaaccuggggggugagaagguuaaccuaggaucagcuaaucacagccugucuuuacagagauucccaggugcuuaugugcacuuucaaguuugagaggcacugacccuaacuccuucccuguuauuuucacacauuggcuguguuuugugguuuugcugucuaccucuggccuucuggaaagucaugcaauguuaaaaggucugaaagaccagcuuuguguccccuuuacucaggugugcgaggaaucccagguguccugggugcugcaugccuggagguagagcugagacccagaaaacccccuuaagcauucuguugaggucaucuuuggggcagagagcugaguggguaauuggagccucccagggccaucugguaccacuuaccccaccccaucugucuuccucagccuguaccagcuggaggacagcgucagaaucaggaugaagguguaguuugcauuuuggggacaaaguguuugauauauauugguguucaaauaaguagcucagaggagagaauacaaauugauauuuucuguuuguuuuuaaaaggauaguaaaauaagauauaauaagguaaaacaaacuagcacauucgaguuggacaaaacaaacaggagaagagccuaagagaaggcacaagaaacagagaccuacucuugcacauucagaaaucccuucaaauacgaaacuggaagcuauacaauguaugcaaaggaccuguagggugaaagacagaagaaaaaaauagauuaaaaaaaaaagccccaacaugacaguaugaggcaggaaaccuccaaagaugcuguugaauuucuuuucuguuggcaguguagugcugggugugcagccuacccuuaggaguaguuuguuccccugugagacuccccuaaaagauaaacuuucauuugcgagugguuaugcauugaagauggcuucuggguuuggggugggggcauguguagucuuuuccuuucagcgcuaugaucucauuggugcacacccaugaaggccuugugcaugcugccucaguguuucaugugggucgauccuauugauuuagaaggccuuguuuucuugggguccucccuccccucuauaucauacacccugccgccucuucuuuaggguucccugagccccaaagagagggauuucauggagacauuugguuggggcugaguguuccaaggucucucacucucugcauaaugucuggcugugggucucuguaugaguucucaucugcugcaagaggaagccccucugaugauggcugagcaaggcccucaucugcuucccuggcuggagucucuguuuuucaagaaaauguuugagaugggucuccagcacuggcuaaccugugcauccuagucacgggcugugagaaagcauugccaccugcccaccuucccagccgcucugcugccucgacccauucugggcugaguuuuaggagcugauuggcucgcccuuuccucaguuucucacgauuccuuuuugguauuugaaggagcuccuccuguuccuuuucucguuugauaguccugaguacuuagcuuuauuugguuuuccccagcaggcuucacuuuuagaacuucugcacggcuuuuguuggcuugcuuugucuugucuuguuacuuacuucccugagaaucuuuaccuugcuugaggaaggcccagagucaguuuccucucugggcuggaaagugacucucucaaaagacagggcacuggagagaugacuuagcacuuaagagauuuggcugcucuuacacaggaccgggguucaauucccagcacccacguggcagcuuacaacugucuguaauuccaguuccaggcuaucugacacacuuucacagacaugcaggcagaacaccaauguaaauaaaacuaaguaaaucuuuaaagaguucucuagaccaucuuagggaggggacagugaugucucgauguucaaaacauaguguauuguagcauacaaugcaauuuuggauggacaaaguuuuaaacauuuuugaaccauaaucauuaugacuuuuaggcaggaaaaguggagacaaggaauaaauuuguaugauucaaaauucucucauguugguuguuucauuguguuagagaagccaggugggugugggagcugcccacauaagagagagcccacacuucauauucccauuggguaugcagguugaguuccuuauuggagcaaaguuuucuuuuccagacuuggcucauuccucauugggauuaacuguagaguccguagaguugaagagcagcucucaugcuaauguuggucucacaaaggcagcugugugguuuuauuuagguacuguccacagggcccagccuagagcugggguacgcagggggcucagcugauaaaaugcacugaagggugaaccugguuccaugagguugucuguguagaacugcugccuucuccgcuuucacacuagcugcucuguggagcacuuccuggucugccuuccagugccuaguugcuguguuuaggagcuggaauccuucugcauugguuauguggccugugccuugaugaaacacaacuuguuuaaguugugaaguguccucucucaacacaaagaggagcuuucucagcuagccugugcaguaagaggaugcuaagcagguugucuucagcccugcuggucugggaaccguauggauccuggguuggcacagggccucucuggaguucuggggguacaacauggccuucugaguucuuaucccucccugaagugcugugagcuggcccagauucuccacguugugugcaacaggcugaggcccucuagugcucuugccaggugaucuuguagaccuuuggucuggacuuaacauuuucagaagauuaccaggcauagaacacuauggcagugccaggccugugcccugugaguggguggcuuugccuuugauggcagagggaaagugaugugggaaaugagcuugugaggcagggaggugcaggguggcaguuuggggugccuggacccugccucaccugagccugcagucugcuccgaagcauugguacaagcagugagaugaaucauucugaaagccucugcuuggcccacacucuuguugccuuaguguucugucugcuggggcacaucuuccccugcucccccgcuuaccaccacccucuuccuccuuuuuuuuuucagaagagaaaaagacuacagaauguguuuugacuugaggucccuuauuuuauggagccacuuauaauuuguguuugguugauguuucuaugagacaggucaugugcgcuuuccuuacgacaguuccuacagaggcagucuggcccaggugcaaccacaugaggcugauuugccucaguuugacucauuguuggugaccugugcugucagcugguuucucugcagggaaguuacaaggcugcccuguguaauuagucagugucuuguggggaggagcuuaagaccuacauuugaaaaugcagggaucuugacagauuggguuauauucauuacgguuccuggauggugagaaucuccuuuuauaacucccucuucaguuuuccuuuggcuuuuuccucucuuguuuauucauuuuuguuuguuucuuuuuaaagugccuuuccaggucuauccuagcccuugaugaaggaaccuucuggaaacaucuucuggacuaagcagcagcguguucuguuuggguucaucuuuaccaggcucucauccuuuccggugggcaccccauggagucagcuaacugcagagaaaagugacccgcucugcuugccaccaugcuggguuucugggucagagcuuuucugaacaaaggcuucuguagcuuuaaagaaaucauaaaaagaguaagccugaaaccccucaauuaggugaccuccauucuaggcccaguggugccccuccccugacccauauccucccucccuuaacaccuuucccucugcagcagccagcaccaaagcggacaaaagcugacucuuucucaauuagccaggagucccauuguuccugacagugcacuuggggcuuguggguucuuagaacucaguguuuaauuuggcauguuuaguguuuucccaggaagucaggcacagaaugcugggcuucuugggaagccuggugcaguucaggccuagcuagguagcuucucuugaagcuaucgugguugagggccugucacacgugggacucucaucugcuccugcugccggcguauuuuagggugauacuuauaauaaaagaagacuccucuucuaaagcccuuggugucuuccugaggccgagcccuacauuuugauccuagugaguggcugguaugccuucgggauggguauugaguagggggcugggucagcagaggauauagacacuucugacucugagggaagucagagagagccaagcccugguuuuugcuugaagaguagcagugccuugggcugaagcauaaaacaguuguuuugugagauuccuguggguagugaggcagcucuucuggcaugucguaacacgcuucucuuuuacuggagcccucgccccuucugugcccacuuguauuuaccuuugccuagucugcucuccugggccuaccuguuccucagcuuggaaaugaguguuccuuccuauuacccuguaaguuccaaggccgccucacuggaaacauacagggcccaacagagcuacuugggagacucagaaaggucauaucacuaccaaaucggcccacccuuccuugggaaaggccugguucagcuuggcagcagugcuaggagccuagguggccuugugaaaauguagaaucuugguuaauggccugcucuggagaacgagagggaggggaaaucgcaaggauuguuaacugugaagcugggcagguaguuauagcuugggaguaagaguaaagucacccaugucaguuggauguugagcaaacaaagggaaacaugggagaggaaaguuagguggcuuuagagaccuccuugacuuaagugugagagaggaagaucugagcagcaguccccuggaggaagugggaggagugaagaacagcucucgaagaugucucagccugggugaguguugacgaagauaccuuagggacaugggagguugaccaaggccucaguuuuugccuggggcuuggggauuaggguugagugacaggguguauguggcaccagaaaccaagaguaggaguggagagaggcucugagaugugccuuacaggaggauggcagacacagaguacugccugcccuaagcggacaaggcagcuggugcuguaugguuuagcagguucugcaagguagggcuagaacacuuguagccacgccuucccagcgccgcuucccuccguucacuguccucugguuuccuuuccucuuggccgcagucuuccugcccgucugucuuuuugcugcuuccugugacuuguagucuaccagaaaggagcuguugcuauuagagccucucaacacuaaucuuacuaaaauaccgauugagauugaggggggcugaaaugugcacuucuggcaagcucguguucuugguaguguuaucugauccaagguggccgcgcuugcuuuuacaccacacaguguccuaagagggcaaguaagaaagagauagcugaguggaggcccuaggaauucaugaaggaggcgggccuugacuccuuuggguguggcacaaacaacaaaccacaggcccuagacagcuaguucagacuacuaguugaggacagauagcagaucuggaaaugaguggaacagagagugaacuuuucucaaccccaaauggauuuucuuuuuuaauucauucuucuguacauuauaccccaacugcagucucuccucccuccuccccgcccuccucccuucgaagcuacucccuaccacaccacuccucauccccaccacacaugacuccccucucacccagaucaacuccuacuuuuuccuucagcaaagagcaauccagagcaagacacuaaagcaaagcugccuuccucuguuuuuccccuguagcuagcaccuugaaauuggggaugguaauucuuccugcuugucaagggcaacugagagcugaaaacccacaaagaaacaggauuugaauccaaaccuaucaaugucaaaauuauuccaaaccccuugguuucuaaaguuaagccccuuacucaaaguuggaguacuauuuguaacuacacgaaaaaaagagacguauagcuguuuuuuguuuguuugcuuguuuuguuguuuuuguuuuuaaggagcacauauaaucaugcuucuccuucaauggcaugagugcagguuuugacaucagcuaauaugaagugagaauuaauguguucagaaagaccgucucccaugacaacaacuguauuuguauguauucuaaccacaaaauaaaaauaaaaaaauauauuugaaaauagcacuuaaaaaaaaaagcaggcuugccagggauaucaacuaaaaacauggcauaaacaaguuacaacgagacuuagcacguacccuccuaagcaagucuggacaaggcaacacaguaggaggaaaagggucccaaaagcagcaaaagagagacagccccaacucccacuguuaggaaucccacaaaaccaccaagcuauacaacuauaacagauaguuauuaccauauaguagaggaccaacaucaggcauauacaggcugccugauuguuggcucagucucugugacuuccuaugagcccugguuaguugauucccauguuaguuagcccauguucuugugguguccuugaaaccucuggcuccuacaguccucccccuucuucugaaggauucccccagcugagccugauguuuggcuguggguccugcaucugcucuaucaguugcuggaugaagccuuugaugaugacugugcuaggcuccagucuauaaguauagcagaauaucauuaggaaccauuccauugacucuuuuuauuccccagucauguuugguuccauccuagaucucugggcuauccagccagccuccgguuccuggucaguguuaggcauggacuaccucugguuacaugggucucaaguuggaccagucauuuguuggccacuccuacaaguucugugccacuuuuacugcagcacauuuuucaggccugacaaauuguaggucaaggguuuuguggcuggguuugugucccagucccuucacuggaagucuugccuggucacagaagauggccaguucagaccccaugucccacaucacuaggagucuucuucacuaaggucacuguuuuagauuccaggauguuuccauugcucuagguuucuauuucacccccuaaaaugccccaauuccaguggucucucccgguacuccccaccaccugaauccccuguccuaucuccaccugccuugaguccacccaugaauucuauuuuauuuccccuucccagggagguccaugcauccaucuaucccccugucccacuugggccuuucuuguuacuuaaucccugggucuguagauuguaguaugguuauccuuuacagcuaguauccacuuauaagagacugcauacaugucuguccauuugcuaacaaaguucaugaugauacuccauuguguaaauguaccacauuuucuuuauccaaucuuugguugagggacaucuaugguguuuccagguucuggcuauuaugaggaaagcuucuaugaacggagcugaacaacaaaaugccuggaguaacuuaguugggucuugagguagaucaguucccaacuuucugagacacugccauuuugauuuccaaagugguuauaaaaguuuguaccuccaccagcaauggaggaguguucaccuuguuccacauccucaccagguuagcugucacuuguguuuuugaucuuagccauucugucagguacaagauucucaaaguuguuuugaucugcauuucccugacugcuaaggauauugaaccuuuucuuuagguguuucauggccauuuggaauccuuuguugagaagccucuguuuagaucuguacccgguauguugaugucugguuuguugaauucuuucuauauuuuggauauuagcccucugucgaguguaggguuagugaagagcuuuuuccauucuguaggcuacccuuuuuguccuauucacaguguccuucgcuuuacagaagcuuuucaguuucaugaggucccacuuauuaauugucuuagugccugagcuguuggugauauguucaggaaguugucuccugugccaauccauucaaggcuguucucugaguuuugugcagggugauagguagggacuguuuguauucuacauacacacaucuagguagauuagcaccauuuguugaacauguuuucuuuuucccauuguauaauuuuggcuucuuugucaaaaaucagguguucauagguguguagauuuacgucugggucuuugauuugauuucauugauuaaccugucuauguuuaugccaauaccaugcaguuuuaauuaugguugcuuuguaguccagcuugaaauccagaauggugauaccuccagaaguucuuuuauuguauaggauuguuuuagcuauccuggagauuuauuuuauuuuauuuuuuaggucuauaaagaguugugggguuuuauuguuguuuuguuuuauuuuguuuuguuuguuuuuugagacaggguuucuuuguguagcccuggcuacccuggaacucucucuauaggccaggcuggccucaaacucagagaucuggcugccucugccuuccaaaugcuaugcugggguuaaagaagagugccacuggcaucuggcucuguguuggaauuucgauucgaauugcauugaauuuguaaauugcuuuguguaaaauggcuauuuuuacuauguuaauccuacuguuccaugaccaugggagaucuuuccauccucugauauguuuuucaauuauuuucuuuaagacuugaaguuauuguuauacaggcuuuucauuugcuugguuacaguuacauacacuaagauacuuuauauuauuauuuguggcuauugugaaggaggauguuucucugacuucuuucucagcccuuaucauuuguauauaggaaggcuacuaauuuuuuuaggggugggguggggagggauggguuaaccuuuuaucuagacacuucaauuagcuucuaccuaaaagcuaaucuuuaggcugggugugguuuccaccuuuaaucucaguacuggggaagcagaggcagguggcaaauucaagccagccaggaugacaugguaaguuccugucaacaacagcagcagcagcagcaauaacgauaauaguaaaguaauaaauaauccaguguuuuuuguuuuuuuuuuuauuuccccuuugguauuucgagacaggguuuuucucuguguagcccuggcuguccuggaacucacucuguagaccaggcuggccucgaacucagaaaucugccugccucugccucaagugcagggauuaaaggcgugugccaccacugccuggcaauaauccagucuuucuucugagcugauagcuuuugccuguagccuuucacuggccucauugaugcuuuaaacccacauauauuucauuugaugucuuacggucucugcagaagcucaguugguuuuuuugggugggucucugaauauauaguuauauagcauuggcagcucugugcucuuuucccgaagcuucgguggggagauucaccuugaggcucauccaggcugucacagaaucuucucuuugcugcuuugggacacugauccauguuuugcuguugacuguaagcuaggcuugugcacauccauaacuccuauauucucugucacaggugucucugcuaccuugggccagcaacagugcugguuauguuaggagucucugaauucucuuuuugcccucagcuuggaaggagcuuuguuuuuaagggcuuauguaauucuguagucauggauucaaccaaccacagauugaaaauauccaggaaacaaguugugucugucugcacacauauauuuuuccuugccaucauuucuuaaacaauauacuaagcaacaauuugcagaguauuuauaguauguaaggcauuauaaguggucuagagaugauuuaaauuuugagaagaugugcauaagcuacugaguaaagaguaccuuuuuuuuuuaagauuuauuuauuuauuauauguaaguacacuguagcuguccucagacacuccagaaaagggagucagaucucguuacggaugaccgugagccaccauaugguugcugggauuugaacucuggaccuccggaagagcagucgggugcucuuacccacugagccaucucaccagccccagaguaccuuuuuaaaaccacauuuuauuuauuugugcacuuuugugcauggauauauauguauauuuauuauagcugucuugucugugugggugcuugucaaaggacaacuugcaggagucaguucuuuccuuccacuguggggauuccagagcuaggacucugucauuagguuugguagcaggugccuuuaccugcugagccaucuggcuggcucuacacgguuuugagaggaccuggccaggcuuuggcuuccuugccaucccuacagaaguccagagacaguucugcaccgaaccauuuuaagaccaguugaggaguagccugaauuacaaaauuucuuuugcucuucaugugguauuacauuauauauauaaaaaacacaccaaugaaaacuacuuccuaggaguguacuggaugagcaugugaauugagcaaacauacauaguguuacuuucucuuaaaacccauuaugagugaaggggaauuuagaaaaggagucaguguaccuguuuggcauuaauggagggcuggguaauaggaacaaaaaaaaaauguauuauucguaaauaaguugugagugguccaguuuaaaguauaagaauugaugguggcaggugauucuggggagaggagaaggucaccucuaugaaauccucagaccaaaauaaaaagagggugggaggggaagagugggaugagguuuuccuagacuucuuccccucuucuuucuguggacuguccaucucccucuguugcuacaguaggaugaccugagucuaggagacccagguauucuugggaauuaguggugaaaccacauuuuuucaguuuuccaggcuauuucccugcccccugcccucaaaacacugguggguuggcacagggagggagacguaacuaaauggauacaaacaaaaacuaaacagacaacaauuagaaauccugaaauguugggagcauggauuuagcaaguggcucagccaguuuauccuggacagauacauccugcuuaaagacacaguuuccaaacauuuuauuuguucuuaauuaagaauuacugagcauauggaaaguaccuaccaugaaugacagcaaaacaauacaaaacaaaacaaaagaaaaaaaucuugaggcagccuauuaagauaagagaguuuugagaaaaacuauucagacauuuugcuuagauuaagagaacugcagcagugugaaauaagaacaagauaguauuuuaaaaggcacauuuggaauguaaaaaguuguuuaaaaaucaagagcugagcaaaaauauagaauuauuaggaaucaguaggaggucaaguuaaagugguuuuccagaaaacagugcuuagagauaggagguggauaauagggcaggaaaggaagggugauugaaggauuaguccagguuucccauauccauuaaaaagcagcagagcuuggcaacaucauggagggaaacacuugguagaaaagaaaguccuugucuucagguuggaagcuccucugccaguggaaccacuuagaugauauagguaaaccaguuaacccaaaugcuuacagagagaaacauuugcaguccaagaucagggacagagauucagccuucucuagaauuauagaaggacaagggaugaugucacuuucuccauggaauugauucccagccuagaauucuacucacagcucauccugcaccccaccuagagaaccucagcacuucucacaacacuaagcaccuucugugaguaguaccuaaggaggacuaugcaucuaucuguccaugucuacuaccuuggaagcgcugcuugaggauaggaauagagcaucugaugcauaacuuacugagcacagauuuugacagcugaaaagaaaaacaaucacaguuuguguggcuuauccuucuggcucacguggucaucauaauaucaacucugaaaaugaccacagccagcccuacagcuucacuauaauuagaauggagagaugaacuaggacaagcaugugggaguggcuuaggaaaggaugggguugguaaggaauagagcuaaauugccaucuuccugagugggcaccgaacaggugaugcugaaaagugacaaugagggaauaguaauguaagcauagauauagagucaauacaagggauacacagauauaaaugagaagaguuggagucuuagggcauauauugcugaaccaaacaaccaccacgaccacaaagcaaguuagggaagaaaggguuuauuugacuuacaccgucauagcacuguucacuauugaaggaaaucaggacaggaacuuaagcagggcaggaaccuggagugaggagcuggugcagaggccuuagaggggugcuauuuacuggcuggcuuccuguggcuugcucagccuguucgcuuuuagaacccagggauaccagcccagggaugucaccacccacaaugggcugggcuuucccuuaucaauaacuaauuaagaaaaugccuuacagcugggucuuaugguggcauuuuucucaauuaagguucccuccuugcauauaacucuaguuuguguguuaaguugacauaagacaagccagcacagucagcuagaagguaaugccaccuaaaguagaaaaggccugucacuuuugucucagcaugauuguugauucuuguguauugugauaguugauucuucuauuguuugcaaauaaaaugagaaaaacagggaauaaggaaugcagagcaugugggaaggagcaggguuucaauaaaguguacguuauuguauacacacugcauucacucguucaucaauccuuucaucguccauucaucacagcaguccugggauuuagggaugguaggcaagugcugcccugugcccuagugcaugaaaugucguccuuccucucaguaggcuguagucaguugguacauuuguuuuaaugucugugaccaaaauuacagagaagcaacuuaauucaccuugugggcccaguucaucacagcaaggaaggcuugauggagauguuggcaguaggagcaugugcagacaaggaagcugagugggauuauaaccccaaucccuaaugaccuacuccugccaacuagccccacuuccuaaaggccccagagccuucccaaaugauccauccucuggggaacaguuacuuaaaacacaagagacagagcagcaguaucaaccaaccagacccucccagagcccccagggacuaaaccaccaaccaaggaguacacauggagggacccauggcucuagccacauauguagcagaggauggccuugucuggcaucaguucaaggggaggcccuugguccuaugaagacgugaugccccaguguaggggacugccaggauguggaggcaggauuggguaggugggugggggaacacccucauagaaguagggggaggggauagggggcuuccagggguggguggggcagaggggaaaggggauaacauuugaaauguaaagaaaauauccuuuuuuguuuuuuuuuuuuuuuuuuguuuuuugacacaggguuucucuguguagcccuggcuguccuggaacucacucuguagaccagacuggccuugaacucagaaauucgucugccuuugccucccaagugcugggauuaaaggcgugcaccaccaccgccuggcuuccaauuuaaaaaaaaacaaaacaaaacaaacaaaaaaaaaaaccacaauagacauuccagguucaaaucaugccaacugaaagccauaguccacuggucucucacugucagcuugcuuucauucuucugaguuggaaauauucuauaguugagcagaggcuaauuuuuuuaauugagaaaagucagugggauugaugguugcaucuugaaugcgguagucagaucagggagcccuguuucugaugacuguggucucaccacuccacuccccuacaguggccuccaucaguguccguaaugccaaugggguuggugagcaugguggaaacucuucuggaaaaucacuuacaguagacccacacgacgcagcucccuuucauggucugauuuuuccauuugccuuuacccacaugccuacagauuguucuguagucacaaaccgugauguucacgguucauacuuuaugcguauacacuuucuuccgcuggcuuauuuucaugaggcaaauucuuagucaugaguuaauuagauuaaagauauaaccagauuuagugucuguaacuguuggcuuuccaaaggguaaugacauauccaucugcugcaagguauggauaugccuaacacucgugguggugacauucuguuaaauuugaaagcgugaacaacugccccuggguagucuggggauuuuauugugagugauagugacuauuuuuccaucugugaauuaugcugcuccucuguccguaccccuuauuuaccuaagccuaaguguuuuguuuuauugggugugaaucacuguuacaaauguugacuuucuaccaggacuguaccuucagaaagcuuucauuauuuauauuucuuacauuaucuuaauguaacuuguaaucaugugggaauuuggcaguaauuuaaaacuuuacuuuuuuacccgguugccucaaaagagaagaugaguaaggaggagaugggccugaaacccucuucuucagagugugugugcaccugcauguguaccaugccccuuaaauauuuagaaugauuuuuguguauuuaauuucucccagauuacuaaucagcuuuuuaaacaauacaaaguagcuuuuagguucuaaccugcuaggucuguuggugucuaaaaaguuuaccguagacuuuuaggaagucaaaaugggugucugacugucuuggucucugucuuugcuucucucugucuuucucuuucuguaugucugucuaugugugugugucugucuguguagguaaagaguacuggcaucaucaacaguugguacauggcuaaguuuuaguuucacugaugugucuuaauuuugccaguaaggugagauggccagggacccuggacacuuuggagucauuuggggucaggucgaguuucuugugucaucauagcugugaaugugcccaggcaaauggcucacaaguguucauuccuuuuuuuuuucugccccugaaguuuggaggugcugguuccuaacuuuacuucugcccugaugaaagaccuguugugcucuguuggagaggauggguuuaggcugggcuggaaaaaaguguucccguuguucuacaguguaagucaugaggauaugucuucuggccagcacgaucgaaaaggaggucucugaauucaggagagcccaaggcuaccgcccccaccuuuuuuuuuuuuuuuuuuuuuuuccacuuccugagacuuaugggagaggucugggaaguagggugaagaaaggcugaauuuuuuuuauuucccuugaaaguuucuuggucugggaguugggaauagggaagugucaucuggaggaugccuuuaccccagggccugagucgucauuuguucagaggaaaugaugcacucaugcaugcccuugguuuguaaguugcaggaggaacaugcugugugagugugauccccugugcccaggaugaucagggagugcguggucacugcugggugaaccugcugcuaguggcugccaaguguuggaggauuuuuaauuuagaucuuggcuguugcaguucuuugaugcccucgggcuuggaccccagcaucuggucuguggggacagaauuguuuccuguuugguuguggggcuagugcguggaggagggugaacuagauggggagggaagauggcaccuccauagggagaaucugcuacacucuagagugcugguuucccugugucguguggucuucugugugugucuguucuccacacugaccugugaacuagagcugaaggagaccgaggauuuggagugugauggucccugugcugucuaucacaggaugaucgugaaggccuggagcuggggcaccuggucagucagcaucaucgugcaaagcggacaaugcuugcuggugagaagacagaggagccuuagaguucugaaccuccauuggguagaugguggccauggaguaccuucuaggaguucuagacuucugggugcuuaugugaccugcuucccaggcuucuccaugaaccucaagaaagaagggauguauuuggugcucugaagacaggcuggucuugucuaaaagaggaacaagugguagcacuugugacauuuugcugucucaacagcacauuuugauagcuaaguugguugguucuaaaugaguucuagcuuuacuuuuuccuccuacacaggacaauugagcuaucucugauuaucucuguccccaccacagauguccucaaaugaaagggacaaccuugauguuuugaggaaugucaucugguuagguuucuuucuuuggggcccauuacaaccuacccagggugcugcauccagacagcagauccucuugucuucucagggucccuacagagaggguagccccucaguguguaguagcugcuccaccaagcauggaucuaguuucacaggcuagccacucaaggagcuuguuagcccggaugcagagcccagccaguccuguacagaguggugggugacuggacucugaagaaugugagguugauucugaugaucccggguaaggcccucaucauagcaaccaggaccagucauauauucccuguuucaggugaggaccccaagggccugaauagggcagggacuugaugggccaggccauguggagaaggauggucccuaugccuuuaucugaaagagcuggggcuucucccuguuguuccuuguuugauucuguggucucaugccgguggccaugagucugauguucagagcucuugagcaccugggaugguguauucccacucauucuuggaggguaguuucauggaaguguucugguagugggguggugcugggauagauguggggcuacuggguggcugaggggccauuccugcugucucacccaugccuccuggcagcugccccagcuagggugaggaaggagugagagguggggucuggaugguucacaugauugcauacuuugggguguggcugaguacaggcagagcccauuuguagaggagucaugcuccuuugugucauuuucucagaacauggcaagccuucagcuacauucgugcucaucucuaaaacugauuuugcaaauagccuguagucaggaaagcuguagcaauuggguauuucaggugucuggguagagggauuaauucuucacugccaggguggccuuguuuggaauuggguccugguccuauaucugggccuuucuaaccuugacaguguccuugucugcaucuaugugugcagugcgguuuggggggaguaguaccccuuccuguacauagggcugggaugguaguaccucuuacugucuggagccucagauccuggcccccucuuucagcuugaguaccccacccuguuccagcauucacuugugcuuuauuccugagggugaugacaaagggaagugcuacuggugggccuggcucuguggcugacagauaaaaaacaacauacacuguucacccugcagcuccaaggcuguucccaaagggacacuauaguccaaauuuauuguauuuggccaggaagccaagccguguucaugguggguagcaguaggagauaggaagauggaguuagggugaaugcuggcugccacugugggcuuugaggcaucucacugcccaaacagggacgucucauuucuguauagacugugccugggagcuguucucagacaguaggcaaaugaacguggagccguaaaggugucuuuguguugaccccacaguuguauuuuguguaagccugcugaucuuuuagguuucuuucuaccauggcuuccugugaucaagucuucauuuccuugguuggcugugaugguuaaaagaaugugggcaguggaauuccuucuccaugguucagauucugggcacugcccuugccuuccuuucuucuguauguauuuuugaagggaagguuucccguguagccuaaguuggccuggaguucacagcagagcccaggauuacagguaugagcuccguguccagcucuuugucacucagucauaucccccuugccccugagguagucacaugaccuuucugaacuccagaguucuuggcauggggaagaaggaacaaucaauacacagcuaagaagaggaugagauaaauggcugagaaaguucaaagcagaguuucugguacuucgaagacacuuaaaaauuguuguucuaucuuuuuuguuuuuuguuuuuggaagcuuauuuaaccugguuguuguuuaaccuuuagcuaccacuaauaguaguagguccguguuuggaugaacagacagauaugacgggacaguggagauuucaggaaguugaaugggagccuuggucuuucuguauguggggagcagguuugaagcugacugugccucaucagucacugucccugcagguccuccuucucagaagaugcacuauuauagauacucgaacgccgaggucagcugcugguacaaguaccugcucuucagcuacaauaucgucuuuuggguaaguccagagauguggccacggucccuugugugaucgggaccaccaucaccaagucaugauucucuguauauuccugaugaccagacucuggggagguccuagaaagaggcagugggcaggugccaugguccucauccuuauagaaccagccaggaguaucaucaugggugggcucaggugauggaaagacaaauuaagggguccagccuaguuuggguggcucaggaagccuuuggucacugucuugguguaauagugcugucuuccuaucccagcaaugcacugguacgacaugaacagccuuguaggccaggcugucuucuauauccugggagggggauagucaguacccagcugagaaggcuguaaugagggcuccgugguuuacuaagaauggcguuaguuugcugagcauugggggguggggcagcuccuugcuguuguguauguguuuaacagagugugcugagccugggaugcagagagugagcugggcggcugaguaucaccgaacaggcugcccaguggguuuugagaaagaaagauucagucagagugguaguuaccgaggcugucuggcuggguauccgguaucccgaggcagaagugaggucagcguguacaaagcaggacaggcacucaugagacuggagcugagugaggaaggcaacacagaggaggacagggacccugagaagucuggccagacagcucuccaugugcaccgagaguaucuuucacuuccucuuuugcugugcuaggaauugaguccaggaccuugugcauugucagguaugcacucugccaugaaagcuacaauuuuuauuguaauaaaauuuuuauuuucagguagcccccccccccccccccauacauuuuauuuucagauaguugcuacccugacuaguuuaagguuugacacaagcaagcaucauuugggaagaggaacucucaauugagaaacgccuccauaagguuugccuauaggcagaucuauagugguuggugugggaaggcccagcccguugugaguggugacaccccuggcugguggaccugagugcuauaagagagcagguugagcaagccagucaguaacaucccuccauggccucugcaucagcuccugccuccagguccuaccccacuugaguugcugcucugacuucccauggugauggacuguaaucugugagguaaaauacaucuuuuccuccccaaguuacuuuggguguuugucagagcaacagaaacucucauuaacacaauugcccgggaugacuuugcacuuaggaccccccugucucagccuucugagcaggugggguuaugaguuuguguuaugaguucuuuguugaccucccaggagcuuuuauguguguguugugugguuggaccugacugcagagugagagaaaggucagcugagcccuaaugugagauggacuuugguggggucugugaguagugagagguuuuauucccuggcuggccuuguguggguacacccugggggugcauuuucggacgguaugggagggagagaacaucaacgugagugugcaugccugcugaggucuggaguauugucugagaugcugaggcgggguggagaagggaagcucccuuggaccuggccaaaaugagcgcaagccuggguaaaaaggagguuugacauuguagaagcuuccgugguagaaaagagcggucagccgugucacagagccgugaccuugguuguugcuggagaugggaaggaaccggcuacgccgaggagguuggucaacagaaaguguagaagugcaauucugaccaacaacaguucuuuucaaguacucuggccucaaaagcagaaaaacugggcaguugcuggaguuggucagggguuggggagccacaauguguguuuggccaucaagucugagcagggcaaggcagacacuggcacugugugggaaggugaggggaaggauuggugcguugaagcuuuucugucggcaagcacaguggucauugggggccauggagaaagggggccacuuccuaccuuuucauucucagcuuucuggcaucauguccuggcgauaugucucugugugauuaggaguucuuguccuagagaaagagggugaaaugcaguggaaugucugucaccccagacuuuuccugugcuuagucuucagccucaucuuaguucccgaugugguaucgcuaggcagcaguguguguguucaccuucugccuaugugacaaaaugccagagauagcuaacuuauaagagagaggcuaagagguuccacgaucaccuggacuguuggcuuuaggcucuggugggggugucagcuguggaguaugacagcaaagugcuguccucaaggcacaggaggcaaggagugggcuagaaugccacaguccccaucauaggcaugcagucagagaucugcaaacuguagcaguagguccuuggucacagagaccuguacaacacucuuaccuccuguuguagggcuccucagacuuggauuugcucccugucuggagaacauugcuuccuguuuccucaagcaaggccccccccuugccugcuugacuuuugacuugaucuuugacacauccuaauuguugcaggcagcacaauacccucauugucauggccaugucccugguuaccucuuccuucagagguucuucguaacaaauucuugguucuuagaggacaggacuugcuuacacacuggcagcacaaaauucacacaguucaucaaauccaggguuguggcaagccuggacugaaguaugggguaguaguuuaaggauuuugcagacuuggcaguuagugugugugguugagaguuaaucauuucuguuaguaagcacuggggcagaagaggagggaacaaacaggaacaguuaggaaaugcccucagagaauggacguggggaacuggggccccuugguguuggccgcuguccccacuuuuccuggcaggaaguuacuuuaccugggcaggaugcagcaguguggagggaggcccaggcucugagacccacagagaccugggaagcucacauagagugcagugaggugaggccagccugcucuggacaccuggauacaguaugcccucucccggaacccagggaccuugaaaaaucugguguugccccugagaaacguugacauugaucucagcugccuggugucuccauuauguaguuucagaaaaaggggaaaguggcaugcuaaguccguauggcuucugaguuucuuuuuuucuagauggagacaauagaagaauauaucacaguugcaccauccagcuucagaaaugaauucagcugguuuuguuucacuuuuguuccccaaccucuuuuggauuacuuugaaucaaagcccuggucauuuuccauaccaaguguuuguguuuguuuugguggggaagaacugcucaauaggccaguguugaguaugcagaaggcaguuucuauagccaggucaagguguagggacaggcaggcugcagcugagccaccaccugccgcuuaccauugcucccacaccguuuucucuaguggacagauuccuguagcauucaaggaacguuuguuuucuuuuuucugacuuuggggcuggaauucccagagaccagcauccauuugguaagaugugaaugcugcugucugugcaccgaguuaggcuucuuuuguuuuuuuuuuuuuuacacaggaaugguauagaaaauuguuuccugggagccuagugcuuugagagcacaccccaccacacacacagauuuuuuuuuucuuuuuuccuuuuaucacuuuuugguugugcuagaccuguuucuaguucagagacuuguucaacucaaggaaaugcaaauuaaaaccacaguauaauauaccucauacccacaaaggugucacauguuuucuuuuaaaaacaaaaaagcagaagauaaauauuggcguagguguguagagauuggugaccuucuacacugugccauggaagcaagugauaaucugugaugccaaacugguguuacuucccguuagcaaugacauuaccaugugcaaccccacuucuggauauauaauaugcagaagacugaaagcagagugucagauguuuguacaccagugugcacaaucuuacuuaucacagccaaaagauagaagcauccuguggccuuuguugaucagggggucaggaaauguggcaucugagagccugaaucacuugaggacacaugcuagaguauagaugaaccuuuaggacauuauguuaaguagaauacuccagauuggauuucauuuauagguuagaggcuguauggcuccaugcagacuaacuagaauagucaguagaaagacauagacacagagaguagauuuuggcugccuggcagugaggaggugaaaacggcaggcucgcaguccauuugugcugcuuuuauggaucacugcaagggucguuuauaaccagaggagauucucugcugcauggcucuagagccgucguucucaaucugugggucgaaacaccuuugagggccagaugacccuuucacaggggccgccugagaccaucagauaguuacauuaugauucauaacaguggcaacauuucaguuacgaaguagcaacaaaaauaauuucaugguaggggucagcacagcauaaggaaaacuguauugaagggucgcagcauuagaaagguugaggaccacugcuccagaagcugagaaguuuaagauuggggaagucauaacuugguggaaaacaucacaugggugagagaauaaaagggaaaagggaggccaaagacagcuucuccgucucucccucucucucucucauucucucucucucucugucucucucucucucuuucucucugucucucacugucucucucuuccucucacccccccuaaugcgggggggcgggugaccauagagccgugugugugcuaggucagcgcuuugcuacugugcuuuguaccauucaaacuccauuuuauggcaaguccacuuuagcaguaaugaguuauuccauucauccucagaaccuacucuccucugaaaagccccacuucucaacacucucacgauggggacaaagucuaacauguggaucuugagggacacaguccaaccacagcaggagauuauuguuuaaggggucugguuucuguuuuguauuguuaaaaaaaaaauucucugauggcugauucuguuuugauagacuuaaugccacugagcuguauaccugaacaugguuagaauaaguuauaucaugugcguuucacugcaguuuaaaaagaaaggucucauuuuagcaggcagaggaagagaaacugugcagcaaggcugggggagccguggaaggccuugucuuuguucacacacagccuaguucuguaaagcaugugcacuucucuuggauuugcuuccugaagguucuugagggguauugucugcaacucaggauugcuuucccccauaagcguugaccauagucucuacaaguucagauaaagcucuugccuggaucuuauuucaaagauagauuuaaaaugaagacuccaucccugcuaaauacagacagcaggccuguguuacaccacaaggagaaccuucugccugucuuuaguuucaaaaaaaccuuacaaauaaaauaacacucugccauugacauccguaaugacuuuacuacgcuugagcccuagcucugaaccuaacugugcagccguacuucugacugagacaguggaacaggagggaaggacuaucugagcucugugcaugaccuagagcccuguccuucagggcaucugauaccuccuauguguagggugaggguaauucauagucuggaucgggaaacuuaagaacaagggagaguauugagaguuuugccagaacaacaaaugagccucaggcugcuucuggcacucugggaccaguggcugcccuucuccagagagacagcaagaagccugguagaaagcgcagcccuaacccaugcuucaggugauggaggauuggucuucccccugcccccacugggcucgagccaugacgaaugagacacaggucugauugcaguugguuucccggcuuccaucggagguguccucguuuucucucucccuacucuuccuccucuaagauaaggucuccuguagcugugaaugaccuugcauuucugaugguccuccuggcauggacuacuugcugucuugccuguuuuauauaggacuggaauuugaaccucaggccugcaugcauguuaggcagucauucuaucaccugagcuaugcccucagcuccuuugcuuccaucuuucaaaugacacauggcuacuacuuuaauagugauacaguguaguuuugguauuaccuuuucuuucaagaacucuugaguggacuuuugcaguugcaugaguuccacaagacuugaacaaggcgucccaggauaguuugcauuccucuuccaugcuacaauugucucuguagauguuuguaguuucauguccuuggggacaauaucuucaaaauccggacggcugcauuaucacaucagcaucagugguguggcacauucagguuguugccacacagucuagcugguuguguuuuuguagaaacuuguacuugagauauuagguuguuucagcuuuucuuucuuccagauaagguuguagagacuagguuuauguaauacagauucuucccuguaggaaagggagggaaguuauugccggaauggagucccaggagugagauuaagugggucagaagguguguacauugauuugaccuggcugacacacuuaacagucaaaaucacuuuuccagaagagcugccccaguacacaggaagugagcugccuuaucucuuggcauagguagggguguauauauucucagucucagucuugccaaggcugagggcagagggcaaagacugcccuagucagggacuucccuagaacuaagguguggaguauugacuuccaccagccucagccaugugugaagcucaaacugcuagggaauuuauggaagaagguuguccuaggagcauggaggcuagugcacaguacggggguuguuacauagccacaggguucaugcaaguccccucccccucugugugugugugugugugugugugugugugugugugugugugugugugugugggugugugugggugugggugugggugugggugggugcacgugugugcauguggcucacugguguaguaacuguuagaggccugccugcuguguggaguuccucacuuccaucuuguucacuguguuuuuuucuuauuuauuucuucuucagaaauccccuuuaaaaauucuguugagggucugggagagggcucagugaauaagucacacuauugccaaagugagggcuggaauucagauccccggaauccacacaaaaacugggcgggugcucagaaggcgggucccugggucuaggagacccuggcucaguaaauaaagugaagaacaaggaaggcauccaggacaacuaaugcccucugcacauguacuucuuucuggcucagucuuaggguugguucauccccugcccucgucccccuuccuauuccuauuccaggucaugguauguguucucuugccaccacacacccuugucgugaagccuuuuuauucugucucaugagccccuucuggaucccuggucucaauccacaaugauuucuaauauuggcugagcaguuuguacucccaccaacauuguauaagggccccuaagcacuuagcuuucuucauacuggccauucugaccagggagacauguagucucagaguaguuuuaauuuguaccuccccgaugucuggggauguugaacacucaaaaaacauguauuuccugaggggaaagaggcagguguguuaaugcacaccuuuaaccccgguacuaaggagucagacgcugauagauuucuugaguuugaggccagagugaauuacauggcaaauucuaggccagccagagcuaccuggucagacccuguguucuguucauucaguucauuggucuguuuauugauugacacuuuggguacuuuuuuuuuuguauuuaauguuuuuugcaauucuauauauuauaaaccccuuagucuaauguagcuggcaaaguuuuuuuuuucccauuuuguaguaggcugucuauucacucaaguuggggugugugugugugugugugugugugugugugugagagagagagagagagagagagagauuuugucauuucuugagccuauuuuuuugugcuauuacaguucuacccagaagauuuuugccuguacuuguauccugcagcgcucucuguguguuucccuuccucagcaugaacuguguuuuaugcaaggagagauggauuucacuacguaucucuggcuguccuggaacucuguaaccaggcuggugucggagucacggagaucccccugccucugccuccugagcacccuugcuucuuuccucuucucacuuagguuuuccucugaauuccugcaguguauguggugucugucagucagagaauguggugucagucauuauauucgaugucaguauauuugguguuugucuucaagucuuugcuaauucugucuuugcucuugucccuuuguccccuguuuauuucugucaccuuauuacgggucccuuuuuucuuucaguacuuuuuaccuggaguccagguaguuauucgugaacauauucuucucuaauaguaugauguucuaacauacuuuauuaagggcaugugucaugaauuauacucaguugucagcuguuaagaacugcuaaaacagcuaggcuguagugacucacgccuuuaaucccagcccucaggaggcagaggcaggcagaucucuugaguuguggccagcaaggucuacauugaguuccaggacagccagggauacagagagagaaacccugucuucaaccccccuccccucccccccccccaaaaaaauacccugcuaaaauaauacaaaaacauaucaaaauuacagauacccagaauuuaugugacuacacuaaaggaaauccuguccuccaucucuagguccagaugguuuuagugugauagugucaugcugggcuuggcugccuggggccuuuaggucagaccuggcucugcuuguuuugagcauaauuuucacuggaaggaagccacauccaucaucuggcuccucccaucauucaccgcuaguggaacgguugcagcagaguucacagaacguacgacacugagaguguuuacugucuggcccugguuuaguaaccuggauuucucauuuuaaucauguguacuggaauagugaaggcagagacugccaugcuggggcgcuaccucagccucccuuggaugacucuuccuccacugucauuccuggacuucagguuacugggucaagcuccaguuaucacugacacuguggagcagcccuugcccuucuucugggccuuuugcuggguccccugcauggcugccgagggcacaucugcuucuuguucacagcagccacccauccggagagaggaaaagcuggugugugauagcuuugugacccugggcauggugccuccugccuugggccccauuucccccauaaugaggaagcugaggaagcuggcccucgccuccccucugguucucagaccuuucaaacuuccuuugaggggcagguuuuuucacaguuuuaaaaucgcguguuuguuaguacugauuguguguaugcauauuuguguguguguguguguuugcauguuccaugcugugcauguuccaugcugugcauguggagauagaggguaacuuugccgcucugagggucccucguuucuuaaugggcagggcuguaaaccccauuagauacacugugauucaacauucagcccucuggguggaauuucaaagucaacuugcguuuagggcagcauuuucagccuauggguuacaaccuuuuuggggccgaacgacccuuuuaggggucgccuaagaccaucagaaaauacagguauuuacauuaugauuuauuaacaguagcaaaauuauaguuaugaaguagcaguggaauaauuuuaugguugaagguccccacaacaugaggagcuguaugaaaggguuacagcauuaagaagguugagaaucccugguuuaggaucugugucuucuggaggccaaucugaccccaaguuuaguugaaucauuggcaucugaaagucuaaaguaucucugguguucugugagcccacacaccuugggauuuucuguucugguguaugccaggaccaugguuuugcauccuaccuggcaggacuuagguggcaaagcauagccagcagagguacuugacugucagauggagcuacagaggcggauggauggcuacucagcgaccugagaugugugaagaacaaacuggauaguauaauuucuucuggcccuugcucucucuggcuuucuguuccuguucuuccuggcuucucuuccugaauaccacaucucuguuuuccccagaggcagaaacugagccucuagaccagggaccuuuucuuaggacacuagucugggagcuggguaaggcuguaauaguuacuuucuccaugcugggguaaaauaucugacaaaagcaacucaagaagugaguuuuuuuuuggcucaugguuugaguguaucauggugguggcaggagcauuagguggcuggucacagucaggaagaaaagagagaugaguguugauugauauuccacccauuucacuuuauuuuucauuccauccaggaccucugugaggaacuaugguuuuacaaccucagguaaaccucuuuggaaauacaugugucuucaguugauucuaaaucaugcaguuggagaugaagauuaacaguuacuggggacauacaaaaucuucagggcagcacaugcagcuauuugaggagucacuccagugacacuucaggccucaguucuguacacaggacagcagggcucccucuguguaagcaaauucuguuagagucuuucaccagcccuuucagccuguuagaagggaggucucuguuguauggaggaaagccuaggcgcagggaagguccacuugauaaaauguugcagaaugaacccugggaugcugaccugugcuguguauuuauuuacuacuauucuggacugcaugguguuucagugaguuccuuucugcuuaucucugagauaucucuaaggaggcccuggucaucagcccgaguuagugaagagauugacugagaaccacaggucaggagcccaaagccucaaaauguugccugacuacugauggaaagacaagaugucuggcgucuacaagaguuuccuacgcacuuagaguuaaugcaaaggggcaaggccuuuggguccuggguggcugcuccugaccugcuugacauuuggaacuuucuccuccuucucuccagcaagacuuagacacuuuuauugagauuugagccuccuuagcuaaagugcaggaggauucuuguggcuuccaggauaaggcaaaccuguaccagcuuaggaagccccacuaugaccucuuuguuuuuggaagguguccuauucuugaucaucaacuugacuaugccuggaauuaacccaagcuguuggguauguacaccuguaggggauuuuucuuaauuaaaucauuucaagugggaagacucacguuuaauguggaucuucugagguggaaagauaacaucuuuaaucugggcuacaccuucugcugacggccuguauaagggccuggaagauagaagcuuucguucgcucuuugcuugcuugcuugcuugcucuugcugaccagcccauugcuucacccacugacaucagagccuacuucuuugggauuccuacauauacugaaagcagcugaaacauccagccuugugggcugagcaacuacuagauucauggaccuucuuuagguaggcagcuauugguagacuagcuggaccacagccuauagggcauucugauaaauucucuuuauauauucacucauucuauccauuucauuucucuacagaugcuaauacagaggggguuguuguugugugugucuggggccuucuagaucaauuaacucuagggaagguagcccagagaguuuuacuuaauaaaccaggcccuggaacuccuugaauuuuauugggagcuucuuuaacccauugucccagugggaccuccuucuccuguaauugcuccugaaucucuacaaagacucagagauccuucugcucugguugggauguagacucuuagaaugcgcauucuuaacaucugguuguauaagguaguugucugagaauugugcagccuagaaacuccucuguggaauccuucacugggucuucuguagauguuuucucagguaugggacucagaaugcugcuugcucuucuggcccagcacccuguagguagugagauaauguguugucagggguacagcuacccagaugggguucguaagucugucaccagcuagcugugugaccuuggacaaauguuucuacauuuguucuacaucugugugggaguucuggggaggaagagucauccacuccuggagcugcuauguguuuccaggggcagguuacuuccuugucugguccuuucucaggguccuugaccauaauuggucuccagaguuccugccuugggcaauauucagugacuucugcucugacuuguggcuguaaaguuccuaucuuucugguaugaguuaacuucacuucuuccuuuaagacagugagagaagauguauucuuauucuuagucaguguaagagaaaacauuguuguauggcugugacugauacagcaaggaaucuccuauaggucuugaggaugugugugugugcguguguguguguguguauguguguguguguguaugugugugagacaugaauggaagccugccugcauuugcacagcuugguauauaugcuuuggcagagcaaacaucuuucucuuuguuaccccagggcaacaccuuuaaucccagcacucaggaggcugaggcaggaguaucucugucaguucaaggccagccugcuccacauagcaagguucaguacagccaggguuacauagagagaauaugucacaaaugaacaaacaauacaacucagcgugggcucacuaacacuuaaguauauguggcauuaaggcugcuuuaauguagugaaaaaauaaaugggaaucugugggaaccaguggggaggaggggguagggguucuagugucacugaucaaauguuucaagacagccugggcacaugguacccgaagugggugguuaggcaggcaggcuugguuuugaaugagaacguggauagaguaguguuagauacuugcagucuuauugcccccauucuguauaugugguuuggaugugauaggcucuugccuagccccaagcagugggcgagacccagaaguaugccuggaaggagagugggaagaacccucggcuuccuuugugggauucucacaugggcccacucuggaccauccuucucugcgugaguggguuaacagcccugagcagacagacaccuuugucuguagagaacauggcuguaugguaggcacgguccauucggcuuaggaucagggcuacaaggagaaccacgccacagguaguucugagugauggacaggggucagcuucacauaagaaggcaaagguggacaucucagggagaucuagauaugaaggaagaggaggccagggacugauaccagagaagaaccuuuaggccaggaauggugcgcugugguggaaucuuaauuuucuccuaggugugaggggaagucauucgagaguuuguaggagcggggugaccugcccauagccauguucaguaaccagcagcucugaucugaguucacccaaccaggacagaagucacuauaaaagcuguguguaccaaacagaaggccuuucccccauuauucccuaaacaauacaaggaacacuaaauggcuaguggacagaugguggugauguuucaugaaggaaaagaagcuggggagaaguagacugaaucccuggagacugcagggagaugguaggcaugagacaggggagagcugcaaggcugcuaaucguagguauggauaauaguuaaaggugugggauuccugaguccccugacugcucaaaggguucuugcacuguuagguuugccaucauuuaguggggucuguaagggaagggccggaagcaggcaagggaggaagacagccccgcccgagcugugugugcuugcugucucugaaucugacugaagaaagaggaaugaccaagagcuaccucaauuuuaaggaagucagaugagaaaaaggccuccgacugggaccuuagggaguaguaggguggccuguugguuuucuugccauccauugugaaauugauggcaaggagaggaaguaaucacacauggcaucaggggagaacagagaccuucccuccugagaaacccgugugguguggggcggcucagggaacuuguccgcaagccucaggaugcucaaacaaacaaacaaacaaacaacaacaacaaaagcagagcuuguuccauuuguacagcaugggguuuauaugcaaaacaacuauuuugucuuaggacugugugguccuauggauggguccaguucucuuggcuguagugagugcccguaggagggagguugggugauguagugccucucuuaugcuuaauucacuagcuaagagcccaguaucuccugagcacaugugugucucauguuauguguaggugggaugaggaggcugcacucuggccaguggaugacccgaguggcuucuugucuguguuuggagucugaguccuggggcugagaugugaggacgguggucaugugcucgccccguaaccuugccuugcagcuggucugacccauaaagaugcucagcugggccagaagccacugaucaacucuggcagccaucagggcuguggugucuugacacugaagagcacacugaaguggguugagggugauuguuggauaagaaggaaagaaggaaacacucucugucagcauaacagucagucuccuguggcagucucucaaggacugaccuagagaucuuuaccucagcuaccucagcgcucugcgguucagugucuggaguagaaaucagcugucagcuguaacggggagguaggugcugcuuaucggcaaucuccaugucccuugguguagagagcuucugucauuugcaggauucaaaugccaccuuggacagaacacaggagcacccaacuggaauguagacuuuguucuagugcugguuucugaccuuacuuuucucuucuccuccuccccccgcccccccccccccccgcccuccccagcuggcuggaguugucuuccuuggagucgggcugugggcauggagcgaaaagguagguggaaccuugaccaggcccagagccaucggacuugaauuguccccucuucuagccuguugaguagucacuagcugcagagaggguuuguagcauuagccaucagaaagaaugugccuccgagguuguguguggugcuggaggucacuaggccagcacuaggagaguugggugggcgguuaugagcucugagaguauggaucuguucccauccuguuuccagaagccccgaguaaccccaaagccagccuggggcuguccccuaaaacccgucacaugccucugggagcgagugagcagucuuguuuacucccaaagugcuugcgcuggccugcagagaaggggguaggacucgguuuugugccccaugugcugcuugccccugugugacggaggggaccccagccucuuauugugcagacagacaaaggggcaguugguauucuaaggggucagaucuccaggggcaagguggagucauaaugcugaccuuacccaugguagguuaaugcuaguagcuuaggugcugagaucuggaaggaggaccaaggagaacccggaagcugaagcacccucugugccuguaguggaaccugucacugcuuccaggaaaaaggaagcagcacaguuuggucuaugaguuuuuaugugauggucuuaggaacagaguaaggucugcucuugagccagugcaccuuucuuagagaccuguucaccacugaugugaaaacuggaguacaaugucccagugaccugcaaacagcaaccaugcauaacagcgccaccauguggcuguauuuggcacugcagcagacuugaccuggaugagcccugaauccuagagcugguuacacagcugccuagccugacagcucuuuucucuuugaguaccacagaaucuaucuguccuuuguagaugccacuaggcacuuauaacuauauguauuuuaaaauuuuuacugauuuuuuuuggggggguggggguggggugggguauguauaugcuuaguagaaguaaaaaacaaccuaccuagguuugguguucuccuuccaccauguggguccuggggauuaaacucggguugccaggcaaggcagcaagugccuucaccuguugagagccaucucaccagccccugacuauacguguuuaaauaaaagugauaaaccaauucuuguugucccuagccucuuuccaaguguuuuuauuacacguacagccaaugauucucuuuggguggugcuaacaggaucauagacacguuuaugggcaacacucucucaucaucuacccuugcugggucgguuuccucaaaaauguucauugugaagcugcuuguagccaguugggccguggccuaggacuccccuucucugaggccuggccaaggcaccucgaaggccacugaggaagcugggucugugcucacaggagcccccagccucgguaugaaccaggaacuucauguagacugucuaagagcuguaguggacaaggacuguauacucaggggccccagggagugggcaggaacacacucuggccuggcucuugaugacagagcugagcugugugaagcagaccccuggcuucagcagcuggcugacauaacuugccccuagggccuugacuccauucuaaggacacugcuaccuuuuauccucugcuucucucagggugugcuguccgaccucaccaaggugacccgguugcauggaaucgaccccgucgugcuggucuugauggugggcguggugauguucacacugggauucgcaggcugugucggggcccuccgagagaacaucugccugcucaaguuuguaagugaugcugcagugggacgcagucuauguauacuagagauaccaauaccggcucacgucuguuuucuggccgcacaaggagggaacaguucuuugaacgugcugccucgcuaagaaggaagauuuuaaggagaaaagcccagcugaugguuccucacuagggaaguggggucuccuggaguugccagcuaauugcggggggggggguguuggggggguggggggugggaggggggguggggguucugcucaccuccuuggcucuauggcucuccugagaaguucuaaaggaauuguuuaucugcuguucaccuuuguccuuccuggcuaagaucaaacgauguggccaauggcuuuaagaaauccuuucccuccuccugcgugugaaucuguuggcugugcaguguaguucuuaauuuucuggcagaaucacgaauuacuaagaguuuaguuuuauauuuagauacaacuucauauuuaaauguauucaguuaaaauuaaauagcaccuggugaggaaaacacuuuuguuuucuuuauggucuauuauuuguugagcuuauuaggucagucuuucuucauuuggaaagcaaagcacacacuccucccuagaucgcccccuccuuaauaauccuguguuuuguaucuccuuuccacaugagcaggcugugcgcacuggcgcaugcuugcggcucuuaucugguuuucuugggaagcuuccuucacauuuccaagcugggucaaagcuucaaggcucccgauagcagcaugucaccaugaccuagagaggucuguauguagcugacaguccugcuugcccaagauagcacugaucccuccagcgugguaaugaacucugcagggaucuuagguguccuguguaaguuguuucagacaagcucuauguccaagucuuaguuuccacauccguaaagugggagugaaagacucgaugucuaggaugguugaguggaggguggggcagacagugccuggguagggcucuacacggaaaacaacugacuucuuucucaucagguggaggugggggagggcuaccuccuaggcagugauggcucagagcuuuguccuuccuccucacuucucucagcuaccagcugugccauaugugcacggguaguggugagucccauguaccgaggagguggcgugcugcaguaggugguccgcugcgucugagcgucugccaggcuggggaugcugacuaccuuucuccuuugcccucgcaguucuguggggccauugugcucaucuucuuccuggaacuggccguggccguguuggccuuuuuauuccaagacugggugagagaccgguuccgggaauucuucgagagcaacaucaaguccuaucgggaugacaucgaccugcagaaccucauugacucccuucagaaagcuguaagcucugcccccgcccaacaggccuccugcuagagcacgcccuucccaccucugcuuagucucggaugcccugcagcugagauggcuuuucugccacaacauggcagggagguauggagcaugccccagccucuggucagccucuggucagcaucgcugugcucagcugcuggcauggcaguucggggucccucucagccugcguuuuggauuggccagacaacuuuaucucccauuccuuccuuuuggguccagucuucccuagccuuucaugauagccauguugcuagucagagaccuccccaggaccuuggcccuguggauauagaggggauacagaggacagagcuccucccccuaggacagugacucacuguagagcuauuccuguauucuuccucucugggaccuuuucuccuuccuguuugagaagaacagacugccuuggggaagccuucuccauggagggaugugaccucucuggaacuuuccccagggagcugacuaagcaggcuucggcugugucccucagccuuccugccccuuccccuugcuugcagcugcaccuggaaacuugaaucucugguugcuccagcuccuggggcgaaccacucccuggcacuguggccuguuugaucugccucucccagaagcccggcuucugaaaugucuuuuccaaggaacacuugguuccaaagagaaaauaaaccagcaagcacuaaaaauaacugacccacuauuauuaaccaaaacuuguuuacccuguugcauguagcauggggguccaggaaaaucuguuuacauaagcagagagacuccugugcguuguuacugacucgggagacucccuaauccuagugaccucgcuacgccuugucuguucaguucuuucuucucuuuuguguucaaauggccuugggucugcuaguuucucgaacuuuccccugcucuuuccuaagagaagucaucccugccaccggucugucccagucuguuuugagacaggugagacaggaucuuguuauguagcuuaggcugcccucaagcuugcaggccucaaccuccggauuauuggaauuggaggaaugugcucuaccgugcccagcuuccuaucuucuaaaauguaagaggcacccacuuaguucuagggcuugugauaaaacauuagguggucauuaagucauuaaagcauccugcauaguggaggaguaggaauggcgaagauuggauuuccacuggaaaguugggugugagggaggcagagauccugcuggccuuuguuuuggcggcagaggucauagaucucuggugagugauucugucacauugaugauguucuuagugugcugggugccgcacacuuguaggccgauaagggcuuuugucagcugcacuagguaaugaggaguggagggugggacuccuggucaagucagacgguuaaugagugguuaaugagugcugcuguuuucacuuuaguuguaauuaaucccuguuguaaaugaucaacagcugccuuuauauaaaauggccaagaagguaacuagggccagcguggccuuuuaucauggagaaaggccuguuccucacuucggcuguguucucugggguaggagaggggcauaucaaugggucuuaauggagaagggguguagcuugcaugggcucugucaaggagugccucggacuuagcaugcuagcuagacuagcucgacuugguccccaugggagucagcauggcugcaguuucccucuuaaugcauuaccauuugugggugucauucaguaucugagccuuucugucuguaaaugggaacauaagaacaccuguguugagucagagaucuuggcccccgucaugugauuuuuggcaauacuuauaauuucagaaucagugcugcggggcuuacggcccugaagacugggaccucaaugucuacuucaacugcaguggugccagcuacagccgagagaaaugugggguacccuucuccugcugugugccagauccugcagugaguauaugccacuucugcagccccgcagcuccugccacuuccaaugccauccaggcugcuacuuuucagcacacugaugcuguaugguacaugcccuuggcuuccucuuaccgcccuggguccuugcaacucugaaauccugugcauacauucuggaacccuucucuguggugcucugugcuagauaaaaggaaagaucaccuuuccucacgcuaaguucugccuuaccgugagggcggugugcuccgguccugcccgcuuucagaacuucuccgcacaguguccucauugcucagaggcucucaggaauggugagguugcacaucacauguggcgggggcuggggcugggaggcaacagcuccaugguuaauccuuuucuagccuuuucuucacuugcuuucauuccuagccuuaggccuaaauccuugagcuucgggaaguugagcacuuuggguaaccugggaagaaacucuguuucacccgagcagagaucugccccgcgcaggcuucugcacagcccuguggugccuagucacggccccucagaagcaagccuucacuguuaggaccuucugcacagcccuguggugccuagucacggcuccucagaagcaagccuucacuguuaggaccuucugcacagcccuguggugccuagucacggcccucagaagcaagccuucacuguuaggaccuucugcacagcccuguggugccuagucacggcccucagaagcaagccuucacuguuaggaccuucugcacagcccuguggugccuagucacggcccucagaagcaagccuucacuguuaggaccuucugcacagcccuguggugccuagucacggccccucagaagcaagccuucacuguuaggaccuucugcacagcccuguggugccuagucacggccccucagaagcaagccuucacuguuaggaccuucugcacagcccuguggugccuagucacggcccucagaagcaagccuucacuguuaggaccuucugcacagcccuguggugccuagucacggcccucagaagcaagccuucacuguuaggaccuucugcacagcccuguggugccuagucacggcccucagaagcaagccuucacuguuaggaccuucugcacagcccuguggugccuagucacggccccucagaagcaagccuucacuguuaggaccuucugcacagcccuguggugccuagucacggccccucagaagcaagccuucacuguuaggaccugggcaggauccuuggucugggagaggccuauuugcugagguugggcagugguaucuuagguguccaggaauguuugaaaaacaccaguguagccaguguauugugugcaaugucaucuacuagcagaaagguugacaaacuguggcccaaggcccaaugaggcaaaauacuuuccauuacuuuuuggugguuguuguaguccaguuuugcauugcuauaacaaacccucugaggagaggcuugugggcucaggggaagaaugcaugcuuacuaugcaaggaguccuaacacuaaucccuagaauuuaaaaagagucagcuggcuugcagugcuggaugcuuucagagcuguggcaccugcuggagacagcaaggagcacauaggcugccagcucuguggcuaaagaacaaaacagaaggcaacuguuuccuuccaccuagauuccauuucccaaagguucuacugccuccugcagcagcacuugggacuaagacuuuggggauauucugcauccaaacucaaacauggcugaagggaaaaagaaguauaauauuuugugauguaugagaauugguaugaaauucagauuccauugcccuuaguuuuccggcacuauagccaagcuugauagaucaugguuguccaagucuagcuuaugugcuguccaagucuguguucuugcuggugagguacaauaaguccugagucuacagcuugcaucuacaaaauuuacugcugaaacaacacagauguggcucacugaccccuguucuagccuagaaggggagcaggcaguugaccucagggugugagcugugauguaauuucuguguaauuuuugcacauguuucuuggugcucaguugugauuguucuagugccuccucccaccggguuuuugacaggucuuuggagugacuaaguuuucugcuuuuccuacagcaaaaagucgugaacacacaguguggcuaugauguccggauucagguaagaauaccaacacacacucuuaaaggauccgaggaaccguuucuuaagcuugaguauuauagucuaaucuccugcuuuagaacaagugcagauuggagugcagaaacaggaagaugugauuagaaggugccacguaagccagaagugagcggagucuggguggccugcugugcaugugugcacgugcauauacacaugugcuugugugaacgugcauauacauguguacuucuagcauaugagaauucagcaguaagacacaguuuaaccagaauguagcaccggacacugaauuugccagcgccuugguguuaggcuuaacccuccaugguggugagaaagaaguuccugucacuuuaggccacuaugguacuuuguuguagcaucucaaaagaccagagagaugcaucuguaugaaaccuaguguccuguuaagaaugucaucgccacuuggggcagccauaacaaaauguagagacuggcaggcuuacaugacacuuauuuugucacaauucuggaacuuaguaggucaagaucaagcugucaccugaguugaguccuucugaggcuucuuaggaaggcucuguuccaggccugucuuccuggcuuggacaucuccccgccucucaugacuuccuucuguguguacuacuguccuaaucuccucuuguauggacagaggucaguugaucagaccauacccugguagccucauugaaacuuagcucuguaaagacccgucuucaaauacagucacaaccugagguucagagguuuggaauuucagugugggagcaugauggcacaguguauuccauaauaccucuaacaucucuguuaacguggagggagaugaugggaaagaaacugagguugauugccacuuaugagguagaaagagugggguguguacugggacaguguccccaugcacugacagguuuuuuagggggauugacagaaaaggagcugccugacucucucccagaaccaagcuuaccaguaggagacagaaucuaaagagccacugcccuucuuucuuccaccuucugugacuccgaaagcauggaauccccuuuccucuucaccuugagagacacauuuuuaauuccaggcugcagauuaccuugcaucuccagauguggagauucagagcaaauucaucuuuggugcugagaaccuuuaguuagauaggcaggauggcugcuugcccugggaggggcccagacugaacaugaacugagguguuucucaggcaggguuucuccugugguccucguccagcccccuuagaccaucaucuacaugcugugcuuugucaugccccauacagagcuaggcugucuuggggcagugcagggauugugugugcucaggcugaagccacugugcuguuucucugcagcugaagagcaagugggaugaguucaucuuuacaaaaggaugcauccaggcucuggaaggcuggcugcccaggaacaucuacauuguggcuggugucuucauugccaucucacugcugcagguaugacccagaauucaagcacugggcccuuaacacguggcaugcuguaaaggaaucuggccuaggaaauaggauguccaaggucaggugcauaacauauguguguguguguguguguguguguguguauguguauguguauguguauauacacaugagguaguaagagugggauguguacugggacaggcauccccacauaugcacaugcacacacacagugugguggcaccuguacauguuuguuguuagaguccgugccuaggauaggucauggccccuauguccccacagucugcuaccugaagggagccccuuuuagggcagacaaaugggacagcuguguccuugucuuuagggcccacaucuuuauaugguauugccuguguaguagucagaggauuggggugcauggccaggaacuggcccacuuugcggucccacccuuuuggcagauggaaguagcaggaauuaaggaggugucaggaaucuauagagugggaggugucucuuacuauuaaccggggcaguuaucccagaacuuccuugucccuguccccuggcugggcuuccaggagucuuuccucacacagacucucccuuggcucacggccuggcccaggggugaguggagcggcugcugcccacaggaaaaucuagaaaaacgucaagaguucaguuacaucagagaaacugucaguuuucuuagggcucauguguacgaggcaccgccucccuuugcgcaucuuguggcacagugaaggcugcaauuucauggagaguacacgcuaggcagcucugccuucaagagcuggacuugggugcagccacaccauauuucuguauucacugugccauuauauugaaugacaacagaacacuggagaaaagcuuguggaaaagcaaagaagacuugugugaagugagacugggcucaguuaugaagccaagagcuuaugggguggggagacagacaagcacaccaaagcuuaccauguuuaugguugucuguguagacagaaaaccgcacccuucccucauaacaugccugucugcuaaggucaggauaugucugcagauaucagggccauggccgggaauuacucucuuggcaauugggccgacagggugacuggcucugaauaguugguguuauuuuacaguuugaccuagagcucaaguauguggguccugccugguauguggcauuuuuacucccuggggucagggcaagcaucuguuucacucugugaugcuuuuucugaccucuuccaugcuugagggaugcuacagcuuaccccaggguucguuuuccauggggugggucaucuuugugguuugcucaagcuuugcuaccuugcccuugaccggguaagagaggggagguagccuccaccugcucaccucugcucccugccuucauuuugaaccgcugaucuuuggcuuugguuucagauuuuuggcaucuuccuggcgaggacccugaucucagacaucgaggcagugaaggcaggccaucacuucugagaagcagaugcagcaaauggaguugagccacauguagaggucaagccuuucacuguccagcagcagcagcagaagucgacauuagccacccacaaccagaccccagucuucggcaucagugugauaugaccucucaguuucuucuugcuggugcugaagaccaaggccccuucucaucugcccacacuugacauggcaucucugaaaagggcuugcccagagacagagaauguguuuuuauguggaguaguaacucugaggacagauggcucccauggcugcaggaaaggcuugauggcccuuauggagcccaagagcaucugcaggccucugccuccucaguaaggcuuagguagaugcucagcucauaucuucuguggguauagcaucaguaugggaccagcacugaggacaaggcuucugguuccaucugaucaagaaggaggaggagggaugaguggucuagugguacccucgugccaacaggguucgugguggugcaaacaugccagggguuugcagaauccucagccauguccaagugaauuaugccugagccagccauagccgguccuggggagcacaucaccacugccuuccaagccuacacugcucucccaggguagaacagccucguuucuccauagcauuaagcccuacugagggccagcucuccuguucuuauaguguguaaauaguuuauuuauagggguaagaguguuccuucaccauaucuucauagccucuuccgucuggcauucuuuucucagcagccuuacccagugucugggaccaagcuguccuuuucaguuccccgagugucuuaagaaccagcugugacagcuucucccucugguucacauccccuccaugcgccccugcuuggcuucccugucuucuggucucggugcuacugaaauggccaccagaacuugaauccugacugacccuuucuccuuccccgcugcccuccagggagccccagcuccugauugccagcuggaaacuggguuccucucacgaccacauacagcuaguggcccaaaguaugcugucccuggagggcaacgcuccugcagccaggcccuggcaagcacagacagcuggugcuguguggaaugcucagugcaucuuaucucuaacuuccguggugacucccccacccacaugccguguucacugucagcacuguucugaggcugcucuugaaaaugaugucugucuuacguacuggauacuccgaggcaugcuggcgucuguccaccuggggcugggcuacucucuagugcuucuuuauaacuuguaucuguccuuaccguucagggauugaguacuaccuucaguuacuugccgaaguguacauucuagugugguguauacuggugauacugguggggguguguucaugaugaugaugauguuauaauuuucuaaauaauucucuauagacuagaggaagaagaaugcuuguguuuuuaggaagugugcagcuucucuuugaccugccaaacucuuuuauggaauauaucuuuauauuaaugcuguuguuugggucuuuuuuuuuuuuuuccuuucugguuugcaaucacuauuaaaacaaaaaagcauuaagcauuuuggugauaaauugagccacugagucaggugugacugguguacaggaacccagugguugaggcaagccaucguuugcacauucugacaaauuccauguauccuccacauucucccugcaguugaaacuagguggcuuacagcuuugccauucuuggcuguaagcaucagcugcguaacuuuccucuccaggacucaaggaaggauuauucucaguuaauuuuggucuagccuuggcaguauugcccauccaggcaaaaguucaugguuccagacaggacacuguugcuugcacgagcuguagacuugcuggugaucuauaguaggugggguggauggucauuggcccugcuggaggccauggagaguagacacucccugcuggcguguugacaccaauggcuucgggcagcucuuacuguuccugcggacuugc

SEQ ID NO: 7382 - RNA, 20115 nt, Mus musculus
ugugcacagaggugauuccuggugaauauuuuuauuagaggugacaguuucccaggugacaguuuuucccaaggaagcaaaucucugcgucuauaagggaagaccacagaaccuucacuuuguaauuuaccuguguaauuuauccaagaacacagcacagcaauugcuuuaugugguacucugaccuuaaguaacaaguuguuaacagaaaacacaucaaacaaaaggauaauucucuaauuaucaagucagccaucagcuuuucuuaggagagagagagagagugugugugugugugugugugugugugugugugugucugucugucugucugucuggguaucccacuuagggccaugugcauguuagguaaaugcuccaccacugagcuguuucuuagccgcacuuuucucagauuucagguuuguuuguuuguuuguuuguuuuuuaacuaggcaugaaaauaaacuucacuucaaauaccggcacuuaggacauauuccuuugaaagaagcuucagcaguaaacuuuaaacauuaaauuuucuagaucuuuccucaaauaacucucacugguuuguuagauugaacucuguucugucugggacccuauuugcccuacugggccuaaacggaauguuaaaggcucugggaccuaaacagacaauguuaaaaugcaucaccaauucuuaguaaauauggugcaagggccuucuggcucuuggggcccuggggaaagcacagcucaucugaugaacacagcacaggccccgugcguucucucccagccagcagcuguacaggaucagcuucucccggacgcuggagucuguagcuugauuuucuuuacagccuccagaacagagaguggguucacucugucuccaaauucuuuuucucggugcucaagaaggaugcccuaaaggggaaacaggaagggaugucagucuccacucggagguguucacucaggaaccagauucugagcaccagcgguccaucaggcccugcguuugggcagcugagagcgcagaucugaauccagcaccuacccuugaggagucuggucuucugaggaaggggacugaggaagucauguccuuauauuugggacacaugaagcuagucauggcuaauuaaaacaaggguauguggaaggcuuccuggaugacaggcagauaaaagaacauuccaucuggagagaagagaaugaaaacacagaaaaacccuaugaaguagagaucagaggccaccuugaugggugcuggaugcccaucugagaagguagacccauuccuuucuuuaagccucauaaacuggggccacacuuccaacacagugaagcaaacacaucaagacugaggacaaccuaaagucacccuggaguagugaaaugauaaaaacgugugucugagaucaucaggaaucuucaauagucuuuaacucacugugguaucuggacacuugccuuaaauuucaaauaaucuguaaugugucccgucauuauaaagacaagaaaaaagaaaagagaggaagucuagucagucaggaagcuuguccagcagaggcauuugucacauacaggccuuacgaccccagaguaaucccuaggucuccuacacugaggcaagaggaagccaaauccugagaguuguccuuugaccuccacacacacauugugaugugugcaugccugcacacacacacacacacacacacacacacacaacaccaauaaauaauaaugaaaaguccaccacacugggaugacuauuaggaagugacuaaggaaauugcaauuguuuacuguguaagccaaaugcagacaggggaaagucagggaaagaauucuuuuucuuuuuuauuggauauuuucuuuguuuacauuucaaaaguuauccccuuuccuggucuccccuccagaacccucccuaugccauccccccucccccugccucuaugagggcgcuccccaacccacccaccuacucuccccuuccugccuuggcauuccccuacacuggggcauugaacucccucaggcccaagggccucugcucuuacugauguucaacaaggucauccucugccacauauacggccggagccauggaucccuccauguguacucugguucgugguagucccugggagcuccgggggguggggaucuggccaguugacacuguugcucccuacauggggcugcaaacgcccucagcucuuucagauccuucuccaacucccccauuggggacaguggaagaaugacauggggaauagucaucaucacugcugagagagaaaccaagccaacugccacccagcucuguucuagugagcugccuccagaacacaacaggaagguuccacccacuuuucacucuuuugcugauauuagauucgcuauagaauauguauacagcauagccauaaagaauauaccuauauucuuuacaauaaccaggcuucacaaaucauuuuuuaaaaacccucauaucuagagguacuugacauaacaggacugcagaaacacccuccaggaggaacuaggugaguccugcugcccagccaaccuaguucacccacuaccuugccagaagcucugagaggaccaacaaacaccacaccuaacaacaccaggaaugugcuagcccggccaugaguacccagugaaucaucaccaggcaagaaaaggcuggcaggugugccaaacccugcccuagaggccaccacaggaggccaagguaagacaaugaaaugccacagggcuagaguacgaacgagaggggccaccuucuagggucaccuagaccaggucacugagaaccacuccuaaugacaaucugugcacacaguggggugcugaccuucuggguuccugaguuuaauuucucccgagcugcucaccagcccugucucuggcugacuuguucccaucucuagguccauuacuuagagagaaaacuaacauugcagacuggcuggucgguuguaaaaaagacaugaaaucauaccuacgggcaccuacaacaaggcaggugcuugguggccauuacuauuaagacaucuuaauauauuuacucaaaaucaagaaacagaauuaugucaaauuggacacuauuuaaugcuaaauucuaauacaaauaagaacaacuaccaaugcauuuuuuuuuaaagauuagaaacuaaguuuccuauucguauuucuuuuauguugugaccaaggcugcuuuccuacagaaacaaaacaacagaaauccaaccacaccccacacaugugcaugucguauguguaguuuccacaaaggcuugucuccagguccuccuucugugacccauuacuguccacugauggccccaaggcccauguggaguagucaccugccuccuaggcccacagggaccucaucucucuuucccauaacccuuccucaggguccccacauugauucuggguccucauugccacgacuccuaacacccuguucacacacagaagaauugguuuucucccuaggcacaguccugacagcaagaguuccacgggacucucuuaugcguaccugucuuccucccucgucaggcugcuucuauuccuucucccuuuuuauuuuccuccacauccaucuucaauggcuugggaacaugccaauugaguauauucacaagcagaauaaaagugggcuacccuggcaaguacggaaacaccacuugaaaugggaagucagguucaggccucugcagugccacacuggacuaagucacugguccaacugcucaccugcucugggacucaaguucaucaacugccgucagggcaacauggcugucugguggccugacugaagugcauguaugagaugcaagccuacaguagaugugugaccagugacagcugcuaggaggaaggauggaggacucaauguagagauucagucuggggccucaaucucagauacccaugggucugaagucaauacugaggucuuaccuguuuuccagauccuaucacaaaaacuccuccaaggaugaagccuucgccuucuagguuuccagagaagccuccauuccaggcucgaaaggaguuauaccacacccccaaucggaugaggcccaugaacaucaucuuccgccucucuggaccauagaauuuuuucuacagagcaaggaagauccugugugagcaaucugcaugucucucaucccuaagaaggaugccaaaagccaaaagccccagagccugcuaguucauguuuuuucugcagucuaacacauuucacuccucccaggaucauacucaacugccuagggaaacagaaagcugccagcucugacuucuuuacaaaaaaaaaaaaaaaaagggggggggugggggauagaaaaaaaaaggaaaggaaagaaaaaaguuuaaauuuaauucuguuauuuuugugaugcaggaauugaacccagggauuuguacauguauauuaggcaagucucugccacgggguucaacuucugcucucaaggcagcuucaaucugaggaaaggacacccccucuugccaccccuacaugugcuuucccacuguccuuacaagguucuguaggagagaguacaaaggagguggcugcauaaaugaagggacaagggcuuggcuaaggggcagaagaggugucuguccuuucccacucucuugagucaauugacaagaacagcuuuaguaauaauggagaacaacuuucaagagccugcccaugcucuucucagagagcuaggggacccugcaaguucagggacacugaaggugaggccuaccuccagcuaaaggacagaccaugcuaggucggugaccucuuccagcuaaggacuagucccaccaguguacagcccagggcccacaaacccaaaacacacucucucuuucuguguuuuauuucuaaugguguguauaugagcaucucugugugaguuuguccaugugagcaaagugcucagaggccagaggagggcauugcaucccuaggagcugguguuacaggccaaggccagccauucaaaggaugcuggaagcugaaugugggucaucuggaagaacccucaagcacggaggcaucucuccaggccaccacaugcucaccuuuucauccaggaagauuuccccuuugaaguaagguuggaaaucuuccacuucucucuucaccugcuccuucaccaccgcauagagagggacaccuagcucauccaacuugggcuucaaggacaucaggucugcugcuuccuguggaagacagggagguucagugacacaagaacccagagcugugcagucaaagagcaaaccaugguuuggggcugacacugagcagagggacaaaggugacaaaauuccagaaauaagccaggccuaugugacccagccuacaucuguccgagguagauacucagccacaggccaggguuucaagugcauucaccaagccaggcauuuuucucuucuuacagugggaaagagaaguaugucugggagccucuuaacaguggcugcucccaaacaugcccuucacucucagccaggacauguuugccuacuuugucucuccagcucauuccuguaccagaccaaacuagcccaagaguccaucagacauauauguaugcaggccauauagcaacugcggccuccaggcuucugugccagccuuccucuccaccccccccccccucuaauccuugcuagacuuucuuucucuuuccagcucugguccaaccuacuggaaugguaucuuuguucuagaaagauucccacaccuguccuucuucucaaguauguucucugcuuucugcccguggcuuuuuuggugcuaggucuucaugccaccauugagcacggccacuuaggauccuaaagguugucuuacuauaagaaaaucugucuuuugcuucauagacauuccagggucuagaacauggcuggauauauggagguaaagauggacaagagguggguguggccgagcacagagugguacaggcauccuugauccucgagaaccauaugcaggaugaauaaacaauacuccacgaaucauggaaaagcuucacccuuaagaagcuuuuucacauuagaggucauaacuaaagaaucuuuuaauugcccaccucugauacaacuacaaagagacaugagaguaaugauauuuucuauaacaagaagaaacaggaagaacugaaagcacaacuagacagaacagaguugauuguaacacauuuaccaaggccuggacugaguaacaaaguuugacgacaacagaagggaggggcuauagugucuggugugguugaggaccaccugcuggagaugcgguucacugcuuuccugggcuccuuccucuggggaugucccuaaagccacugagaggaacagagucauauaacuccucuguugagucacucacacaccucuauccacccacauucuggacacuguaaguuuccacaaaaugcugugccagggcccagagcagaauacaggagaacaggcugcaguuaguaagaacuguugcuccugggaccuucucugugucacuggcuucaacagaucaugucagagcaguuuccccacugcugucuggggacacauuagauuuggaauuaaaagcccucccuuuaacacuccaccuccagggugaaagaaaauaaugagcccccaaagauggccaagucuaaaugacugugaccugucacaugaccggggguggaggggaccgagacugagcggaaacuuagcuugccaaucaccugaccuuaaaguaaaaagguccuauguuaacucgacugguccaaugucaucacugggaucuuuuuuguuguuauuguuguuuuguuuuguuuuguuuuguuuuuucgagacaggguuucucuguguagcccuggcuguccuggaacucacucuguagaccaggguggccucgaacucagaaauccaccuaccucugccucccaagugcugggauuaaaggcgugcaccaccaugcccggcuaaucacuggggucuuaaauguagaagacagaggaagaaagucaggguuggagggaugugauguaauaaugaucugagcaggcacugcugacuuuagaaacggagggagaacucacaagcaaaacacauuggugagcucuggaagggugcaaagacaaagaaauggacuuccauuacagcuuccagggggaaugcaaccagaugccauuugagaacccaaccuucagcccuguacgaugacugcuguuaaagccgucaaacuugcgacauuuggccccagcagcaguaauugaaaacacauuaagcaggcagucuggcuuuguggcaaccucugcaccacugucuccuccucuguaaaaugaaaaugaugacaacagguuguguuucuaagagaacccugagguugggcagagaacccacagguuggaaauguagcucaguugguagacuugcaugcacaauguccuggguuccguccccagcaucacagaaaacuggaugcaguggugugugucugugaucccagcacucaggagguggggaugagaagaucagaaauucaagggcuacauagcaaaugagaggucagccugggcuacaugagauccugucuaaaaaaaaaacugaaggaaaaaaaaggugccuugcagguaagacauugcaaagugugugcacucaguaauguccguggauucuuuaucucacacagaagcggaaggaaauaucuuaggguugguucaggcuuccagagaaauuugagugagaauccugauguggccaagguaacuugggaaaccaaaugguuucaagggcaagagaaccccaggccacuuuucuccuagucaaagcaauuaucugagaaugugaggcuuuugguaccaccugggcaggccaucaaacuaccccugcccucuuuuuacucauugauagaguuacagggccaugcucgggccacuguaaaauuccugcugcacuagcauucugcauugcaauaaccgcaauuccugcccugauguguauucucuguuaggggaacgacuuccauuugaguugccgaccuggagccacacuguaaguaagccucagcgucacccaagcuuacaggccaaaugcauccacacugagucccugggaugacugagucccugcucagcugcccacucugugggagcaaacagggagaaagaacagcucaugaucuagggggaaaugggccauggugggucccaaggagcaggaauguucuacagagccuccuugaggggggucccugcuugcugcagcuccaucagauagcagcuggcagcugacauuagcagugaguguuccugcagucuagaugcuuauuucaacaagugugcaacuaugcgggccaaugggagcucagaauuuucuccuguugcugcuccggauuaaaugaaaaggcagugcaggacauggcugcuaccauauugggcaaaaggcuugagggacagagaaagucagacgugugacuaaccccaccaggauauuuggagcugguacaaacaugaucagagccaaugucaaaacaaaugcauagagcaaauaacagaagcauccagaaaugucagaaggcucagagcacacauaagcccuugguccuaauggaaauaguccagaccccaaggccugaaugcuuuccucccaacagguucucagaggcacucaccgcucggcagagaaagcagccuggccugcguacagccauaaucacagccccguucuucucccacagcuccuuugcuuugaauguccuugguucugagagagaagaaauaguuacuguuugcuucuggccugcccaguccuucuucaguuguucagaugcuccugaacuacaagaagcugagcugagcucagggcccagccuaggaggggaccaggaugagcccuccaugcggaagaggaggcaagcacggacagggaggaagacucaucuucccaaggaacacuaacaaggagggcuuaaugauccaacugcacacugaaaagucccuccccgcaaacaccaacgugcaacuccaacauccaaguugcgaucauuucuagcaaaauugaaaucccuuuuacggcuggcagcacuggugggucuaauaauucuguagagccucaaaugaguuuuauauuuugacaccccucccacaaauacucuuaaaagcauauucaacuuuuucuuuuuuaauugaucuaaacauuucaacugccguacuugcaauacuuacaaacagaacaagguggaagaaacccaacaagugaaugcuugggagaauuagugcggacucauuauagagcaaccuuaauuauuuuaguauuccucggagguauccacacacuugugggauacagugugaacaaaaacaggaaagaagggaaguguggucacaugagauccuuaagaugggggauggacaaagccuugguuuuucucucucuggcacuuuucuaaggugacuggccaugaaugugagcuaccacacuccugccuuucuagggcagcucccucacccacugagcacaugauaacggcuuuucucugggggggcacuagccagagguucauccaaucagugagcccuaauguuuaccaagagauuucccugcugagccugggcucugcuguggaaaugcaccuggcagggguagagcuggggacagguacacaggcuccuuuguccuaaaaucaacuccccugcugcagcuccaucccaggcagggugaccacaaaggauugucagcuucccagaucccccuuuccagugugcaguuucuuacugugcgccaggcccuguaccaugcacggggaacacaggacggggugagcaggauuucuuaagcucuuuccacccagacaagucuauuuauuucauucuuugugacaaucucacaagccuuggaauuccucagaauacucuccagaauagcuggcuuauuaaaugacgguaaaaucuugcgugaaauauuacggagcaauucaucauuacaguuaaggcgacaacaguaacggagagugaaaaaugacuuugauaagaaaaagauaaauuugccacuaauaccaagaucaccucuaugugacuauauaagcacugaaaguaauacagcaaaauaaaaugauuuguguuagguugggacaacuauugguaauuuaaaaauuguuauuagauuucucccuaauauugcuucaagaaaaggggacaauuuuuaagaggaaaacuaaaggaguaaagcauguaucuuacccuggaaaaguaccgaggccgacaacgucaccccuuaccuuucuccaguguuuucaggucuaugucuuccaaauauuccagugcugcuuuucggggcuuggacagaaacaugucuguguuggccaggagcagugccacagcagcggcccccacagcucccacaccgauggaccacauacccauggagaagaaacuuggguccuggagaaaagacaugucuggagauugagaagaaggaagauguuacugcucccacaggacagcuggaaucugaccuccugcccaaggcuccagugggcaacucgccaggggaccagaggaggagggcccggagcagggagagaugggacugcucagaacugcucagccgcuugucugagccccaucggagagcuuggagaaagcgccgucacacacagguuugugucccaaggagcucacuagggcgugaggaggaaugagaggaauggcagccgccuaggggcuuuucuugccccucugcuucccagggaggugugugugcugcgcaacgugcugcuccccucucauacuccuucacaucgaggguggcaagcggcucagcuaucaccuccccggguagggccggccuucucaucuuccaucaaaagauacuuguuuuguuacccuaucugucuuccucuggaguuuaagaaucucccagaaacaaagccggcauucuauucaucaaagccccagcgacugcccagcagggccuccgcucuggggaggagacuggauaaucuuagucaauuucucccagcugagaauagcuuucucacucauuauaaaaacgaaauaggcuuccauuaaaaacaaaaccaccaccaccaaaagaguuucaacagcgccaauacauaaaaccaaccugacaagaaagcagaggcugccugaggccuacggccuagagauggccauuguugaacaccuguauuauaagagggcagugcugcuguuggcccucauuccauccuaagguuucgccccuccugguuguucccucaaaccuggcuugaugcuuaggucacuggggacaggacacugacaggaagugggauaaauccccuaaaaugcuuaauuccaccuggcacgaucugaccuggaaguuucuccaaagacugagaggaggcugggaaauccacaucacugcucagacagggggcucugaggagagaggaagugacucauggaggggugacguuggggagaaagggguuaacaucaggacugaagccagcuuaggaaguucaaauuugagcucugcaauaaaagagaggucacgucucguggcacaggccuguaucuuagcuguucaacaggaugagacaggaggauccuaugaaguucaaggacguuccagccaauuuauugagucucaaagcaaaaaggaggcuggggaucuagcuugugguagagcacuuccauagcacacucaaguuuuaauccucaguauuauuaaaguuaauuaauuaaccaauuaauuaaaagagaacuccaggaaagggauggccaaauaugacagaagaggaggagaagggagaggaggaggaagagaauuaucaucaucaucacuaucaccaucaccaucaccaucaucaucaccaucuaguauugacucacuuggagaaaggaggaggccagcauggguguuuaaagccgugguggcugcuacugcuacugcuacuguaucucugauuucaucugagagagaagaggaaagacuuagaaccacacaaagugguucuaugagcaacggcucaccacaaacaagugcugaaauggauucagcacaaaugagggaugaacaugacuuagacacaaucgaggucuucaggcucagcaggaaagaacguuccacaggccugcuuccaguuuuucuuuggcaagguuacgcauaacuggauuauaguucacagaacgauuaggagggaaaucacagcucccagacaccugcuguaaacaggagaguuugcgcagccuggaaagaaugcugggaccauuauaccauccaccacaguucuggguuacgggcaggucuacaggacuuaggagcacgugagugaggucauccggucacagaugugcaagcuuacaucaacccucccaguggaacccagcagugcauuuggggaguccugggaccuccuacccuaccaacacauccccuaccgcacucuuagaggcaccaaggcucuauuuuaccaccacgcaaugacaauuuacuaucaaccuaaauaacgauuuuggggaaucuaguaugacacacgauccugaaggagacucaggaucauaggcucaguucccaaaggaucauaaaaguaaguaggaagguuaagcggcuugcagaguaugaacacgcgaguuauggugucacgaggaagggagacaguccgggcaaccacagaaauagaggaaguaccuuggaauuggugugggacucgguuaacaacaugaaagcuuggcugggagccucugggagaggaaauccagaagcgcccugccuaccccuguaacagcaauaggcgcuucauccagcccauuuccugacagccaccucaagcaccuggguuuccucauggcucucaugccauccuaggaucucaaauauucucaggccuccguaagaccccaccucauucugcacguuuaaaucccuggggagaggucuaggguagaaccaccuacuagaaucaacuauccucugcaggauuugaucgugggcugaaggugcccuaagaacucaaguucacauggcccagaggcucccaucuccuuaccucaaguucaagaagcuuguauucaagaugggaguuucaaagcucccccaggugugauguuuuccacccuugcccuuaccccuacugugcucuaaaacuaacuaacuaacuaaauaaauaaauaaauaaaaauuuuaaaaaagaguggagucacuccucuggggagaacacccuauccaggcucugcaucugggcuuuaucagcaguacugcuggaggcagacuucucagugcacaggcucaugcugcccacccuagcagguggcucuugugcuggugacaggcagugaaaacuaaucgccagaaguaccgagcuuccagaacucaaagcaacuccuggcaaaucucggaauagauaccauggcaacaugugcacagucucaguagacccuggauugccugcuugcacucccacaaaggggauggggagagagguuuuagcaacuagauagaacucaugccuuuccaccugugccuccaagaccacuggccagaggagcagggaggccaguaaccgcaaauuucuaaaugucacuugacauauuuggcuuaaguuuauucucucaauugccuugugaagcagaagauagucucuuugcagggggcaacacuaagguucugaguucuguaccuucccuucugucacaggaccagcagguagcaauccugccaucuauccgcagucaacaagaacagcacuccaaagcuuagagccuuccacaugucacaccuggccucaccucaccuggccucagaaguaggauuuguggaggccaaggacaugacccuccaccuucaggcgaauuucaaacaagaagcuuauuguauucagucaucaaacacagcuccacuaugucuggucuaaaggaaauuuaccauagaccagcugucccuucucuuuucuccuccuccucuguccccuuccuuuaaaagagggccagaagagaacggaaagguuguuuacagaagagccagcccccaccugacagcucuacuacucagcuccccguggggggagcuuuaucugauccccaugucucccagaaggugaagcuggauaagacuguaaauaaacagcagcuggaagagcucagaguggcagcagcuuuggucuggagagcgcugaggcuggguagagggaagccagcuggauucucccaagccaaacuugcugccaucuuccccaggcucauucaucuucucaaacccaaaaacgaaggaguggcuccuuagacgccagggacauccucugauagcaacacaaacagccuacuuuggagccccaacauucuucuucacuaaccccacuuuggcccaccugcucauucaugcuucauccagcuuggugcccuuccccuaaauagccauccuucagcaggccaaaccugggaauagcacuuaccaugugcaguguccacgccucugcuucuacugacaaaggacucugacccacaggcuguguguguguguguauguguaggcagggugaccaggcauagggagggcuggagguggagcucuggagucuugccuaggccccuaagcuuagccacuccacaggcaggacugggccacacagaaacccuggggcuccuucagcugccaaugguuaaucuccagaaagcaucgaaguggccagcugccaaggcccccuagcucuucaaaaaaauugagcaaaguuuugagucauuugcaauuugcagucaugcagacuguaacauuucuuaagugccagcagacuccccuuugcuaugggugcauacuaaaccaggcccuuaacacagcccauaugucauauucagcaucaaagggacagguccuuuuguccaaggcucuuugcccagccugcucuguacccauuucuuacccuacacccaggaagucaacuggacugccaaggauccuuaccugguaucuauuuaucaccuccucuucucuucccgucacagugugcaaaggugcauguguguucacuuaggcauggguccugugaucagacagagccuucagguagcaaugcuuucaggaaaggguuugagcaaaaaguacuguuuauucuggaucuugucaucaggcaggauuuuaccuaguuggcauaagggcuguaagagcucagaguggcagagugagggaacucuggguaaaggaauaauaaacaguguagucuugaaagcagagugguuggugaggguguaguggccagcgaugagaccagaaugggaguugaaguuaggcccugucagcucuggcucacauguucagagaugcccacuguaugagaagcugaaauagaggguucaaagugauacgaucauucugacuaggggcuagagagauggcucagcaguuaagagcacuggcaaggcuucuagaggccuggguucgagucccagcaccucgauggcagcucauaacuaucugaaaugccagucccagagauccaaaacccacuucuggccucacugauaccaggcagguaugaacauggugcacagacaugcaugcuggcaaaacagcccuacacauaaauaaaauaauaaauaaaucaaaaccacucuggcuacagcauggugagugaagugaaccagaguagagcuuggccaaguucauuugguucugggcaguucagaguaaugaggaucugggcuuggacuguggcagucagugaagaagaggcuggguagcugacucaagaaaugaacagaauuuugacugguaaagucuaggccaaagaaaggaaaaucgacucuagguuccugguuucuugucuggauacuugugccauucacugacuagggagcuguagaagucaguaguggauggaggucaguuuuggauauacuauaacagauccauauaacauccucuacccgaaaacuuuucaggaacaggaauggggacuuggagggcauugccaagccagcaggugaacuauuagaaguagguaaggucacccagcaaggauggauagguucagagaagccacuuaaguggcaaacucuuccuugaaagcauugccaacugcaggcuuuaccugauuauacagcccaugcauaugugaacauaggcacauuucugcacacugucaaaaacaggccucagaugcuguguuuugguuaucugucugacuucacaguaacccagagggcaaggggcauccacuccuacaucaacagaaccucccaagcaucugcuauauguaauguagguaacaugcugugccuguaagguuaucaaaccacaaaugaagggauuugaacuguccucuugaaauuccacaguggagcaaaguuggaaguagugguugcugcccaauuuuucccucugcgugaaagcucauucuggacacugcuggcuuggaguuagagaacauacucaagcuugggacuugaccuugcauugagucccagcucugcugcucacugacauagcugaggcccaguguacucacuaaauagaaagaaggaacuggagauccccugucuccagucucacacccaggcucugcagugcccagugacuacaccuacagggagggccuugagugcacccagcacuaccgagcuccuccugggugagcacacucuuacaggcacacacauugaagucagaugcuugcucaaagagcugccucuaggcagggaccgauaaagucuuaacaaaacaaaagcaucagcaguggguggguuaacuccugucugaaacauguagggacagcaaaaaauuuuaaacaucaagggaacaccugcccugcccagccucacccagagacucuucccaccuuggaaaaagcuggccuaaggcagacccaggugauggaagaaaggaaaaggagggaaagcaagaggaagaggcacaugacuuccuuggcucaggccuucagugaaaagacuggaaagacgguuccccaccucugcucuaccaucuccuguucuuaauguccuuugcuccuaaaguucuacuucaguaacccuuucauugaguaaaugaagagcuaagacccagagaagcuggcuagcccaaagucacauggguaagaaggacaucggugucuacguugagauccaauccccauuccauaacaguuuacucugcuuuagauccucaagguccuacacagccugccaugaaccaggcaccuaaagccaggacaauaugcacaugcauugccaucagaaaagcuggugcugaaaccugaucauuggcucggaacaagcugagcaagauuccuccugaauguggccugguguccagagagcaccccagucucccccaggcagcucacaaaccaaugccaaauguuuucuuaaggaccauucucuacugagaagcuggucugcauuuuucuccuauaaacagugacaaggcccuguuaagucuggaugccauugaaaaugccagcuuagcgguuacggucacagugagagacagcagagaacucccacaagcacccguggaacuggccacugcaguggccugcacucauuugucacagacaguucuguugucuggggugagugccugccucucucccacccuucacccagaugcuaagagucagaaugugaacguaugaucagaggagaauaagacaacacacucagagacacaacuuagagugagggguauagcuggcggggaaguccuuuccuacgagaacugguccccuccaaagaccugggcauucugcugacuuuucagccucuugccuuggcuuagaagacccguucucucaagucauaugaauauuauggacaggaagaugaggacaaauguccaaaaaacacuggguuccggcaaccaaauccuaacucucauucuggcccccagagaccguuuucuugcuuaucaccauaagaucuucuaaaaaucaagcugcauccagugguggcacguguuggagaagaccaacaugaaacacagcagcgcucuaggaaacuggaaaugcuucguuaugguuuucauuuucuuuauucuuuuuccuuuuuuaaaaaggaaaggccuaggauagccuagaacuugccaccuuccuaccucagccuccuuagugcugcaauuuuaggcauaggccaccucacuggguggucuuuaucuuuugcaggguucagaugaacucacucacuguccuaggaagguaaaacagacaacaacaacaacaacaaaaaagaauagaacaauuucuccagcaguguuacugcaagucagcuuucugggugaaaguuccaggcccgggggaguccugccuuacguccacauucuccacagcacauacucugaguuaacucuuuggcucucccacaacugcuccugguagugccaaaggcaaagguuacugcucaacuucaaucugccuuggcaagggccaaagagcucaugggugaggcuggcuucuuccacagcaacgcuggacagguccugccacauuaagacucuguccaagcagacucugagcuuagcauuucaaagaagcagauagccaacuagcaggagaguugcuuuuaaucugggauacuaaugaaaucguaugcaccuuaaaauuccagaccucaccaaacaaaccuucuggugccacacaagcuugaaaugaucauugcaaucccagcaaucaggaggcagagacagggggacugcaaauucaaagaaagccuccgggaaauucaaagcuacccugaacuacauaaggcccacccccucaagaagaaaaggggaaagaggugggguagagugcuuuguaccccuucagggacaacacaaagggucucagguaaaugccaucccuuauaaggaaggacaccaaggaaaggucggacgagaagaaccaaguugcaugagccuggaccagccauguuucacauuagcaaaaugggaacaauuuccuaaucaccuucuacagagaugaaucacugaagaugcuauaagcucuuugcaaagacugccagagauguuaaauucuuacuuauuucuggauuacucauugaucaccccaaauauuugaaacaaaggauuuucugaugaguaucuugugaggacccagauucuauuagcagggcuccaugacaagcaggaggauuucuggguuuggggccagccuggucuacagaaugaguuccaggauagccagagguacacagagaaacccugucucgaaacaaaacauccaaugaguauuuucuuuucacauaaaucauuuaccaaguuccaagacaagaaauguugaaguaaaaauaaaaccaaaaaucuagguaacagggcugugaaaacauuggaggcacgguggcagcgagacucggauugucaccuucccaugcaaacccugccagguuggaccuuaacuuugcucucccuugggccauuuucaccaacuccaacaaccuaacaauucggaggaugggcuguccuggagcucugauuaucucauuaccacaccucagcagcgguuugaaauuuacaacggagcuuucuaaggcaaagguuuguaacccuuagaagagaaggaggagcagguaucucagagacuuccucacaggacaccccaauaccgaaacuggauagccacggccaccccuggcagccuucagccuagcccauguuggguggaugccccuuccugagaggugggcaaacguuuuuguuuuuuuuuuuuuuuccuucaguucucugucccaacaauucaaacaucugggugggcaagaguuuuucuguccucugucccaacgauucagacugcugggugccgccagcgccauuccgggacaggggucucugggccccaagcguggagucuguccugaucgcuguggugggcugagggcacaucggagagcgguaccuggagaggaucgggucacauccucuauccagcaucuagucuccgcggucccuggccugccucgauccucaccugcgccccaaggaccccgccuccguggaccucacuggccccugagcugcgccagcggacgcaggugccuccucgguuguagugcaguuuugagggcgggugagacuaaggucuccccgcgccugcgcagcucagcg

SEQ ID NO: 7383 - RNA, 20115 nt, Mus musculus
cgcugagcugcgcaggcgcggggagaccuuagucucacccgcccucaaaacugcacuacaaccgaggaggcaccugcguccgcuggcgcagcucaggggccagugagguccacggaggcgggguccuuggggcgcaggugaggaucgaggcaggccagggaccgcggagacuagaugcuggauagaggaugugacccgauccucuccagguaccgcucuccgaugugcccucagcccaccacagcgaucaggacagacuccacgcuuggggcccagagaccccugucccggaauggcgcuggcggcacccagcagucugaaucguugggacagaggacagaaaaacucuugcccacccagauguuugaauuguugggacagagaacugaaggaaaaaaaaaaaaaaacaaaaacguuugcccaccucucaggaaggggcauccacccaacaugggcuaggcugaaggcugccagggguggccguggcuauccaguuucgguauugggguguccugugaggaagucucugagauaccugcuccuccuucucuucuaaggguuacaaaccuuugccuuagaaagcuccguuguaaauuucaaaccgcugcugaggugugguaaugagauaaucagagcuccaggacagcccauccuccgaauuguuagguuguuggaguuggugaaaauggcccaagggagagcaaaguuaagguccaaccuggcaggguuugcaugggaaggugacaauccgagucucgcugccaccgugccuccaauguuuucacagcccuguuaccuagauuuuugguuuuauuuuuacuucaacauuucuugucuuggaacuugguaaaugauuuaugugaaaagaaaauacucauuggauguuuuguuucgagacaggguuucucuguguaccucuggcuauccuggaacucauucuguagaccaggcuggccccaaacccagaaauccuccugcuugucauggagcccugcuaauagaaucuggguccucacaagauacucaucagaaaauccuuuguuucaaauauuuggggugaucaaugaguaauccagaaauaaguaagaauuuaacaucucuggcagucuuugcaaagagcuuauagcaucuucagugauucaucucuguagaaggugauuaggaaauuguucccauuuugcuaaugugaaacauggcugguccaggcucaugcaacuugguucuucucguccgaccuuuccuugguguccuuccuuauaagggauggcauuuaccugagacccuuuguguugucccugaagggguacaaagcacucuaccccaccucuuuccccuuuucuucuugagggggugggccuuauguaguucaggguagcuuugaauuucccggaggcuuucuuugaauuugcagucccccugucucugccuccugauugcugggauugcaaugaucauuucaagcuuguguggcaccagaagguuuguuuggugaggucuggaauuuuaaggugcauacgauuucauuaguaucccagauuaaaagcaacucuccugcuaguuggcuaucugcuucuuugaaaugcuaagcucagagucugcuuggacagagucuuaauguggcaggaccuguccagcguugcuguggaagaagccagccucacccaugagcucuuuggcccuugccaaggcagauugaaguugagcaguaaccuuugccuuuggcacuaccaggagcaguugugggagagccaaagaguuaacucagaguaugugcuguggagaauguggacguaaggcaggacucccccgggccuggaacuuucacccagaaagcugacuugcaguaacacugcuggagaaauuguucuauucuuuuuuguuguuguuguuguugucuguuuuaccuuccuaggacagugagugaguucaucugaacccugcaaaagauaaagaccacccagugagguggccuaugccuaaaauugcagcacuaaggaggcugagguaggaagguggcaaguucuaggcuauccuaggccuuuccuuuuuaaaaaaggaaaaagaauaaagaaaaugaaaaccauaacgaagcauuuccaguuuccuagagcgcugcuguguuucauguuggucuucuccaacacgugccaccacuggaugcagcuugauuuuuagaagaucuuauggugauaagcaagaaaacggucucugggggccagaaugagaguuaggauuugguugccggaacccaguguuuuuuggacauuuguccucaucuuccuguccauaauauucauaugacuugagagaacgggucuucuaagccaaggcaagaggcugaaaagucagcagaaugcccaggucuuuggaggggaccaguucucguaggaaaggacuuccccgccagcuauaccccucacucuaaguugugucucugaguguguugucuuauucuccucugaucauacguucacauucugacucuuagcaucugggugaagggugggagagaggcaggcacucaccccagacaacagaacugucugugacaaaugagugcaggccacugcaguggccaguuccacgggugcuugugggaguucucugcugucucucacugugaccguaaccgcuaagcuggcauuuucaauggcauccagacuuaacagggccuugucacuguuuauaggagaaaaaugcagaccagcuucucaguagagaaugguccuuaagaaaacauuuggcauugguuugugagcugccugggggagacuggggugcucucuggacaccaggccacauucaggaggaaucuugcucagcuuguuccgagccaaugaucagguuucagcaccagcuuuucugauggcaaugcaugugcauauuguccuggcuuuaggugccugguucauggcaggcuguguaggaccuugaggaucuaaagcagaguaaacuguuauggaauggggauuggaucucaacguagacaccgauguccuucuuacccaugugacuuugggcuagccagcuucucugggucuuagcucuucauuuacucaaugaaaggguuacugaaguagaacuuuaggagcaaaggacauuaagaacaggagaugguagagcagagguggggaaccgucuuuccagucuuuucacugaaggccugagccaaggaagucaugugccucuuccucuugcuuucccuccuuuuccuuucuuccaucaccugggucugccuuaggccagcuuuuuccaaggugggaagagucucugggugaggcugggcagggcagguguucccuugauguuuaaaauuuuuugcugucccuacauguuucagacaggaguuaacccacccacugcugaugcuuuuguuuuguuaagacuuuaucggucccugccuagaggcagcucuuugagcaagcaucugacuucaaugugugugccuguaagagugugcucacccaggaggagcucgguagugcugggugcacucaaggcccucccuguagguguagucacugggcacugcagagccugggugugagacuggagacaggggaucuccaguuccuucuuucuauuuagugaguacacugggccucagcuaugucagugagcagcagagcugggacucaaugcaaggucaagucccaagcuugaguauguucucuaacuccaagccagcaguguccagaaugagcuuucacgcagagggaaaaauugggcagcaaccacuacuuccaacuuugcuccacuguggaauuucaagaggacaguucaaaucccuucauuugugguuugauaaccuuacaggcacagcauguuaccuacauuacauauagcagaugcuugggagguucuguugauguaggaguggaugccccuugcccucuggguuacugugaagucagacagauaaccaaaacacagcaucugaggccuguuuuugacagugugcagaaaugugccuauguucacauaugcaugggcuguauaaucagguaaagccugcaguuggcaaugcuuucaaggaagaguuugccacuuaaguggcuucucugaaccuauccauccuugcugggugaccuuaccuacuucuaauaguucaccugcuggcuuggcaaugcccuccaaguccccauuccuguuccugaaaaguuuucggguagaggauguuauauggaucuguuauaguauauccaaaacugaccuccauccacuacugacuucuacagcucccuagucagugaauggcacaaguauccagacaagaaaccaggaaccuagagucgauuuuccuuucuuuggccuagacuuuaccagucaaaauucuguucauuucuugagucagcuacccagccucuucuucacugacugccacaguccaagcccagauccucauuacucugaacugcccagaaccaaaugaacuuggccaagcucuacucugguucacuucacucaccaugcuguagccagagugguuuugauuuauuuauuauuuuauuuauguguagggcuguuuugccagcaugcaugucugugcaccauguucauaccugccugguaucagugaggccagaaguggguuuuggaucucugggacuggcauuucagauaguuaugagcugccaucgaggugcugggacucgaacccaggccucuagaagccuugccagugcucuuaacugcugagccaucucucuagccccuagucagaaugaucguaucacuuugaacccucuauuucagcuucucauacagugggcaucucugaacaugugagccagagcugacagggccuaacuucaacucccauucuggucucaucgcuggccacuacacccucaccaaccacucugcuuucaagacuacacuguuuauuauuccuuuacccagaguucccucacucugccacucugagcucuuacagcccuuaugccaacuagguaaaauccugccugaugacaagauccagaauaaacaguacuuuuugcucaaacccuuuccugaaagcauugcuaccugaaggcucugucugaucacaggacccaugccuaagugaacacacaugcaccuuugcacacugugacgggaagagaagaggaggugauaaauagauaccagguaaggauccuuggcaguccaguugacuuccuggguguaggguaagaaauggguacagagcaggcugggcaaagagccuuggacaaaaggaccugucccuuugaugcugaauaugacauaugggcuguguuaagggccugguuuaguaugcacccauagcaaaggggagucugcuggcacuuaagaaauguuacagucugcaugacugcaaauugcaaaugacucaaaacuuugcucaauuuuuuugaagagcuagggggccuuggcagcuggccacuucgaugcuuucuggagauuaaccauuggcagcugaaggagccccaggguuucuguguggcccaguccugccuguggaguggcuaagcuuaggggccuaggcaagacuccagagcuccaccuccagcccucccuaugccuggucacccugccuacacauacacacacacacacagccugugggucagaguccuuugucaguagaagcagaggcguggacacugcacaugguaagugcuauucccagguuuggccugcugaaggauggcuauuuaggggaagggcaccaagcuggaugaagcaugaaugagcaggugggccaaagugggguuagugaagaagaauguuggggcuccaaaguaggcuguuuguguugcuaucagaggaugucccuggcgucuaaggagccacuccuucguuuuuggguuugagaagaugaaugagccuggggaagauggcagcaaguuuggcuugggagaauccagcuggcuucccucuacccagccucagcgcucuccagaccaaagcugcugccacucugagcucuuccagcugcuguuuauuuacagucuuauccagcuucaccuucugggagacauggggaucagauaaagcuccccccacggggagcugaguaguagagcugucaggugggggcuggcucuucuguaaacaaccuuuccguucucuucuggcccucuuuuaaaggaaggggacagaggaggaggagaaaagagaagggacagcuggucuaugguaaauuuccuuuagaccagacauaguggagcuguguuugaugacugaauacaauaagcuucuuguuugaaauucgccugaagguggagggucauguccuuggccuccacaaauccuacuucugaggccaggugaggugaggccaggugugacauguggaaggcucuaagcuuuggagugcuguucuuguugacugcggauagauggcaggauugcuaccugcugguccugugacagaagggaagguacagaacucagaaccuuaguguugcccccugcaaagagacuaucuucugcuucacaaggcaauugagagaauaaacuuaagccaaauaugucaagugacauuuagaaauuugcgguuacuggccucccugcuccucuggccaguggucuuggaggcacagguggaaaggcaugaguucuaucuaguugcuaaaaccucucuccccauccccuuugugggagugcaagcaggcaauccagggucuacugagacugugcacauguugccaugguaucuauuccgagauuugccaggaguugcuuugaguucuggaagcucgguacuucuggcgauuaguuuucacugccugucaccagcacaagagccaccugcuagggugggcagcaugagccugugcacugagaagucugccuccagcaguacugcugauaaagcccagaugcagagccuggauaggguguucuccccagaggagugacuccacucuuuuuuaaaauuuuuauuuauuuauuuauuuaguuaguuaguuaguuuuagagcacaguagggguaagggcaaggguggaaaacaucacaccugggggagcuuugaaacucccaucuugaauacaagcuucuugaacuugagguaaggagaugggagccucugggccaugugaacuugaguucuuagggcaccuucagcccacgaucaaauccugcagaggauaguugauucuaguaggugguucuacccuagaccucuccccagggauuuaaacgugcagaaugagguggggucuuacggaggccugagaauauuugagauccuaggauggcaugagagccaugaggaaacccaggugcuugagguggcugucaggaaaugggcuggaugaagcgccuauugcuguuacagggguaggcagggcgcuucuggauuuccucucccagaggcucccagccaagcuuucauguuguuaaccgagucccacaccaauuccaagguacuuccucuauuucugugguugcccggacugucucccuuccucgugacaccauaacucgcguguucauacucugcaagccgcuuaaccuuccuacuuacuuuuaugauccuuugggaacugagccuaugauccugagucuccuucaggaucgugugucauacuagauuccccaaaaucguuauuuagguugauaguaaauugucauugcguggugguaaaauagagccuuggugccucuaagagugcgguaggggauguguugguaggguaggaggucccaggacuccccaaaugcacugcuggguuccacugggaggguugauguaagcuugcacaucugugaccggaugaccucacucacgugcuccuaaguccuguagaccugcccguaacccagaacugugguggaugguauaauggucccagcauucuuuccaggcugcgcaaacucuccuguuuacagcaggugucugggagcugugauuucccuccuaaucguucugugaacuauaauccaguuaugcguaaccuugccaaagaaaaacuggaagcaggccuguggaacguucuuuccugcugagccugaagaccucgauugugucuaagucauguucaucccucauuugugcugaauccauuucagcacuuguuuguggugagccguugcucauagaaccacuuugugugguucuaagucuuuccucuucucucucagaugaaaucagagauacaguagcaguagcaguagcagccaccacggcuuuaaacacccaugcuggccuccuccuuucuccaagugagucaauacuagauggugaugaugauggugauggugauggugauagugaugaugaugauaauucucuuccuccuccucucccuucuccuccucuucugucauauuuggccaucccuuuccuggaguucucuuuuaauuaauugguuaauuaauuaacuuuaauaauacugaggauuaaaacuugagugugcuauggaagugcucuaccacaagcuagauccccagccuccuuuuugcuuugagacucaauaaauuggcuggaacguccuugaacuucauaggauccuccugucucauccuguugaacagcuaagauacaggccugugccacgagacgugaccucucuuuuauugcagagcucaaauuugaacuuccuaagcuggcuucaguccugauguuaaccccuuucuccccaacgucaccccuccaugagucacuuccucucuccucagagcccccugucugagcagugauguggauuucccagccuccucucagucuuuggagaaacuuccaggucagaucgugccagguggaauuaagcauuuuaggggauuuaucccacuuccugucaguguccuguccccagugaccuaagcaucaagccagguuugagggaacaaccaggaggggcgaaaccuuaggauggaaugagggccaacagcagcacugcccucuuauaauacagguguucaacaauggccaucucuaggccguaggccucaggcagccucugcuuucuugucagguugguuuuauguauuggcgcuguugaaacucuuuuggugguggugguuuuguuuuuaauggaagccuauuucguuuuuauaaugagugagaaagcuauucucagcugggagaaauugacuaagauuauccagucuccuccccagagcggaggcccugcugggcagucgcuggggcuuugaugaauagaaugccggcuuuguuucugggagauucuuaaacuccagaggaagacagauaggguaacaaaacaaguaucuuuugauggaagaugagaaggccggcccuacccggggaggugauagcugagccgcuugccacccucgaugugaaggaguaugagaggggagcagcacguugcgcagcacacacaccucccugggaagcagaggggcaagaaaagccccuaggcggcugccauuccucucauuccuccucacgcccuagugagcuccuugggacacaaaccugugugugacggcgcuuucuccaagcucuccgauggggcucagacaagcggcugagcaguucugagcagucccaucucucccugcuccgggcccuccuccucugguccccuggcgaguugcccacuggagccuugggcaggaggucagauuccagcuguccugugggagcaguaacaucuuccuucuucucaaucuccagacaugucuuuucuccaggacccaaguuucuucuccauggguaugugguccaucggugugggagcugugggggccgcugcuguggcacugcuccuggccaacacagacauguuucuguccaagccccgaaaagcagcacuggaauauuuggaagacauagaccugaaaacacuggagaaagguaaggggugacguugucggccucgguacuuuuccaggguaagauacaugcuuuacuccuuuaguuuuccucuuaaaaauuguccccuuuucuugaagcaauauuagggagaaaucuaauaacaauuuuuaaauuaccaauaguugucccaaccuaacacaaaucauuuuauuuugcuguauuacuuucagugcuuauauagucacauagaggugaucuugguauuaguggcaaauuuaucuuuuucuuaucaaagucauuuuucacucuccguuacuguugucgccuuaacuguaaugaugaauugcuccguaauauuucacgcaagauuuuaccgucauuuaauaagccagcuauucuggagaguauucugaggaauuccaaggcuugugagauugucacaaagaaugaaauaaauagacuugucuggguggaaagagcuuaagaaauccugcucaccccguccuguguuccccgugcaugguacagggccuggcgcacaguaagaaacugcacacuggaaagggggaucugggaagcugacaauccuuuguggucacccugccugggauggagcugcagcaggggaguugauuuuaggacaaaggagccuguguaccuguccccagcucuaccccugccaggugcauuuccacagcagagcccaggcucagcagggaaaucucuugguaaacauuagggcucacugauuggaugaaccucuggcuagugcccccccagagaaaagccguuaucaugugcucagugggugagggagcugcccuagaaaggcaggagugugguagcucacauucauggccagucaccuuagaaaagugccagagagagaaaaaccaaggcuuuguccaucccccaucuuaaggaucucaugugaccacacuucccuucuuuccuguuuuuguucacacuguaucccacaaguguguggauaccuccgaggaauacuaaaauaauuaagguugcucuauaaugaguccgcacuaauucucccaagcauucacuuguuggguuucuuccaccuuguucuguuuguaaguauugcaaguacggcaguugaaauguuuagaucaauuaaaaaagaaaaaguugaauaugcuuuuaagaguauuugugggaggggugucaaaauauaaaacucauuugaggcucuacagaauuauuagacccaccagugcugccagccguaaaagggauuucaauuuugcuagaaaugaucgcaacuuggauguuggaguugcacguugguguuugcggggagggacuuuucagugugcaguuggaucauuaagcccuccuuguuaguguuccuugggaagaugagucuuccucccuguccgugcuugccuccucuuccgcauggagggcucauccugguccccuccuaggcugggcccugagcucagcucagcuucuuguaguucaggagcaucugaacaacugaagaaggacugggcaggccagaagcaaacaguaacuauuucuucucucucagaaccaaggacauucaaagcaaaggagcugugggagaagaacggggcugugauuauggcuguacgcaggccaggcugcuuucucugccgagcggugagugccucugagaaccuguugggaggaaagcauucaggccuuggggucuggacuauuuccauuaggaccaagggcuuaugugugcucugagccuucugacauuucuggaugcuucuguuauuugcucuaugcauuuguuuugacauuggcucugaucauguuuguaccagcuccaaauauccuggugggguuagucacacgucugacuuucucugucccucaagccuuuugcccaauaugguagcagccauguccugcacugccuuuucauuuaauccggagcagcaacaggagaaaauucugagcucccauuggcccgcauaguugcacacuuguugaaauaagcaucuagacugcaggaacacucacugcuaaugucagcugccagcugcuaucugauggagcugcagcaagcagggaccccccucaaggaggcucuguagaacauuccugcuccuugggacccaccauggcccauuucccccuagaucaugagcuguucuuucucccuguuugcucccacagagugggcagcugagcagggacucagucaucccagggacucaguguggaugcauuuggccuguaagcuugggugacgcugaggcuuacuuacaguguggcuccaggucggcaacucaaauggaagucguuccccuaacagagaauacacaucagggcaggaauugcgguuauugcaaugcagaaugcuagugcagcaggaauuuuacaguggcccgagcauggcccuguaacucuaucaaugaguaaaaagagggcagggguaguuugauggccugcccaggugguaccaaaagccucacauucucagauaauugcuuugacuaggagaaaaguggccugggguucucuugcccuugaaaccauuugguuucccaaguuaccuuggccacaucaggauucucacucaaauuucucuggaagccugaaccaacccuaagauauuuccuuccgcuucugugugagauaaagaauccacggacauuacugagugcacacacuuugcaaugucuuaccugcaaggcaccuuuuuuuuccuucaguuuuuuuuuuagacaggaucucauguagcccaggcugaccucucauuugcuauguagcccuugaauuucugaucuucucauccccaccuccugagugcugggaucacagacacacaccacugcauccaguuuucugugaugcuggggacggaacccaggacauugugcaugcaagucuaccaacugagcuacauuuccaaccuguggguucucugcccaaccucaggguucucuuagaaacacaaccuguugucaucauuuucauuuuacagaggaggagacaguggugcagagguugccacaaagccagacugccugcuuaauguguuuucaauuacugcugcuggggccaaaugucgcaaguuugacggcuuuaacagcagucaucguacagggcugaagguuggguucucaaauggcaucugguugcauucccccuggaagcuguaauggaaguccauuucuuugucuuugcacccuuccagagcucaccaauguguuuugcuugugaguucucccuccguuucuaaagucagcagugccugcucagaucauuauuacaucacaucccuccaacccugacuuucuuccucugucuucuacauuuaagaccccagugauuagccgggcaugguggugcacgccuuuaaucccagcacuugggaggcagagguagguggauuucugaguucgaggccacccuggucuacagagugaguuccaggacagccagggcuacacagagaaacccugucucgaaaaaacaaaacaaaacaaaacaaaacaacaauaacaacaaaaaagaucccagugaugacauuggaccagucgaguuaacauaggaccuuuuuacuuuaaggucaggugauuggcaagcuaaguuuccgcucagucucgguccccuccacccccggucaugugacaggucacagucauuuagacuuggccaucuuugggggcucauuauuuucuuucacccuggagguggaguguuaaagggagggcuuuuaauuccaaaucuaauguguccccagacagcaguggggaaacugcucugacaugaucuguugaagccagugacacagagaaggucccaggagcaacaguucuuacuaacugcagccuguucuccuguauucugcucugggcccuggcacagcauuuuguggaaacuuacaguguccagaauguggguggauagaggugugugagugacucaacagaggaguuauaugacucuguuccucucaguggcuuuagggacauccccagaggaaggagcccaggaaagcagugaaccgcaucuccagcaggugguccucaaccacaccagacacuauagccccucccuucuguugucgucaaacuuuguuacucaguccaggccuugguaaauguguuacaaucaacucuguucugucuaguugugcuuucaguucuuccuguuucuucuuguuauagaaaauaucauuacucucaugucucuuuguaguuguaucagaggugggcaauuaaaagauucuuuaguuaugaccucuaaugugaaaaagcuucuuaagggugaagcuuuuccaugauucguggaguauuguuuauucauccugcauaugguucucgaggaucaaggaugccuguaccacucugugcucggccacacccaccucuuguccaucuuuaccuccauauauccagccauguucuagacccuggaaugucuaugaagcaaaagacagauuuucuuauaguaagacaaccuuuaggauccuaaguggccgugcucaaugguggcaugaagaccuagcaccaaaaaagccacgggcagaaagcagagaacauacuugagaagaaggacaggugugggaaucuuucuagaacaaagauaccauuccaguagguuggaccagagcuggaaagagaaagaaagucuagcaaggauuagagggggggggggguggagaggaaggcuggcacagaagccuggaggccgcaguugcuauauggccugcauacauauaugucugauggacucuugggcuaguuuggucugguacaggaaugagcuggagagacaaaguaggcaaacauguccuggcugagagugaagggcauguuugggagcagccacuguuaagaggcucccagacauacuucucuuucccacuguaagaagagaaaaaugccuggcuuggugaaugcacuugaaacccuggccuguggcugaguaucuaccucggacagauguaggcugggucacauaggccuggcuuauuucuggaauuuugucaccuuugucccucugcucagugucagccccaaaccaugguuugcucuuugacugcacagcucuggguucuugugucacugaaccucccugucuuccacaggaagcagcagaccugauguccuugaagcccaaguuggaugagcuaggugucccucucuaugcgguggugaaggagcaggugaagagagaaguggaagauuuccaaccuuacuucaaaggggaaaucuuccuggaugaaaaggugagcaugugguggccuggagagaugccuccgugcuugaggguucuuccagaugacccacauucagcuuccagcauccuuugaauggcuggccuuggccuguaacaccagcuccuagggaugcaaugcccuccucuggccucugagcacuuugcucacauggacaaacucacacagagaugcucauauacacaccauuagaaauaaaacacagaaagagagaguguguuuuggguuugugggcccugggcuguacacuggugggacuaguccuuagcuggaagaggucaccgaccuagcauggucuguccuuuagcuggagguaggccucaccuucagugucccugaacuugcaggguccccuagcucucugagaagagcaugggcaggcucuugaaaguuguucuccauuauuacuaaagcuguucuugucaauugacucaagagagugggaaaggacagacaccucuucugccccuuagccaagcccuugucccuucauuuaugcagccaccuccuuuguacucucuccuacagaaccuuguaaggacagugggaaagcacauguagggguggcaagaggggguguccuuuccucagauugaagcugccuugagagcagaaguugaaccccguggcagagacuugccuaauauacauguacaaaucccuggguucaauuccugcaucacaaaaauaacagaauuaaauuuaaacuuuuuucuuuccuuuccuuuuuuuuucuaucccccacccccccccuuuuuuuuuuuuuuuuuguaaagaagucagagcuggcagcuuucuguuucccuaggcaguugaguaugauccugggaggagugaaauguguuagacugcagaaaaaacaugaacuagcaggcucuggggcuuuuggcuuuuggcauccuucuuagggaugagagacaugcagauugcucacacaggaucuuccuugcucuguagaaaaaauucuaugguccagagaggcggaagaugauguucaugggccucauccgauugggggugugguauaacuccuuucgagccuggaauggaggcuucucuggaaaccuagaaggcgaaggcuucauccuuggaggaguuuuugugauaggaucuggaaaacagguaagaccucaguauugacuucagacccauggguaucugagauugaggccccagacugaaucucuacauugaguccuccauccuuccuccuagcagcugucacuggucacacaucuacuguaggcuugcaucucauacaugcacuucagucaggccaccagacagccauguugcccugacggcaguugaugaacuugagucccagagcaggugagcaguuggaccagugacuuaguccaguguggcacugcagaggccugaaccugacuucccauuucaagugguguuuccguacuugccaggguagcccacuuuuauucugcuugugaauauacucaauuggcauguucccaagccauugaagauggauguggaggaaaauaaaaagggagaaggaauagaagcagccugacgagggaggaagacagguacgcauaagagagucccguggaacucuugcugucaggacugugccuagggagaaaaccaauucuucugugugugaacaggguguuaggagucguggcaaugaggacccagaaucaauguggggacccugaggaaggguuaugggaaagagagaugaggucccugugggccuaggaggcaggugacuacuccacaugggccuuggggccaucaguggacaguaaugggucacagaaggaggaccuggagacaagccuuuguggaaacuacacauacgacaugcacauguguggggugugguuggauuucuguuguuuuguuucuguaggaaagcagccuuggucacaacauaaaagaaauacgaauaggaaacuuaguuucuaaucuuuaaaaaaaaaugcauugguaguuguucuuauuuguauuagaauuuagcauuaaauaguguccaauuugacauaauucuguuucuugauuuugaguaaauauauuaagaugucuuaauaguaauggccaccaagcaccugccuuguuguaggugcccguagguaugauuucaugucuuuuuuacaaccgaccagccagucugcaauguuaguuuucucucuaaguaauggaccuagagaugggaacaagucagccagagacagggcuggugagcagcucgggagaaauuaaacucaggaacccagaaggucagcaccccacugugugcacagauugucauuaggagugguucucagugaccuggucuaggugacccuagaagguggccccucucguucguacucuagcccuguggcauuucauugucuuaccuuggccuccugugguggccucuagggcaggguuuggcacaccugccagccuuuucuugccuggugaugauucacuggguacucauggccgggcuagcacauuccugguguuguuaggugugguguuuguugguccucucagagcuucuggcaagguagugggugaacuagguuggcugggcagcaggacucaccuaguuccuccuggaggguguuucugcaguccuguuaugucaaguaccucuagauaugaggguuuuuaaaaaaugauuugugaagccugguuauuguaaagaauauagguauauucuuuauggcuaugcuguauacauauucuauagcgaaucuaauaucagcaaaagagugaaaaguggguggaaccuuccuguuguguucuggaggcagcucacuagaacagagcuggguggcaguuggcuugguuucucucucagcagugaugaugacuauuccccaugucauucuuccacuguccccaaugggggaguuggagaaggaucugaaagagcugagggcguuugcagccccauguagggagcaacagugucaacuggccagauccccaccccccggagcucccagggacuaccacgaaccagaguacacauggagggauccauggcuccggccguauauguggcagaggaugaccuuguugaacaucaguaagagcagaggcccuugggccugagggaguucaaugccccaguguaggggaaugccaaggcaggaaggggagaguagguggguggguuggggagcgcccucauagaggcagggggaggggggauggcauagggaggguucuggaggggagaccaggaaaggggauaacuuuugaaauguaaacaaagaaaauauccaauaaaaaagaaaaagaauucuuucccugacuuuccccugucugcauuuggcuuacacaguaaacaauugcaauuuccuuagucacuuccuaauagucaucccagugugguggacuuuucauuauuauuuauugguguugugugugugugugugugugugugugugugugcaggcaugcacacaucacaauguguguguggaggucaaaggacaacucucaggauuuggcuuccucuugccucaguguaggagaccuagggauuacucuggggucguaaggccuguaugugacaaaugccucugcuggacaagcuuccugacugacuagacuuccucucuuuucuuuuuucuugucuuuauaaugacgggacacauuacagauuauuugaaauuuaaggcaaguguccagauaccacagugaguuaaagacuauugaagauuccugaugaucucagacacacguuuuuaucauuucacuacuccagggugacuuuagguuguccucagucuugauguguuugcuucacuguguuggaaguguggccccaguuuaugaggcuuaaagaaaggaaugggucuaccuucucagaugggcauccagcacccaucaagguggccucugaucucuacuucauaggguuuuucuguguuuucauucucuucucuccagauggaauguucuuuuaucugccugucauccaggaagccuuccacauacccuuguuuuaauuagccaugacuagcuucaugugucccaaauauaaggacaugacuuccucaguccccuuccucagaagaccagacuccucaaggguaggugcuggauucagaucugcgcucucagcugcccaaacgcagggccugauggaccgcuggugcucagaaucugguuccugagugaacaccuccgaguggagacugacaucccuuccuguuuccccuuuagggcauccuucuugagcaccgagaaaaagaauuuggagacagagugaacccacucucuguucuggaggcuguaaagaaaaucaagcuacagacuccagcguccgggagaagcugauccuguacagcugcuggcugggagagaacgcacggggccugugcuguguucaucagaugagcugugcuuuccccagggccccaagagccagaaggcccuugcaccauauuuacuaagaauuggugaugcauuuuaacauugucuguuuaggucccagagccuuuaacauuccguuuaggcccaguagggcaaauagggucccagacagaacagaguucaaucuaacaaaccagugagaguuauuugaggaaagaucuagaaaauuuaauguuuaaaguuuacugcugaagcuucuuucaaaggaauauguccuaagugccgguauuugaagugaaguuuauuuucaugccuaguuaaaaaacaaacaaacaaacaaacaaaccugaaaucugagaaaagugcggcuaagaaacagcucagugguggagcauuuaccuaacaugcacauggcccuaagugggauacccagacagacagacagacagacacacacacacacacacacacacacacacacacacucucucucucucuccuaagaaaagcugauggcugacuugauaauuagagaauuauccuuuuguuugauguguuuucuguuaacaacuuguuacuuaaggucagaguaccacauaaagcaauugcugugcuguguucuuggauaaauuacacagguaaauuacaaagugaagguucuguggucuucccuuauagacgcagagauuugcuuccuugggaaaaacugucaccugggaaacugucaccucuaauaaaaauauucaccaggaaucaccucugugcaca

SEQ ID NO: 7384 - RNA, 5498 nt, Mus musculus
uccucauggguucccaagcaggcauguuguccaugcuccucaggguauuucagagagagaauagaauacacacagacaccagaccaaggcagaaggaggcuggccgcccaucauggugggaaagggcaagaaacaacuggucauggagaaggcacagugaguccugggcaagguuuggggagcucccugggggaugugggcuucagcugguccuuccaggaauagggauugugaucuggauccuucagauuccucaaugguagaaccagagucaagagugucugugucugaugauuaguuuuacagacagccugguauugacaagccugcaggggcuuugcugagagaucuuaauuucccccugaauggcaaauuaugcaaagaccaagcucugugagaauagaaguguuguucucaggauagaguguucauguacuucaucuuuuuucuuuaaagaucuauuuauuuauuauauguaaguacacuguagcugucuugagacacuccagaggagggagucagaucuuguuacagaugguugugagccaccaugugguugcugggauuugaacuccggacccucagaagagcagucggugcucuuauccacugagccaucucaccagccccauguccuucaucuuaauauaguuuccucuagguuacaugagcaugugaugccaagaacagagagggucauuccccugccuaugaaucaaggucucagacaguuugguauugaacgcacaugauguggacugauacacagucuggguuccuguagcaguguacgagcucucaucaugcauuugaagaagacuagaaaaguguuggcuaguaugcuuagagguacggcuuugguugucagauaugagcugacaaugcccuccauuuauucuugccuggcccagcuuaugcauuucagggcuagggcgauuacaauaggaagucgggcauauguuuagcgauggugguugcgaacagggaccuagcugaggagcccagcuugaagacagcuaugaugcacuaucagggauucucagugucucuagauuuuccucuuccucaggcuucugugugggacaaagcaugguuucccuuucccugcccuauuaucucuacaagguuacuaguguuuuuuaaccuacagggucugcuggggaggcaucaccccaagcccccaccaucaaugagcaggagaagagacacgagagguuggagaagcucaaaagagagcuccagaacauaaaaaaugccagagacgaacuucagggaauccuggccaacuacacuaacaaggacuuaaaugacagguagucauuaugcccaguucuuugcugacuaucuugggccaucccuguuaagcccagauucccucauaccacagguggcuacaacuccaggcugucuacauacgcaaaucaauuuugcugauugcaauuucgaugcagaacuucaaguucagauaggagugagauggggucacaggcacuuuugauuccuccaaaaguaauucagagccuguggcaugaaccacagucuggggaugaagguaguaaugugugagcuccccuccugccauuuaagaagcuuacacagguguugguuggugggaguugcuagguaauguuuguuuauagccaauccuuuccauaauugaccaagugguaauguggguccaauugguccugucaacagcuggaggggccugucacacauucugccuuucaguaugacuggauuggcugcaguucauaauugcuuuucucaaauuuuguucauaauacucucagauaaaccgaaaucaauuuauuuauuuagcauucugauugacugugugugucuguguguaugugugugugugugugugugugugugugugucugugucugugucucuguguguguuuguguguguguguaaaagagagagcuacacagagauagagaaugagagagauacugggugcaugugagcuugugugugcauuuguggauguguguguuccuguguguguguguuccugugugugcagcuuaagaucuagagagucuguaucaugugauauauccugauguugugccugacuccauuuccaggcaauaauagugaagaagccagggagguucauuuuuaguagcacagcacuuaaccucugugcucacuguggaugcacauuggaaucuccugguagguuauagaggcuuuucccuguagauaugauuauguccuuuaggaauugauguagcaauagagacaaggauugucaauuccgugucuaaaaccaggaggagaauuguacagauuuaacguggacccaguucugugacacagauuccuggaaaguucugggagaacuagucuauucuuuaaaaccccuacagggagcugaggcagaucagcacccugccuuuacuucccugggcuuacuggcccaagcugaagaggaauaaguuuaauaagcaccaaguggaaccgguaaccaggagcuaggucaaguggcauauauagggugggguagugcaugauucagcuugaauugaaaugauccuuguauccuuaguucaugggacaauuuguuccuuguccaugccuucccacaggaucaacuuugagacauucaugcuugagaugcaacaugaccaggugaugacugaccugaagagaaugccccaggacaucagugaggccuuguccaagugcaagcaguugacuaaagaaaaucaguucuacuggugagugauuaacagggucaugacccaagaccuaggcacaggauaugucugccaauccuuguauuugaacuaaaguggggacucagguucuauacuguuagucucuaaacaggaagccugacuccuucaaacaaggcacuaagauuuuaacaucuuggaucauuuugaccaagugugaagagacugggagccccucaagccacuguccuuuccaacuaaguauccucaagaucgaaaagguuucuaccaugauggagauaucaaucagccuugguccucuugggcucugaacauagauuuauagaugggguuuccaggagaaacauagaaagauucugugaugcuugcgucucuucacuccuagagaauuuugccccagguggguuuuuuuauaccacagacuuauaagcacauauagaacccauguucuuuucugagagauacaugagucccuguugcugucaggguuuucaaaauuaccuugggucuucuggaaaguggcaguccucuggauuugaucucccucuauggccaaucuggauacuuguuuggggcugccuggggaucagggccaaugaugaaggaaugguccuuggcggaaugggaggaagauggaugcuuccuggauucaccauguuuuguuuguggcucagcuucaggaauugccaccuccugauugaaucuaaccucauccagcacaaagucaggauguugaggaaggagaacagacagcugcuaagggagcagauugcauuggaagaaugcaacauagaaacaaaaacacuauguaaugaaggcagccagaagaucaaagaccacuauacuaagcagcaggagguaggaugaaugaagcaucaggggcagaaugcccuaaugugugaucauaaacacagucaagcauauguaaccauccugcaccuuauccaggcucucuccuauuucucauccaguuuuacaauucugugauaauuuccaagacuuucuguggacuuacccucuuuugaagaaauuggauuucugccaugcccucuccuccccauccuagucggccaccucuagcuugccacucuaggcagaggagauccuggaccccugaaggcaaccccuugaggcucuaugguauggagaggugccucaggaugccacuuccugaaauaucuaggaaccauguccucuguucugcucuauggcaacucauccugaggggcuuaggccugccccucagaaggagagaagggcagacucaaauuuuauuuuauuuuguuugugugugugugugugugugugugugugugugugugaguuugugugugucauggcuuggcuuggcugaaaagaugcagcguccuuucacugucuccaagaugagguacuagcacaggauugcaguaccuaaggagccauaagcauagcagggcuauugguuuuugguuuuguuuuuguuuuuuuuuuuuucccuucaugaguauccucuuuacaguucaaugcuuacccuugggaagauuugcaggaagcacacucuugcugauuacaguauccuuucagugugcaugaauuuccugugagaugguuucucuggggauucccagauauagggguucccaaggagagccaaggaaggauucagcacuccagaaauaauaagagccuucacuucaaaguuugcuaggcucccuagaaggccucuguuuaauguuagauucagacacugauacacacuuauuuuucaauaucaaguauuuagacuauuggagaaaugugguguuuuacuauaacuccagcacaguguguaguuaacaauccauugucaagcaauuuuuuacaguugagaaaaacauccaggcccaggugcucucugcccuuucuccuauggggauacaggaaagaucucagaugaaaagugauacuggauuguccugcugaguaaagcugguauuugcuggaucgcugacauggcaagaucucaccaggcuuuuuuucucuuccucccguaggucugaaauauucugcagaagcucaaacagaucagagaccaggucaaaaucuugcucagacacacuguucaccaggagcacugggugugcaaagcaaauuaaccaccauugcaucuaauccuuguaaccauggcaaucuugggcugcauuuucuucuuuuuugguuugcuauggguaaugaggccuuuauuuuguguagccucugguccagcaauacugcauguuuggaaggcuucugagaagugcuaagauacaucaagaucugcucggcauccaggagggcucugagagugccaauuuuggcugguccuguugggucaucuagaauuauaucauggugaucagucaagugaauuugaaaaacuuugagguaucaucuguaacaucucucaugcucagacuuggaaggacuaguacaucagcaaaaaacccaccccaaugaagcaugccuauauucaucuugaaaagauuauuaccaucagugacugccuuugcacuauuucaccaaggccagcaacaggcuguaggucugugcugaacaucugcagcaagagaaugaugcuuagcuuaauuauucuguuugguuuugauuagaguuuugauuucuuugugucuuugguuuuccuguguuuucauuugaaguuucauuauauauucacuuucuuuuuguuacuguaauuaauuugcuuuuuuugcuaagucuauauacuguauaaacugacuccccacuuuaaguuguuauugaauaaaauuaguguauuguuaugga

SEQ ID NO: 7385 - RNA, 1903 nt, Mus musculus
gagacagcaguguuugugugaguggggaacucucauagaugcagauggagggggcaugagauaaaagguuuugaaccggaaacuaggaaacaggauaaaauuuaaaguguaagcuuaaaauauuuuaaaauagaaaaaaaaaaaagagaauugaagacccagaaauuuaaccacacauauggacacauggucuuugacaaagaagccaaaaauauacaauggaaaaaagaaagcaucuucaauaaauugugcugauccuacuggcaguauguagguauguagaaaaaugaaaguagauccauauuugucacgaggaauaaaacucaaguccaaguggaucaaacacuuaacauaaaaccagauucacugaaucuaauugaagagaaauugagaaagagcuucaaacucacaggaauaugggcaaauuuucuaaguacgcuccgaugacucagguucuaacaucaaaaacugauaaaugggaccucaugaaacugaaaaacuuauguaaggcaaagggcauagccaguaggacaaauugguaaccuacauauugggaaaaauuuucacuaaccuuacauuccaaaauaucuaaagaacucaaauagcuaaacaccaaaaagaaaagaacccagucugaaaaugucauaaggaacuguagaaaaaauucacaacgaggaaccuugaauggcugagaagcacuuaaagaaauguggaaaguccuuagucuucagggaaaugaaaaccaaagcgacugagauugguauaaggccguauaauuuccaauaaagaauggccaagaucaaaaacugguaaaagcacaugcuggugagaaugugagaaaagagaaacaaaacuucauuucuggugggagugcaaagugcuaugauaucuauggaaaucaaucuggagguuccucagaaaguuggaaauagaucugccugaaggccaaagacuuaccuucguggccuauggcuuccuaauuucauguuucacccaauggcuuauuauuuagaucuuccuacugggcuucgacuuugaucuugguaagcauuuggucucuuugauucucaaacaguucucuguccucacacaguuuugagguaccgccagccccagggacauauuuuuuuccuucaaauuucuccaaaucuggggacuucuaauauuuggggaacugagugacaaaagcaauguauguugagcacuuuaguacccaguguguaugaaacuauguguguuuagauaugguaaaccucuagaacauacuuuauuaaagaagcaguaugcucuuagguucccucuuugaccucacuuaacuuugccagcuuugugggcugcuguacugcugcucggagaacaauuggaaacuccuggaauagaugccucaugucucauugccuuugccaggcuuaggacacuagugggaguagguuugaugggacauuaacaaaaccagggcuucuugugaaccaucugaaugcagcaccauguuccaggacaguucuguaugaacuucucauauccaggaaauggagcaagaggaaagccaagcagaaggcauccauuuccagcacccucaacaccuuuucacaggacgggguaaguugacuuugguagaagaagagauguccugagauaguugccccucaucugaucagagaauaagaguucaugaauuuuggggaaacauugugauugugggguugcaguaagcaucauguaaugugaaugagcaaaaacuauuuuaauacuaaaacaaaauuaaaguauuaucaaaauggggcaaaauauauuguuuuacuaacucuaguauguauacacuggcaaacauuuuaacaucuagaauggcuagauguuguauaguagggugacuuugucauugacacauacuguguacauagca

SEQ ID NO: 7386 - RNA, 1648 nt, Mus musculus
agagacgcguguggcgaccggcgcgggaaagcggcuuccuaguuagggaagcguuagccccguggacccagcagcugucaccggugagcuacuuggaaggccgauuuggcgagcuuguaggaggagcuugagaccuucacguccccuccgacucucagcuggaaggcaagaugguugaagcagaucgcccaggaaagcucuucauuggugggcuuaauacagaaacaaaugagaaagcccuugaagcaguauuuggcaaguauggacgaauaguggaaauacuuuugaugaaagaccgggaaaccaacaaaucaagaggauuugcuuuuguuaccuucgaaagcccagcagaugcuaaagaugcagcuagagauaugaauggaaaguccuuggauggaaaagccaucaagguggagcaagcuaccaaaccaucuuuugaaaguggcaggcguggaccaccuccaccuccaagaagcaggggcccucccagaggucuucgaggaggaaguggaggaacuaggggacccccuucacguggaggauacauggaugauggugguuauuccaugaacuuuaacaugaguucuuccaggggaccacuuccaguaaagagaggaccaccaccacgaagcgggggucccccuccuaaaagaucaacaccuuccggaccaguucgaagcagcaguggaaugggcggaagaacaccagugucccgugggagagauagcuacggggguccaccacgaagggaaccccugccaucucgcagagauguuuauuuguccccaagagaugauggauauucuacaaaagauaacuauucaagcagagauuacccaagcucccgagacaccagagauuaugcaccgccaccaagagauuauacuuaccgugauuacagucauuccaguucccgugaugacuauccaucaagaggcuacggugauagagauggauauggucgggaucgugacuauucagaucauccaaguggagguuccuacagagauucauaugagaguuauggaaacucacgcagugcauccccuacacgagggccaccaccaucuuauggaggaagcagucguuaugaugauuacagcagcucacgugauggcuacgguggaagucgagacaguuacucaagcagcagaagugaucucuacucaaguggccgugaucgaguuggcagacaagaacgagggcuucccccuucuauggaaaggggguacccuccuccacgugauuccuacagcaguucaagccgaggagcgccaagaggagguggccguggagggagccgaucugauagagggggaggcagaagcagauauuagaaacaaauaagacuuuggaucaaggucuccaugcaaagaaacaaaagauggaaagucuucugucauaacuacccaaggacuacuaaaagaaaaguuguguuaccuuuuuaaauuuucuguuuuaaguuucccuucauuuuuguguucuugugaggaaaaaguaaaacaugauuaauuuugauauuaugaauugcuuucaacaagcaaauguuaaauguguaagacuugacuuguacuaguguuguaauuuuccaaguaaaaguguuccuaaaggcaaaaaaaaaaaaaaaaaaaaaaaaaaaaaaaaaaag

SEQ ID NO: 7387 - RNA, 1648 nt, Mus musculus
cuuuuuuuuuuuuuuuuuuuuuuuuuuuuuuuuuuugccuuuaggaacacuuuuacuuggaaaauuacaacacuaguacaagucaagucuuacacauuuaacauuugcuuguugaaagcaauucauaauaucaaaauuaaucauguuuuacuuuuuccucacaagaacacaaaaaugaagggaaacuuaaaacagaaaauuuaaaaagguaacacaacuuuucuuuuaguaguccuuggguaguuaugacagaagacuuuccaucuuuuguuucuuugcauggagaccuugauccaaagucuuauuuguuucuaauaucugcuucugccucccccucuaucagaucggcucccuccacggccaccuccucuuggcgcuccucggcuugaacugcuguaggaaucacguggaggaggguacccccuuuccauagaagggggaagcccucguucuugucugccaacucgaucacggccacuugaguagagaucacuucugcugcuugaguaacugucucgacuuccaccguagccaucacgugagcugcuguaaucaucauaacgacugcuuccuccauaagauggugguggcccucguguaggggaugcacugcgugaguuuccauaacucucauaugaaucucuguaggaaccuccacuuggaugaucugaauagucacgaucccgaccauauccaucucuaucaccguagccucuugauggauagucaucacgggaacuggaaugacuguaaucacgguaaguauaaucucuugguggcggugcauaaucucuggugucucgggagcuuggguaaucucugcuugaauaguuaucuuuuguagaauauccaucaucucuuggggacaaauaaacaucucugcgagauggcagggguucccuucgugguggacccccguagcuaucucucccacgggacacugguguucuuccgcccauuccacugcugcuucgaacugguccggaagguguugaucuuuuaggagggggacccccgcuucgugguggugguccucucuuuacuggaagugguccccuggaagaacucauguuaaaguucauggaauaaccaccaucauccauguauccuccacgugaaggggguccccuaguuccuccacuuccuccucgaagaccucugggagggccccugcuucuuggagguggaggugguccacgccugccacuuucaaaagaugguuugguagcuugcuccaccuugauggcuuuuccauccaaggacuuuccauucauaucucuagcugcaucuuuagcaucugcugggcuuucgaagguaacaaaagcaaauccucuugauuuguugguuucccggucuuucaucaaaaguauuuccacuauucguccauacuugccaaauacugcuucaagggcuuucucauuuguuucuguauuaagcccaccaaugaagagcuuuccugggcgaucugcuucaaccaucuugccuuccagcugagagucggaggggacgugaaggucucaagcuccuccuacaagcucgccaaaucggccuuccaaguagcucaccggugacagcugcuggguccacggggcuaacgcuucccuaacuaggaagccgcuuucccgcgccggucgccacacgcgucucu

SEQ ID NO: 7388 - RNA, 1619 nt, Mus musculus
ggccgaaccaccaugucacagagcggggaggagaaccugcagggcgccuggauagaacugcacuucagcaauggcaaugggagcagcguuccagccuccgucucuauuuauaauggugacauggaaaaaauacuguuggaugcccagcaugaaucuggacgaaguagcuccaagaguucucacuuugacagcccaccucgcucccagacaccacaagauaccaacagagcugaaagagacagccacagcuuuggcgagaaaaagagcacucugucugaggaagauuauauugagagaagaagagaaguugaaaguauccugaagaaaaacucagauuggauaugggauuggucaagucggccagaaaauauuccccccaaggaguuccuuuuuaaacacccgaagcgcagagcuacucucagcaugagaaacacaagcguuaugaagaaagggggaauuuucucagcagacuuucugaagguuuuccuuccaucucuguuacugucucaucugcuggccauuggcuuggggaucuacauuggaaggcgucugacaacuuccacuagcaccuucugaugaagauuuggaucugacuucuguucacacagugaggauucaugucugagcugugacagcuaauugaagagcuagcaugguccuuggguguuugcacuauguguguuaauuuguucuguaaaugcgguguuccugauuuagugagacagaauagacucuugucaugaccuauaauuuaacuaugggaucaauuaauaagcaugucagacugaugccuauuguagcauuuacuaguaaauuucuuugaauauuagauacaaauaguauaaauaauuuuaauauaguagcaaugguguauuuaaaacugaucuguaaucauaauccaguuaagacacuuuacacuucuaaagaacaaguaagugauauuaaaaucauuaaaggguuuuccccaaaggaauauuguggccuuauaauccuauuauauagcagaaaauuaaagggugcgugcggguuaucuguaaaggccucuaacuuugugaacugaguagcaaguagaagcuaagguuacccacgaaccccacuuugcaguucccccucguccugcuuugcaggaugaggauucucaccuugcuguccaccauuaccuuggguggucaguuuuguugcaggcaccuuuaucacucugcugaauucuccuguuuguauuuaaaucuuaugugcucugaaaaucagcugucuacuuuaaaagacuggaagugaaaaacaaaaucuuugccaaauccauuggagaauacuauauuugcauauccauuaaucacuauccaaagcuucuuaaaucgggcguccucccagucuucucuuuucuauagcaugguuucaaagccugccuccuugacaugcuguauauauccuguuguauuuguuucagucccacacuuaacucaggugugcuaaaauaaaagugacauuuuaacagucuuuuguuuauauuuacauaauuacuagacauagccuauaucccuuucauuuggaucaagauccuacaggauguaauagucaauagguguuuucuugcuucaguaaaguauuuuuguaagaaauua

SEQ ID NO: 7389 - RNA, 1619 nt, Mus musculus
uaauuucuuacaaaaauacuuuacugaagcaagaaaacaccuauugacuauuacauccuguaggaucuugauccaaaugaaagggauauaggcuaugucuaguaauuauguaaauauaaacaaaagacuguuaaaaugucacuuuuauuuuagcacaccugaguuaagugugggacugaaacaaauacaacaggauauauacagcaugucaaggaggcaggcuuugaaaccaugcuauagaaaagagaagacugggaggacgcccgauuuaagaagcuuuggauagugauuaauggauaugcaaauauaguauucuccaauggauuuggcaaagauuuuguuuuucacuuccagucuuuuaaaguagacagcugauuuucagagcacauaagauuuaaauacaaacaggagaauucagcagagugauaaaggugccugcaacaaaacugaccacccaagguaaugguggacagcaaggugagaauccucauccugcaaagcaggacgagggggaacugcaaagugggguucguggguaaccuuagcuucuacuugcuacucaguucacaaaguuagaggccuuuacagauaacccgcacgcacccuuuaauuuucugcuauauaauaggauuauaaggccacaauauuccuuuggggaaaacccuuuaaugauuuuaauaucacuuacuuguucuuuagaaguguaaagugucuuaacuggauuaugauuacagaucaguuuuaaauacaccauugcuacuauauuaaaauuauuuauacuauuuguaucuaauauucaaagaaauuuacuaguaaaugcuacaauaggcaucagucugacaugcuuauuaauugaucccauaguuaaauuauaggucaugacaagagucuauucugucucacuaaaucaggaacaccgcauuuacagaacaaauuaacacacauagugcaaacacccaaggaccaugcuagcucuucaauuagcugucacagcucagacaugaauccucacugugugaacagaagucagauccaaaucuucaucagaaggugcuaguggaaguugucagacgccuuccaauguagauccccaagccaauggccagcagaugagacaguaacagagauggaaggaaaaccuucagaaagucugcugagaaaauucccccuuucuucauaacgcuuguguuucucaugcugagaguagcucugcgcuucggguguuuaaaaaggaacuccuuggggggaauauuuucuggccgacuugaccaaucccauauccaaucugaguuuuucuucaggauacuuucaacuucucuucuucucucaauauaaucuuccucagacagagugcucuuuuucucgccaaagcuguggcugucucuuucagcucuguugguaucuuguggugucugggagcgaggugggcugucaaagugagaacucuuggagcuacuucguccagauucaugcugggcauccaacaguauuuuuuccaugucaccauuauaaauagagacggaggcuggaacgcugcucccauugccauugcugaagugcaguucuauccaggcgcccugcagguucuccuccccgcucugugacauggugguucggcc

SEQ ID NO: 7390 - RNA, 2354 nt, Mus musculus
ggccgaaccaccaugucacagagcggggaggagaaccugcagggcuccuggguagaacugcacuucagcaauggcaaugggagcagcguuccagccuccaucuuuauuuauaauggugacauggaaaaaauacuguuggaugcccagcaugaaucuggacgaaguagcuccaagaguucucacugugacagcccaccucgcucccagacaccacaagauaccaacagagcugaaagagacagccacagcuuuggcgagaaaaacagcacucugucugaggaagauuauauugagagaagaagagaaguugaaaguauccugaagaaaaacucagauuggauaugggauuggucaagucggccagaaaauauuccccccaaggaguuccuuuuuaaacacccgaagcgcacagcuacuuucagcaugagaaacacaagcguuaugaagaaagggggaauuuucucagcagacuuucugaagguuuuccuuccaucucuguuacugucucaucugcuggccauuggcuuggggaucuacauuggaaggcgucugacaacuuccacuagcaccuucugaugaagauuuggaucugacuucuguucacacagugaggauucaugucugagcugugacagcuaauugaagagcuagcaugguccuugggcguuugcacuauguguguuaauuuguucuguaaaugcgguguuccugauuuagugagacagaauagacucuugucaugaccuauaauuuaacuaugggaucaauuaauaagcaugucagacugaugccuauuguagcauuuacuaguaaauuucuuugaauauuagauauaaauaguauaaauaauuuuaauauaguagcaaugguguauuuaaaacugaucuguaaucauaauccaguuaagacacuuuacacuucaaaagaacaaguaagugauauuuaaaucauuaaaggguuuuccccaaaggaauauuguggccuuauaauccuauuauauagcagaaaauuaaagggugcgugcggguuaucuguaaaggccucuaacuuugugaacugaguagcaaguagaagcuaagguuacccacgaaccccacuuugcaguucccccucguccugcuuugcagggugaggauucucgccuugcuguccaccauuaccuuggguggucaguuuuguugcaggcaccuuuaucacucugcugaauucuccuguuuguauuuaaaucuuaugugcucugaaaaucagcugucuacuuuaaaagacuggaaaugaaaaacaaaaucuuugccaaauccauuggagaauacuauauuugcauauccauuaaucacuauccaaagcuucuuaaaucggguguccucccagucuucucuuuucuauagcaugguuuuaaagccugccuccuugacaugcuguauauauccuguuguauuuguuucagucccacacuuaacucaggugugcuaaaauaaaagugacauuuuaacagucuuuuguuuauauuuacuuaauuacuagacauagccuauaucccuuucauuuggaucaagauccuacaggauguaauagucaauagguguuuucuugcuucaguaaaguauuuuuguaagaaauuagaucgcuguacuggcuaguuuuauguuaacuugacacaggcuggaguuaucacagagaaaggagcuucaguugagaaaaugccuccaugagauucagcugaaaggcauuuucucaauuagugaucaaggggggacgcccccuuguaggugguaccaucugugggcuggaagucuuggauucuauaagagagcaggcugaggaagccaggggaagcaagccaguaaagaacaucccuccauggccucugcaucagcuccugcuuccugaccugcuugaguuccaguccugacuuccuuuagugaugaacagcaguauggaaguguaagcugaauaaacccuuuccuccccaacuugcuucuugguuaugauguuugugcaggaauagaaacccuaagacaauugguacgaggagugggguauuccugugacagccugaucauguuuuggggaggacuguggaaggacuuuggaacuuugggcuagaagaucuauucgguguuaagagcucugugggauguugugaaggagcuuggaagauaaugaugagaacagugcaggagauggaguccuggcuugugaaauuuuagagggaagauuaaagacucuuuucaggccuggcaugguggcacacgcuuuaaucccagcacuugggaggcagaggcaggcagauuucugagucgaggccagccuggucuacaaagugaguuccaggacagccagggcaacacagagaa

SEQ ID NO: 7391 - RNA, 2354 nt, Mus musculus
uucucuguguugcccuggcuguccuggaacucacuuuguagaccaggcuggccucgacucagaaaucugccugccucugccucccaagugcugggauuaaagcgugugccaccaugccaggccugaaaagagucuuuaaucuucccucuaaaauuucacaagccaggacuccaucuccugcacuguucucaucauuaucuuccaagcuccuucacaacaucccacagagcucuuaacaccgaauagaucuucuagcccaaaguuccaaaguccuuccacaguccuccccaaaacaugaucaggcugucacaggaauaccccacuccucguaccaauugucuuaggguuucuauuccugcacaaacaucauaaccaagaagcaaguuggggaggaaaggguuuauucagcuuacacuuccauacugcuguucaucacuaaaggaagucaggacuggaacucaagcaggucaggaagcaggagcugaugcagaggccauggagggauguucuuuacuggcuugcuuccccuggcuuccucagccugcucucuuauagaauccaagacuuccagcccacagaugguaccaccuacaagggggcguccccccuugaucacuaauugagaaaaugccuuucagcugaaucucauggaggcauuuucucaacugaagcuccuuucucugugauaacuccagccugugucaaguuaacauaaaacuagccaguacagcgaucuaauuucuuacaaaaauacuuuacugaagcaagaaaacaccuauugacuauuacauccuguaggaucuugauccaaaugaaagggauauaggcuaugucuaguaauuaaguaaauauaaacaaaagacuguuaaaaugucacuuuuauuuuagcacaccugaguuaagugugggacugaaacaaauacaacaggauauauacagcaugucaaggaggcaggcuuuaaaaccaugcuauagaaaagagaagacugggaggacacccgauuuaagaagcuuuggauagugauuaauggauaugcaaauauaguauucuccaauggauuuggcaaagauuuuguuuuucauuuccagucuuuuaaaguagacagcugauuuucagagcacauaagauuuaaauacaaacaggagaauucagcagagugauaaaggugccugcaacaaaacugaccacccaagguaaugguggacagcaaggcgagaauccucacccugcaaagcaggacgagggggaacugcaaagugggguucguggguaaccuuagcuucuacuugcuacucaguucacaaaguuagaggccuuuacagauaacccgcacgcacccuuuaauuuucugcuauauaauaggauuauaaggccacaauauuccuuuggggaaaacccuuuaaugauuuaaauaucacuuacuuguucuuuugaaguguaaagugucuuaacuggauuaugauuacagaucaguuuuaaauacaccauugcuacuauauuaaaauuauuuauacuauuuauaucuaauauucaaagaaauuuacuaguaaaugcuacaauaggcaucagucugacaugcuuauuaauugaucccauaguuaaauuauaggucaugacaagagucuauucugucucacuaaaucaggaacaccgcauuuacagaacaaauuaacacacauagugcaaacgcccaaggaccaugcuagcucuucaauuagcugucacagcucagacaugaauccucacugugugaacagaagucagauccaaaucuucaucagaaggugcuaguggaaguugucagacgccuuccaauguagauccccaagccaauggccagcagaugagacaguaacagagauggaaggaaaaccuucagaaagucugcugagaaaauucccccuuucuucauaacgcuuguguuucucaugcugaaaguagcugugcgcuucggguguuuaaaaaggaacuccuuggggggaauauuuucuggccgacuugaccaaucccauauccaaucugaguuuuucuucaggauacuuucaacuucucuucuucucucaauauaaucuuccucagacagagugcuguuuuucucgccaaagcuguggcugucucuuucagcucuguugguaucuuguggugucugggagcgaggugggcugucacagugagaacucuuggagcuacuucguccagauucaugcugggcauccaacaguauuuuuuccaugucaccauuauaaauaaagauggaggcuggaacgcugcucccauugccauugcugaagugcaguucuacccaggagcccugcagguucuccuccccgcucugugacauggugguucggcc

SEQ ID NO: 7392 - RNA, 35687 nt, Mus musculus
ggauaccccgaccccggaaggaccgcgucuuugcgccggacgagcugcaggccagguguaccggaggcgggugcgugagcggggcgcgcaggaaggcggccgcccgaggcucgcguggacagaggcgcgcgccgcugcacguccgcaggggaggcgggagcgcggagggcgcagggcggagcgcggggcggggccggcgcaggcuacuucagcgggcgcgcggccugcgccggggagccaagcacggcggcgcggguagagggcggugggcggcgagcggcgaugggccgcgccuggggcuugcucguuggacuccugggcgucguguggcugcugcgcuugggccacggcgaggagcggcggccggagacagcggcacagcgcugcuucugccaggugaggcgcgcgggcggcccaggggcugcgcaucuccgggcgccggcgauccugaugcgcggcccgcaccgcguucccgaucgccccgggacggggcacccuucgaugggcgugggcgccuggccagcuugucacacugcuuccuugcauccugccuuggcugcuccguguccacaggaccggggguucugaauggacccggcaccugggcaccucgugcgagcggugccggggacguccccagccuuucuguucccgauauggacucuuggggagacuaguuguucuuuaggucuugucguugucaagagguugaaugaccuugaggggcucuuuggguggccugaucuaacugccuggugucuuugcggcuguuguuguccugugacuucucggccuguguauggugcaccuugccccugaagcuuauucucguauacugacacuuccuuugcggaauccgagguaggcccuagcucuucuguauucaaguuugauuaugagcugugauuauuuacuucuguaggagauguggguuccgugagcaaaacauucaaagaauuuuauuuucuuaguguagccuguaaauuuuguaugaggccguuuaggcuaggcgcauugaaauaacugugaauuucauuuugcugucuuaaggaaaugcuaacagcuuggaaauacccagaaguaucauauucagucgaugugcuagucucuuagugcuuucuuguaaagccuggaagaacucucgaauauuagcgguuccccagacuuucuucuguuuaaaaguguauuagaucauuuuauuacugagauacuuaauauguaaauuguauuguuaaacagacguucacgaccacaccuggcgcuggccagcacccuuucccccucgacuuguucauuacuguucuuuacgauguuuaaaauacagguuuguuuuguggguauguauauuguaccugugaauguacgcauuguagggggugcuuuuaguccacagcuugcaggaaccucuccccaaccaccacaugggacaccgggauccaccucggguccucaggcaaaugaccaagcauuggcuuucuuauagcccuauaagcaguggcucuucuuauagccaccuuuuugguggacuucgauuucugaaauuacaucuauaaaaaaauggagggauagacagccaggucacucgugggucuuauuauuugugaucagaaauacguguaugcugcauaugauacuguaagauaagcacucgagugucaggaagaagggguguuaucuguuucaucgcuuuaaacuuuuggauuuuauuguuuuguugaguaauuuuggagcagaagugaguuguuagaaguccagaaaaaggccauuuuucuauugauuacaaauuuaagguaaacaguuucaacaucuaaacacuugagauaggaagcuuuuaacuagaguguugagaaaagauacuaggaguuacacuuucaaguauguucucuggguaaugguauucaaauacuguuugacucuucaacuuuguuauacaaccaaucuuuuuggauauuuacuuaaaauugaggaacuuuuaauuauuuuugcauuuucccuugguuaguaauaagggguuuuuuuugguuuuuuuuuuuuuagcuguugucaaaauaucuucagaucaaucgauccaucuaucugucagucugucugucuaucugccuaucuuuagccauuuuuaacauagcccuggcuguucuggaaaucacuguguagucuaggcuguccuugcccugacagagguuucacugccucugccuccuaaguacugugauuagaagcaagggucaccagcccagcucuuauuuguuuuuuggauuuauuuauuuuuauuuaauguguauuugccugcaugucugcaccccacauccgugaagugucugaguaggccagaagagguuguuggaucccacggaacuauagcgugggccaccaugugggugcugggaauagagcucagguccuguggaagagcaguacuugcucuuacauacugagcucucuucaguccgcaauaaccucagaguuucgaaacagggauucucacucuguaggucaagguggccuccaacuuacagagcuccuccucugccuccagagagcuugguuuaaaggugugucccacaaccaucuaagccacuuuuucuuuaaaggaaguuucugguuuuccucuucagagucaacuuugaguaauagcaagauagccuggagcagugguguuuguguguaacaucugcagacagcuugaucagggucuucuggucagccuggguuacauagugagcuucuuguuuccaaaguauagccuagccaaugacagaaauagucaaaauagucaguuuguuguuguuguuguuguuguuuuuguuuucuccuuccugcugugggucuuuguuaccauguuugccuuggguuaccucaucaccaccuaccuccuguugucacauggguaucugguuuguaaugggguucaguucauagaugcugucugggucagagcagucgguggcuguuugaccuuagaaagucauugcaacaagucccuagugcuuguugagaucaaaacugaguuaaaaaaugguuuucaaaccuagcauuugauuggugcucagcagauguucgggagauuucaguguaagauguuagaaaaauugagccagcugcuuguuggcauagcuugcugggauugggcuuuuugaugggggauggcuguaaugaaucuuugggcucgcugagguacuacauagauugugcugguuucgaguccuuuuaacaugaucuuucacuguauguuauaaaucauuaaaaaaaauuuuagcuuuaugucuaugaguguuuugccuacuuguauguaugugugccaugugagcgccaggagccucuggaacuggaguuagauaguugugagcuauguggaggcugcaagaacagccacagaggccuauuccaacccuuacauauaaacucuuuucauaauaguguuuuauuguuuacuguucauuacucgaaaugguuaauuguuugggaccuguaaaucuuccuuacaaccacuugcuuuuuauuaucccauuaaaacguuagcuaauaauauuacuaacuuauaaggaaaguuggcucuuaucccccuuugaauaaacaaucucccgugcaggaaguacuccuccugugaaccgaaauaguauuuguuaucaccaauacagacuuauugcuauuuuauuuucugacaguuagguugaauuaggcaucauuugaugacgugaauguaguaaaacuuuaggugcaaguagugaaauauauuuuaaagauuucuuagaagaaauacugaaaauuguuuuggaggacauaugaauauauuuugcacuuaauuaauuuaaaaugaguguauauuccuuuucacuaaaacuguuuuauuguuuucaagucuaguaagcaguagcagugcucagccaccugagugugggggaggccugccucaggcugcuggguggguggguaggugggggaggccugccucaggcugcugggugggugggugggugggggaggccugccucaggcugcugcugcugguguugguggggcacuguagauaccugagugugguagguuugccuugagcugcuacaggaaggacacucaugucagcuuuacaaacacaugaguuuuugcuuggaguacauuguagacauaaucuccaaacauguucuucaguagauuuaaccuucuaaguguccugcuaaaucaguuuuaaaaauagcuuuacuuguuaggcugaguugcugggcugugggagagaugauuuguuuguugguggguggguguauuaaauccuagucagagggaucuuugaaacagguuauacuggugagguagccauugacucuuuaagugccuguugcaucucugacuuuucugaauagagcguauggaagaaauacuugugagucacuucacaaugcuguguguuuuuucuuccuuccuuccuuucucucuuaaaaaaaaauauguacuuauuuuauguaugugaguauuucaccuacaauugugaaacauaugcaugccuguggaggucagaugaggacgucggauucccuggaacuggaguuacaguugugagccaccauguuggcucugagaauugaaccuuggaacuccacaauaacaucaagagcuuuugacugcugaguaaucccucuagccccacauugggaacuugaguaaaacuaagacuuuaggcagagauaguugacaguaugguacggggggcaguggaccaugagagguagccugguccucaguugaacuaaaggcuuugaagcccuggagauccugaauggacaaugguaggagcuuuacuugcuccugggcaccaggcuccugucacuagcugcagcccaauuuagauuuguggccaucagucacaagggcaaucagaucaagaaauaggaaccuguagucacauagucucaagacagagaucuccaugcuaaagagguaccuagaggucuggagggcuuggccaauaaguuuuccauccuagacacuccucccugccaaagguauuuacucucaggcccacccugagaagugggguaugguuuuaugcauccacucuccgccauggcaaugaaugauugagaaccaugacucuuuucaucagacuacaccauggagaacccuagagaaagccuuagccuacagagucacugucuaaucuccuguagaaggccucucugcacucccagccacaaccaccacaauauugccaccaucaagccaaagacucucuccgugggacuagcucuucuucucuccccggcccugggcuagacacagccugcaggcccccaacuccauucucagcucuucccuggcuucuagcagcgccuggguguccaagagacugagaaccagaugacaggccccgggacccccaagccagcucuggcuuuuccaccccaagugagcugcgugggguacaugcagucaaacuccucgcuauuuugccuccccaaguggccaugcccuguggcagagcagaugcaggaccuacaaucguaugccuuauaaucugguauagauuuuuuuuuguuuguuguauccuuugauuuacaaugucccaguuuuuuuucuucccaucuuagucagucagucugccugucucucacucuugcucuccuuuccuugcuuuugcucucaugcauguacgcuuguucccaccccacucccccccagcucuuuuccuucuuucuccuccuuucaugaauucuauaugugaggccaggcaaaucuuucuuugguuuaauucacuuagcauguccgccggggcuacugaggucaaauagcagaaucuuacucuguguauguggcauuuucuaccauuuguuuaucuugguuggggauuuagagguucagugcacagcaacaucagaaguauggcuaguaguguacucagcaguuuugcuagaugaguaugcuacagcuguucuucucaugggguagaccgguaauuguauguaauuguauguuaacugguccuguuaugguaaucauuuuacuauauguaacauguuacaccaugauguguauuuuaaagaauuauuuauauauuuuauggauacaaguacacuguagcuaucuucagauacaccagaagagggcaucagaucccauuacagaugguugugagccaccgugugguugcugggaauugaacucaggacuucuggaagaacagucagugcucuuaacugcugagccaucucuccagccccaugauguauauuuuaaaauauagaguaauauuuauuuuaaaaaacuauguucuuugaagaaaugugucugugugcaugcuguggagcccuugaacgcuagaggagggcauuggauuccuugugagcuggaguuagaguuguuugugagcuacuucacaaaccaguggguacugggauuggaacucugguccucaugauagaggagcugcgcccuuaaugauugggccaucuuucuagccccucuggucacaaaacacaguaaaaauuaaauacccuaguucuuugacaaagcacauuuugaguauauacauuuacuuacugagaaacagcagggugguauauucuagaagauguuuuuauacacaaauacccugggauguuaaaaucaagcuaaauuaucaugacaccaucgcccagcuagcugcacauguggugagaauacugaagcucuguucucuuaacaaauaugcacuauuacuagcuauggucgccaugauguucauucagagcccggaagcuauuuauccuguauuucuccacgucuuccacuucuacccuuaguguccuugaucuuccuuagaucucacaagugaggaaggucgugaaguaaccuuuauaucuagcuuauuuugcuuccagauucauccaggaugccacaaaggacagaauaauaguucauuguguggugugugugucacauuauccacucuugcccugacaaauaccuagaugcuuuuguaccucggauauugugugaugcagggagcacaggugugcaggucucuuggagccagugguuuuauuucuuuuggauguguccccagaagugggauugcuagauccagcuauguuucuaguuccuugaggaguauccacacugguuuccaucauguaauaaguguuccuguuucagugugugcucaccaacccugcuuccaccuugguugcaugucuuaagauuuuauuugcuugaugcuauuauaaauggaauugcuuucuuguuuuuuuuucccccgauagucucauuuauuaguuucuagaacacaacugauuugauuuuuguagccuaugacuuuauuaaaauaauuugaguguuuuuuuuuuucuuuugguggaguucucaaguuuuugcauguacugccuaagaucugaaaauucugauuuuaguuuuuuauuuuuaguuugaauuccuuuucuuuuuuuccuucugucuuccuuuucccuuuuuuuuuuuuuuuuuuuuuucuucgagacagggguucucuguauagcccuggcuguccuggaacucacucuguagaccaggcuggccucagaacucagaaauccgccugccucugccucccaagugcugggauuaaaggcgugugccaucaccgucuucccuuuccuuaauugaugcuuggacaagcgcuuuucauaagaaacacauacaagaaauacaacuguauaguucuuugaaugagaacaagauugaucuacaauagaaguaggcuuucuuaguauuguacacaagacugugaggaggguguuuuugguugguuguuaguuuguuuugucauucauugugaauuaaaaaauaccucuugcaaaauaagauccuauacagaguggucagccuucaaacuguuuacauaucaaaucacaaagauggacgcaacagauuauauuuauguauaucugugauuacagauuuccuuucuugccuauuguauuugacuacaucaacuguagucaguggagagugugccugagccucccuacccccaccccacacuaguuuuuccauaaucugggcccucguuccagugggaaggcuggaauaauccaguguuagaaacuuugacuacaaacuaggccuguauuucuuucccauuagggaaaugugggcugcuuuggagaguaaugagccagguuaacagugaugcuuagcaaucaagcauuuccaaaucugcagguuggaaauuauucuucuauauuauuauaauuauuauuauuauauuaaauuauucuucacagcacagugacagaggugggccuuagacccgcucggccugacugcagagcacgggagcuggcagugggcaccuccagaggcuccguaccucucacuggcuaggccugcaacugggcuaggcuucugucauccuacugucucuccgcgugggccuuuuuacgcauaguguuaguuuuccuacccagagcuuagguucccgcggcaggcaggguugugcuuugggauggcaccgugaguaccgcagcaguggaagcaggucccaagcauagcaccaggccggcgauuguuucaucuaacaccugucgccugucccgggacuuuucuucuaagagucuguggguuguauuagugguguucugcccaagcccuugcuugugacugcuuugguaacaugccuguuguucuccagauccucgaacugagcugacaucacaccugccacacuucugccaaggaugggcuucugccucaccucuuggccagcauaccugaacugucaguaggcuuggaucuccaagugucuuugugucuucacugagcgcucaguugaaacucuguuuuuauuuuguuuccuuggccacccuguugcccgagguuguaguggcgaauguggccuauuccacaugaaggguaaagggaagaaggcuuaaaagcucucauugugcugccucuugucccucugcagucuccuggcugugugccaccucugcucugggggaccuuguguuccuuccgggcucugggcuuccucugcugcagguuaggauggcgaguggacagucagaaagcgaggcgcgaaggaucauccgcgcgaagggucauccuuacugcguuuguuccuugccuugugggugugcugcugcuacacaugcucuugagcguggggcaggaggagcagcaggcagagcucagccacucaccugcccaccccaucacugagacccacugugucuuccagaagcacggugccacaggcugggaucgcaacagugaaaaaaccugauuuuaucccagugauuugauacucuaguucaaaggggucucagccuuccugaugcugugaccccuucauacaguuccucaugcuggggugagucccggccguaaaguuccugcauuacugcuucauaacuguaguuuugcugcuauaaauuguaaugugaauauccgacaugcaggauuaucugauauauggcccccaaagggauguggacccucagguugagaaaugcugcucuaguugaugcacuagauaacagccaggauagugagguaauucuaauacagcaguacuauguggaauguucuggaagcucccaggagaggcaguugagcccacagugauagaagagcgccuaagugugucugaaagugauugugcuuagcgacauccugcagguugauuuccacguugucagugaccucgugggacgguuggcuucggcacaggugggcucaaucuggguuaccuuuucuaacucgccagcuccaugugcuggucucuucuugcccuuccugcuguuucuguuauucuuuuguaacaguucaaaucaaaggcuagaaguaguaggugauuucuauccuuccaaacucaaaaggagugaaaauagaaaugauaggauauauggaucagauugcuagaaacuagaaccagaaaaaucaguaaacuacugagccaucucccacccccauuacugguuuucaauguucuuaaaugaagauaguaugggauuucauauaguccaaggguaaauauuaauccaguguuuuaauaaaguuuuacuuacuuguuuucuuauuuauuuacccauauuuauuuauuuauuuauguucuuuugagacaggguuucucuguguagcccuugcugucguggaacuuacucuguaaaccaggcuggucuugaacguagagaucugccuuccucugccaucccaaauacaggaauuaaaggcaugugacaccacugucuggccacuuucuuauuuuuuuuaaaugaucuuuuuaaaaaaaaauuuauuuuuuauuuuucaaaaauuguuuauuuuauguauaugaguacacuguagcuguccucagaugcaccagaagagggcaucggauccuguuacagguggcugugagccaccaugugguuccugggaauugaacucagacuucugaaagggcagucagugcucuuaaccucuccaguccccacuuucuuauuuuuaaaaaauguuuuuaauuauguguuugugcacauaucugugugggguaugugcaugagugucaugccuggguaggccggaagaaagcauuggaucuaucacagcuggaguuacagguggucugagccaccugacagggguguugggaaccaagcuuggguccucuggaagagaaucgcaaguuccuaacugcugagucaucauucuagcccucacuuccuuuuagauacugucuuuacuaacucuuggagaacgucauaucugucuguaaugcauuuugauucuguccgucugaucuccucuuccuacucuucccagccaggcugauuuagaucugccugcuucugcuucccaagcacugggauuaaaaguggccaugacgcuuggcuauccucuauaaaaauacuguucucugagaccaauuugugcugcucuguauguauggguguguggccagccaugggagcagggagcauggucaaccuaccagggaccacaucccuaaagaaaacucuccggggcagcugucaauuccuccucagugcggggauuguggcacuuccuuauuuucaauguaguuuacagugcaaacauaucacaccaaaggauuauggguaaugcauuuuucuauuuuuugaaucauuauguacuuguuauuuaauguuacauuacuuuuauuaaguacgugcuuagcuccaaauaaauguccaaaaccauucaguuuuacagccaguaacauuggcugauuguaaauucucauuucauccugguguagaaagucaauaguuugaucuaggauguagggucaugacauucgugcuaagcauuugugguaaguuuauuacccaaauguuggccaguagucgggguuguuagucuuaaagugaguuacuguuuguuuuauucauuaguauuacuucucuuuauacauucaccaagcuacauaaccucagaaaacaagagagagagagagacagacacacauauacacagagacagacagacagacagacagacagacagacacagucccaagaaaacaguacagccuugcuccagcuagccagguguaagugggagaugggcucuagggauccccuggcccuguguguaucuuucuuucuucugauugcaguguguguucaucagcucaugggaugagauaugauuugaguuuccuuguuucuuggcccagccacagggagacauaccucucuccuuuuuuuguuuuguuuuuguuuuuguuuuucgagacaggguuucucuauauagcccuggcuguccuggaacucacuuuguagaccaggcuggccuugaacucagaaauccaccugccucugccucccgagugcugggauuaaaggcgugcgccaccaccgccuggcaccucucucuuucuuaaucuccgugccagccuuuggucaggucugcuggguccuggaagguaaggcuacaaggugacugcuuggguccaggucugagaaccucugagcucagcugagcuuaugaaagugccacaguguugcucuagauuauuggcauuauuguuggauuuuuggcauucucuaucuuagagaaccaagagaaggugggaagauaauguugcugaguagcaggcuuuuaaaaaacaauaacuguguaaggagcagggccuuguggcaccagggaccauuaaacccgauguuuccuuuuccguucuaacagguuagugguuaccuggacgacuguaccugugaugucgagaccaucgauaaguuuaauaacuacagacuuuucccaagacuacaaaagcuucuugaaagugacuacuuuagauauuacaagguacuuucaacuuuuuaaaauauaaguaugcuauaauggaugguuauauuugcugagaugacuaaucaucaguacuuuuacugaaauuggcaauuauauaaauguguacaaaguuuaaguuaaaauuuuauuuuuuuaaauuuaguguguguaugcaugcaaauguccguguguguguguguguguguguguguguguguguguguguguguacguacaugcaggagcguaugccaugacaugccugugaauggaggucaaaggacaacuuugcaugcuuuuuuuuuuuuuuuuuugugaguucuggguuugaagcccaggaugucaaguuugugcagcgaacacuuuuaccugcugggcugccucugacuuaaaauguauacgguuaguaggaaagcucgguucacacaggaacuguuugcuugagaaaccacccacuggacuuuguaugugugcauaccugugcaugaggagacccaaggacaacugugggugcuguuucucaggcacaguccguccacuugacuuuuccagacuuggugucuuacuggccugagcucuggcaguaggcuagacugguugguuucuguaaucuggucucugcuuccccagcucugggacugcgaguguaagccaccaugcuugcuugcauuuacauggcuucugagaaguaaacucaugcccuuaugugcuuuaccaacuaagcucaccccacagcccugcuggcuuaacuucaguaauuucuagaggcagaaacugauugguuaaaauugaaauagaauggugaaauagaaauuacuauauuauucucaaaauuguuucgucagccaucagaugggcuccaacuauuauaaauauuugagaggacgcacuuuuggauuuauuaaacacuuaacaguagucgaucagaccugguccacacaguuccuuccugcucuccugcuuaaauaggagcugugugguucugauuugagcccugacucccagcugccaucuguccagggucuguuuagugguaguuugugccucucucuggacuuacccgcagcuacacacuuauacagacaaggaaacuugacaauaggagaaacaguguaggcuggaauaaaauauaacgacaacacgugaucaugaugcucagggcuuuauauuuuuuuauaacuuucuauucuucuguaggugaacuugaagaagccuuguccuuucuggaaugacaucaaccaguguggaagaagagacugugccgucaaacccugccauucuguaagaacugccccggcugucuccauucuuuacagauuuccagaaagggccagcauuagucaaacuauaacuugauucugcuuaaguauaacauucaguuuacauaucauacaccuaaacuuacaaguacaaagcuuaccuugugcuuucuacuggacuucugaugaggcaagaugguugcugccucuucagcccugggauuacaggggcugccuccugccgggcuucucccucggaugcugaggauuugaacucugguucucaugauuuuaugggaagcauuuuacugacugggugguugcuuaaccccguaaaaucuauuuugaauuacacuuuuaaugauaauauauuauuauuauuauuauuauuauuauuauuauuauuauuauuauugagacaggaucuugcaccauggagcucugguagucuagaaccaagcuguccucaaaacuugagagauuugcuucugccugccaaguguugggacuaaaaguguucaccaucauuccaauuuuuuuuuaaguaaauuaaguuuuuaugauuauuacacuuaauuuuuuuagagauuaauuugauauaugugaguauacuaucgcugucuucagacacaccagaagagggcgucagaucccauuacagauggaugugagccaccaugugguugcugagaauuguacucuuccucuggaagagcagucagugcucuuaaccgcugugggaaggggcuuugcagggaggagggaaccaagagaaguggaagugauucuagaaugcacuuugcacuuuauaugcgugagaaauuccccaaaacaaauuaauauuaaaaauuaaaaaagaaaaaccuaagauaaugguaaaauuccaccucaaaauauucucauuuuguaaauauauguaacauuggcagagaaauguugugauuuagaaagaugauauaguuuugugaggcaugagaggaaaaugagaccagagacuggugaagguuaaucagcguguaauuugaauaaugaauauucuaugugagcuugcugguugccaggucuuggguauauaagcuuagcuuugcccuuguguuugcgcuuuaguagagaggagcagcacuaauugaauuaacccuuucaacacacauaugcaugcugagaacaugcugagaauagagauaagcccgacacagagacacucccucccucccugcagacaagccugagcuucauccugauacuuccuaauagggaccaaagaguaccaaagagcaucucaaggguucuggaauauuugccacagauuaauuagcuugauacugcguuugucuuguacaucaacaagaguuauagaaugcuuuuaagcaucuuuauacuuccaugggccuuggauucuacuuacuuguuuuaugggagaagaucuuauuucauuguucuugcuauguaguccaggcuggucucaaauacagauagccucuguccucggcccuuggacugcuaggguuaaagcugugugcugccauaccugucgaauuuuuuuauuuacuuuaaagaaauuauuuaaaaauuucuaacucuucucaccuaaaaauaguccccaguaauuugugaauuuuucucauacaucauaagaauuuaaaauauuuuuccagaggauacaauaaauguguucuuuuucaggaugaaguuccugauggaauuaagucugcgagcuacaagguaugcacauacacuuaccgacgugacuggugucuaugugagcuuuggagaacacauucugcucuccuuagugagagcuaguucguauucaauagcuucuacuccuuuaaaaacguuguauaagacauuuaaguaaaaguggauggaaaccuacuuacucauuauccauccagcaguugcugcggaugcccaguuuuguuuucucugcauuuucuacuucacuuucccaaucauguaaaggucaagauuggauuaaaucauuuuguuugagagccauacaaaauuagagcauuucagaauuaaguuaaaugcuuuucaaaauuuucucagagaguagaacuuacgagacaugaguuaaaugaucacacacacuugcacacagggaguauuuucuuauguucagagacuaaucagcugaaguuauugauaauuucaaauggauuaaucauaaaauauaguuuugaagauugugaccaguuuuacauaaaauuuaaaauaagcuauuuuuaaaaauauucuuucuuuggaaacauuucuauaaccuaguaaggagauaaauguaauuaaggugauuaaauuauuaaaugguacuaagaagcuauuuuaacuuaaaaaaugcagaugagauuuaaaaauuuuuguuucaacaaguauacauaggcauauauuuuuugaauacauuaaaauguauuaaauuguuuuggguguggucuugaguuucuggucacuccccugucucugccucccaucacugcaggcauacugggauuauagauaccauugcauuuggcuucuuacacggccucuagggagcaaacucaggcuaccacgcucacacgacaagcaugucuauguguuagacccuggccuggcccuuugauguuuaucuuaaauuuucuuuugaaauaauuuucaaucuauagcuauaccacccugaccauggcgaaucuuaucugaaauaaucuccgacuuggugauguuaucaagucucacgagcuuggucugugcuguacacaggccuaguggaaaaaaaugaaugugcauguuuagauagcacgagggaaucguguuguuagagcaugcgcuuuaauaccugaagcuacuggcaugcuuuguauaagguguuccuccaguuauggcguggggggaagcugagacacauaagugcagccauggccaugagggaagagaaagccagagcuuauagucaagucacaaggacacugccuucugauguaccgcaaggcuuccauguaccucagaaacuuuuccuuguggacagugcagucacuguuaugucacagugaucuuuauuuugugacuaugauaguaaauuguguuucugacaaaagcaagaggcaaaaaagccuuucacuuacuuuuuggauguaagagcucauuuuauaaguuuugaagccuggguugauaguggcaggcagaaccagccugguuaacuuuaauuccuuaaaguuguguggcuugugccuguaauuccagcgugccugguugaaacagggaaauuauguggugaagucagcuuuggccuacauaaugugaccuugucucaaaaacuaaaauggaagcagcagcuuuaaaauguaguaaaucugauuucuuuccguuuaguauucugaggaagccaaccgcauugaagaaugugagcaagcugagcgacuuggagccguggaugagucucugaggugauuugcuuuucgugauccguuguuuuucugcaucacaguuaacugggaaagagaauaaugcaguuuuccuuauuugaagugaggagacccagaaagcuguacuucaguggaccaagcaugaugauucgucagacagcuucugcgaaauugacgguaugacguuugugaaagugugcauuacguaccaaccaaccuucuuuccugucugcuugccugccuccuuuccaccuucccuccuuuccauucacuguauuaagcauuaaacucaggcuuggaugcuagccaagugcuuuaccaagagcugcuccagaagcugcucccaauauuuuaaaaaauuauuuuaaaaaucgcaguucuaauagugugacgguuccucaaagagcuaaacacagaaccaugggacuuaacaaugacauuccuuggaauguaacucaaaagaauuggaggaagacucagacacagguagauuaauguucauaagaggcacaaggaaaaauggucuaugugucuaucaccacgugcaaaaauaauugaaauauguuacauaugauacacaugcaugcuacugaacgauaagaagaaaugagcuuccagcagauccugcaguggagcagagccuugauuauaaaacguugugaauguaacuuacugguucacugaauaugguggaaauggccacuuucauuaucugucuuuuuacuauaauuaaaaaaaauacuuucuguaaaacaauuuaccuauuacauuuugcagguuuauguaauuuaaguaguuucuaguucucuuucuuuugcauuuuguaaaaguaucuacauguaggaaagaggaaaacgucauuuguagaugcugcuggagugcagagaauguggagccauggcgucgagucugcagccggugcugaaauugcacagccugacagugcauuaggaccuugaucaaguuuuauugauugcucuaauuccuccuuuucuaguaucuuuuuuguuuuguuuuguuuuuuuucgagacaggguuucucuguauagcccuggcuguccuggaacucacucuguagaccaggcuggccucgaacucagaaauccuccugucucugccugccaagugcugggauuagaggcgugcgccaccacgcccggcuuaguaucuuuuuucuguuugcauuguuugccucugcauuggcuaggcaaaauuaaaucagauuugaauuuugauauuauuucuaugguucuauaguaguggacuaaugaucuuuuaaaaaguuagugaaaaggauggguggugguagacaccuuuaauccagcuggugauugguuggccauuccuuccgucucuguugcaucuuuguccuugcauuucauuuagauuggacaaguuuugggucgcaagauuuguggguggguugguguccuuaucccuggggguccugccuagcuauaggagguggucucuuggggccccauuguuaagcaucccagcuaaggucacccgcauugacuccugggagccugucuaaucccaagucucugggacuuccuagagauucuccccugaccccagcuagcagcugcagauuuccauuaauucuucuggccuucuggcccuuucugagacaggauuuuucgauguagcccuggcuguccuggaauucacauuauagaccaagcuggucucaaacucagacauccuccugccugucuccccagugcugggcucaaagguguacagcacggccaacucauauuuuccuguuuuuaccacuacaaggucagggauuuuuguaaccuuugugugcaccucauguggcuguuuguuucucccuuuuuccuccucuuaaaacguuguucugaaauggguaagauuuggugccacauuuuaucuugcagauauacagucccccgaugcugaguauguggacuuacuccuuaacccugagcgcuacacaggcuacaaggggccagacgcuuggaggauauggagugucaucuaugaagaaaacuguuuuaaguauguacuguuggucuagaccugugcagaucagguucacauucuuaaaagauugacuaggacauagaaacuaaaaugcccugauucccuaugggcauuggcacaaguugcaacaacuucucugaaggcuuagaccuuucuaggauuggagacacugaacaaacacuccugaguggauuauauauaggaucucauuauguagaugaaguaacuggggagucaugggcuuugcuucauuuaccaagaccacuguagccaauggugggguguagaucagcaucuacagcucaggauucccuuuguuacccucucucuucucuuuucuguggcgcaguuauuuuauccucuucaaccuaaauugauuuccaagaauagcuccaaggugacguuuuugugugcuaaacacgucacagacauugcuccuuucguucuuauggcaacaguguaucauaguuauaacugcucauagauggagaaucugaaacuuuuaaguuagaugcuuguucaguacuuggggaaccaccuccuuuguauucuuaaggaguacaccuaagauccuuaggugacugagaaaugcuucugguucuucacuuggcagccugaaggcucuuguauauauugugugugugugugugugugcaugauucucccagagacaaaagaucuguaugauaacacauuucacuuucucaaucagauacaacuagaacauuauugguaacacugacguucauccucugcaauccuuuuguuuguaggccacagacaauucaaaggccuuuggcuucugggcgaggugaguuauuugcaucuucucuucuuuauuggcaaguggauuuggguuagacugaagaaggcacaggcagcuugucggguagucuacucauugcuucuagcgagugaucucacccuugcaagcagagguaaauauucuuagucuucuaaggacauauaucaugguguuagaccauuguaauaugaagauuagguuauaucuuuauuaucuguuuuugcaaugcacugaguaguuguuugcuuacuucaguuucauucaucuccccagauacaugaauaucccaaacauuuaccuaauuuuucaaaaauacuugaguuugagagaaaguuuaagggugcagugguuggucagcaugguugagguccugggcuugauucccagccaaauaagaaauacacacagacacagacacauacacacacacaccccucaaguaaaagacuuuacauucucaucacauuccacauauggucugauuauaaauccacaugccuuacauaucacuaaauauguuuuuauguccauuuacauucaagaucuggucuaaaugcugccuuucccgaaacacuucccuuuccaguuggaagucaucucuggcucucuguggagcagcacaugcuggguuugcuuccuucuuagaauguuuacugguggcaucauucugugauuuauauauguauucaccugcccuagugccuugggauaugggcagcaauaucucaacauagagccugguaguuauggaguaaguugcuagauacauuaugaugucaaugguuuuccccagugaacaguuucuuuaaaagaauuagagaaauugacacauuuuauaauuucaauaaaauuuuaauuuuggauacugucuagcgcaguguaaaaaucacuuauucuugcaagaacugguuauucaccauugugcaggccuuauguagaugccaagaggacgugcagauucaaauugcccucucaguuaguaaugguuuauagaauaaacaauuucuacauaugauuucugguuuuuuuuuuagaaauuacauauucuuauugccuuaguuacuuuuauauuguugcgaagagauacugugaccaagaaaacuuauaaaagaaagcauuugaguuuuagagggcucaauuuagaguuuucauuacaguuuuagaggguuaauccaugaccaccaugguagggaguguggcagcaggcaggugagcguggcacuggagaaguagcugagagcucacauaugaugcacaagucuaaggcauuagggaggcccaaccuagaugaccugggcuuuguaaaccuaaagcccagcuccagcgacacaccuccuugaacaaggccaaucuuccuaauccuuccaguuuggggaccaagcauugaaauguaggugcuuguaguggccauucuuauucaaaccgccagguauauucucccaggauggacuuauugauagacucuucgcugcccuuuaagcaaauauguaagguuuuuauuuucucaguucauuugaaagccacugaugucacagucagcaagcacggcuaucaggcaagucugucugucuuaggaaagaaagaacauuuucggcuguguuguauguggugaggcaggggaggguguuuaucuaauuaggugaaguacaaauucauagauaagugcucucuauuagcagcucauauuuaaucacuuccagucauuuuaguggaaaugggaacucuuucagugaucaucagaaaacaggcuacaugguaugugacaagggacacaguauaauacaguuguaacaaacauuguuagguuuguaacgguggggaggaguuguggggaugacagagggaagcucauuaaauaaagaugaucagcaguagagugaaggaaaaaugcauaaauaaaaacagcaucuauaguuacagaacagagccucuaaauaccuaaguaaacaaaaaauaucacacuuuccaaaguauaaauggucuuggcaaggcaaacugggaucuggguuugguucccagugcacgcaugguggcuuauaaucaucauaacuccagcuccaggggucugaagucuucuucugacgcaugagggcacacacauacaugcagauaaaacaccgauacauauaaaacaaaauaaauaaauuuuaaaaauauuuuaaaacauuggcaaugagaacauguuuaacaaacugugaugcuaaagaaaaaccgacaaaauguaaugaacuugaugguaguuuuuagaggcuuuauuaccuuguaaugcuuucucugcgaguuuuauuuuguuuuguuuugcuuuuuuuucuguucuuuuguuuuguccuauucaucuuuguuuuuauuuuuaucccauuaaaauuuuuauaugcuuuuuuuuuucuaauguaagaacaaaaaaggguguggguuuggauaugugagaaauuggggaugaggggaggaguugugagaaauuggggaugauggagaggaguugugugggggggaagugggaugacaaaacggaguugugggaggggaaaaugaaauccaaauguauuauaucaaaaauuuuuucaauaaaaaguaaucuaaaacaaaaaggaaaaugggaacaaugaagauuauguuccaacaguaaguaagcaacugcauauaaacugcugcauuaugaggaauuugaauuuuacagucuuugaaaacaguccaaagguuuuaaaucuuaugucagucuggaggagugaaagcaguaauacagaccuuuagcagaaguguguuauagcuucaggauaauaaguguacaaagagugcuguccaagugcacauaggugcuuuagauguguaagcugcugacagacagugugcugcaugucccugcgcaucagcacaggugaguucugugagccuaaacuacugcuggguggagauuugcuauggguguucuuucuccugacauuguuuguauggauacaugaacucaaaaagucauuaaaguacucucaugaaaguguagcauuucagaagggaaagguggagguaauuuauaauaauauaacaaaaaauguuuuuuuuuuguuuuucaggaaaaaguaaagguacguauuuuuaucaugcaauaucaguucugccugcauauucagauguguguucugguguugauuguggcaaacugcauuucuuuccacuuccucugacacuuuguuauuuuagaguagugguucucuuuucuuuucuuuucuuuucuuuucuuuucuuuucuuuucuuuucuuuucuuuucuuuucuuuucuuuuccucuccccuccccucccccuccccuccccucccccuccccucccucucuccuccccucccccucccccucccccuccccuuuuuaguuuuucgagacagguuucccuguguagcccugacuguccuggaacucacucugcagaccaggauggccucgaacucagaaauccaccugccucuguuauuuuguuaacucagacguuacuuuagaucauuuucauucuuugaggguuuuuuuaaaaauuuuuauuagguaucuuccucauuuacauuuccaaugcuaucccaaaaguccccccauacccacccccccacuccccuacccacccacucccccuuuuuggcccuggcauuccccuguacuggggcauauaaaguuugcaaauccaaugggccucucuuuccagugauggccgauuaggccaucuuuugauacauaugcagcuagagucaagagcuccgggguacugguuaguucauauuguuguuccaccuauaggguugcagaucccuucagcuccuuggguacuuuccuuaagguuuuaaaauuaaaauaguaaccuuucuacaaacuccuuguccucuucccauuuuauuucuuuagaugguaauucugaagcuagaaguagugagcuuuaguauucugacagugguaccauuaggucacagaacauggcaauuguguuuagcgcuggccuacugcucuuuggauguagugaccugcauggaauucuguuccaucuguaguaucaucuuacaguguuugugucuucugaaccuaaaaguauguaguaugucccgaguuuucaaagcauaaauggcuuuggcaauuuaucuaguuguguaaucuugcuagauuuggugugcgagugugcgagugugugugugugugugugcgcgcgcgcgcgcaugccuguguguuauuucugguggaacagucuuggggauugaacucaggagcucaauuugaacaggauagccaagugaugugucacagagugacacccuccugacuccagauucuacaguuugauaccauaugaaacauuuuauccaagaagucaggagacaggggcugagggaggaacagagugguacuuacuuggauccacucccaaacuucucuucuuggaagaaauuagauuugaaccuuuagcuggcacaguucuuaguacuuggaaauucacauuuugguguuaugaaaaauuaugacuuauuuuuuucuuuuaauuucagagaacacauuuuacaacuggcuagaagguaauuagaaacuuugaaauaaauuuaauuuuuuauuuuuaaaucaugaaguaauucuuaaauuuucaagauucacauauaaauuuuaauuuuuaaaucauugauuucuuuuaggccucuguguagaaaagagagcauucuacagacuuauaucuggccugcacgcaagcauuaaugugcauuugagugcaagguaucuuuuacaaggugugugacuuuugaaaucuuucauugacuugcuuuuuagguauuuuuagaauuuucuuguauuuaccuggguaggaaaaaaagagacuuguuugacuaucgggcaguaagauuacacucguaaacgguaguaacuaggaaugugucuauaguuguauggcuccauguauuuauuauuaauucucucaaaacuagauacauugcuuuggaaauuuucuuucacuuugcugugggaauuaaaauagcccccacagcacaguuuguuauuguacgggagccucgauuuguguguagacuuuaauggguacagcauugucugcgcuuccucaugguuuagaaugcugauggaaaaucagcaugguugauuucccuccguaacucacucccucugaaauuggaauguauuuuacuuuucagaaauaaaaugguaacucuaaauagaugcuugagacucauuaguaauuucagacagucauuaaaauuuuucacuuuuauguuuaauuauacgugugggguuggggguugggguggggguugauaugugcauggaggaccggugccucagaggccagaggccguggcuguguguugccauggauaccugaagucaggucuucugaaaaagcauacuuucucuucacugcucagccaucccugcagcuuagcaagucacuuuuuaauuauauauuuugauuuuaugguuguugauauucagaaguuugauuuuaucaaauaccuguuucuuugucuuuaaaaauggauuucaaagacaaaauucuuacuauagaauuuuugaaauuuuaucuauuuguuuuugauggcaagggcucaucauguagccuuggcuguccuggaaaucuguauguagaccaagcgggccuugagcucacagaguucuaccugucucugcuuugaauuaaaagcauguaccaccaugccugguuuucaacagagguuuuaaggcuaaauuauuaaaaacaacaacaaacccaaacugucuuugguuaaauuacauauuuuaagcuacaaaaugaaauugacuucuauaaguauaagcagucccuuauaauuaaaaugaaaauuacacaacuguacaauucagucauuuaguguucuuucuuuuuagauacuuggcuggaaaagaaauggggucacaaugucacagaguuccagcagcgcuuugaugggauucugacugaaggagaaggcccacgaaggcugaggaacuuguacuuccuguaccugauagaguuaagggcucucuccaaagugcuuccauuuuuugagcguccagauuuucagcucuucacugggaauaaaguucaggaugcagaaaacaaagcguuacuucuggagauacuucaugaaaucaaguaggugcuauacauuauaacauagauauuaacauauaggugagggguggugcccagaguaaacugcauuauuugguuagagaagaaaaccaucuuuauaucaugcauauguaguuguauuucauugaaguuuuaguuuuuugagauggucacauucucuugccucagccuccagagugcugggaauguggguauguaucgccuggccgcccagagcuucuagaauagcuuggauuugcuuugaacuguguacuacauuuuuguuuuuuauguucuuaauaccagcauuauuuucauuugcacagucuuuuaaguuugaggccacacuucuaauacacuuagaauuuguauuugaggauaaauauucauuugcauugguguuggcguuacugaauuuuauuccuaaaauuguauuauuuaucucugacaaauaaaauauauuagcaaguuuuuugaugcuucuaauucaugaacaugagccuuuucuguuuaaaugcaggucauuuccuuugcacuucgaugagaauucuuuuuuugcuggggauaaaaacgaagcacauaaacuaaagguaauuaauuacacaucggcuuaauuguuagcuacagccaggcggccauguaggcugauuguaacagagcaguagcauuggaaguugaguaaaaggaugcuuuugagaggcugaggacagagcugggauaggugggagaucuugaccagagcggaguucccauuggaggaggcugcagugcucaggaggaugacuaguaaguagucauguguuauacaguucacaacucuucccagcagauucuacugcaaaaggcuauguuaacuuaugaauuuguuauuguggguuuauuguuccauauuaacuaguaaauaucaaaauauuauugcauaccacaaacaaucugauugucaauuaaaaaguaaauuuaagguauaaauguauuuauacuuccuacugagucuugccucauagcucaaugggcuugauaugacuuccccagaauauuuguaacaccccucccuguuucuuauggugaugaaagaagcuaauuuaaucagugugugaagcaaguucuguuuugcgcaucgugcugaggucagcuguuaggucagcugcucuugauccaccgucucuuuccucuugagugcugucucgacacagauguggaccucaguggugaugcaauccccacagcuuccaggagacuggaagacagacagacagacagacagacagacagacaggggaagacuucuuuucuguaugguuuucaauauguuccuauuuguacuucacuugcugguuuguuggugaguguuuugguaucacacucauuuuuagacuguacaaauuaagaaauuuugucauaguguuuuaauuugauccaaauuccagucagcuuuuaugugcuuugaaguuuauauauaguccuuacaggaaaaaaaaauaggaaauuaaaaaaauguuuguuaucagauuuacuuuuaaaagcuuucugguaaauauagauuugaacauuauuuauaaguucauuuugcugggcauagugguacgcuuuaaucccagcauuuaggagucagaggcaggaggaucucugugaguuugaggccagccuggucuacauagugaguucuaggacagccagggcuacacagaggaaccauguuucaaagaaacaaauuaaaguuuucauuauggcuccuuuauaguggcaguguauggauagaaaugauugcuaguguucagaacagaauggagucugaagguuuauaagacauuugaggauuuggcaggaacuagucaguugaguuuguucauucucccaaaugacuguaauccaugaugagaacuuuggaagugggacuguguaccuggaguuccugucuggcugggaggcgagggagugccugccugagcaucagaacagcaaggcucugcuuuagcaaguucacgucugaugauuuuaaggaugguauauuuuucuaauagggauaacuuugggauauauccagauuauuagauauuguggauguuuguggaaaugacaaagcuuuucuccuaauccaguaaguuucuaggaucuccaguucacacagguaggcuauacucauucuauuuuauguggcuggcuuuaauuuuauaaugguauuuggcuaucauaagcaacccugugugcucgcuguacauaucaugcaaagauuuacucaaaagaugcucuguucaaauacuuggguuacauagauuccagcacuacacuuagacaaaagcaggcauaaucuuuuagaauaguuuauaacuuugcaaguaugauugucuuuuaaaagacuuuuaagccccuucugcauuaguccacuuuuauuaucuuguaauauaauauaauauaaaauaaaauguaauugucaaaaacucacuuuguaucagugacacccuuuagguaaacacgugucacuggcccaucauaguuauaucuguuuggacauucauggagccuguguggacagcugcuucuucucuagguaacuugucuccauauagauucuguagaccucuagaacaacuauuaauugucaguaaucccucagggaggaguugggcaucacaacccucuuccccucuaguaguuaaaaguuaugauucuuuuuuaguuaaaaaaccuaaaaaccuggaauuaggcuacauuuggaucauuuuacccguucccuuucuuucuuuuaaccucugcccugguguuccucguccuguuuccucuccaguucauggucuccucuucuuuaucacuguuacauacucucugucucugucacucugucugucugucucucugucugucugucucucugucagucucucucucugucucucucucucucucacacacacacacagaguguagaccuguuuaaucugccuuguaugaauaugcauucagggcugaccaguuggauuggaugagcagccagggacugaucccuggggguauuacccuacccuccuuuuuaaaacacuaaaggaaacuuccuguuaugucaugaaaacugucuacagcaguauuugguaguuuaaaaaguguuguuguuguuauuguuguucguuuuugagauggccucauguccaguguaggcuggccacagcuugcugugccgcugaggguucccuagagauuacaggucucuaccaccugguuguguagugacgggggcagaacccagggcuuuagguauauuagucgcuacaucucugugccguggguauucucauuuaaaagcuuaagauuaggauguucucuuaaugaacugguccaucaguaccaaacggagaaaguuguaaaguguauaauucauacucauuugggcuuugaauauauuaguagagauguaagaucucgagucuugugagaauauuccacuugcuguggcggcuucauccugagcugagucagucaaguuucugggcaguccaccucugaagcagcuugagauggccuuugaguuacuggaucagcagagugcuuacaucuagccucaggcccguggcucucaacugguugaguccacuuuauaugauuuaucucauaauaaaaacguuacagacuacugaaauacuagagguuucuucugaaaucugugucagaugucugcuucagauauugguuguucaggacggcugagauggccaauggguaaaggcaguugcagccaagccugauaccugaguucaguccccagcacccacaucaucaaccucugacuuacccacaugcauguacaaacacacauacacaaacacacaacaugcauacaugcauagcaggugcgcgcgcgcgcgugugugugugugugugugugugcgcgugugcgcguaugaauaaaaucuagcuuaaaaaacguuuaaaaacgacucauagcuugagauuucacuuuuaagaccaggagucacuugaagggucaguuacuaauuuugacacaagugguaugcaugaugccuuuuucuucauuccguaagaacagacacuacuuuuagacgauuguaugcaagcugcucuguuauaaacaauauaaugcucuggugucaauaaacaaacacacacacacacacauauuaaaugaauaaaaauauaaauugaacaacauuccaaguccagcauaguaguagaggacaggcacagaagugggguaugauaccuagggaguuugaauuauauuuguaaugauuuaaaaaaaaaauugguaguguauacauggcuauuaauuuuaugucucucuguguguauauauauauauauuuaauacauauauauaaaauaguaauauauauuaguggugaauauauauuagauaauauauauaauaaauauaaauuauauauuaguagcaaaaauauaauuauguauuacuacugaugucaauaauaucaguagcuaagaaaaucccguguuuuuccuaaguccagggaaggagagcuguaauuuaacuuuauccaaggucgcccuccuccauccucccgcccuuuaccuuuugggugauauccuuuuaucccacaacugccaauauacaacuaaauaacuuauauuucuauucagccgguguggauuuggagugaggcagagcugguuucaaaaagaacauacaggucacuaggagugugaauuaggccugcuaacucauguuucugcaucuuuuaaaggacuccaugagggguggauuguauguaguuuuggaucucugccgaggauucaauggaaugauagggagggagggguguucuccuagguaguggaugcucuggugcccugugguacacuguucacggaaagcacugggaacccguucuuauaagauuuuguuacauuguuuguaggaggacuuccggcuacacuuuaggaacauuucaagaaucauggacuguguuggcugcuucaagugccgccuguggggcaagcuucaggugagccuuggucuggcuccguacucauccuuuggugagcugugcgcuggcucuguacuuguccuuuggcgagccgcuuccucaucuguccuucuuauuucuguuuuagacgcaggggcugggcacugcucugaagaucuuguuuuccgaaaaacugaucgcaaauaugccggaaagcggaccaaguuaugaguuccagcuaaccagacaagaaauaguaucacuguuuaaugcauuuggaagguuaguuuugauguccugaaacugcuucugcuagccaugguagucugcuaucaugaguacauuuucagaggaaaccagaaauguucuacucagugagauugccuuguuacagcaucauaugaucugaugaaauagcucagggauacacacacauguaccuacuaguugauuauuuccauccauugauuuuuauauucauguuuacuuuucugacagauuuugaguaucauuaauuuggauauuuuauuguaauuauuuuguauauucauacauauauacauccacacaugguuuuuguuuuguuuugagaugaggucucacuauguagcccuggcuggccuggaagucacucuguagaccaggcuggccucaugcugagaucugcuggccuuugccuuccugcugggauuaaagcauauaccauccagcccagcuaacugugauuauuuaaaagcauuucuuuuuccuuuuuauuugcuaugugcacugaugaagcaagcacuauuggugcuaccuuuaaagguuauggaaaaucacaaguauuucuaugaacucauacaaaaagaugaguaauucuuacaaauuauuuuuucuaucgaaacugaguuaaagggagagauaaggaagacacaucaacaguucuagguguagacggcuuuuccuucugcgcuuggugauucugagacgacggccccuuccccucagugcugccacugagcccucacguugggcagcucucacucaaaaacacuaucagacauucuugagauugaaauaacugggcuuagaauuuauuucccuaguacccaggagcuuuacugcuacaauaaacuguguguuccguguuuaucauacuaaagugcagagcugaaggccaggagcaugcagggaugcaguacagaauagacuucacuaucuauagcuuugcccuuuguacauuuaguacuaagaaagguauguuacuuauugugcucuuauacuggauagcuaaaugcuuauuuuaauauuuuuacauuucuguauuuuguauuauguauauaauacaaauaacaaguacauuuaugaauaccuaaaauauauaaguauucugaugcuguuauauauuuuacacuaaauauuggugugcuuuaaauaccucagcauagcucuggauauuuaaaauacacacuuauauacauauacauauauauuuuuaauacuugaauauuaaaaguuagcuuguguugggcaauauuaucuuggguuuuccuugccagauuaaaaacuaaaggauauaaguagauuuauguacuuuuuuuuuuuaaauguuuaccugaugguuuauuuauuuauuuauuuuuauuucuuaaauuuauuuauuguuauauggaaguacacuguagcugucuucagacacaccagaagagggcaucggaucucauuaugggugguugugagccaccaugugguugcugggauuugaacucuggaccuucaggaagaguagucagugcucuuaaccgcugagccaucuugccagcccuuauguaccuuucaauuuguugaaauaaacuacuuuaaaauuuuuauauauucuaaaaaaugcagaaugauuaauagaauuuaugaaagacaguuuuuacaugaaauguuucuugguuacaggauuuccacaagugugagagaacuagagaacuucaggcacuuguuacagaauguucacugaggaggacgguuggaaugugccuguuucugcacaggggaaucugaagggcagaaucucucugagcaccaugguugcaaugacuguccuaagccaaacguuuauauaaagcugcuuuuguaaaagaagagauacauugucuuaaguaaaugacauuuuuaaaaauuguguucauguuuaauauuauugugaauagaaguaguauuuugauaauauacaaauuuuaauacuaagcaaaaguaaggucauuaaacucccuuaugauaaagcuagguaaauauugccuuaggcucucaaacuagaguugaauuuaagaagguaaugaaagcuaagcuaagguaccugugacaaguguuugguaauaaaauacuaagaggcucagcaguaaaccaugguuaucagccucagauaccaaugcuuuuucauuugccucauauacaaagaaaauacagacugcccaguuagauuuaaguuuuagaaaagcaaccaguuuuccuuucaauguuaaguguguugaaguuuauuagggccuauuuauacuacaaguuauuugcucgaaguucaaguuuaacugggagcccuguguuuuccuggcaaccuuaaaauacacugguaugaaacauuccuuuuagaguuaaauagcuauuuugauugugcuguuuugguauguugggaaguagaacaauucaaaggcacaggagauuucuaaacaucguagaaagauaaauagauuauauauuuauucucauaauaguuucccuaauggaauuuuggggaaaauuuuauuuuuauauaauuucauauuuacagaaaaguuucaaaaacaguuaaaaaaaaaaccaaacugguuuuacucagauucauggauuguucacauguguuuuaaccccucaccccagcucagaguggcgauugagcccaggaccucagucaugcugggcuagcccugcauucaugagcuguguccucaggccuugcuuaagcuccuacauagacauagacacccuguuuuuauuuaaggguuugagucaugggccucaugauuuaacccaaaauacuucagugugguggucaauaauuuccuaaaaacuauuuuuuguuuucuuuuuaaaggaauauccaaaccuuacaaaucugagcugaacuacuuacuauaagccuuaaaauaaggagacaucccacaucccagccaccugacguuugaauuugguugccuuuuucgaccuguguagucacaggcuauacaacucauguuuuuacgcaugaaacucuguuuuucuccacaggauggagcuguaacguagauaggauggguuguuaguagaagcucuacacugagagcaguauuugauguggcuuaagaauuuacaucacauggcaauuauaaauggcauauaccucaaaauuaugcccccuugaggucacaucuaaugucuugagcaguuaggacugguugagaugucacauaagaaaaagcaggacuuacguauguaauggcuaggaaugucacuuuacacuguuguguauuuucucugucccuaagacuuggucuagugccaggcauacaguuggugucuaauauuuauugauggaaaguauauguauuuaguauacguuaagugauggugauguagcuuguuuaguaauguauccuauuucccccucccucucacuuuuucuuuuggaucucauaauaaaagacaucaacccacuaauuaggucaguuuucuuggggacuuaaaagaacuaaaugaucaccacacacaagccagcccuuuugaaacccucacugcuuucacgugcuuuucccacuugauuggcuauguccucugucccuccaagugaagucuaauaccuaauucuaaguuuauaguuaacaagcaguuuaauuuuuaagaaaucuuaacuuuuccuguacaugacacaauugacaaucccuauuccuuuguguccuuguguuuggauuacuccuggguaucuuucuucuggucucuucauuuaaccuaaguaucauuccucagacuuuuugcucuuaagucacuggaccguacuuuugaguaauuucaaugcaguaaucucauuuuagcuucucagucugucucucugcugugcucacuuggcugccuguugucgcuucugcaucuucaaggacucagucaccacaaaccuacucuauguuuguguuccuuacuugguuaauuucagagccguugcaccguucaaggcuuuacaguucauuccuguaucguccaccugacuauuggugucuuaagcucugccgauuuucucucaacauuucuaucaguguuuuucaguuuuuauuacgaucaccaaaggauuaccugucuuuucccaucucucuguuggcuccuaucaccagauugggcuuucuagaaaccuucagccuaauuccugcuggcaaguuucaugagcuuuuuggugagagucucugcuugauauccaagacccuccucuuguguuugccacuguucugauaagaguguuaaaacguuuuccaaaaguccagaguuguuggccuuccaaaccuuugcaaacacaguauuugcauugagagcccuaggcuucuuucucaucugggaaauuccaugcauuuuugaaaucugugaaauuaccccuguccccuuccuauggucaccacuguaacugcaaccuaccucuacugaaucacuuauuguacuguauauuuuauuuuaugaaguguccuuuauuagaaugugagcuccuuaggggcaggaaaagaaacuauucauuuuggcaccucuauagcauaauguuuggcacaugagcauuuaauaaauguuuguugaauaaauugcuucacaugacagcuguucugacugcagguaccuucacugccuuugcugcacagugaggaucaguagacugggcguggggggcaauaaagaugaaaauaauugaaauau

SEQ ID NO: 7393 - RNA, 19911 nt, Mus musculus
uugguauuuaugaaacugaaguuugaugucuuuauuuaaacaagaauuaacuauaaauaaucucaauuuuuagacauugacaauuuccuuauacaacuuuugauugccacaugaaauuagaauuguguacagguaacagaacuuuuguuuugaacauuuaacauuccauagaguagacacucucagccugguauuuacuggaagauauuuauagaauccacuggugaaccuaagaaauaauagaucgcuagaaaucacauauauguaaaauuacauguccaugaacagacuuuuccuggauccagaccacaaaaagggaauuauuuuucacauaaaccaaauuauaaguauuacuuccagucauaaucuuuaaaaaguuaaaauuaucaaauaccuaacugcaauagguaaagagaauuucuuggaagacacaaguacauguauauacuccauaaccccacacucuaugaucuauaaaagaagacauucuuguggacucugugaguacuguuuaaaauucaaagcccuauuuuaauuuucaacuucauccagguuuucaaaucauauacuuacuaauccaaaaggacaagaauaaaugugcuuuuagaaaagacaagaguauauauaggacaacuuaaaacagauuuuauugcuuuuuuuuuaaggacgaggaaaacaaaauauaaaauaagucauaagaaaugcucuccucuacuaucucaaucauuuugaauguuguacaaaaugcucacaaagcaaauaugaaaagcuucaggaugucuuuuguaaauucugcugaaguaaaugcaacaucaccaaacaugacuuucuucuguaccaauuuuuaaaaaauuacugaauuacauacuauuauguugcuuauacauguuuauucacuuuuaauaagaucauugccaauacauacauuauuuuccuuaacuuuauuuuuacauuaaaccaaugucugucaugcagccaccaaacccuucuagugaaucacacagguuuguaguccagcuuggacuccagcuucuuggagucagccacuuuccugacugcuuucaugaagucuuccugaacuacaaaaucaugaucggcacgaauugcaaacauaccuguggaaaacaaaacaaauugcugcuuauagugugugcgaugcaguucaaucaguaagacagcuaagcugggaacagugguaccugacuguaaguaagcucagcacuuagcagaucucaaguucaagaccagccuaacaugucaagaccucaucucaaaagaaaaggggaaagaaaacuaagugaucuuaucucuauggaggaaaugugaagagauauacacuuacuacuucugagccaguaaugcuacuucauacauuuucauaaauagcgugagcauuguuuuugaaauaagcagauaccacaauuaccugacuauuuaaaaucuggacuguguaguacuuaaugaaauuaauauucauuuaauaaaaauccuggcaguauuaaguggugguacuuaauaaaaacaccuggaacaaaacaucugggcuaggauggaacagguaggauguuugcuuaacauaugcaagaucuuagguuugaucucaagcaaugcaaaacuaaacaaccaacuugcagugacuuuaauaaugauuaccugucacuaagcaaggcuuaagguuggggauauagcugucaggaguauugccuagauuauagacacuuguucaaccaucuguacugcguacuauaagccuaaaaucccagcauuugggagggaaaggcaggauaaucacuauacacuguauauuucaaaaaguuagaaaaaaggauccuagguguuuucauagugaagggaacacagguaaucuccaaggaagaaaagcuccaagucagguaugcaacacagaccuuggacccacacauaaauggcgcucacucuugaugacauguacaguuacagguuguaguuagagagagagacacucucuucagugguguagccacaggaaaaggguccauucuucucuaagcauccauacuuaaacucaacggaucagggacuggggagauggcugcuccuccauaggaccugaauuuaaucugaucuaaguauuacauaauauauacauguauacaaaaacaugguuccuauuaaugugugauuuccuucaaaguuuuucaaugugagaaaaaaaaagcaccuaucaaaauuugacagcaucagcuuuaaaaucacaguacugccuuuugacuuuagcuuuuccugaaagucgcccuugauaauuauguggucugauuuuggaaugugauaaauuacccuagagacaugccuugggucugaauauucugaaugaaaacuaaaugacuucaaccuggcaguguuucaaagucacuuguuaccaaaaauaaaacuaguaucacgaaauucagaauuguauuuuaaaacuucauuuugaacaaauuccaggacaucagucuucuagagcaaucuuucaaauacuggucuuaugggacuuguccauucuaguucuagccacaguguaccaaacaguccugcaaucaggcuucccacaacaugccugugggcaugagaucacauccccaagggccaacuuuauuggggaacgggagaggguagcugguaaaucaguguuguaggcuugcaugucccgccauacaaccucaacagcauucuguacguuucccuaaaaucaaagucagcuacuacaguggugcauccuccuuugcguuguucaguucuacuucuugaaaucaagucucaaaugcaaaccaaaaaccagaaauccugccaaagugcagcucugcuuuuagauaagcuuagaacauuguuauugaugguaaaaauauacuuuuuauucucaccugcuucaguacaaacauuucucaggucugcuccauuaaagccaucugaaagcuuuacaauugcuucauaaucuguuuagaaaaaaaaaauaacagaaaucagcuagauaacaauaaagauucaauauugauuuuugcccauagagaaaauuuaaauggacuaguucauuuugaauuugaucagcauuaccugugcuacuauuuuacagcauuaacaacuaaacuugcugcaaaguaaacuagaaucaaaaaaauacuuuugaauuuucaaccaaaauuucauugaaauuuguuggugccugcuuuuaagcuguaaaaacaaacggaaguaagugcaaagcugugacucauuaaaccugcugcacccuuguaaucaaccccaagauuugggagggugguaaagaaaagcuccaagucagguaugcaacacaaacccugcacccacacauaaauggcguucacucuugaugacauguaaacaauuacagguuauagucagagagagagagacucucuucagugguguagccacaggaaaaggguccauacuucucuaagcauccauacuuaaacucaacggaucagggacuggagagauggccgcuccacaggaccugaguuugauuccuagcacccacauggugccuaacaagugucuuaacuccaguuccaggcuccaauucuuucuucugguauuuaggaauaccaggcaccuacuuggugcacaggcauacauacaggcaagcgcgcacacacacacacacacacacacacacacacgcacagcauguacauaaaauaauaaaauuuaaaaaaccaaaaaacucacucaguggcaaaauaaaacauaauuagaagaugaaaagaggaagaaaucagaugcauggaaggggaacaagagaaagaaauggggugaauauggccaaauacaaaauacacaugcauguacacacauacacauggcauaaugaaacucaguacuguuuauaguguauuauaacaaaaauucuaaggacuaggggacgacccaguaguagagugcauguucugcauuucuaaaguccugaguucaaucaccacaccacaacauaaaaaagucaagcaacaaaaacaaaacaauuugggggcuggggagauggcucaguagcuaaaagcacuugcgcccuugcagaggacugagguuugggucccaguacccauggcguggcuaacaacugucuaacucugagacagaugugguaaacagacauacacuuaggcacauacaaguacacauaaaauauauaaguauauaaacaguaaguggaauguacuuuagucaugcaaggcaaauguaaaauauacuaaagguagagauaauuuuaucaaaacagaaccuuuaaaugauauagcaagcauuuauuagcuuucugauuuucuuugcaaauuucaaguuguaugggaucuggaauaacaacagugaacucuuucuccucacaaaguagacauggcuugaagaacuauagcucugugcuagcuaugaaugugacagagacagugagaggaacagcagagcaucaaacaccuuugucggcaauaaagaacuggccagucucuauacagggacuccucagucagcacguaaccaugggcaggucacuaaccuuccaagagcagggauucccaaggauaccauaguuaucuagcaccuuaggagagcucaguauuucuagaagauacucauaaccucauuuuuuaaaaaaaagauuuauuuauuuauuuaacuuauuauagcuguagcugucuucagacacaccagaagagggcaucagaucucauuucagauggcugugaaccaccgugugguugcugggauuugaacucaggaccucugaaagagcagccagugcucuuaaccacugagccaucuugccagcccuggaccaaucuuuccagcuuaaaaauccucguagggacaaugaaauaagugguaauaaucaaccaucuguagcuauuuagagccaucaaguucuaaagaguuuuccuuuauuguuuuuuuauugagagaaggucuuacuauguagcccugguuggcuggaagcucuauguagacccagcugacgucaaauucucagagaucuuucugcuuuugccuccagggagcugggauugaaguugugggacauuauaccagcucuaagaaauucuuguuuuaguaguaauaaugacugaacccaggaccucaagcagccuagacaagcaaucugccacugugcuacuuucuaaagcugucaagacuuauacuagauucccuuaguacagaagucaacaagcacuuuguguaaaaggagaaaaaauaaagccugcucugcaggcuuucugucaaaacuacuucacucuacuguuguggugggaaggcagccauaacagcaugcaaaugaaugauacagaugagcuacuucaaaacucuuuuacaaaagaacagccaaggagaacucagcuuaugagccauguuucgcuacauguucagcccucacuuacauaugcauuuuauaauauuuaaaauuuuuauuuuaaacuuauuuuaguuuuuugagacaggguuucucuguguagaccaggcuggccauuaacucaaaggucugccugucucugucucuugacgguaggugccaccaaccaccuccuggcuaaacauauuuauuuuuauguguccggguguuugugugugcaccauaugcacacagugcccucugaagccagaagaagguguuggaucucuucagacuucagacuggagauacagcugcuaaugagccgucaugugggugcugggaaauaaacccagaaccucugggaaagcaaccagagcucuuaacugcugaaccuucucuccagcauacacauguaacuauuuuauauuuuuucuacugcccucugguuuguagcaauacuuccaaucuucacacuuuauucuucugaaaagauaaaagcauucagaagaguccauaaacuccuaggcuaccugggacacugucggcagcagcauccuguugugcuaugcuucauuuacccgaugcauacuugaauaaucacucuacuuucuuaccuauuucaccaugcuuuguaauagguccugcguggauuuucaauauaucuaaucuugcuuguucauuugguaaaucgauaucugaaaauagagagaaacuauuuuguacuccaguugauaguuuaauagaguagaaagagguuggguaaaaagauaaaacugacagagagaaaaacagagcagauaaagaaaagagaguaacucacguauuuuucuaucuaaucuuccugggcgcagcaaagcaggauccaguguaucuggucuguuuguagccaugaucauuuuaacucuaugcagaguaucaaauccauccauuugauuuaguaacuacauaaaaaauuaagagacagacuuuaccaaacacaugcauuuuuguucacauauguacaaaguuuaacgaaauaaaaauuauuaaaagauaacuagcugacugaugaugucugcuaguugaugauauauuaucaguuauacgaauacacuaauaauuguguugcucuaaaauaucucuuauaguuuuggcuuuuguuuuaagacagagucucauguaccuuaggcuauguuuguuugauuuuuuuuaauguucagugguguuuugugaggucuauaugaggacgccacaagccuggaacuggaguuagagacagcuguuaacugucaugugggugcugagaauugaaccuggguucuuuggaagaguagccagugcucuuaacugcugagcuaucucuccagccacaagacuuuauauuuuaaauuuaaaauacuguauacagagacaguccuaaguucauggucagacuggucuauguagaaguuccaagcuagucagcgcuacgcagaagacagccugucuaaaaauacaaaacugcucauccucugccuacgucuguauaaucuguaaacaacaacaacaaaaaaucgauuuucaaacacuacaauaaaaaaagauuaaaaucaaaugcccugugcuaccuaguuuccauuugcaguaaaugggaucuugcauuacguacccucuucacuucaucaccucccugcuccaucauuaaagcuaguuuacuauauauaucauugcacgggacugagagcuucuggagaggagaugcacuacagccaugaccucacaguggcugugauuaccugucaggcaauaauucccacacaacuggugggcuuaugaggaguuacugacugaugacugcuggaacacagagagcaacucuucuucaaggguauggccccuagaagguugcugauucaagcaggaaacacuacuuggacucaguuauuaaaaagaaagaacaugaaggugcgaugguguuggggguguuaggagugagagugaggaggugggguagaugugaagacacacaauauguaugcauacauguaugcauacaugaaguuaucaaagaauaaaaaauguuuuuuaaaaauucuauuuuagcugucauagucuuaguaauaaagcucaaaagugguuuucagaguagccacaaacauaaugcaacucauuuacugcugaaagucuuaauauauguuacucauaccuuuaccaaaccagcauaaucaaucgcuuaacaauaauuuauacaucugaauagcugaucuauuuaaaaaaacuauagaguacuacaauuuuaccaaauaggauuuuauauguuuuuuuucuaguauucuuacuuuaccucuuuauauaaaaacauuaaaacuaaccauauguuuuaauucacauuuacacacuuaagucaguuuaaacauaacauauucuccuuacucaucauuuccuuauggugaaaacauuguauuccauuacagucuugaaauauacauuacauguuuuuauagagauacgcagguaccuaacaaacaauaacugcuuguuccugaguaccugguauccacugaucaaccuuuuccugucuuucccuguucuuuagugaguaaccuccuccuuuuguguauguguauagauauaauauguaugugugggguccuucuggagacuagcagcagaaggacauugguguacuuugccucucugcauuauucucuggaaauggagucucucacugaacaugaagcuccaucagcaauaagcaagucugagcaacucuagucucgacccucauuaugcugcccuuauagauguaugacugccaagaaaagcuuuaccucaguccaucauacuugcaaagcaaucacucuuucccacugagccaucuucccaaacuccacaguaaucauuuuucuuacuagggauuaugguacaagaaugcguucauuccuggcaacaucucaaacacuuguucaccuucaaauaugcaauauuuaguuuuuuauuaauaaguuuuucuuuauaaauccucuuuaccaaacauuaccuccauuaaaguucucugaaucucucugucagcugauguucccucagaaaaccgacggccaccuaaaguaauaaauuugggaauacauagacauuauucuuuuguucugugcccaucauuuaauaaaacagaauguaauaguagccgguguuaaaaauacuaaguaagccgggcaguggugguguacgccuuuaaucccagcacuugggaggcagaggcaggcagauuucugaguucgaggccagccuggucuacagagugaguuccaggcuugaagcucugagaaggccuaugcaggcaggugguacugaggaugcccacucgcugugcuaccuacugcagacaagucagagcugcuuacugcucaggcaggaccuucuuucagguuuuuaaacaauuucuaacaaaaaaguauuuaagauaaaauugaaaagguuucauucuuaccaauagcaucuauuucauccauaaaaaugaugcauggcugguggucccuggcauaauuaaacauuucucuaaucaaacgagcacuuucaccaauguacuugucuacaauagaacuagauacaaccuguuuaaaagaaaaauaguaauacaaauuagacaaaucaaagaaauuucauuuaaaaaaauauaaaagaauuucccuuaccuuuaggaaguugcaguccagcuggcuggcaacagcucgugccaagaguguuuucccagugccuagaaauaucaaaugaaguuggguucaaagcagaaccauuuuuaaaagccuuucaauaacucuuggagcuuaguacuuaagaaugcuugcugcucuucccaggacaagaguuuagucagucccuagcaccucuaacggcaucuuauaaucacauacaaccucccacauauggcacucacuugcacagauacacacaaacaaauaaccaauaacauaaacauaaugguagugaauuuucuaaaacugaagcuaaauccuacauagaauuuuuacuuaaaaauucugaugcccucuucugaugugucugaagacagcaacaauguauucaaauauauaaaaauaaauaaaucuuuaaaaacuuuuaaaaccauccuuccugauuuaaauuaguaaauaacuguaacauuaaaacugugacacuguuauauguauacauucuagauugauaaaaccacgcuaauuuacauaucuauuaacucauaugguuauuacuauguggugaaaaccaagucuucuuucaucaauuggaaauaccuaauacgccaacagcuaacuuuuuguguguuuuuucugugaccucaacccaucccucuucccacagcccuucuuaaacaaaccacucucuguaaguucaacugucuaaaaucccgcacacaagugagaucaugugguaucuugucugucuuugcgugccugcuuacuucccuuaguaucaccacugcaagauugauccauguugacacaaaggacagaaguuacuucucugugaagacacaaucauauucuacuguguauaugcauauaccacauuuucuuuacccuuucauaaguugauggauacuaagauuuucuuaucuuggccacuguaaauagcacugcaauaaacauggaagugccaacaucucuucaacauacugauuucagcugucuugcaugaauacacacacacacacacacauauaccacaccaccccucaauugccaaggaauauaguacuuuuauuaauuuuucugaagaaccccaaacuguuuucuaaaauggcuacaucaacuuacauuccuaucagcaauauagcuucucuucucuccaucuuugccaaugccugguuuuauuacauucauucacucuuuucuugguaacagacauucuaacaggugugagacaauaucucaucucguaauuuuaagcacaaugaauauagaacuuuagaaauaaauaaaaaguuacaauaugggcuauauacauugaaugaaucuuuuugaaaauuauuuauguauuuuauguauauagguguuuugucuacauguacauuuguaccccaaaagaggguauuagauccccugggacuauaguuaugcaugguuguaagccacuguguggguguuacaaauugaacacaugacuucuggaagaggagccagugcucuuaacugcuaagccaucucuccagcucacgaacagaucuguuaucuguacaugauaucuuuagcaucaaucauuaguuauuuggaaacuagagggugagugaauuaugcaauuuccuuaaauauugacauuuuucaccauaaaauauucaaaaucauuuacugguaucacuauacaucuuaucaggaaagucuucuagaauuaacauauuaaagcugucaaauucacugggucuaguaaacauuuuuuaaaaauucuaauuuucggguuggagagguggugcagcaguuaagagcaauagcuguucuucccaaguucaaucccagcacccagaugguaccucacagccaucucuaacucuaguauuaggggaucugacacacucuucuggccucuuugggcacccagaggcacacaugugguacacagacacacauguagguaugucaacuugauacaagcuagagucauuugauaaggagccucaacugagaaaaugcccccaacugggcaagucuguggugcauuuucuuaguuagugauugauaugggaggguaagccuguuacuggaagcgccagccuuggucugaugguccuuaguguuauaagaaggcaggcuacauuagccaugaugggaaagucaguaagcagaacuccuccauggucucuaucgauaggcuccugccuucagauugcugcucuguuugaguuccuuccuugacuuuccucagcaaugcaguauaacaugagagccaaaagcugaaauaaacccuuucuucucugaguugauuauggucauguuuuuuagcacagcaauagaaacccuaacuaagacacacauauucauaaagauaaguuguuuuuuaaaaguucuaauuuuacuugccaucucaaauuuuaugacuacuaacaguacuuacuuuacuuguucuagaaaaacuauaaacuaaauaaccaacugccagacugaauaaccaauuaucuaaucuccagaaagcaacaaucugagucacuacagacugcaaauuguccuuuuaaguaaaaccuaucccaugugaagccucccacucaaugacggcauaaaugcuuugccugagcacacuauacucuucagcaugcaauuguacagaaguacuuucuguucuugcucccauuucaucacaaaaaacagcucuuaagaauaaaauauuaauaaaauuuaucauuuuuaccccuuuacuagcaacauucaaagggaaacuggcaucuuugccgaaacugcaaguaugugguggucaagaacagugauuaccagcauugugaugccaguguugagcaacuuuaccacaaugccuuuguaccaucaauagauggcaaauaauagauuagauugaugccagugguuuugaucuugcagcuccauuaaaguuucucagggacaccuguuucuaugaaaugaacuuuaagggcuaugguauauagaauuacauggauggggacaaggcauagaaggacuccacaugccugacggaagagcagaugucaaccuuuacucucaauagaguggaaauugggauuaccuauauuaaauuccugucuuacaacuuuuuaauuccuucaucuacuccuuuucuaaaggagauaaucugauaccaaccuggcgguccauagagcaaacagccuuuuggagguauuauuccuacacgcuggaauaauucuggauuuguaagaggcaauucuauuaccuggaaaagaaguugcagguuucuuaaacaguagaaaauuuuaauauauuuuaaaauacuuaaagucuaauaauaccauguuacaaucucugagaaaacuacacuuucuugcuauacaaaaugacuuaaauauuguuuuuauuucagaugaaaucucuuaaaaacaaaaauuaaaaaguagugguuguuucuagcaagcuacauauuagauuguacagauguauauacuuuguaaaaaaauguauuagaauuacauauuuaaaaaucuguacauucauaucaggugcauauuucacaacaauaaaaauuacaguauaaagaaacagagaagcuggguccacuggcauacaucugcaauucaugcuacucaggaggccaaugcagggugacagcaagcucggucuagaguagguaauuuaccaagauguaucucaaaagacaaagugaacaagaacgagugcagcucaggaacggagcaccugccuggcacgugaaauccuaaguugaauucccaguauuacaaaaugaucauagucagcaaagaauaaaagaaucuauaauaauuacagaauacagagcaaaauagucauaaaacaaggaauguuucugaugucauaauugguuacuaucacaaaagacauaaaaucucuucugcuagcauuaugucacagcuuuuuuuuaaaaaguuauuuuuuacucucauucagaggauuuaaaaaaaaaagggcaggcgggcaggcuggccauguacucaguugguagagugcuugccucaccuaacauguccaagcccugggguccagcuccagcacggcugaugagaguguggcagugagugcccacaacaugcagcacuagggaggagagagagagugggaggagcagaaguuccaaguaacuuucugauguucaaugaauuuaaggccugagauauaugagauacugugucagaggaggagaaaagaaaaauaggaggaggaagaaaggaggaguaugaggaggaagaagagaaggaagaggaagaagaggaggaggaggaggaagaggaucuggcuauccaauuuauuuauagcaccaacuacuugaaauaccaucugugugauguuacugaauguuucugaugccaugaagcaugauuaguauaaacuaagugugaagaaaccaaaaccaccaacauuccaaaauaucugaggauaaaaaguguguguaagugugugugugucuccuacuccuuggcagaugggaugcagccaagcacugugggagggaggcaaguuucaugaagacauuuccuuuuccuucucuuacccccucacuauccugaacucaguauauacuuugauuucauagucaggccagugcuucuuuauauauugccaagaaaaaucugguuucauaaucaccuggaaugccuguucccuaccccaaucuucaaacuacucagaccaguuuccuuuaauuuuuuaaaauauuuauuauuauucuguguacaaauauaugucugugucccuaugugugucuguguccacaugcaugugcuaaugcacuugugcaugaugaggaggaaguguauggcacagcacacuugugggcaagagaagacaacuuuauggagucgguucuucugcccuccuucaccugggucccagggaucaaacccagguuaucuagccuuguguggcaagcacuuuuacugacuaagccaucuuaacagcccaagcaguuuauacuuuaauaaugguuucaaaauguguaaugagcugaggucuaagaauuaugaaccaccaugaacuacacauucaagaacuacucccaacucuucucauucauuccuaaauacuuaggcuggccucgggaaacauaaaucaguaagacaguguaacuucccagguuaugagacacggcgauccuaaucuaauucaucacuugaaagcuuauaaacuucuguagccaguauucuaaagagcaacaaauaguuugaaaaaagauaaaaauauuugggggccaagguaacacaguuuuuauuguacuggguucaacaucacuagcuuuaggaaaaccacacagcauguugcccagugugcaacuaguugaccuaagcacacugaagacaauuggaaauguaaauggcaaagguauuagauaccaauauuucuucacuuugcccuauauucuuuuuuggacacaaaaaggugacuuuaccaacacuccaaaauagcaagcagcaguaaucuuuacaguuacaaauucauugcuauucucagcagaguuacaaauguauaauaagcagaagcuacuauugagccaaaaacaaaaugaaaugaaacaaaacaagaaaaaccaaccaaacaacaacaacccaaaauguaauuuuacaccauuucucccuucagacauccuaaaagcaauagggcaauagucugagaucagagaacacaacacccaccucucuuaacucccgaaucuguucugacaggccuccaaucucagaauaagauacauuuccaggauccucgugagacauguuauaaaccaauggauccaccucucuuggcagauaucuaggaugaaaaaaaaaaaaaaucagaaacuuuucucucaagggauuucgucuuagcuuguggauuaugcaagcaccuucuaaagaccuugaacuuaauagguaagggguaguaaaaucuucaaugauuccacaaauccuguacuuuagaaaaccuccccucuaagaaaaugggaaguaaacaaugagaaacccaccucaugaugguuaguguggucauauccaaagcaacucugguuccuggcuucagcuuacuuuugucaagcugguuucauaaaacaaaagauguuacacaaacauuuaaaaggggaaaugcuacuuuaacaagagcuuaauauucagaaaccauauauauauuucaauacuacauaagagacacaaauaucacauuauaaacucccugucaauagaacuuaaaaaaaaaaucccuuagugaauauuuuggggaaaaagaaaggaaaaugguuugcaaguguaucuauaaaaugucuuuugaacaucuucuagaagaaaaaauuuauauacauaacccuaagaggaaaggaaacagguuuccuuuagaagauuucuauuaacauacuaaggaaugcaagccuguggugcuacugcacgccuuuaaucuagcacuugggaggcagaaccagacagaucucugaguuuaagaccagcaggaucuacaaugggaauuccaggauauccagggcuacacaaagaaaccuuauccucaaaaacaaaaaccauacuaaggaaugcaaacgaacaaaaaaaccaaaacucacuccugugcccuuguacacaacacuccucauagugaacacaucagguuggauaauuacuacauaguuaagcauguugacuucuugguuacaaucggauacucuauucuauagaugcacugaauauauacugaagaucucacuugucagaaauaaaaaguuauguuccaauaguuucaaaacuguuuaccaucguauuuuuagaauuuuaacaacuuuguacaggacucuacaaugagcuauaaauuuagauugaauugugcucacuaaacuagaaaugaucuagaaaguuaguaauaacaacauuugcuuccuuuucaacccaccaguaucuuccagauacuauauaagacaucuggaccauggucaaaaugauggacaguccuagaagcaucaucaaagcgauguggcuauugguggaaggcugagaagugacugggcaggcacaaaauuaacacugggaaaggaugguguuaccuuagucaguucaaaaugaaguaagggguaaggaaauugcucagggcuguuuucaagagggaggacuuaagcucuucucucucacgucuauaaaaagccaacugguaccuauuaguccaacauugguagguggggauaggcagaucccaagaucacuggccagcuagccuagccaagacuuccuccaguucuaugagacccugucucaaagcaguaacacagagaaugauguccugcucuggccuuccuauaggugcauuacacaaucacaugcauguaccacauauauaauacacacacacacacacacacacacacacacacacacuuccuccaguucuaugagacccugucucaaagcaguaacacagagaaugauguccugcucuggccuuccuauaggugcauuacacaaucacaugcauguaccacauauauaauacacacacacacacacacacacacacacacacgcgcgcgcguaaaaauaggcaaaacacuaaauaaaaagaccuuuauagccgggcagugguggcgcacaccuuuaaucccagcacuugggaggcagaggcagguggauuucugaguuugaggccagucuggucuacagagugaguucaaaagaaacucuuucaaaacaguaucuuagaaaugccaauuuuuggcauccagagggccuugaaaggaaugcaaaagcuaacuaagacauaacaaaacuccauuuucauuaguaggguucaccaggugucucaugugcuugccauguauuuugcuacugugcuacauccccaaaccugggccuauaauacuuucuaaaucuucauuuuuauguauauggguguuuugucugcauauaugcuguguuaccaugcagguggcuguagagacgagaagaggacaccagagcccuuggaaauagagguauagaugauugugagcccuuguugagugcugagaaucaaacccaguuccucuggaagagcucccgugcucucaacagcugagccacucaccagcuccuaggcuuguaguauucgauuacaaaacuaucuaguuauaugcugaaauccuaagauuagcuuuagccucaauguuaaauauuauucuagagucauguuauaucaacguuuuaaaaccugaacccggcauaauggcaaauacuguccugguacucaggaggcugagguaccaguauuguuaguuuaaaggcacuauaggcuacauagcaagauccaguuacaaaaaacaaaaccaacaaugaaaacguaaacucaauaugacaaauacucccagaaaaagugcuucagcaaaugcuuaagacacuuccuaaagaauagaaugguuuauaaauugcaaaugcuacugucucauucuaaacuacucacuuacacuguaaagucugcaaaaugaaaugcagagguauuucaauuugcccauucugguccaaaugacuaaaaaguuaacuaccgcugagucuguaagcaacauuuuugaauguuuaaauguaaaacauggguaauugauaugcucuucaagaaagacaucauacuaaaccauuuucuuucuaguuuuaaaaugauuugauuucuaaguacagauaugaaacacuagggacuaagaaauuccaggcuuugcuagucauuugcugugucugaacaaagcacucuugggaguuaugggcacaaugccccaucagaaaacauuaccugacgacgacaaccuacaacguaucuugguccauuuguugcuuuaacgaugacuagaacaaauugaaaaacaaaguuagaaaacaaauacaucuacaucuauggugaguguaguuuuaugucugaccacuaagaacaguaaauacaaaauuuagcuuauguaaacaaagaccaacuccuuguauuguugucauuagaauacuaggcacuucauggcuauccugauggguuauuaaauaaaggcacuuacucccaagcucauugaucuuacucaggccaaucucugggucccaucuuacauggcagaagcagaaaagcaacucccacaguaguccuuugaugcaugcacacacacaugcauacacauauacacaugagugcaggggacacagacauagagacagacacacauacauaaauagaugaauuaagaauuagaagggcuggagagauggcucagcgguuaagagcacugacugcucuuccugaaggucuugaguucaaaucccagaacccacaugguggcucacaaccaucuguaaugagaucugacucccuucucuguuccucuguucgcugucugaagacagcuaaguguacuuacaaagaacaauacaucuuuagaguguguguguguauguauguauauacacacacacacacacacacauauauauguauauauguauguguauauguauauauaugaaugaauuaaaacagccuuccauaaugucacacaugccuaaaauuccagcacuggaaagcaaaaggcuugugaguucaaggccagucuagucuacauaggaagcugcauccagagcuacauagaaguaccuggccucaaaaaucaaaauaaaaugggcauuucaaaagcuggcaaagaacuggggcuuuuuauuuuuuaauaauuaguaaguuaauccacuuacauuuuucuucuguuaacuguuuuagcacuucaccuacaaucuggaaaagaaaaaaggggcauuaccuuuugccaauagcuuagaaauggcaacauacuuucaaacuuuaucaccuaccuguccaacacuuuguagugccuucaaaucauuuucagacuuuucauacugcuugguaaguucuuuuaauuguucccuuacugaaauaauaaaauuuugacauuuuaaauuaaacaacugcauaaaauuuuuuacuuaggucucuuuuaccuuagguuucaaaccuacuguuucaaaccacaaaauaagauuuuuuuuuccaguuuguaguggauagguggcauguuuuaaaaugaaauguaacagagaaaguaucauaucuauuuucuugguaggaaauauuuuuaaguuacauuuuuaaccgauagugacauccugccaccuucagauuugcuacaaaacuaaacgauaaggugaaucaagccucccauagcuacacuaagaucaccuggcuuacucugguuguccauacuaaauuaagucaaccaacgcaauucuucaccgaauccuaggcugcgguauucucucauuuaauuaaaucacgcaggguuuucaaaacgugaauguucaggguauacagaaaacuugguacucaguaugacgccugagggaagacgagaaaggcuauuacaaccacugagcccccuucuaccccaaguacaagccgccuccgugagucccgcguccggcuggagcuucuuugacucaagcguccucccauccccgggucccgagacuccaagccugccuuccugcacccggaauauguccccagcccacuuguaccucacuccucuaaucuuccccucuuccaccucagaacuguggcuguucucuaugccaccggacugggacuggggccauacccacggccgaggcggugcugcaccccagcgcggggcgggaugacaaagcgccucgucccuggacucgggccuucccaagccaggcgcuguuuucgggcucagccgaagccuccgcucuaucagagaccgaagccgguccaggcacuagagagugugucaaggcucacucacgcuccuuaagacggccgucaaucuccuugugcucuagcagcuucuugcgauaguccugaagcgccuuaucucuaggguccgccaugaugagaagccgucgcucauaggggaugccgggaagggccauggcagcccgggcgggggag

SEQ ID NO: 7394 - RNA, 70406 nt, Mus musculus
gcggccgggggccggcggggaggcggagucgccucggccgcagcugcugcccugcucgggauuugaaagauuauaaaguccgggccgagagggcggcggcgucggaugcgcguguggcggaagcgccggcggcaugaacuacccgggccgcggcgccccacggagccccgagcguaacggccgcggcggcggugccugggagcugggcucggacgcggcgggcguguucggcggcggcggcugcugcuucgagcaccagccgggcgacagcgugccgcugucgcugcugcgcgccgagccgcugcaccuggcaccgggcgccgacgaccugagccaccuggcucuggacccgugccucagcgacgagaccuacgacuucagcucggccgaguccggcucgucguugcgcuacuacagcgagggcgagagcgcgggcggcggcagcucuucuucgccuccgccgccgcucgucgcccagaacucggggggcggcggggcggcgggagggggccccggggacaggaagcgcgcccggcccggcggcgcagccgcccggcaccgcuacgagguggugacggagcugggccccgaggaggugcgcugguucuacaaggaagacaagaagaccuggaagcccuucaucggcuacgacucucugcgcaucgagcucgccuuccggacccugcugcagaccacgggcgcccaggcccgggcggcgggccgcgauggagaccggguguguggcccaagcuccagcuucggggaggaagacgaggaggacagcgccugcggcuucugcccgcgcgcggcggggccugagccggagauggaggagcuggugaccaucgagccggugugcgugcgcggcggccucuacgagguggaugucacucaaggagagugcuacccgguguacuggaaccguaaguggcuggccaggggcgggccaggcucggcgcgcgcuggacggcguuuggggguucgguugcccccgcgaugccugccucggguuaggaugcagguugcgcggggugccucggcaggugaaggguaaaagagcagauggcagcgcccaagcugcuagcggggucaggaggggaggauuccgccggggauugugccuccugggugaguagagugcugcugccauccccuggaggguauccaggaacggauccccaagccaguagcuuuaguuucuugaccguaccaggggcuuuguccaccuggauaucugauucggucucgugucuccugaagcuccugugauuuaaauaacauguccuggagugaguggaaaugcuugaguguuuuuaugagaaucaacaguucagcuuaaaaccugagaagagaaaagcccugacgggaaaggagaguuacaauguguuauucacaguggauguguugggcacaagaggaaagaacugcaggaaguggcagugcgaaguggguccguacccucuguauagaauguuuucauaucucuuggguccuuuuuacauauuuuuacuuuugcuucuuaaccuagaaaaauugcacgaccucgguuuucacaucuguuaaaugggacugucauaaaggucugaacgaugcuuuaggcaacacggguagguuuaaaaucagaaugaggaaggguaauccauaaucugacguggcaugcagcaguuauuaauauauaugauauguaguaguaacaaguuauuggccaucaauaauuuguaccauacaguauuaacuuuaugggcuucagugcccuuacucaaaugucuuuuccugaucuuuuggcccucuauacaucuuauauuauuuauucugaucuauauuaauuauguguauugauggcuuagcuuccuuucgguuuauuuaguagcuucuggucagaguccaccaccuuuaucuuuguacucauaaagcagguauucgaugacuugguaccgaauugcaucagugauucugauaaugcuaaagcaugcaugcauuaggugcaaguaacuaugauggcagauucagcacauuccaagucagguauagguagcauagcaggaaauuucuugcuacucuucaggacaauaaaggcaauaaagguuguuaguuuuuuaaagaugagacucauauggacucuguuaggucaccucuugauuauaaacucacugaggacggacuuaguaguuguaugugcuagcacaguaccucugugcacauuguuuggaaacccaugucuuucagaggcuucccaucccauuucuuuuuaaaugauccacacaucaccaugggucuuuccugcagauaaaaacacagaacuuaguggacccagaaagcaaggucagaggggcuggagagaugggucagcagguaagaacaccgagggcucuuccagaagacccugguucaaaucccagcccccauacuccccauggcagcucacaucugucuguaacaccaugaucugacacccucacacggacauacaugcaggccaaacaccagugcacauaaaguaaaaacaauaaauaucaaagggagcaggggagugagagcauagagcauccuggaaaggggggcuggagaguaaagcugucucucccuuagcuuagccuuagagugcuugcacuagacugacaaguuuaacaccuuacucugcucacaaaguaauuuucacuguggagcaaauugauguugacuuucauccuacaaggauguagccucaguguuauuaaugaacuugaccaaggucacgcagcuagaaagugaugcaguaagcaguagugagggaacacagugccguauguauuucacccauccaaagggacgcacaggccaccguggauguaagacugagucugcaggagucagaggaagcacggggauuagagaaagggguuccucucaguuggggccagcauauccaaggauacagaggcgugaaacugcagagcaguugaaggaaugaaggcugcaccucugaggcucaggcauccaauguggguuuggaucugaccaccccagcaguguggcuguaugaggauuggcaaguggcagucugucaggagcacugcccagaggggaugugcagcgcugaguuuggacuuuauccuuugagucgcagccagccagagagucuguaucaggugugauuggugccugugcacuguuggguuggagaugagaaaauagaacaucauacguuauaagucagugauggcgacaacauaaaccugaaggucacgugggccucgccaguguucuuuccgaaagcaaauguuaggaggcuagauauagcuaaugaauuacuuguuguuaauucgcacauaacaaccauuuuguuuucauuuuaguuuuucugaccagcucuucacaauauauaguccuguggguauucaagggcaccuuauaaucuaguggcucucaaccuuccuaaugcuguaccccauuaauagaguucuucauuuguggugaccccccccagucauaaaauuguugucacugcuaccucauaacuguaauauuugcuagauugugaauuguaauguaaauaucugacauuucuguuggucucaggcaacugcugugaaaggguucuuugauccccaaaugggucacaacccacagguuuagaaccacuggucuagugugcaaacacaauagcagguuuucagggguccucuuaagugucuaugucuuguguggcuuuacuugaauuaguuucauacguuuucacaccuuuugaggggaagaguauauacccaguaugguggucucagccuugccccuaaugacgggaccuaacaauccuguguaguuuuuuaccuuucccauuguauuucccccuuuacccuuugggaaacucugaaugguggguaaugaaagguuuuuuaaagaaaaagaaaaaucaauaaagacuuccuuaguacaguacuagaugucugucugucuguuggccauuucgguuuuguggccugauuuaacccacuguuucuuggcauuauggagacugagcuagcucuguccaguguaaaggaaagguguuaauuuacaguguuuuucugaccuuuuauccauagacaguauuucaagcacuggggcaucugucaaucagacagggaauggcauuugucuucuacagauaggaaguccauacagaugagaaaagccagcuguaggacauuaauaucauccacucagaugcuuuuacggcugcaugugcacauugcagauaaaagcucaucauugcugagcacuggcugggugaccgcccuucuucccacugucccuucaaagcugcuuguuuugagaauuaucaucugugacuugguagagggguacuugcacacacaggacuagguagguaucugcuggcuguauauggaucucagaaagcuauguaccuaacaaagauuaaaacucugcgcgcugcaaguacauugcuggccuuguccucauuagaggugacaaaauaaucugcaaagacgauuugcaagaaaguggccaaagaauuuagucacacacugauuggaagacaucuggaacuggagauguuucaugagcuuaaaauagugucuuuucuguaucgugguauugcuguguacaguaugcacuggagaguguauaauuuuuacucauugaacaaauuauuuaauuggccauauuuucuuccuguggauguguaguuuccagaagcagucagcuccuagccacugguuucuccuccagcucugguucuaguaccauuguuaugauggguuucacgucuccugucaaauacuucaaaaaguagucuguuaucuucauggauguuaaaugaaggggcauuauauuccugacaaaacaggauuuuaagaauccuguuuuuuuuccccucagauauauguuuauuaauuuagcauauauguaacugauucaagagugaagacuaaucaucuguauggcauagggugucaugagagacugugacaaaguccaaggggguucuaggcacucuuccuugaucaguuucugccuccaaaacaggauuguaaggggaccccuuacaauauuaguaccaauuaucaauauuguugauuauuauggucauacuaauauaccuaacccugagacagugcugaagaauuucuccaauaauccagaugagaaagccuccacgggcacacauuuacagauccugguuugccuugugacuuagagacccguuccaggucuacuuugggaugcuuugucugugacucacuaaagcagcacacacaggguguuacuggcugcugccauaaacagggggcaggaccugccguucugaucauggcccagucaagaccucuguuaaucuuugcuguuaguuaaaaaacaagucuugucauaucauuuauuggguuugccuuguuucuguguggcaugaauguuuauguuuguuaugcaagugcuuuauguaaauguucaggaugguuccuccucugccaagccccuccucuuucuucauguacuguuuuauuauaaaagacacuuugugcucuuuccucuucuagaauuuauuuccuggaucuuuuauuucuccaccaaugcguguuuuguguuugguuggguccuuuuaugccccuuuuuguagagaacaagaagagauugcaugugcuggccacaguauucucagcaggugauagacacuaagaggagguucugagggagggagcagagacuccacaagcauccugagguggagauugcuggccagaggcauugaaaggagugcagacagccugcauguaugcacuugaaccaugucugugcauggugcccauagaagucagaagagcaugguaucagauccccauagaacuggaguuaaccuggcugcaaaucacuggcugggauucagauccccuggaagaauagccagugcucuuaaccucuggccauugcucccgcaccccacuucuaguucugcauuucuaaaggucagugguacccccacccccaaaaccacacacaaagcaaaugccucucuguugagacugaggacauacauagacauuuccaauaugccaacauuaggacacaagugaacacagauaguaacaagccaguauugacuguguccgagagcugugcacaaacagaacggaugucaugguagcagcacauaucuuuuaugcacuacuuuccacuucucacguucguuaauguuuuccuaaagucugaguaagccacguggaaauaucuuuauuauuuugagaugaacucucuaagcgaccacaggggcugggacagccuuuggaaauuguauugcugucgguacuucucuuaccccauagccugagaucccugagaauucuggggaaauagaacuauaaacuuccucucagugguagauggcauuucugggguuuuugcuuguuugguuugguuugauuuuuguugcuguuuuugagauagaguuucuuuguguagccugagcuacccuggaacuagcucuacagaccaggcucugcucugccucucaaaugcugggauugaaggccuaugccaccauggcuagacaacauuucugcauacuugaaaacuaagcuuuuaugugcuuggauguaguuuuuacuacugugugaguagaaaucuguauuacuguuucucccuuggcuauaucauggaccauuguuuuaacauugguacagucucacccuugauucaugguacaggacuaaggacugggugaacucuacuaaaacccgaauuuucuguuucugaacccugugccauggggugaacugcucauuaacuuccacuggugcagugacaacagagguggacggagucucagccucaggauggaaguaauuagaugagucccacccuuggguuuuacuguuacagguggccaacauucacuucauauuuuacugaaagaauccacuauuuccauagaauugcuuuuagcuaagcccagagucuaccuaguucaccuuccuccuucuucaguaaagccugcauuuguguguguguguguguguguguguguguagggcagcuacucauguuauuuuccugaguuacucaacaccuaauuuuuuacauaauauuuuuauuuauucugugaggauuuuaugcaugaacacaguguauuuugaccauaucaucuacucugccuccagugccuucuagauauauccuuccagcuucauguccuccuuaccuuuaugaucuauuaaauccaguuaguguugcccagaagcgcauggguuagcccuccaguggugcacugucaccccacuaguggcuguaccacugaaagaaugauggcaccccucccuggcagccaucugcuuccucccuugcuuucugagacaguuucucaccuauccugucuuauuugccaucuagauuggcuggacagugagcccugggcauccuccuuucucugccuccccagagggcugcaauuacaggcagaugccacugucucccacuuuacauguggguucaggggucugaacucgguccucgugcuugcacucgggcaagccauuuccugcacccccaaaaacaucauuauaauaucaaguauuuuaaaccucgcuccaaguuuguuuaugcuuuagaaaacaaagccuuugcuucggauucaaaggacaauccuaggaaagagucuacuucacaguaaaccaguguggguagcacucggccuagagauagugagugaggcugcucaagcauguguaggagcaccuauggacaccggacagcuugacugucccuguugagccuuuguuguagacuuaucccuaaguaagacaaauguaauguuccuaaauuacugaacaggggcuggagacagcucagcaguuaaaaacauuaacugcucuagcaaagggccagguuauauuccuaccacacacuuggcagcucaaaccaucuguaacuccauuuccaagaccguguuguccucuucugguuucugugagcaccaugcaggcacauggguacauacacaaacaucagacaaaacacucacaugcagaaaauaguaagccuucaugaaucugugaacagauaccugccuuuccucaacauccucacuucacaaccaaccacccauacaugucuuaucuaagauuaacacaaguuacugguguuuuucucuuugccuuucauugggaaagaacuugagcuauacugcuauuguugcuugaugaugcugggaauugaacccagagccauucgugccagguaagcucccuguuacugucuuuuugaauauguuugcagguguguguguucacucauuuauucauguguguguaugcacauauguguucauacacguggaaacuagaggacaucuagucuaguguuaucugucaagcacuguccaguuugguuuuugagacaggaugggacauggagcagagcaggacgacuaagugagccccagggaucuaccugacugcacacaaagauagauggaaaauaaggggugagcugcaucaucuagggcacuucucuguguagcccugccuugugugcagugaaugccuagcacuguacugcgggauggacuugcuuggaauucugauuaccugauuggauucugucuggaagaaagaccucuggcccuuccaagcagaugaccgugcccacacagcagugggcugguuuaaagcuuugguuuucacaucuccuuucaucgaauggcagccccacaguuucauccuugccgccuccaccucgguucccacugccuuuucuagagaaaagcugcauugucuagcccuuaaaauuaagacugaagagccacugaagcgggcucugccaugugcuggucugugugacuguaggugacuuggguuaucugugucuuuguuucucccguggagugugggcagugucaucugccucucagcagagcaguggauguguaaaaauuccccgccuuccugccauucucuuucugaguuugcacacugcuugacauucuuggcucccuugaucuagagucucuuucccggugugauauuuucuuggccuguuguuuugauaaucaccucuuaaguagguagagcccuagcguccccauaauuguugcucagaaaccccagaaagaagcugugguuucugagugaucucucagaccccugaaaaggguaagcugucuugagucucccuggcuuggcccuuagagaagugccuccucagcugucuccugcagucugccaccuggcuguguguuggggcagaguggguuuuuuuguuuuuuguuuuuuucacucuaaaacccugagcgucugcuucugagagacugacucuacccccaaagcucauucagguccuuuccaccaccuucugagauuuggauacaguagaaaacuuuaaaagacuacucaguuuucaguugagguggagucaggaaugccucuauuuuucugccguguuagcaaaauaaauggcucauaaccauugcuuuuacaguggagaccucagccuggaaacuucccaggauuccuuuagcugaccucuagcugagccggcagguaccgacagcaguaacuaacauuggguucuggcaucuaguagacuagcuugaaauaaucuugaauauacccuuaaucaaaggauuugagacagccaccucuuuccaacaaacacacugggcaggcucagagaacaggucuuuguugucccauuucuuuaguuaaauccuugauuuacuguaguuacaugacuuugaacaaguuaugaccuguggccuaguuuuguuuuuguaaauggggaucuuuccugugucagaagauucagaggaaacauaagucgaguucuugcauggcugagugaguggugauugcucuggcuaaggcagacuagugucuuuuuuuuuuuuuuuuuagugucauuaccugaaagccuugucuccggaauuaaaagugaugggacaggccuguuucuuuguggaauagaggugugcagagcuauaucuccauaaacacuccuuuggcucacacuugacgacacucacacauuuguggacacgcacccaucuugagcuugucaucaccagaaaguuaaggagucgcacugaagcucaguaccaagggcccuccuaucgccaggaguguugaagacuugagucugcacugcccaagugagguccgucuccagagucuuguguuagacuagcagcuugcaaagcucuggagccuagcaauuggagagacuguuaaagauagagauucaagccucaucccuggggcucugauugaagagauccgagggagggccuaagagguucgguaagauuccugaacugaaccaugcaggaguguuuccaucacgugcgcgacugugcuucacagaugccucgccuuucgcgucuacacguacacucagagaauugccaguucaguuagucauaggcugcauuugcaaagguucaagccuauauauagcuuggcaucuucuugacuguccacccaccuauuucuguuauuucuugggugagaggaggaaggacccacaguugcauagacgguaccuacccuucagcuauccuuuuacucuccaacuccacccugaguauagagacccauggccguaagacucuaugcagcucgggcagaauuacacaccauugacgggaagguacaggugggaauggccucucuaugaggggagggcaacaggccccaucuugagaguguucuguaaacagccaugguugcugugaugcuguggugguggcugcagugccugggcacgccguucugcagcacugugucacucuggugcugacuuguugauuuguaugguuucugauaaggagcuggcauuauuagcuuagcguaggucaucaguccgucaucuuucauucuccugcuccuuuccccccaugccccccuccccugauggcuuucaacagcucgauuauauuguaccuugguuuucuucauauuacacucauuuacauauuacauuuacauaagauuuguugaaauuuuggcaacugggcuuaugguuuuaaucaaauugguaaaacauuuggguuuuuccccccaaauuaugauuguaauuguucucuucacagcuugacguggagucugcuguuggaugggccacugucacagcucugcauugauccccucaccagcccuggcucuuccuuucaguggguuucucguguuucacucuagacaguuccugugaucgcugucagguuuauauuuugagcaugaagaaauuucacuggucuucuguaaccucuuucaacaauucguaauucaacuauuucaauuucagcuacugguuucauuuucuauguuuuucaugucugauguauuucucucuucugcaagucauuuagguuuuccugcgccguguuuccuccuucauuguguuccauuuuccucuaucuucuugcaucaagacucauaaugguuguuuuaacgucuuacuauucugaucuuaccauuagugggguguguguugguuauuuucucccaggugggguuguucugugcuuagaauacccacuagguguucuuaaggauuccuuaggacucugugggacucuggaacgcugagggacucugagggacucuucugggacugugugggacucuaggacucuggugccucucagauuugcucucuaauacacagauaaguuauugcacaguuagauugaccuucuagggcuuuccuuuauccucuuugucuuaguugagguuuuacugaugugagcagacaucaugaccaaggcaacucuucuaaggacaacauuuaauuuggggcuggcuuacagguuuagagguucauuaucaucaaggugggaacauggcagcauccaggcaggcauggugcaggaggagcuaggacuucuauaucuucaucugaagacugcuagcggaauacuggcuccaaggcagcuaggaugggguagcccacacccacaaugacacgcuuucuccaaaaaggccacaccuucuaauagugccacucccugggccaaacauauacaaaccaucacauucuucuagguucagagcaauuaguaguauaagaauaauuugucccuuuuauacagaggcaaugccuaugaggacauuugucgagauccccuggcuuuggcguuuggaaagacugcucagcaguuaggaacacuagcacauaaucucagcuccuuacaucucugagcccaucuccaguuuguaccgauucucuccagccagcacugcacuccagcuacaguagacuucuuacugauccuagacgcuagccccaggaccuuugcacuuacuuacuauugcuuucuguuucguauuuuaauuuaacuuaacuuuacuuuuugguuuucugagacaggguuucucuguguagcccuggcuguccugguacucuguuagaguaguaucucaaacucaagagauccaucuaccucugcuucccaaauucugggauuaaagucguguaugaccaugcccagcuuucuauuuaaauuuuuguuacacuuaauuauccuucuauguauguacacaaaugauguuuguauaggaguaugcaugugggggccagagaauagucuguggaaaccaguucucugcuuccaccaugugggucccagggcuugaagaacucaggucgucagacaugguggcaaguaucugccuguugaccaucuuacaggccccgguucuuuccaauguuuuuuuuaaaucuucuuucugcaguuuuuaucagacgugacacaauacucuuaaauacuugauagccuucuguguaggggaagggaauuagcaugagcagcaguaaccccuuuaagugggggacagaucaagugucugccacauagaguauaauuaaggugucucuguagccaguuuuaggagcuauaggauguaagugcguacuaacuuuuuauuucagaacugcuugcugcuagcucuuuuauugcugguguaauaacuacaggcuaauuuaauuaguugcuacauuuaauuucuuguggucuaaguauucauagcacacucaauucguauacugaaauccuaacuuccaaguugguaguauugggacauggggguuggauggugaggaggagauaaggucaugagguuagaaaguccuccuuaaugagaucaaugcuuuuguaaaagaggccugagagaaauuccugccccagcugcuguauguggugcagugaagcagaaggugagaccucaccagacacugugccugccagugucuuucccuucagcuuccagaacugaggugaaaucaauugcugugugcaagcugcccaguuuaugguuuuucccuauaggugaccagauagcuucccuaaccuccuccaccucucucucucucucucucucucucucucucucccccucucucucucugguaacaaaggcaggacucaccugccuuuuaaugguaucaccaagaaauaacccagaguacaaaaguaggucucuagucccaguauuacuacacaaucucaucuucaagucuuagcagauccuggguucccugggcuacggucuacaccuguccuuaccagagauacucauuuuggaauuuugagaugguagaacaaugggguuuugauuauaccagauggcugaagacacaauggggauauagacagacuuaacuagcccauguggcuuuagaaccuugaaaagauaccuggugagucaaagcaguguagcaaugcagaaugggcucuguagagaagcaaagugacauuaugguacacugucgcucuguuguaagacaguaucugauuucagccuugccaagugucucuagugcccuuucugugcgcugugagcuuucucagcugugcucgcucgcaucucaggcuucucagcguucuggauuggccguaagaacgcuuuccucucuccuguucuuccucuuuaaaaaaggaaagacuugcuucucuuaauuucuauucaguucacacuggaguuaagaugcauuugccccucaguuacaguuugucaguggccuuugucgccgccgucgccucagugugguucauccuuuccaccgggagggauuuucuucccacguuuucuaaaaaaguaaauuacuuugauccaacacacuuauucaugucuccagauaaaagaaggaaaucaucaccuuucucuugagaaauaacuuuagagagaaauaugugguuggcuugagucuuaaagguccucgggacaggaaugagggcauaauugaaaaccuggaacugugaggaggaggaggaggaugcuuucagaacuuacuuggcaaggggcauuggaagaagaguaaaacgggauagaagacaacuagacagggacuacacuggagugaacuuuuucaugcugaguuuuccaaauuguauucuuugaaaacgaaaccuuuggcaggcauagaguggagaagcugaaauuugcauuuuagauugccacuuuggcagcagugugagagauuagcauaaucugggaaagcagcucagaaugcaggaggcucaccagggacucacacagugcuuugagguggacagccugagcagcacuccaaaugguuggggcaggggcgggaaggugauagaaagcacagagaggguacagggugcauccauaugucagaggaugggugguccaguccuaggcucuauaauguuuuuacuugauugaacuguguguaagaaaauggucugacccagcuccagccugugguggcagagaaaagcucccuacuucaguuaggaugaaguauccacgggaguugaggguacguaggucuggaauucaggagaagagcaugcugggauucaaggugcaaaaagacuguaaacuaguggccucuaaaauggaauaugcuagcacuacuuuuggguguguuacaaugggaauauuuggauuuuauuuaauuuguuuggcccuaauuuuguauaucuuauaauuaguaaaacauuuuauaacaauaguauaugugcaugauuuauaaauauauguguacuagaguauguuaaaauaucuuuuuaaaaaaaucuuugaugagugaccaauguggaaauggcuaguuuaaacugguuaaaauuacagaaaacucguugaauagaaagagaacguguuugaaugacacucuacucaucugaaaacuccauaugguaaugcauauuccuuuuacuuuaaucagcacuguggcugcauauucgauggccguguugugaauagagcagauguugucaguauagaauugaagaucuccacuacuuuaaagcucacacugaaagcucagugaccguuuccauguuguuuacucaucuuccacauccauguacaguaauaucaaacuuuuuauguuaaccaaguaccuagauauaaaaauuuccuuaagcauguacaauucugcaugcauaaaucuaccaaaacccugaacuugagagacuuaauacauagugacuuaugauauaaacucuguucuccagauucaaauggaaggaaugcuaagacaucuggaggaugccaucuccuguuuauaaugugaaggauuaugaauaggauauaacccugaaagagaccaugcaguagagacuuccagggauugucgugagugaaucagguccucaccccaucccaggcuccaacccuuggaaugugaguggaggugagacuaaccagagagguuagagucaggcugacaggugagucagccucagucagcuggaaccggguaaagaaggaaguuuaggcacagagggaagccugugugagaacugagucagugagcgcuguauccucacugcaaagcagagaggccugagugccggaggugccugggaucucaagaugcuaacaccuaugccaagggcaccuuggucucaguucugaaaagccacguuucuacugaacgagcucucucggcccguugugcuuuguuaggcgcucuggcaaacugguagugaggcagugagcacugaagcugcacacugcacacggagagaacagggccuuucagcuccuucgaggagccagagcuguuggcauucagugcacaccugcacccagcauuuccugcccccaaggaaucuaugaaguggccugagcauggccacugguagguaguguugggauugauguaagcuuggcuuugcgaucauaacgugguuguugcuuuccaguguggcccaagguauauguggaggucuguuuuauuuuguaagaucagauguaacacuacagugaacugagccagcucuguuaggacgaucauuugauugcucucauccugcauucccccaagucaccguuucucucuagugaugacuugcuuucaaggaauucugaugaucccuaauuugcuaucuuuaauuccauuuauuaguugaauuuuugucaguuuuauuccuauucuaucauucaccuaaguagugucaauuuaauauucuuaaucuuaugauuacauauuucaaacauaaaaaaauaacaaaaaucauaaccaagaauauccucuuuauuuagauuaaacaucacaaacaucucuaugaccccuccagucacugcucuucaaucuggacagagccacuuagccuguuuaccugugcguuuuuagauuacuguuuccuguuggcacuuuggacuuacuguagcuauguguauaaagggcuguucuguuuuuugucucagaaauaaauuauugagacuuauucaugcuaauacacagacucugagacuuaccuaugguaaugcacaggcugcacccguguccauugugugagcauguggcuuuccuuuccccguuggucaugucagcuguaaugguuugggagugcugugaccauugcugcagcacacaucuucccauguacccccuagguaccugugccagaacuggagauguugcacuuugucugugucugauucccagugaaucagagcauuuuuauguuauaguuuccucuauaacuauaacuguuuucuacagaaguuuccucuuccauagaaaaucuuguuauagauguccaguaagaccagaaauuuuucucuaguuuuaacagaaaguauaacauaaagaacauaaagauuuauugccaggcauuuguggugcacaucuuuaauuccagcacuugggaggcagagguaggcagagcucggcagagcucguaaguuugaggcuagccuggucuacauagugaguuacaagacagccagggcuacacagagaaacccugucucggggggggggggaggauuauuaacaaagaaauuaguacagcaaagauaauagagguagaagguauagggagcgaccaugugggaucaagauagaaaugaccauugcugggaaggugcguguauaugugugugugugagagagagagagacagagaaagggagggaagggguauguguguauguauaugugugucagagagagagggaagaaggagaagggugugugugugugugacagggaggaagggaagggaugugugagugucagagagggagggagggaggagagggugugugugugugugugugugugugugugugugugugugcaacagagugggggagaaaugggugugaguguggcauguguggcacugugcacagaggacagcuuucaggagucaguucuuuccuccacuguggggucugaggaucaaacucaggcugucaggccugcacagcaacuaguuuacccuuugagccacucaccagccccauuuuuuuuuuuuuggccuguauuuuuaauugauuuacuuauauuuucuauuuauagaauguacucuuuaaaaaaaaaagaauugucagauaaguucaaaguaccuuccuccuggagcuaaauuguuuuauauucaaguaccuccagcaugccuggggccacagccagcacacagacaguuguauugugcaaguccagcaugcuaacgauagaugucaagagucugccauuguccugugguagcaaaggaauguguaggcccaccgcaucugaguauagaugguagaugcuguaaagauuauauuguuugguugguuuguugggggguuuuugagaucagguuucucuggcugucuuggaacucucucuguagaugaggcuagccuugaacucacaagaucugccugccuuugccuccugagggcugggaugaaaaccgugcagcaccauuccaauaucuauauaaguaaaauuagaaaucaggagcugcuagauuuugguaagcagguuggcagcuaaauguauugguagaacagcagcugaacugcccuggcuauuguggguauugaggacaugugaaaagcauaaucgccauagaagauggcuguauuuggaggaaggacaucaucugagggaagaauuauuuucaggaaccuuaauagagcaaugaauucuacauagcucaggucaaaacaaaauaucugauguaacuucuaaugcuugucccaaagcagugcagauuucugguaagcaaugcugaguguggagacuuagacaauggcuaauauaucagcgccaccuccucacagcuucggugcagaccacaacuggcuuuguucauaggaaguucaagugcuggcuagaaaauguacaaucauaugaagaguauuccauucaauaaggaaaggguuaaagaccugagaaaacuucccaagcuuugggaucagaugucuuauauggcauuguaauuagccagaauacuauauuucaguaacgaacacauguuauauuuuaguaauuuuaaugggagauguugcaggaaauauuuuaaaagaccggcaggcuucccccacuacuccuggcuauucucuucccaggugcagucccuggaccucugccucuagaccagccccaucagccacagugauccccacgugguucauuucacugccucagugcugcccauaaccucucagccauaaucccccuguggucgguggucccaccuuccaguaacucaguaaaacaaacucuagaagcuugcaauuaacaacucagauuuacauaucaauaaauucucaauucacaaguugcccacacaauauuuucagagccaauugauaaugauacaagcuguccaccuggaucagacaacuuaucccaauuuuucuaucgcuauaugauagucauaacuaccuguggcuauuuaaaaccacgcggaucaggcucuucuuccuaucuguccaccuccauauuggcuucuccucucucuccuguccucucugccucccaaccuccccaagucuuagcuccgccucccuuuucccuauccaaucacaggucuccugcuacacuaauauuuaaauagauuggacagggaaacgugccacaggagaugccaauguaauuauaucugaauagcuagaauuuaauuuucuguaaagugaauuugaauuaagugcauguuuugugcaaaccuugaagugacagauucuuuaucugacugggucuggucuguuuugguagcuaagcuuagcuauuauaugcuaauuugccuaucuugucuuacuagugcuugacggcuuacaaugaccagcacaggaaagucagaugguacacugcacagguuccaaaagagucagagcauuuuagaguccaaggccuaugugugcuggagccacaaagaguuaucaccauugcccagucuuggauacuguuaggaaaauaaaaauguucacgggguaaaauuuuucugccuuaacagagaaaugugugucuggagaccuaaaucauagcauaggauucccuuuucucuugugacuucuagcguguguguccgcaucugucaucaaagcacauauguggaaguagaagacuaccugcuagggaucagacuuaguccucagauuagcaguaagcaccucuacccagcugagccaccucgccagcccagaugcauuuuucgcuaauaaaacauuauaaaagauguuuucguggaaaugguauauuaacuaacaaacauguaauggcugaaggaagcgugugucugugugucuguccgccuaagaugcuacagugccuaguuuugaaagcugcuguaguaguggcuuaaacacaugaguguguggcucucugaagucaguaauaagcaucuauuuugugaccaggaagaaccauaagcaacacacauguguuguagugagcauguggaagucagaggauaacuugugagaaucaggucucuccuacaguguggggccugaggauggagcuuggguucucagacucagcagcaagcgccucugcccacugagucaucucccuaaccuauauuuauccaguuuucuguugauaggccaugguuuuuuguuuaauuugcuuuuuauuuuuaauuaacacugaguauuggacuuugcuguagcauucucacacgugcucaguguggacugauccuucccucauuucucuccacauccccauuuauguccucucaccacguaugucauuuaugucauaugugucauaugugcuuacacuccuaguguuuugcuuuccaccuugauaugguguguguucuauugccuucuccccacccucugucaaacccucuuucccuguguucaugggcccuuucuagauuccugcucucuaacuaugcucacccccacauaauuguuaggaucacuaugggagagaauauguaauauuugccuuucuaagccugguuuacucuacuugaaauauuuuccaguuccauuuuccugccaguuucauaauuuuguuuuucuuuacaauugaauacaauugcauugugugucuggacacauuuuuacuauccauuugucucaauggacauuuaaggugauuaaauuuucuuccuauuaugaaguagacaauaacaaauauggucaugugaguaucucugcaguccuugugauauauuccaggagugguauagccaggucauaaggcaggucuauuuuuaguuuuugaauuuuugaaaaaccuccacauugauuuccauaguggcugaagccaguuuauauuuccaccaauggcaagagucccuuccccuauaucgucuccaguguuugcuguuuguuucuugauaguauaggccgcguuuugucgugcuuuccuuucuauuacaguaguaccugaguaaauaccucggcaucaucucuggacaguucagcauguuucuguaaauacauucuagaaauacaguugcucuauaaagauuacuaauauuuuaguuuuuugagaaauagcugagccagauguggcacacaccuguaugcaauucuagcauuuggggaggggaggcaggagaaucaggaguucaaggccaccuaacuucagcuagacagauccguggucauccugguagacuacauaagacacugucucagaaaaaaaguucucgguaucuauacuguugacccuuugagcccagcacguccuuguuggugggaaguagagaggaagaagcuggauugcuuagauugucagcggcaucuuuggcuccacccacugaguuccaguuagcagagcuauccugggaccaagucuuugacaaaugaacccucagcaaacacacaccgcacccaagcgucaaguucaucuagagacccguuccugcuuuaauauucacagcaugcaauuagugaguuuuucugauguggugacauuacuuggagucaguuuagugguagaaauaagcaagccaagaacaucucauagcugucuaauguuugguaauccgugacaagcacuuuaaccauuauaauaaucccauuccuggcugguuauuggcucaucugguaaaacugcuugacacgaaguucaggcuccagagccccacgugcggaaggggagaacucugaccuucaccugugaagauggacggacggauggauggacggauggauggauggauggauggauggacggauggauggauggauggauggacggauggacggacggacggacggacggauggauggacggacggacggacggacggacagacggacggacggacggauggauggauggauggauggauggauggauggacggacagaugacuaguaguuaaagucccauguuuugaggcaaagagacaacaaaaaguacaaauuauauugugcuaauaucauauauaauuucuaacagcuaagcugaucuauauacugcuguaaauuaggaguuuacuuccuucagaggagugaacaguugugucugaguggugguggggaaccuucuguaaagcucccuuagucuggguauuagcgcuaugugauugguguauuuuucuauauaacuauuauucuucaaugaguaguucacucuaaaaucugaccguucuuauacuuagaagguagggagacaguuguuuguuuccucaaagaauuaguauuaaaaaugaauguguuaauggcacuacagcauauaccaacugaucagacagacaggcacacucagaaguggggaaaacccaguguaguuuuucucugccagccacuagggcaaugcuaaugccucccucagcaacauuuuacaugugauauugaaguagcucuucauguuaguuccucuuucaagcaucugagaugcagguggacauagaacuugcaucccaagauuccagagaaacaaaaaaggcuaagcaauuagacuauacacaaaauaaacacaggcccauaaucccagcauguacaaggaggaggcagcacuaucagaagcaagggcauucucaguuacauaaugaguuuaagagcagccugguguccccuaagucccugucucaaaaaaaaaucauuuaaauaaaaaugaucaaaacagaagcaaaguacaugugaaaugucauaaaccuuuacuuuguauggauagguuuugaucuaauuuuuuuaaaucucuaaguauuaauuuaaaagaauauguucaagauaaacacugacagaucuguauagcauuacuccaguagagucauagcuaagggaaggacuugugaaaagguaaagcuaguaguuaacgagaugaaaguagguaagaacaaccuaugaacauauguaagagcauuccaggagcugcauacacagaauagccagauacccaccuugcacguauacauacacacacacauggaagugcccuguuggugugaaaaguaccaggaccaucagcgaucucuucugcaucccacagucuaccuuggugccugcuuuaugguacauacucaaaaguugugugaauauaugugaaauaaaugaagaggcagucuaagggaagaugauuaggaacuuaucugaggagcagugcagagccauaagagaauuucaguauugaaauaaauaguuuuuggcaacuguaaaagguggauuagguuucugaagagaugcacauguaugcuuacacagacgugggcugacaacuaaguguuagcagggguggagggacuguuggcagauuugacacuaggaauuccaggcuuccaugacagcuucagaaacuaaacaagcgugaaccaagacauccugaugaguaagggaugauuuggaaagucaucugaacuuuuuguugucuggucacugauggugguggguccaugcccaugugcacacaucuggagacugggcucuguugugcuguaucuuauuccuuugagauggauaacugaccagcaagcccgggaaucugccugucuccauccucagugcugggguuccugggaccugcgaucacaccuggcuuuuauaugggugcuggacacuuggcucagcucuucaugcuggccugcucauagagcccaaugugagcaugauuuuugagauauggucaacaguacauaguguugagcaguaguuguaaaaagcaauuaggaagaggcgucuuggauaacgccaagguuucugccuugagugacccacccagagcaugcugagcaacacagagagaagggacagacuuguauggucauguguuuguuugguuuucccuggaagucaauguguugggugacuauuucaugacucaacacaacucaagaaccugugauuuuggugagagaaggcuaagcaagugccuugccuaucuggaaagcuacauuguauaguugaaaauagcucucuaagacucugugcacuuaggaagcuggagaaauaauuaagauuagaguuaagauuaaauaagauaagcuacuugauuuggaagguaguagcagcucucuaaaccucaauugcccuacauguccuuacacauacucagacacaaaguccagaaugggccacauacccacagcucacacacacaaagugaauuacaacaguuacuaucacugcugcagaccugaguucacagaguggccacacagcgaccuaagagacugaagaagagaggagugggaagagagguuaacacaagcacagcaaaauuauucacagauccaguguagguguggaaaccuccagaggccccggcaccucuggaauggagagcugcaggcaaucacuggaagggcauccucaccagacauugguguccaaucccgacugcucagaccuacgcauauguacacaugagcaaugguaaacgaacucaacaaacucugagaguguguguguguguguguguguguguguguguguguguguguguguguguguguguguguaacaaugauaaaaggagccauuaauuugacaagaguugaacagggggaagauauaguucaaaugaaaauauaguauucauuuaugaaaaugucagacaguaauguaaauaaaaauaagugugaccacuuaaagcaucaacuauccagguagagaaaaugucccagcaccagucaccaguugcaggccugggauugguaaagaaggaagagaaggaggaagaaaguaggggugugguucgggguggagaagggaaaggagaagggcagagagucacuuaaagacaaacauucagaugcuaagacaaaacaaaaccaggaagaaguguaacaagauuuuauugaauuuaguaaagaaguuugugcugguugguuuugucgacuugaacaacccuacauguaucugggaagagggcaucuuaauugagaaaaugccuccaucaguuuaggcuguagacaagucucuaagguauuuuuuugauuaauaauugauuugggagugcccagguuacugggcaaugucacugugagguuguauaagaaugcaagcugagcaagccacagcaacaagacaguaggccuuuguuucaguuccuaccucgaguuccugcccugaguucccuugaaguguaagcucuaaggugaaauaagcccuuucuuccucaauuugcuuuuggucauguuuaucguaacauagaaaccuaagccaaaguugaagggaagauaauacaugaacuacaagcuauccaagggagaguaaauucaaacaacuaccuacuaagggccauugauaaaaaggaaaauagccaagagugugaaaggaggaugcagaagcaagggagggucguaggagguaggaugccauagccauccauuggacagagcacaggauccccaaugaaggagcuagagaaaggacccaaggagcugaagggauuugcagccccauaggaagaacaacaauaugaacuaaccuguacccuagagcuccuagggacuaaaccaccaaccaaagaguauacauggugggacucauggcuccaguugcauauguagcagaggauggccuauucggucaucagggaggagagacccuuuguccugugaagguucuaugcgggaguggguggguuggugggauucuauggggagggggaggggaugggggauuuuuggagugaaaucaggaaaggggauaacauuugaaaugcaaauaaaauaucuaauagaaaagaucuagaugacagaagaguuucaauaaauucuuucaauuaagauaguagguaaucuuuaaaaguaaaauggaaaguaaaccaaaacccagaaagacuauauauaacccaaaauguaauauuaaauuuucauuaacuuuaaaagaaaaagaagguagggugcagaagcaagggagggucuuagaaaguacccaguguaguccaggcuggaauacccaccauggaaaaggcaagacggcucucauucagccccaugacaugagaguuuacagaucaacuguaaagggagaaaaaagucacauuacuaagaaagcuaagaccauguucuaggaagaugaaaauggaacuuuuagaacuuacugcccuuccaguauuaggugaacagauugaauauauacacaacaacaugccacaaacaauuguauuuucaagaauaaaacaguauugagaaaauaaguguaauuguuauguccagauaaagggaaaauuagaauaaaauaauuaaccuauuguauauauuauaagugugaagucaugaugccauuuaaaauagacuggccaaaugguaaauuuuaaauaagcaaaaaaagauaugcacaccugccuagucuuccuaauugguagggaggugggcacggaaaugcuccauagggaaaguuugaguaauaaagcugguaacuauaaagaacaaagaguucagacauauuaauuguaucaaugaacaaucgaaaagaaaauuccacauggcuuuaucugcgaagcccaguucugugcaguauuugagacacguguagagcccaguggugugaaaggugcagacaccacagccagaugggaagaauugggggucagccucaagagcagagguaaaacccaagccccacccuccccaauaaggauagagugcaccuacagcacgauaaguccuagcucaugagguucuguguucaccguguacaccuaauacagcgagacucagugccagcaucacugagagccuagcaaauacgagagcaucccaagaagcacaaggaaggagccaggguaguggaagccagcacucaaggcaaaggccaacggauccuucagggucaaggccugggcuagccugggcuacacagugagauuucaccucgaaaaacaaaaugagcgucagaaacuuuuuacuuaggaaucagcucagcucaguguuaggguugcucacaugcacuguuugugccucccccucccccuuuuaagagaaaagguaucuguaguucacauugauauuccucauugaaaucuauaauuacagagguuucuuuuuauauuuuaaucucuuuuguguuaacauucuaaauucuaauugucagguccaagggaaacccccaguuccccaaacuucaaaagacaguccaaauuaucaagaaaugaacucaaccuagacuauggaaggcuuucuuguaguuagauaaaagccagcaguucucaggaauuuguggaacggauucccuucugccaaaaggagccauuucccauaccccuggcagaagagacaguugacucucugauuaacauacgccuguggcccuaucaacguaucaggcgucucagcauaucaagguccuuguaacuacauguguagugccuaucagcaugucgagguucuugcuagcuuccaggugccucuggcuguugucuaugaacauguuuuuucuuuuaugaacaguaagacauggaguguucaugucaucaguuuauauacuaaugauauccacaaaauuaauguauucaucaaagccuacagcuucaaaugacuaacaaugugacuauugcugaaagcuuaaggcauguuucuauguguguuugugugugcgugcaugugugugugcauguguguaucuucucauucauuuauuucuauuugcuucuacuuuuaggguaauguuaacuuucauccugaccagucuuuggcuuuguggggguuguuuguuuugucuuaacuuugugcuguuauugagaauugaaccugggaccugguguugcucugcaagcacccugauacuaugguaaaugccacccuaguuuugcuuuuuuuuuuuauaaaccguuuuuggauucaagaugacauguuccaacaugaccuauaaaaagcccaucauuguguucacagucucuagacacuaugucuggaaugcuacccugauaagcuugaacuaccaacaaaacauugcauuaaagcccuuaaccuccacaccuggcuuacacaggaccucacauacauagacaguugcucaucugucuuccuaaugauaaagcaauauacuagacauuccuugucuagauagcuuaaucuugauaacuggaaaacccuccagcaaguguagugggucacaccuguccucacacucaagaggcagaggccagggacuaagggccagagugagccucugacugaaacaagcagagaagguacaucuggcuugaagccugcuugcucuaccuuaaaugauuaugcucugucauaaaagccugcuuggggaauagcuagugugccucccugugagaggcugaucuugugaucucucuuucagaagcugauaaaauaccaguaaugcguggacagugguuuauugaugggacguggcaaccucuagaagaagaagaaaguaauuuaauugagcaagaacaucucaguuguuuuaggggucagcagaugcaagaaaauuuugauauugaagugucaaaauccuuagauggaaaagacgguaagaugaccagucaaugcauuugguauguucuaugaaaguugucgguacaguuauuuaguguguucuauaaacguaaguaauugauauugcugguaacucuaguaauaggcagagcuuauuaaauaugauguugccuugaggugcuagcaaucaggccuaugcauguuaggcaaccguucuaccacaacuauacccacagcucuaaaauuuguuuuuuuuaaaacauuuuacuauucuuaaauuuaaaacugcuaugaauuucugaauuauuuuacuuaguauauauauuuuacugcacaauacuagcacaauuuaccauauauuuacaaaauguuuauauuauacucagaguuagucauuuggggcaauuugagucaucacagaaaguagaacuuauaaaacccuucuugcugucacauaaaaaagcaguuuuauuaguaccuuaguaaucuuuuccugaauucuaaaggccagaauugcuuuuauguuaucuuuuaauuaucucuggaagauaaauacaaguuucuaauuuaaagcaagcaugcuccuuaguuuauucacucagaaguaacuuuguuucagccauuaggaaccuuauagacuugccaagauugccauguuuucaguaugugucugaaucuugaauaaaccucaaaauguguggugaaguuaaaaccccuucuauuauuccauuugcugcaggcagugggaucaacuacucuggugaguaugaugaauaggcagcuuagacuguguggaugaugcucaguguuucuuccuccaugcuugucuuuaugugggaggcuuuuggcaagcccugccaaaccuagugaauuaaaguacaauuugagaaaccauuuuccuuaccccauaaaaccucucugaagccaagaagcccucccaguauugaucagguaauucacgggaugcggcuccucacuguccgcaggccuucacuggguuucuucucuuuugcucauuuuuuccucugcuucuguuuuuguugucugucaucucucugaauguacguauagauccauacauuggucacaagaaaagaaguguagcucuaccuuggcuuuuguuccccaguuagggugacugaggaggcuugugaaaauccagcacuucuauaacucucuuguaauuugcagggaccaugcucugaguuuuaaauacauuaucucagucucuugaucuguagauucaagcauuuccuuauuuugcugucagauuuaggcuaaagguguuacccaccaguguagagaaaagauuucucuauaagacuggcugcauguaacacuuuaauaacuagagaaacaacacuucacucuugugcaacaaaaaaugugauuugaagguaaggaauggucucucaccacuacuacuagaacugccacacaccuacuucauagugucugaaggacagaacuuuuugucauaaaacaaugucaucgcuacuagacaaagcagaguugagggauuuuuuuuuucuccucaagucuucuaucucaagagugacaauucauauagcaaacauaguuuugucaacgcucgucaguacgguuagugcuugaaagcucgcagggaggauagcacacacauagaagggaguugcuccaguccucacugcacuuccccuuugcagucagccugugcagggacucagcagggcugugucaucucuaccaccugcuuacagucauauucacaaucaaauucuuuuucauguaaacucaguauucugccuucucucuaaauauuaaauguaacaaauacuucagucuucaaacugcccaaacuuacuaugccuaaaaacaguuuauuuguaugaguaagguuucauagguuucucucugucccugccucucuguuucucucuguucuguuuguaucucucuccuacccucucucccucugugugugugagacagacaggcaggcagguagacagacagacaaagauggagaagaggaagaucuaaaucucagcuaauguaacauuauaugaggucuuuaagaugcacauugagcaguaaaauucuaauuagaaauaauauguuuaggcagguaugguggugccaacccucaaagccagccuaguagucuauguagcaaguugcugggcaauuaggacuacauagacccuucugaaaaaaaaaaaagaaagaaagaaaagaaaaagaaagagagagagagaaggaaaagagaaaaagaacgagaaagaaagagaacuaucuaaacuguuacacuguccuuuuuaaaaugagucccugaaggucauuagaagaaauuuuuucuucuuuugagacagggucuccuguagucccauguggccuugaacucuccauguaauugaggaugaccucuaaccucugccucccaagugcuuuacaggcacacaacaccacucuuaguuuaagauaaaaauuuuaguuguguuguggcauagguaaagacuuaacauuguuaguucaauucaucaaaaauauaauuuccugcccuuuuaucuacuauuugguauuaugcuaaauauauacucagagguuaagaugugacauuuaacguugaagauccugggaaauuuuguacuguauuugaaaauuacaggugauguuacagaaacaucauguacccuccagagagccaccauuuagggaaauauaccucaaauuuaaaauauuuaacaaaaaauguauguuccuuuagauuguuuuggcuuucuacacuucugacguuuucaauuuuacucuuuuuggggugaaaauauccuuuaaacauaaaucuuuucauguguggugauaaagcauugacuuuucuuugucaagauuauuaaugccuccaaguugugcugggcacuuuugugagaaaaauauaaaggcauauaucucccccuggaguucucaggaucuuagagaagagagagcccacaggauaggugcaggauggucagugugagacaguuugaguaagugccaugggaguuacuaacaggcucucuguagcgucguccaguacaugcaaguguuuaaaauuaccaggagcaggaggucauuaguauuuuagggaauuacaaagaaacuagguucuugccuacaggagcauuagaauaaaauacuacuuugacuagaauaagaaaggaccuuugaccaugucugucuagaguagcuguugccaugguggguuagauaugucuauguuuuaccuccuuuagauuuucaucccaguguccaaacaagcauuggauuagaugauguaagucuggaauaacuagaaaaauaaagagagcccacaaaaagaugaucauuauugugauuuagauacuugaaguuaauucuccucccucacccaguagcuaggagaaaaauuacauacgugugugugugugugugugugugugugugugugugugugugugugcgcgcgcgcgugcgugcgugcgcgcgugcgcacgcgcauauccaucugacugcacuucuaugcaccacuugggggcaggagccuaccagggucagaagaggcaucagauccccuugaacuggagcugcugauaccugcugccuuguagugcugggauccaagccuggguccucagcaagcacaauaagcacuucuaaccacugagccuucucuccagccccacgccucgagaaaucuuaccuaacauagugauuacugugaggccauccaugcacuuaagaugacuaaucuaaauaaaguuaugccuucaaguaaguaauucuguaagcacauuuaauacuggauuacaguucauccagguauauauggugguuuuaaaaaguugaccuaaaugcauuaauacugugcaucgcucuggccacaaagugcacaaccucaaucucauaguaaaaaaccguaagagagacugaaacugagggcugguguaccaaauaacagauaagaugcgccuguucuguucagacucggccaccagcaggagcacacgggcgcagaccugcuuguauuccagauucaggucgcaccaagcgcuugccucacacggggaaggcccaggguucaucuccaccaccuaauaauuacccacacagaaguccugggucagaaguucgagcgaggagcuccgcugcuacagugucacggaugcugugagcauccgcagcugugggaagcggguaagaacguugaggugccagagugaugccagcauuccaaagacagaggcagacugcccuuucugagugugaggguagcccuguuccaccaaagacugucuggcggcugaggguccccaucuucuaguuuggaguugcaguuuuaugauuuguuuuuuaucauuuucuuuaauuuaccugaagcccaagaaagagugcuggaguuuugcuggaguuagcaaguuugagaugcacaaggccaccugcuuccccugagaguaagacuuuuccagaucagugcuagccaucaugguacuucucuagacuagacucugauugcuugaaaagaaccucagcaaaagaucauuugaggcagccuauggaagcccccaccuaaaaaagaauaaguccuaguuuuccagacaguguucaccaaggaaaaagguauuguguguuucucuuacaggaauuauuaacuugcccgcuuuguggauaaauaaacuaacuauguucagaguuacauggcgauuaaaguuucuuuauaaggaaaugauucuaaguaauuuaacauuucaguauuugcugauuacugaacaagacuuuacuguguaaacauuuaauaaauguuaucagcuuauaaacuagcaucuucaguugcaugaaugcaugcauacugcugcagugguacauaggaacugcuacacuuuauaguuaacaaaagacaaaggaaauagaacaucuuuuuuaccagugaaugaucucuagcugcaaaguuugcaaaggcuuuucuucugcuaaaagagaaguaauucuggguuugggguuacaagaauuaagcucccuagcaagugauucucaaggggaaauaggauguaaagggaaagagccauaccauucauuuuauuaaaaagguuuucaauaaguccaaguuucuguugggaauaaaaagcuauguaaugaugugagcuuaucuucuuagagucaugcuauuguuuuugaaaggcaagaacucauuuuaugucuugaccagcuuucugaaagugcucacgugauuuuauaucagguggcccgugugugucccaagagcucgauuugguaaaugugggauuugguucagguuuguuuuacugcuagaccuaaaaauguagucuuuguuucucuguguaguaaauuaccaaguguguguguccaucugacccccuagcuaugccucagcuuuucccuaguuuauuugguuuguuugucugcuccuggugccugaugaggagacacaggaaagcaggaggcaggaagaaaccugcuuccauguucuuucuuuccuacugugucagaggcaucucauagcucugcugucacccagcuuuuagcccuaguuuagaggccuacagccuucuaauugcauugcagauguaguaauuaauguguaggugcaguuuuuaaugccuuguaggaauuucgcaaaaacccuuuuugcacaaaucuuugcauauaacaucaauuguauauacaacaaaaaugaaagauucuuuauuuaagcaguauuuaaucuaugaauguugaguucauguaaaagggagugagggugaagaugaauauauuagaauauagauuuuaauuaaaucauaaacauuuggugauuuguuaacugaauaauuaacugauuuauaagauuccauuucaaguguacuaaaauaaucacuuaaguauaaggaauguuaucaguaacguagcuagcaaaauuggacaaggagcguguuggcuuuaagacugauuugucaaauaucaauucucugcuuggcuuuuuuucuuucuguguugucugcuuaaugccuacaagguaucacagcauaugucuccuaaugaaauuauuuuuguuacauuaucacuagucuuuccaaaagagaugguugaaaguagagccuucaauuugauuuucuugaaaauguuuucacuuuuaagucaucaacagcugucucagucaaugaaaggaagccuugcuucggaagcagucuugaagccaucauuccucuguauggguggcauucgguggacuguauacugugcuaucucaggacagcuaggucagcuguuuaaagcaugguuguauucucagaguguguaucaccucguggcuaugccaucaaaauucggugacauaaauaaucuucagaaucauaaagauagagaaaaucgcuuagcauuuaaaaugcccugcaugucuuacagcuugcagagguauuaaaugaucauguaauugucugucacugguaaauuuagauauuauuugucuuuguuccuuucaauaaaaguagagcauauauauuugacagacauuaacuaauuuuugcuuuacuggucuuuuaacuaggaguugcauuuuagaaagcauuuagaauaauguuugucaagugcaguuucuaaaaguuagggcuaaaaggcagaggcagaauagaaaaccucacuuaaauuuccuuugaagcucaguguuuuugcuuucuuaguugucuaccaccucccucccuucucccucccuucucuguucaaauggagaggauauaaggagagcacagaugccacaggucuuaagcgaaagcguucccaagguacgguaaaccugcuucuguucucuguagcucacgccagccuuagagcauagaagugcuagccuuucuaagagugugucuguugugcuauuugccuuaguuuuacguuauuacacggauguauauauuuauuuugugucauauguguauguucuuaagauguuaagacuauauauaacugguuugcagaggaacagaguuuugcuagauuuuuuuguuacuuuucuuuaaauauuucaucaguuucaaucuuuuaaacauauguagcucagaacuauuucaacaaaaauuugcuuuguaaguaguuauuaagcccuugcaaaaauuuuaauccuuuuagcuuuuaaaaagcuauuuagaagucugaccccgugguugcuuucugugaacuaaagcuauuaguguauguuguauuaauugaaucuuaauccugugagaugcacgcacacacacacacacacacacacacacacacacacacacacacguauguacauacguacaggucaguagagguaaguaacauaauugauuuugauaaaacuuaaauuaucuguaauguaaggagugaguuuucuucuagugugcugugucuucucauggggaacacgcugccacagcaugccuuaugguuuugaccaggacugaacccuccuacacagaacuguauucuuuuaaaaauauuuauuuauuuuaugugucccuguaugcauaucuaugugcacuaugucaugccaaggacucccuaggaauuggaguuacagacaguuaggugccauguaggugcuaggaauugaacccugguccucuaaaggagcuuaagugcuaagccauauuuuaagauuuuauuguuuuauuuauaugaguauacuguagcuaacuuccgaaacaucagaagagggcaucagaucccauuacagaugguugugagucaccaugucguugcugggaauugaacuuaggacucuggaagaacagucaguacucuuaacugcugaaccaugucucuagccucccagaguuauauucuuaacuugaggucauuuacaacucaucuuuagguaaaacaggugcacccugccaguuacuagcuuuugagcaaaauacucucuuucugcaucagguuuuuaugacuaaaauggggauacaguuuuugccauaacgagauuucaaaaugauaauuggacacagugaugguaaauagcaguuuucagaagauaagacuauggaagucucuuacuuaagugcccaauauauaaaggaaaauuuaaaccuucaaaaugcauguuaacaaauuaugaauugauagaguagaucaaucuccaguucauugcuccugcacuauuacuggauucacauagaugcuccacacucggaacacaguauuuacacuagagaugcagaagugaacaguucacagcgccugccucgugagcuuggggauuccucaucagcaucugcguuuaagaccuugugcacaauaagccuaaucucaguuacagaaauucaguagccaugccacauaaauguuaauucuucuuaaaccuucauuuuuguauuucugcugucaagugauagcuguccuuaauaccauucccaauguaccuuauauucuaguacauuauacugucuuuuuuugucucacauugaguaaaaauuuuacguaccuugauacuuuuaguaaaaucaacaagagggacagaguuagagucaggaagaggagccauaccacuggggauacagcuucuuaauaaucaaaaaacauauuagcuacauacaagggcuugauauuuacagucauaccuggcacucugcuguuccuuguaguacuucuuuuauaagguucuaugcauugcuuaugugacauaguuuucucuacugaccugaaguccauggugucugaguuagagaauacugagucagaaaccuggguguuagagugucuugcacaaggaagaucagucuuggagaacuugcagucucucucuuuuguacaacagcuguucacaguuucaagcugagucggaaccacguggacuggcacagcauggaugaagucuaucucuacagugacgcaacaacauccaaaauugcgagaaccguuacccaaaaacugggcuuuucuaaagguaaugcuuacauguuauuguggcuugucaaaauuugggggagcaaaaguagauaauucagauucuguuuuuaauuuauauuuugaguagaaguucagugucaagaacccugugaagucacucaucagcucagaauuaggaauuuagaauacucugacaaggacaggaauugcuagucaugagugagugcaguccaauugaacauggcaguugauauguagcguaaaagaagaggaggcuagaaauggauucaguuucagugcaggaagagaggagggaaaggugaugugagaaagacaacacaacucucuaaaguuuugcuaacggaauugcuucuuggccuuuuacaguuuaaaaagaaaaaaagaagggcuggguaaauggcuccauagauuaaaaggcugccccuucagugugaugaccugaguucaagucaucuggggucacauaagcuagaggcauagugugcaucuacacuccuagcgcuacuuagagggagagccagcuacccugccuggcagcagagcgagacacugcucuguggagggugagggugaugccuugaggcgcccaucucucacacacaguucuucacacacaauguuuuaggucuuuagggaagauagagcauccucaauaagcuugaaaauauguuuuauuuuauuuuuuuaaggccaagaaaauguuacuaugccacucuuuuaauuugcuauaaauguaugugaauauuuuuuauaucuauagcuaguuauauucacuuugugagguaccuacuuauaucuuaagcacaaaacauuaauuggauauauguacuuuuugauuaguaaacccucuuuguauauaugcuauaacaguaggcuucauauuuugcuuaguuuuccccaauuuucaugcaucauuguuuuguuuuuuguuuuuuuguuugauaaguuuuguuuuguuguuuugagacaggaucuugcuguagcccuggcuguucuagaacucgcuguauauaguccaggcuggccuggaacucaagagauccaccugccucuauuuccugagugccaggauuaaaggcaugugccaccaugccugguguauuuuuuaauguggaagguuuuguuuuccuaaugguuucuggcuuuuguauuguauccaguuuguuuuaugucaaucaauauaaucuuauggauuuuauuuccucuuuguauaaccagugaaauaccuuuauauagucuuauuauuacuacuuuuucuuucuuuaaaccuagugugcaaguaguaaaccuagggcuguaauuuccccacagccuccagcagugggaccagacugcacagagguuauguagaagaagccacacuggaagacaagccgucgcagacuucucauaucguguuuguugugcacggcauuggacagaagauggaccaaggaagaaucaucaaaaacacagccaugugaguacugugcacacacuccacaccaaguccagagucccagcuuccaccuacggcauaagcagguacacagagccucaguuccauguucccaguaucaacucucuaagcucagugauggucgggaccaaaccuagagugccuguaucuaaaugaagucugaccucacucuccacugcaggagcgagagagauaagaaagccguagucaauguauuuaauugauuuaaggucgacagcaggaaaagaucugguuuuaaguuuguuccuugcucuaugagcuucagaaauuaaaaucguuuaaaguuguccaacucugagaagauuaaaauuuguuuaaacugacaauuuucaauauccucugcccacucauugcuccggaggaaacaacucuggacauuuacacagaggccaguggauacgaacacacaaggcagacuauuuaccuccucaacugauacaucucagcuuuauaucaggauaugugugcggggaucuguguguuucagaagcugcuaagcgcuguguuaaagggcuguuaggguuaaaggucgcaagagaaccaccugccucuauuuccugagugccaggauuaaaggcaugugccaccaugccugguguauuuuuuaauguggaagguucuguuuuccuaauggcuucuggcuuuuguauuguauccaguuuggcucuuguccaaaauaaagcaaacugacgagcucagauuuacagugccugagaccacuggauucacuacugaaagcauaauuuaucagacuugaagacugccaacaaaauuccuuauugcugaagugagcgcugucugaugcuaggaaguagaucucaguaaccugcauacaauaaacacugagcugcuggaaaguuaaagcaaaaguuucgugcaacucagguuguguugccgcggacacuggugcgccugagcgcuucagucuugguuuccguuaaagcaucucacagcucuaauucugacuuuguuuuauggugaguuguauauuacuuggcacaauaauuguguccugauacauccucugcuuaaauauugaggaucacgagaaggagguuugcaggcggagccucccugagauccuuaguaaaagagaaguuugauuucuugagguacaaaacauaacacagaaaggcugaagccugugaaucuuuccaaacucacugacaacggcuuggccucuguagcuuacuacugccucacaagggcuauacaauaggaagaccauguuaauaacaucacgcggaugcgauuagcaaacagacuguagauaacucucuagacaaguggugugucgggagguggugaauuaacagcagacaguugaaaccugucuaccaucugcagugaguggacuguacuauuugaaacauaaaauaaauauaaaauauuuuaauguuauauaaaauguuauaacaguuuuuauaaucagcuggggaaaugaggccacugaacuacguguuugcuaaaaguaaaaauuauucaauugcaacaucauaauaucaaguagauguuauuuuagaaaaauaugcuauuuagagauaagagagcugggauguagcucagugguagagcauugacuucacacgugcagggcguaacucugguacagcauucgccucaaggauuugaaaccuugggcucaguguuuguaugaaggaucuagaagcagaaauaaaacaauguggugucugcgauuugguucagaccaugagaggaaggggcacuuguugaagggauaacaugaggguuuuuacagugacccuucagcauccucauuauguugcaccaaccauaauccuauccacuugguaaaauucacauaacugacaccaaaaaaguaaguucaaugacaccuuaauuuuuaaaguaaaaaaacucgcaauuuacauuauaaagaaaagguaagagucuguggagcagaaaaaguacaggagccagaggaaugauucugcaagauggcguccuguggauguaauagggaagaccaccacuagacaugcuaacauggauggcggaaaacucaugagggccggucagucacuagaggaggagcuaccggcaaguaacuacuucagagggagggaaaguuagucaucuucagacgagcucccgaauuguuauccaguaacacaugggcagaccugaagcuauauacacagaagcaacacuaaacagaccuagcagguuauauuuauacaguguguguguguucaauaauuugagagggaacaggagaggcgaguacugggauaugagaugcuggagggaggagaggaagaaagaaaagaauugaucuaauuauaucucaguuagauaguccaugacugggugguggguggaggugagcacagcauggacacacucccugugcucucacaucccccaugagccgugccaucuagaauguucuguacccaggagcagcucaaguccugugacagacaggaaaguaacugaggcaaagcagugcugaguugcagcucagcucagucgcaggcagcggcaggcaauggggacagguggccaugugagguauuucaacaugugugcgagguuaugcccagaguuugucuuauguuuacuuguuugcuuuauuuuuuuuuuuuaggaugagagaggcugcaaggaaaauggaagaaaagcauuuuuccaaccaugcaacacauguugaauuucugccuguugaauggcgaucaaagcuuacucuugauggagguauauuuuguuugaaauugaaugaauuuagccagugacaaaacuuuucuggaauaaauauacagauuuuaaaaauuauuuuuauuaagaauaaaauccuagccaggugugguggcauaugcuuuuaaucccaacauuuggccaguaauacaggaucucugugaguucaaggcuagcgugguuuaucuaaccaguuccagaccagcuggacguacacaccaugaacagaucuuuucugucuuaggguauauuucacuuuuuguuccagauuauucaagaacauauuugaggggaaaaauguuuuuaaaauuacuagcauugacuugugucuuuggacugccaugcagaccucauagaucacacuguguguguguguguguguguguguguguccuuugugauugggaggagauguaggucucucugauaccagcacacacuuuccccacauugcuacacaugcacacuccccacuccuuucccaggcacugguuuuguuuuaaacagucugaccuuuguagcccagauggccuugaacucacagccuuccagccuuugccucuugagcccugaguucuggguguuaccuacuggugauaguuggaaggcacugagauaacuggaggaagucagccagaaagauccuguucuuucugcuuccaaucuuguagcagugggagggcagaacugcaggggcagagaagaagccagggacggccagaacuuacggaaggaaaggcagaccauggaaguccuggucacagcauggcuacaaaaaauuguacaaguauuaaauucauaaucagcuuuacucugcaugaaucucaaaauuaaagcaugcuauggcaaaucccaguguacuaacuagucguaaaaggauaaaaacaaugauuucuaugcugcuuacugucucugcacauaguaacgcaugaagaagggaugacagggaugaagaauucaaagcaccaguucuggcucacaggucacugcuaucugcucagaauacacacgcacacaucacagaaaaaucacuagaaccgaucaacuuagcaaggucaugacauagaggauuuaugugcaaaaauaagugcuuuucuguagaccagcaagaaauaaaaauaacaucaaaaaugcaguacaccaaggaauaacuuaaauauccaacuuuuauauaaaauguauaacuuucaaugacguaauuuuagcuuaauuuuauacauuuaaauauuaaaguacaaguacuauuaaaauauagaaaauuuaaauacaaaguugauuuuccucauuaaauggucgaauauucuagagaugcuaacucucaaauuggucuguagauuuuucacagaacuuaguaagcugacugugaaaugacuguagaacagagggcccaaaauagccaagaacugagucagggagucauguccuccucgguggcuggagcgauuuaacuuuugaaguugaaacacuuuaaugucaggacaaagcuaggcagauaaagcagggcugcagcacgagccucacacauuccugugcugaugcuggagccugaucacagcagagccgugcagagcagcccugcagcccagggcugaagcugguuauccuguggggcaaaugcuuaaaagagagaaagaugccuguuuuauacaucagcuggaccaaagcuuucaacaguuuagaaaaacauuugggagacuagcucagagcacauagagagucuuagucuuuuaucguggugccuucugguccuuacuguguugugcuaaaacuacagaauaaauacagacuaaacaaucugggcagugcagcgacugaggccuaagacucugucccccuuccauacuuugucccauuuucaaagcccauagcagguucguucgccuuuguuuguauaugggaucuggcagugcaugcccauagaguccuugggucaccagggauagauaaauaggaagcauaagaaagguuuuguuugcugcugguuuucagcagugccagcaugccaugccagaugggcauggucaggcucaagguaaauagauccccaaaaguuaauaauggcccccauccuuccacguuccuuuccuuucugugucgcucuuuguugccuuuugcuuuuuaguuuuugguuuuguuugguuucgucuuagauauuuugcaagaaggaacgagccccacugguguuuaauauuucaguagugaccucuguaacugucccuguaaccuugcuaaguuugguuugguugcucugcucucacagacacaguugauuccaucacuccugacaaagugcgaggccugagggacaugcucaacagcagcgcgauggacaucauguacuacaccagcccacucuacagggaugagguaaacguccuggccagcccgccaugcugcugggcuauacagggacagcaaauccaggcuggauucaucuaauagggacuuugucagcuccagaccaaagguuucccagacaggccuguccugauaagaccaaccacuugguacuccuuagaaauacagagaaaggccagaacuggcagggcacaccuuuagucccacacucaggaagcagagcuacacagugagaccuugucucaaaacaaggcaagaggguggugcucaacuguauucccagcacacggaagaccaaggaagaaagauacauuucccagucauguauacuaaaauagcuaagaaacaaaauaccccuuaucacaaugaacacaccuaacauccagauguuuguaguacuguuuuucucauaaagagaaauuauaauucuuuguaaauguagcugauucagagacaaaaacauaaguaguucaugacauaagcuaaggaaguguucagacagauaauggcaggugacacggauaggagccagugccuggcucugaagcggucugagcacuggagcccaguuuguucagucacuacaggaauuauuaccacuugcaguauaaggauaaaauaaugacagugcaguaaggaggccaagccaguuuuuaaucuaacuuucacauugauuauaauucaagaaauacgugggaagcaaauaggucccuugcuuuuagaacaguaaagcugacugugguuagaaaaucauucuuacagcugucaugggaguauuggguguacagacaccggacaugaaucacgagugaacauugacuuggggcaguguuuuguuuaggagcaaacugauugccuggucuugacugcaucccuguagacuacucacuggaccguaaaggagagccguaauuacacacaggagaaaucaggcagcgucuauacuggguuuccccaagggacaguggacaccuacagucccuuuggauggggugcccuguggagggugcaccauccccugugcagcagcagcauaauauugaggaaauacccgagaaagacaaaacaaguuagugucauaaagacaguaguuagagaaaacgcucccuaacauaggaggugaagagaucugaucagugcucuguccuguucucugcugucuguaguggaggagggagcugcagggaaggacgacaaaagugggguugugggugguagauuagaaaaaauagauccaaauagugcugugugguguggauaguuaaacuagaacuacuuguaauucgagggacuauacaaggaaguauuaagggauaaaagaagacaguguauauacuaaacuccucaagucuaauugccaaaaauuuggggaagauauguguuugcacguuuauagaagcaaaaagaacacaaaugugauaaauguuaacaaaagaagacucuaaauaaacauaauguguggauuuuuuuuaaguuauguauuaugaggaagggaaugugcaggugagcccaaguccuguggaguccagacaagggcagcggcacccgggagcuagaguuagcaggguacugcaaacuacucugaugaacacggguccucugaaagagcagugugccggcuccaggccagacauuugauugauuguacuaauuuuauuuuguauuguuuuauaucuucaagaaaaaaaaagugaacaaacaaaauaucaaaguuaagaggggaaaaacaguuuuccauccccuggagguugugagucacuuagucuaaaauggagccuguguuuauauuuuaaauuaacaguucuccuagguaauaccaucagggaauucuggguagugcuucuuaaagcauugugaagaacaaaagcaguucauaccaagaggugggcgaaagugcucuuguuuguuuguuuauaaaagaaaggucuguaauuuaaaaucccccauguuggagcuggagacaugacucagcaguuaagagcgcuuguuacucuuacagaggacccugguucaguucccagcacccacaugauggcucagagccauccaaauuccaguuccaggggaucauaaccccucucuggcauccuccaggcacuugugcuacauagacguacauccaaacaaaacacucauaaaacauaaaauaauccuaaaaagucaaucucucgaguuacucuucagcauaaacgaugaugaguaacuaggaggagcacacgguucuucagacgaagaccauugcaaagcugucuuaaaagaagggacacucccuucagcauggaaacacgacuguguagaugcaagcuaccaccaccagaggugcugcagaagggacucucaucuccacagcaguuaauuuaggucaccucuuggucucuugaaucugagauugagauucucaagggaaaaacuguaacuuuguuuuucaccagaagauguacaacagacuuacugcacaguuucaguagcccagcuuagcuucagcaucguuucauuguacgcuaagaugucagcaaaggaugccaggccuucaugccugucaucccugggccuugcagucauaaagcacaagaguggaugccaguuuaugcacucuggugaagaauguucaguagcagaugauggagauugguugucucuugauaugacaugauugaaauuagaagcugcaaaaaaaggaaaaaggaaggaaggaaggaagugagggagggagagaggagaggggaggggaggggagaggagaggagcaacagcuggcuuguuaagaaaugagauaaaguuggagcugaagcuuuguaaucagcuagaaggagcagugaggaggaggaggacuggucagguccaggacagguuggagggauaaacagcgucauucucguggauuugggaaaggcggguuauguuagcucaguaguuuuugcugauguuucacuucaagggaaacagcuucacagagacaaaguauaucugucacaaaugcauauucuuuuaaauauuuacuauaaccacagccugcacacuauaaaaauuuagaauugacauauaguaagaugaacugaaguagaaauuucuaggggucuuuggagaucuuaucuuugacaucuaaaaggaagguuuuuugguuuuuugguuuuuuuuuuccaucuacuugaaagcuggcuaguguaauuuacuuaaauccuacaaaaggaucuuuguggguaaccugccugugguguguucuguaguggugauacaguuugcagcauauauauguaucuccauuccuauaucuuuuuaaaguaccugaguaaauuugauaaccuaguuguaguucauccgucauguuuguuuuucuucuuaauaaauuugcauuuagaaauaaaguugcuagcacucagugaaaagucuaauauuauauuuucuuauuucaaacagcuaguuaaaggccuucagcaagagcugaaucgauuauauucccuuuucuguucccggaauccagacuuugaagagaaaggggguaaagucucaauagugucccauuccuugggguguguaaucacuuaugacaucaugaugggcuggaauccagguggacucuaugagcagcugcugcagaaggaggaagagcugcccgacgagcgguggaugagcuaugaagagcggcaucuucuugacgagcucuauauaacaaagcgacgguaacagcccuggccuuugaaggaguuggcaauguccuuacggaauuguucauguuuguaagagaaagccuuaguuaggucuggagagauggcuccauggcuaagagucuuucagaggagguucccagcaccuacaucagccugcucacaacucccccuaacuccagcucuggggaacccagugcccuccucuguucccacacgugcacacagaaagcacggaguuacaaguggaaggaaaaacucucugcuacauuauuuuaauuaauacuugcauucucaucuuuuuuauuuucauucacuuacugacacaagucuacaaugaaaaacacagauuuugauaguuuagcacuguauaaaagcaguuaaguuagccgacgagcuuuuacucacaaaauguuggcuuuguuuuacuuuuagaauaguugucucaggauuugaccugugagaugccauaaacauaaauauuaugauagcaaaaugauuuuuagucuuggaagaaaauggcauuuuaucagaggcagguagauuucugaauuugaaaccagccugguuuacagagugaguuccaggacauucagaacuacacagagaaaaaccugcauacaaaaaaaggggggggggagaaagaaaauuaaguuugacaaugcucagagcaacauuuaagauguauaaaucuggugaaacaugcccuggaccugaauuugauuuccagcaccuaugucagacagcucacagucauguuaccccagccacaggagacccaacacccuuuuccagccuguacaggcagugcauucacauuuacacacacacacacacacacacacgauuaaaaaucuaaaaagcacauuucaaaauaaaaaacaggcgaagucaugguagaacauacuuguagucauggcccuuguuagauagcucagagucagccugagcuacaugagacugucuuaaggaaauacaugagcaaguaaaugagcaagucuguaucaaaaagugagcuguagcuuuguugagaaagaaacauuaagcaaauguauuacaugugagcagacuucgaugacucugauagucugcggcagagaagcgcuaagccgaggcuccucauguaguggacagacaauggcagcuuuagaaguuaaaguaggugggagcaaagccaugaaaagaccuauaaaacuccuuacuaaaucuagaaaagggaaagacuuucuaaaacgacugaacagaagaggauaaaguauggguuuuagagcuacauagaccagguagguagauagauagguagguagguagauagauagauacauagcuacauagauacauagauagauagaugguagguugauugauuauguaugugcaugggguagugugaaggccaucauuugacuuauaguaguaaaccucuaauacagcacugugguguuuguagugaaacuauaaaugugugugugugaucucauacugccuccuaggcugagggaaauagaagaucggcugcacggauugaaggcgccauccauaucacaaacaccugccuuaaaauuuaagguaagggagaucagcgucuccuugucucagugcuucuugaauguuugauaugggccaugaaacaacugagaguccagucaugagggguuaucgagcauaugugugugcuugcacacuuuguaaaaacagcucggacaagaugguuuuccagcaccgggauauaacggugugucugucagugcccuucagccgcgugcagagcagaggagcaccagaggguggacggcuuuaaaagaaugaacacuuguuccucaucucaguuuacacuuggccaagucaaagaaaagagaaaauaaaaguaaggagaggagaaguugaggcagauguguggcgugauugcuggauaaagugacaaaacucugggucagcagcacaagugagaagugcacaggagccauuucaggguagacaguugggcauuucccaagacaagggucacgggcuuaguuuggcugcaauuuucaagacuugucaacaggcugaaaggagaggaagugccaucugcuugccagggacagagugaaacugguuaguagacugguuaagacagugcucuagcgaagggucagguggaagggugucagcacugacugcacucaggaaggagacguucuuaccugcgucgucgauacaagauggcaugagccucugacacuugaucucugcugccccagugcgccacccugccuguucuugcugugucuccucuauggggccuuagugcagguuaaaacauggaugauagaaggaaaacugcauugacccucuggcuuacaguucuucuuuaacuguuacuuauuuuugugagcaucggggacugucuauauguaagccacacaugugccuagugccugcagaggccauagcugguaccagaucccuguaacuggagucaugugcaguuuugagcugucagagggugcugggaacuaaacugggguccccuguaaaagaguagguucucuuaaccacuaaaccaucucucuggcucccccacacacacuguuuuucuuuuaacuuaaacauuuaaaaagcacauuguugagcugugcucauaacucaguggcaaguacuaggccagcaugcauaagguccaaugccuaggacuacacaggagaugaaaugguaaauuugaaacaugcauuuaaagaauaugaucucagaauuauccuaaucuacaauuugaguuccagcucuaccaacacuaucauauauauuuaauguaucugguagauagaacacaucugguaccacaugauuagaaccuauauacuauaguuguuucuucugauacaagucauacauagcuuaguaaagacuccucauuguuauucauaggaaagcagaagucuagauuaaagagcaucuaaggacccagugagucauacuugggacuuaaggggucagaauagagcaggaaugugggucgccaucagacagugacuugagaaugcugguaucuguccugucucaguugacuguugagagcagugacaagugucagugugugaugggcacaguuacauguugguuugcccgugauuuuuguccuguccaguuagugauauuagccaagccauggaacgguucuaaauccaucuguuuacucauaugcgaguaaauacagagcuaaacuaaacacuuaaaguucccuuuuguuuucaaaagucuuggagguuggugagauggcucagcagggaaaggugcuugcuuugcaagccuagugaccugacaucaacccugcaacccacauucagguagaaggagagagucaacuucaugaaaucguccucugacuuccacauguguacaugguacacacaugcccccuacauacagaucauacauguacacaaucaaaaugauuuuuaaaucuugucauuauuuagcagucauaaguaagcggucuuuaaccuccugucagagaacaguacaguccucugcauguucgucacacugcagucaucauaagcuguuccauauggaaggagcgacuuaacauguuuauggagagacgagccagucaggaagcauuuugcccagaaugucauaacuuucuccucucaccuauuuuugguauauuggagggcuggugugagugugugcaugugucuauguccaugaguguguauguaccugcacuugaguaugagguuguuugcccaauauucauaacagaucagagcacaaagucagacaucuuccucuaucuaucaccugccuuauugccuuuagauucucucaugccguuuugacuggguggcuggguuuguagaguuucagaauccugcugcuuccccacaacccuggggcuccaggcaugcauaaucacacccagaguuugcucuuuuacaugaauccagaagauucaaauuuagguccuuuggcuuaaagaauaagggcucuuacccacugagccaaucccugccccuugcccuucuuuuuaucuucggaaacagaaucuugccacuuagccuaggcuaaucuugaaauuacuguguagcccaggugggcuucaaauacccaguccugccucaguaucaugaguguugggauuauagacaugaggcaccuguguggcuugauuuucuguuucuuccagcucuucucuucucacuuuauagacgaaccggauuguaucaucugugucccugguauucgcagugcuuuuuguugggcugggcacagcuuggugguagcacaugcaagggcuccagguucaggaacauaaagacaccauuucagaauauucauucaaaauaaauauucauacauguuuuagaaggcauucuguggucucuuuggaaaacguuacagguguauaaaguuggagguugacaugaugggguguuaagaugagaaucugaccugcaagaugccuuuucacucugguccuucuagagucccccuccuccugcugacuaaauaaauguaggacuguccaugcucugagcccacccggcacauucacagucuuggcuucacagccaugucggugauggauguagcuguggguggggagagauacgguucuguaccccugcucugacugacuguucagccacauacuacagagaucucaaacuucugaacagagaugagauuuagcuacagcuuccucugacgggaucugcaguccugcagacucuaguuguccucacccaugucuaucaggaacgcuuccauccucgcauguucccguuaccagugacacugcgcugcccuacugggcauugucucucaccucguuuguuuaagaguauugauuuuuuuucccccaaaaucaguagaaucccaauuuuuaguuacauccacacacuacuaccagguuaagccucuccaaauauggguuagguccuguucuucacuaccucaaaaauaaauuaagacuaucuuccuuaaacagucagagaucugaguguuagcaucccaaguagauuuuucuuccacacccaguuuuucagucuuaccuauuuucucaaacaucauccaauaccucucucugcuuuaguccaugugagugucagucuggacugcccuucucccagccuccgcuguagaaauccucgcugcaccucuguaaagccucagaguuggaggcaacuuacuuaaaacaaauauacuuugaggugauguuauugcuuauauuuuauuauauaacauguuauccucagagucccuugaaaauaacacucccaucauuuggugaauuuagaauggcucuuuucauuuuagguugaaaauuucuucuguaugggaucuccgcuagcaguuuuuuuggcauuacgcggcauccgaccaggaaauucuggaagucaagaccacauuuuaccuagagagaucuguaaccgcuuacuaaauauuuuucauccuacggacccaguggugaguuucagcauuagcauggcugcucugggagaaaucuugccagggacucugaauuaacaagggaauuuauuaucuggcucauugggaaagguuauaucuuaauauuugcucauucagaguucaugaaauaaaauguuaagagaggaucuucuauuguacugguaacaucagagacuggagagaugacgcaguuguuaagagcacuugcugugcuugcauaggcccuggguuugguccccgucguccauaucagaugacuuaaguccaaccucaguggaggccgugcaugcgcauggugcacagccacauaaagcaaccucugauuaaacaauacauugugaaauaauaucccuggucagcgcuacaggagacaaacaucugcuuuacgcacuguaagcaauucuaauuuugauggccuaggaacagguaagucuuaccugcuuuagaggcuggcaagagaaggugggaaaggcgcuugccaccacaccugucaacuugagauuacuccccagcacccacgugaugaaagaaggaaagcagcucccaaaaguugaucuuugucacccauguguuauaguacacaaacacaaaaauaaauaaauaagacaauauaguuaaaauguccugcuuuaaguaauguuuuucaaaagcaugcuauaaaauugagaugagucuggcagauucucuuaaaccaaaaacaagaaaggaggugaagucguguauuuaguugaguggaaguguaaaguacucaagcuuuucaauuuucugcuaauuuugugucuaaauguaaacacuuggagaucuaauccagguguaaauagcgagagcugagaggacguucauagacaagacacaggcuagaguacggcucaguggccaaaugcuugccuagcuugcaggaggagugugguuccacaccacacagagugaagacguuuguguacaucguuagggagaaugguuaguacagcacacacacacacucacacacaguaaaaggauuuuaaauaucugaaguuagcuuuuauuuuacaaagucacauguguguaaacuuacagccaccucuuguaagcgaagcugaggcgcugaaagcaccgggaugauagccuacauguguuagaggcucagaugcagacugcaggccuggcagucccuucagagacuagcauggccguauguuuuacuccaagcaugaauucugucuucuuugugcaucucacauuuagcuuuucuauguuuggugcugggauuugaacccaucuucacauguucugagugugcauccugccagucugcuuuuuccuaaugcuuucuuaaugcuugugcagaccugcucucuucuuccuauaagagagcgccgagaucuuugugacguauuaaauggcagugaauugcuaacagcagugagaaucugcacuacggauucucaguaaacaccacacuaacgagcgacuugcuggacagcaaccuuuccuuggcuuucaaguuaggcucuuauuggagucacguguuugaccuuauuuacuaaggucugggcuguccuccacuucagcuuugugagucugaccuuauaacaagacucauucuuuucuuuuuuuuaagauuuacuuauuuauuuuuauguagcuguacagaugguugugacccuucuugugguuguugggaauugaauucaggaccuuugcucacuccugucuaaagauuuauuuauuauuauaaauaaauacacuguagcugucuucagaugcucaagaggaaggcgucagaucucauuacgggugguugugagucaccaugugguugcugggauuugaacucaggacuuucagaagagcagugagugugcucuuacccgcugagcuaucucaccagcccaacaagacucauucuuguuugaucagaauacagugaaaccgucuuucuaugaaaacaaauuaauagacaaagauaacucauuuuuuuuauuacuguucuuuuggguuuuuaauaaucucacuauuagggacguguaauuacacaaccucacauaguaacagugaaaaauguuuuucagauaaccauuuuuuaaaaauucuuucucacuuuagaauaaacauuuuacuaaaauccaggaauugugaauuaaggucauguuucuuugcauucuuaaaaaucuaggccuacagauuagaaccguugauuuugaaacacuacagcaacauuucuccaguccagauccacugguacaacacuucaaacccucuaccuuaugagcauaugaagccaaauuuucucaacccagcaaaagaaccuaccucaguuucagacagugagaacauagcagcuaucccaagcccugugaccucccccgucuuaucucggcgccacuauggagaaucuauaacuaacauuggcaaagcaagcauauuggguaauucucucauuucuuaccuaugaauguaaguacuuuauguguaaguauuaaguugguuggaaaugcacuguuagaaaucuuccaccuguccaucuccugaauuagcgucuuugcugacugaagcagaugcucugacauccucugacuagauugaagaaaggacggggcuuucugcugcuccuuauaaucuuggcucugugacuugcugagggagccuuuaaaaugcuguuguuuuuauugcucuugugcauucugggggcaucaaggucucugauguccucucaaagugaaauuguuuaguccuuucgcuuccuaaggcaagagggauauuucaucucuccuugaguaacuuccugugccagcauagaaauuggguauuucaauugcauagcacuugaauguguccuuuguuucugagugaguguccuuuaucuaagugccacaagauggcacucuaaguaggccuuagcuaccaaacuuacuugcuauuugacaucaugcguaaagguuacuaauggcauuguauagcauacauuuaguaagacauauuccuauuaauagguagaugccccaugucaaccgcaugggucucuuguuagaaguuuuaaucuugccauaaaccucuguaacaaugaauauuugaauaaaauaacaccuggguugcuuuggcuauauguuccuguaucuguauuccuagaauuuauauuuuccuucuuuuaaacaucauucuuauuuagaaaccuacaguagaaauuggaauauuuuuagguccccacccugagaaagucccucagucagucggcugugauugcgggugcugcuccccagggugcugugagcggagucaguggagugauugccuuauucugugacaugcaggggcugcuagcauuggaaagggccuuggaggaauguuguucucaagauuuggacguucuucagcaucacagccgucugagccaucuaaagacucacuggaagaugauaagaagccuucagcuucacccucuaccaccaccguggcaacgcagacccugccgcacaguggcuccggcuuccucgacuccgcaugucaguccuacaguucuauccuugagcuuuugugccuuugucucuguagcuuuugaugggugggcggggagggcugggcgagcagggccaguaguggucccacucaagucugaagucguugaaaggaaagguaaugugaguuuuaagaauauuuucuaggcaaguguaguuuuaguaucugcguugacaaguugcuagauuauaaccaggacucucuggcacgagagucuaaauuaucaaguacaagacaagucucugggguaggcaacccuagcuuguacaaaguacauuuuuauuaauacgcucaccaagguuuaaguuuccagucacucuagauguguccucugucugacacacugcucuguccugcagcuaaccacacacuccuaugcagcuuucugagcccuccaaggcugaggcauucucuugggccccacugugugucuucugucccugcccuguuaccaguagacaguagggagaccugugaguaggugcaugaagcauuaagguagaucucuuguuucccaguagacuuaagacuuuuuaaucuggcauaacuguaaagcacuggucugucggugaacuuaaagugccagguaauagcacagacacuuugugucuucccgucgaugauaaggagagacagacucugaagcagccgcuuccuuucuguagcuagcaagcgggaauggacuucuccaguccuuuuaacagacuccaccgcagcuaccaggagcaccguguucuuacugugucugccacccugaauucugaaacagccaucaaccagaaccggucuggguggcauccaagaggcugccccacuccuccacacacauaguccacuccaggguaacuaggcagcagggcuaggcguucuuaugugggccaacagcaucugucaguccuuuccagugcuaaaaaauguguuugcaagucauuagggccauguguaaacaauucuuuuuagauguugauauuuguauaaagcucauuuuucuucugaguucuuacacuguuuuuuuuuuauuuuuuaguuagaaacaugauuauaaauguauaaacuuuaguggcaugcagaaaucaaaauaguuaacuucugaaaacaguuauuuuggaggaauuuuguaagguggcacuaagaauuuacaguucuucauggucuugucagugcauggcagugaugcuggugaaugggagggugcacacuggggacagacacucccgggaacaguugagaccccagcaggagugaacacauacagugucugagcaaagaaaaccccgguccguucuguaugcugcuacaaauguaaagaucccucccucucucccucccucccuccgcagugggagcucagcugaacagaacucaccacacauguccccucagacccagacccagugugugcugugcaugcagccugcgguccugcugggcuacaccccagccgugcugugucauacuugcauguaaaugcucugccagucuucuuguuagauuucaccuguagucucgacaacaucugagauaucuaugagucuguuucauauagucagcucuaaagagauagacuaauguuagagucaggcccugacagugcgcgucugucuucagucacucugggucuggguuccugauucuuagacuugccucaguagaguuccuucuguguaauccugacuuuuaugccauaauugcugacuugcaauccugaaacucucucuuccuuaaaucucuguggacccuggcuguugugaugagguucuugggccuccuuccuccuccccuccucacacugagugccucagcuuucuggauagccuucaucugacgccacugucuuugagucucauugucugaggguaaagaggauacagacugaauccaugaucaauccuguuuucucugugaagaguaaguccugucagguguccuuuauuuucaucgacuugacacaucuugcacagcuauccuuaauuucuucugaaaagacaaggcuuaucuuaaagcauuuuaugguuucauuucuugugcuccugccggauuuuuuuuuaguuuguuuaggggaggguugguugguuguuuuuguuugguuugguuuuugcccuguagguuacaacgugaauuagcacugaguuugaggaguaucugagcuuauuaacagauucugacauuacacuugagaauugaacuguguccauauuuuccaugaaggagcucuugacagaagccuagaggugcgcuccuugugggcuaggcuuaaucagccuauuuggaaugugguucuuaacgauuggccacugcaacacugaaggccauuuguaacuaucagccuugccuuuacaccgcguauuguuuguuuuucuucacagauuucagacuucaagaaucguucuuuuaucucccacaacuucuuuuuccggaaaauguaaugcagaguaaagaugauagccucgguaugguauaugucaggaguggcacucagcacccugaaaugcucuccuuagaggucugcucagugagaaaugggaucagcucucugcgagcugcuucagugcuaccacagcagacuauguguguguucuugucuucaaugguagaguucaugcccacuucagaugcuaaaaaauagacuccuaccaaagagggacuugagagaagagagggcauuaggccugugucugucuucuauauuguccucaggccucaggcccacuguucuuuccacgucugugcuuagcauacaguucccugccacagagaaccgcaucacuuguacuggugaugucuaacaucagcaccuggacuggggucugcccuagcugacagcucauucuacacaaugcucaauguccuucauggggugaugagggcggggggggggauauuuuuaaauguagugauacuggugcaaagcuauucccagucuucauuuccaacauauccugaaucuaucaccaaggacuaaucuuaauaauuacuuuuccuacuaacuucuuauuucuucuaaauuuucuauauuuccucuuucguguuuuucuuauuaauagugaauucuaucuuugguguuaaaaaauguguucaggguuuucuuuguaauuuuacccaccuuuaaauuuuugugcaucuuuuucaguuaucaaaaaagauugcuuuguauaguuccgaaacagugguugaggauaacaagcuggcuccuuuugugccuccagagcagaguuuauaguagccaaucucagugaguuccccucaagaacuuaucuuauguaaggaucucuccaacugguagucauagacaaacaauuccacuaaaauaacucguguuaagcuagagaaacagcuuagccaguaaaauguuuaugagagagccugaguucaaaccucaaagcuuacuuuuuaaaaagcugggcacugcaguacacagcuguaaugucauugggguggagacgugggacugaaucccugcaccgcucuggccaggcuggcccagccaaugagauacacuguccaaccaagagacagcccugaaggacugccucccagagcugcggugcggccugagcauacgcgugcaucuguguuaaggcacggcugcucaggagcaaagggcuuuguguuuuguuuuuuuuaacagauuuuacauuuagguaucugaagcacagagaaagaaaggaaggugguuuuauuuucuccuucccccaugaucccagagggcuagagagaggaggagaguccaucucccucugcagucccagcaagucugggugugauaaugccaggacaacugguacacgugcaucagagccugcuuugaccaugggcauguuguacagccgaacccaguggugcugccguguaaaccucucccguagagauccugugagccacguggagagaggaugggacacaagcccacuccacucaccgcuggccucccucccucccuuccuuccuuccucccuuccuuccuuccuuccuucagagccagcaagacgugaggcggcugcacugagggcccagaggacguuggcuggggaaagcuggcuacccuagcacagguggagccagucuagguagcagcuaguguccccagaggugacaggcaugacaagagcacagaauagaguagauagcuccaugaugacagcagucauuuaggacaguaaucgcuuguuaacaacaaauuucaggaccuuaaagucaaaguggagccagauaaaucuuguaacaagaaagugucuuugacuuucaagcaguuugugcuggagagucuggacuagagcaguagaugccgcaggcagcguuggaaagugaauccucucgucaugugccugccucuucucuuuccuguacccugcuucaucuugacucuacuucaucaucuuugacuucaguuuucucaucuacauagucuggucuuugugggugacugccuacagaucucaugugaaggcccaugguguacaaaaauaagggguuagggcauuccaccuaaaugcacauggaucucagcgugucugacuuacuauggauuauuuugauucagugaaaacuuuagaguuagaagaacuuugcaaaaggugcugugucaguguucuauccaaauguuccauagccuugacauucuaucuucugugugccuucccuaagcagauacauagacaccuucacaaaccagacaggcagagcccagagguaacuacucuguguuuauauuucagacucucagaugcuacuaccacaaagcaagcccuguauauaauuagcauuaacacugcauuuauuuaaaauuacuuucuagaguagugcuauuauguauaacugccacuuuuuacuuuagacaucuuugauugacagugaucaaacagauaucagugucuaguagugacaugagauaggucuuguggaauaauaucauauggcucauggacaguuuuaaaagagacccugagaagcguaaugccacuuuaaaaagauuauguacuguacuuguguaugcaaguaaacuccauauguagaggacaaccuuguagaguuaguucucucacucaaccuuuauauggguuccaggaaucaaaguuaggucgcuaggccucugccaucccaccuggcccucagaccguccuuucccaaggguguuguuucugagggucuguuacauuuacccguugagauuugacagagccucaagcuguucauucucuccaauguugcaaggacuuuuuauagguuuuggaaaggcuuuaguggauucacacgauuguugagggcagcaaauuauagguaaagcccuuucccccacagcucuucccccaggguaacuuuuccagcuacacagugaauucuuuugaguucuucaaugucccgggcacaggcuagugcccacuuaauaaauacaaacuuggggaggggguguuuuuaagggauucagccuuauggggagaagaacgcuguugagcugcgaaguaauaauaauaguaauaauaauaaaauuugguuguugugaaacauacauauccucauguauucuguagggccucccuaacugaggagacauauacccacuuccccaggaauauaggaaauucuucaaggaaggcagauaagaaauagucaucuaagacuuaaauugagccuccuuuuuuuuaaacuccgaaaauauaccaagauagcaagcaaauuuauuugauuuucuuucuuuauuauucuuugcugacgugcacuaagggacaggcugcagaguagaucuggcuacuuuggcuuuccuacugccccaaaaacuuagagugaagaauguggcagccuaagucacuucccuuggcuagacucuucuccacugucuccggccugcauuaaacacgugguaaccaacacuuaccucuugucuuuacaguggaacuggaacacaggaucgacuuugaacucagagaaggccuuguggagagccgcuauuggucagccgucacgucgcacacugccuauuggucauccuuggaugucgcucuuuuucuuuuaacauucauguacaaacacgagcaugauaccgaggccaagcccagccuagguucacucugaacucuugaaggacgugaaugcccaaagcuuuucuguuaaacaugugucaagaugcagagacuucaagguuccaguuuuguuaagggcaagaacuauuuuaauuuaaaagcacuuuauuuuauuuuuaaaagagaaaaaaaccacauguucaguucuaaaggaguuauuuauguuucugucguuuugauucugucuggcagagcccugcaaagaaucaccagaguagaaguguggugggcuuaggagaacugcaugaaggcagccaucacaguccaggucuccagaggagccuaauguagcguuuuaaccaaaaggcgucacagcacuaacagcccuaaguccaguacacucugcauagacuacaagguggcaucaugguuucuugauucugugaaggcuuccguguccgcaguuccuuugaaagaagaguauaacaaauuuuaaauguucuaaauuuaacuuguuuugaaaaacuaaugcuaaaaagcaauauuugaacuacugcacuuauaauuuauaaucucuacuuauucagcauaugaaacauuuuuaauauuucuuuuaagccacacuuauuuuguaucauguugaggccccuuuuucucaaaacuccaucuuuguaaaugagcagaugauccugugacguacuuucaggguuuuuuuguuuguuuguuuugguuugguuuuuucuuuuuguuuuuuuuguuguuguuuuauuuuuguuuucuuuucuuuuucauuaaaaacaugguuucacacagcacuaguucaauuauuuuuuuaauuuuuuauuaugucacauauacuucaaagaaaguuaaauguuuucagcacagagacuccacucuguauguauugcauuagcuguauuagaaaauuaagaaacagcuuugggcuagagaauaugauaacuugaaauauauaaccgucugugugccaaacagcuaacacaugugugggagcaggaugcauuuacuguguacagugcuaaccagagcauggugacucggacacagaaaauggauggacgcugagguacugggggggucugagcuguagauauuuuccaccaugcuuuucaucugugaugugcauccagcaacccccguguguaugcuuccugagguaagugugcacguuaccauguguuaccaugucacauguucauacacugaggcaccaguuucucaagugccuugcauuagaucacacagcaaauggagagaguguggcuuaaagccagaccauauucuuuccugugcuguuuaauggugucacucaccagugaccuugagaagccugcagauguuaguagguuagaagauggccauaaagcccaguguuaccuagcagaugcagucgagauucuuacacucagaagaggaguuaacaucaaaggaacaggagccgauccugcuguagccaacacucgcaucugguggcucucccuagguucacucaaggugcugucuuucuugugugugggaaacuugguagcuucuggcagucacugucacugcugggagcagagcuggucagcccacgugucccuugcucuuuucucuguaggguggcagagccugugacuuuuuuguggguguuacuccuuguccucgcuguugccugcuccucagcugucauugaauuugugcaauagacagcacuucuuucuagggcuuaagaauuccaaggcuguguggcucacuaaaaaccuuuguucuacaggcugaaucuuagccgugcuaaagcgacaucuuugaguuuagagguuccugucaacucaggucagcuucagagccuauuucuuagcaggucucgucuaacucucaggaaaauuaagcccgugucauauggcugucauuaaagguaguugagaauauguuguugaauaucaacugaaaggagaaguuugccccugcaagcaaaggagugugcccacuuucuuuccucacaccgcaaagucagguuucacugcuugcguuuuugucggcucuugggaagagcagcguucaaaccacucugucaaugggaagcagauguucugcaccucuggacagcugcuuucaguucauguucucaucaauaccaguggcaguuuuggucauagagcucuugucuccccgucucugcauguaaucaugggaugugcuuguauacacuaaaguaauauacagaguauguguaauuuugaugauuuagaagauaagucaguuaccaaguaacaguuggcgauuuuauuccagcaaguacugaaucgacccccaaaaguccugauuuugauacuauuaaaauucuauucucucccuguguccaugcugagucucuugaguccugaucacacaaacuuuaacccaauuagguuggauaaagagacuauuuggagcuaaaucuuaguauuccuuuaacauuggccuuucugaagccuuuuacuccuaacuuuuucagcagugauugcccuuuuugguacacuuuucucauaauccaauauaacuauuauaggacauaauuacaaaauaauacugacuuucuaagucuugagaaucuuagccuuuauaccagaaaguuagcuuuugugcuuacuucaaagaucucagacccaaaaacucucaucagucucugccuccaugcuguggccucccugaccuguaaagcaaauggggcacggggcuaugcaccuguaaucccagcacaugggaagccgagguggaaggguugcccuaggcuuaaggcugcuuuaagcaguagacuuggaacucaacugguagaguaauuugccaaacaugcaugaaauguauuggauuuaauacccaccagcacaugaaccuggaauacaccuguagucccagcccuugggagguuacauagugaguaugugguagguagugugcuauacauacaugaguagacagcuaggaaagaaaucaugggacacguguggcucagugguuaaagacagccaagcccaguggccugaguucaauucccagaaccccacaugguagaaggagagcucugacuccuguagacuacccucgguccccuacacacugccauaguaugcacccgcccucacacauagaaagcacccuuagaaugagugcagugucagcaacugcgacacuauccuuccagcaguggccccugaaccccuccaaguggagucagacuaaaccgguuuuauuagcagaccugucaaacaaagaugaguaguugaccauccucgucgguuacgguuuccuuggauucuaaugaacaaggcaucuaagacuuugagaaagugaccgaaagucuuuaaaauguuuuugaaucuuacacuaguuacggaaacaggccaagaucuaugaggaaucaguggccaaggcagagcugaacagauaauguaccaauagugucuagaaaaaaaagaaacuaccaaaccgaguguggaccgcuguggucuguuuauucuccuuucgcaccccuaccccgcugcuacccaggccccaggcuucugccaagagcugguugcucaggcugaaucugaaccaugacgcucaagucacuccuuaccccuauggugcuggcgccugcuaaauggacacggcccugagggaaacuuagcccugcagugguaaugaccugagauacgcucuuucucggucuucagugaauauuuccaaagaacccucaaauuguguagauucuguauuuuuuuagauuuauuuuauauuuacaaauauuaccugcauugcauauccaaaaucacauguauguccggugccaacagaucagaagagggggcugguuucccuggaacuggaguuacagguggugugaaccaccauguaagagcccccagugcuuugccaucucuccaacccugaaacuguaucgcguuuauagaguccucugguccaacccuguuuuaguuucacauagcaguaaaggucauggaaacaggggcuccaggcuuaacagggaacugacuucacagugacuggggacauaguggggucuccaagggaagacugaucaaguuugaaagccagagcaguaguuuuaccaagcauggucugcagauauuaauaggucaugccagaaaauaagugagacauggcaaauuuagacguuccuucaagccaagcauaaugguacaugccuuucaccccagcacuaggaaggcagagacagguacaauuaaugugaguucaaagccaaucuagucuacauagaguuuccggccaagucugcacacugagacuuugucucaaaaaaaaaaaaaagaaaaagaaaaagcuuugcagggggauguagggaauuggcuguauucggugccuuuucaccaucagccagugcuguugggaggggugcaaacuuagcuaagaaggcaagcuucuauuagggaguccugagcacccuucacuccugccgcuuccccccucaucuggucccuuccucuuacaaggcugugcuuccacccugcucaagucacugccuccuggccugucuuguaccacacagccuguuucaaaaauuaacaggaaauuccuaaggguagaaaguggcuuuggggugggggauacauauccaugcaccccucuuagggugaccaguggcaggcugaacuacccauaacuugugucuagaguuaucucucucacuccuucaggcuucauaaagagucugagcagaucuaaacugacguccuugcaugucugagacucaugauagcaagagacaggagacacaaaaacccaggaaaacaguuuaccuuucugaugacacaugugaaugugguuaggaaggaaaugaaugugacacgauugguguuugucucucaguccucaucucgugugugauagcagcaaggucguuccugaaauuuccaguguaaguuaauucaugcaacuuaaguauggugggguuuuuagagaccaggagaagcacuuuugcugaaugucuguaugcucccccaaaauagccucuugcuagauuggauagcaugaacucucccuccgccuuuguuugaacagggugguuccaugcuuaggauugucucuuaccuucuguauuuccauuuauaugugacagagugcagcuuccuccccacccugaucccagggcauguugggaaauaucccauaggaugaugauuacaacuggccagaauucuguuggaguaaaauuuaaaaaaaaaaaaaaaaaaaaaaaaaaaaggugugcuaagcccagggaggacuaaauucagggccuucugcuggcacaaaugacugcaggugccauacauagcauggcauggaguuuacaccgagccugagcaucugugcacacugaccuaccuagguuacuuggaaucuauaauguaagggacauuuuuggcaaagagcuguauuuaagaaacaauggggaaagccuguuaauguucagugcuggugcauuguucuuuccgauucugcccucacuugcuuggauccacacgacugcaggugaccaaguauuaguacaucgccuuagugcuguuuccuugaagacauggaauagcuaggaguaccacucaaacuucccuuggugaugaccacacccucuccuaucaucuugaccuuuaaaaauauuaacugaccccaccaaacuucaugaacguguaaccauguuguucuggucugagcucagucugccauaguaaacccacucugcucugcugugagaguccaaaggggcucuccuuucccuugacucccguuguuauuagacaaggcaagugcauuuucucagauccuuugauuuuguugaagcauccacgauuccuguuuuaucucugcggugaucagcuugaacggcaaaaaccuuaaaacacuuaugcuaacauuguccaguuccaacguucucaauccgaauuuagucaauauguuuuugauaauugaaggguaguggagccugucugcucacaagcuguggccaccacauccuucauucugcuagaaacuggccacuguauuccuuggcaccagagccaaggaaguccacauauaacacauucagaccuuacagugcagaacacucacagcuucaaagauaauaguucucaagucuaaagcuaaaccgcaaagccuggguggcuuuugucagcuuaacacagcuacuaaagucauugggaagagggaaccucaauugagaaaaugccaucuaauugaccuacaggcaaaucugugggcuuguuuuguugauugauugauugauugauugauugauugauugauugauugauugaugauuuggaaggggaagccuagacagagucaccccugggaaguggucccaggaauuauuaaaagguagaugaacuugagcauaagagcaagccaguaagcaguguuccuccauggccucuacuuaagauccugccuugagucccuacccugaauucccuucgugauuauaucuguaggauaaaauaaacccuuucuuucccaaguuucuuuuguuuacgauguuuaucauagcaauagaaaccuaaggcacuuuuauagcuuguuugcaauggauucuauuaaggaaaauuaggaaauucacuggauuugaggaugcucucugccuggaugccacguaccuucugccuacacuauuguaaugguuucuucuugcugauggucuugccucaccugucauuaacgacuccugaucgguacuuaccauuuagagccugugguaucuccaucacgguaggaauagaaaaggagugaucaaagaccuggcagccuucucuguccucuacucaggaagucuauuucacgaauuuggcaacaugcucaaccugcaacaaaccagugacgucagcaggucgaaccacuaucucacucacagcucauuuuuaucuguuuucuagccaaauuguggagccuugucugucuugacgauuaaauauuccauaugccuuuaauuuacuuagcgcuugcucccaaaguuuugccuuggccuuuguccuacuucuugguuguaccaaacaagagaagcauucauuaaacacuacacuguccacauucuugugugcuuucggguuuagaacacaaggucuuuuuguugcagaaaaaaggggggaguuaaggaauguucuuaagcaugggauagcagaagacacguuaccuuggaaugucuaccacacuacuauacauuuuuaaaguuccaauuagcucuuaacugcgcguguuucugagaaaguguucuggaacaagauggugaauacaauaauuguuuuggaauugucauccaaaaauacccucaguugugugucaaaacauaccugaguccuaaauaguucaguaacuagggcaggcucuccacucuuccuuggugggaccaggugaugguggaaggcacccagcuuaucaaguuuuggcugaccuuuuuggaguggccauuugccagagguauaaaagauaacuuuucgccauucgacgguuacagauaaggagccuccggcuggaacuccggugugcccagguaugcaacuuucgccuccagaccuuccuguucugcagucaaccgacaagcucccguucuuccucggacccgcuugugaagccgccugagcaccagcccaaagagaacucacaacugcaguguaugucugacgagcagaauccugaaaucuuugggcacacagaggccagugaaaccagugucacuuucaaaaguuaccgacucaaguacuauggucagcaaauuuccaggcaugaccagacucgcugcaaaaccaaaaugaguauca

SEQ ID NO: 7395 - RNA, 2695 nt, Mus musculus
uagaaaaauaaguaaaaaaacacauauauugaaugaaguccuauauauucagaaauagacaucggcuacaguuuuguucugaguuuuuaagcauauuagucauaauucauaauuaugauucauagcuccauaaaaugaaauaauuguuuccugguggugguuuuuaauguguuaacaaggauaugaagcauuauucauugcaaagggaaaugcuacuuuuuuuccuugaaauuuuagauacauuguuuuguauagucuuaucuguaauuucucagaguaaucacguuuuuucuguccaacacgggggaggggagagggcugggagagagaccuuccuaagccauaguaauguagacauagguuacuagacaaaugauuugacgagguuugucucuguuucaaaaacauaacagaaagauauuaaaauauauauacuguaguaagaauguaguaagaaggggcuggagagauggcucaaugguuaagacuucuuccagagguccugagcucaauucccagcaaucacaugguggcucacgaccaucuguaaugggauccaauucucuuuucugaugugucugaagacagcuacaguguacucauaugcauaaaauaaauaauuauuuuuuuaaaaagaauguaguaagauacaauguaucaaagcaaauauuuugacauaagaaugaaaaaggaacauguaaauaacccauuguacagcuauccauacauuaacagcuauccauacaguaacaguuauccauacauuaacaguuaagaaggguagacuuacuggcucagaaacuugaaaauggcaagcuauaaaacaguaaccuacgauuuuauuguuacaauaaaacaacugcacaguauauauguaaauuuauacacauacauauauaacauacauguuacauacauagucaagaguauuucuacaccuuucuuuuuguagauguagaucacuguaaaauucugaaagaaucauuuccaaaaguacccacauucuuauucuggauauuggggaguaaguaaagguugacuuuagguuuuacauuauuugaaauuuauaugacaaacauacacuguaugguauuuguaucauuaaaauagcuuucaaaauaaguaaagccaaaugaaauauaauauuuuaaaauacgauuuaagccuauauguuuuaaagaucgauuuucuugaagaagucuccugauaugaccaugagaauaagcauauuugaauaaaauuauuaucaacagauaucauaaaaaucccauguacacugcaaacagaugcaaggucugugaccugugcacuuggacucaacauccagcacagggcugauauacuugccuuucuuuguaaagguggguauuauuaaaugcaaagugagacagcauacauggacccuuuggugguggcucccgugacugucaucugucauaguugguagcaggcacaucaugcaaagggagucuuuccuauguugcaacauuuuucugcuuuagcccuugauuuuccucugucugaaguccuacagaguagagccaacgguccucagcugauaaaggaccuugcuuguuuucauuucacuccagccuugugauuucuuaguugcaaaaccgucuucucagaacucuuggccaauccccauggaggucaggggaaggaacccaacuucucuguccuggaagggccugaaaaagcccacacacacacccuuuuuuuuuuuucuagagcuguucacaaguucuuuuuuguuccuucuuuuuggaaaggccaugggcaugaauuucagcucacagggaguccuuguuguaagucugcacucugcacaauucaauacuauggagcguccuggugcccuugucccuguccaugggguucugggaacuaaacuuuagcacauuuuucaguaagcuuagggauauuccuuaggggaccuauaguucuuuggaccauacaaauuuaucaaauaucaugaaagccccauuagaucaaaaucaauguuaauuggguaaguccaacuuucugggaguuuucuaaguugauaacuuaguaacucuaagccagaaaggugaacucugaaauucauuauuauuugaaagaaggauaaauaugcaauuagaacgugcuuguuaggguuaauuuugcugugaugaaacaccaggaccagaagcaaugugggaaggaaagggcuuauuugacuuacacuagcuugugugaagcugacauaaaauuagccagcacaacugacuucuugucaacuuggcacacaaacauaucacucuuaagcuacaaccuuuccuuuauuguuuaucccaaagaucacacauuaauauaaacauccuaagauaaacauuuuacggacuuagaacaucuuuacaaauucaaauacuuaaaauucaaucuuuaaaaaaaaagucucuauuaaaauccaaaaaucucuucaaaaguucaaaguuguucaacuguggccuccuguaaaauaaaaaauaaguuaacuucuuccuuacuucaagagagaagaaccagggcauaguuacagucugaacaaagcaaccccacacgcuaacauuguaaauaacucgguguccaaauucugggauucacucaccaucuucugggcuucuccaaggggcuugggucacuucuccagcuccaucccgugcagcacacacagcuugccaucuaggcucca

SEQ ID NO: 7396 - RNA, 5047 nt, Mus musculus
cucacacugugaguuugcagugacagaguuccuugcagaucugacgagauguccugcugggugaagcugaauggcugagacagggccaggugcuugcaguacuguaacacaaaggcaccacagucacugucauuauucugccuggccacauucauuuugaaauaaccuuuccagcccugauggaaguccacuuggccuuuuuuugacugccucugccuguagauacuugacaauauacuuagggcagcggcgauuuagaguucgcugggagucaaaauaggugaugguauguugccuuacaucaacugagauaagggaccaguccacuuccagauggauggggauuagcaguaauuccuuauugaagauguccacauuuuugguccaccucuuuaccccaucauaacccuugguacggaguuuaucauagaagagacuguggaagaaaugcaccuuuucagggacuguguccaugaccaggucuccauacauguucaucaccuggucauugagccaguucuguccauauaagguacccaagucauccauggugagcacgugucacuuauaggauacccggaagccccuuaccauagcguugucuggcauccgcugauaagacuggaucagcuguaguaccagacucuuccaugaggguguagagaacuccugcuggaaaacguccuccaacuucucuacaacuucaucagugcugagagggaugaggcugccguaaguuugaaggaauucaucuaagauacucugcacacaggucacauguuccucccgaagggggcuaugcuggccaguuuucuccccaguccgaucugccucuucugcagugcccaagucagagcucugaaaaaguuccugagccacguggucuccaaugcugcacacauuacugaugaguaugcuggcaucagggggugccaggcugcgcuccccuucaggaccagacagacccccaaaaucauuagguagaguacaugagaggaggcccaagucaggguccagaggagacuuugggguccaccuuaguccaucuuccuccauggggggcccagagggcacuggugaagacccucucaucccauccucugccaugagagcaccuagcagacccagccgggguggggguagccccuggggaagucaaaaccacagcagggugauggcaccuguggcguugcacccccuuccuggggugagagcugguucuuggggugugcgagguuccgccaccggccuuggucgcgcccccaaagcuuccaguggaaugucagcgaggugcuuuuugaguagagcagcaucuggaaggcucucguggcucggcgccggcgccgccgcugugagcacuaacucaguuccuucucuacugaguuucagaauguuuuagucaccauuuuaugcauccagccucccuggucaagugagguuguuuuagggauaagcacgggacccugaacuucuucagccucgucugauguaagcacgggcuucacuaggguccucagaccguauuuggguucugugagcagacaccgagaguuccaguucuuuuaugcucaaacaagaaacugaacggagacgcgcaguuacugcagaagcagagaagguguauuaagagauaauacaugcccguuucaggcaggaaggcagggaugagagauggacuggagaaaagagagaauuuagcacagaguugagaauuaugucacugagcaccaaggggcuuuggagacucauuugcaugacaugagauuguggacucauuugcauagauugcuaugucuuauccuugugugcuguuacguagaguucugcggucaccucuggacacccuagugcaagugugcuuuggucagauugaagggggauguucaagucuuccucuuggcugccuucugucuucacaugcuaauuuuguaaggcuugcaccaaacuuucuggcccucccucuccucacucuuccuccucgguuuuauuaaaaacaaaagcaaaaguuaacucuguuugcacauucacugaaaaccguaggaguucuuuggagauuaauauugauuuucaagauuuacuuccuagacaaauaccucuaaaaagcaaaucauagcuggccuaugaagccauaugcucugguucuaauuuccccguucuagcaacaugcagacuaaaacagcacacacacacacaaaaugcuuuacucaaauaauaaaagauauuguuaugaguugcccuucauauauaaacccauuuauuacccggggaauacuuuacgacaagugagauuuaaagauaggaaagaagagaggauggaguuuaagcucucccuuuguguucuccaaucggcaaggacuuccuaagcuggguuuccaaagccagccagucauagaaagcacauccuccugcuagccgccgccgccagcuugcuggggaaacaugguucuuauuuaaugacaucuaaagugauacacgcuccuggguaaguagaacaaaaaaccacaauguuuuauccagaugaaauuacugaagaaugagguuuggugauuaaucaaagucgauuuggggccaagcaaccaagguucugaucucuaaagggccagaaggagcugcugggcugagcagggcagauugagaccuccauacguuagaaaaaaaaaagaaagaaagaaagaaagaaaagaaaagaaaagaaaagaaaagaaaagaaaagaaaagaaaagaaaagaaaagaaaagaaaagaaaagaaaagaaaagaaaagaaaagaaaagaaaaaaggauucuccccauaguggcugcagccaccaacacugcagaacuggcauaagucuggcuccaaagaaaggccagcagguugaaucacuaaaucuucacauaucugauuucauauauguuuucagagacugaagugaugucuauaugaauauucacagauugacuuaaaggaagaaucaagaccauuuugaaaauagcaaggugcugaugauaauacuugaugcuauugaaucuauagcuauauaacugaaugcacacacagguugagcccuguauguggcucuagccaugaauuucccuucuaguggcuggccugccaccgugcuaauuucgcucaauacccuuucuuaguuuagaauguaguuuuaagcaacuugcaaauguaaacucaagcaucuccaagagaccacuuuuauacaauuaaauccacuggaucuccccccccccucccuugaccuagcaguuuccaagugugaacacagaaugguucucagcuuuuggcaggaagaccacgcauguucagcuccugguuccuuucugguuucuuggacuuggcuuauugcaauuaaucucuucucuaaaacucuccuaaguccucuuccuagcaacaacauaccuuuuuguuccugcuucucccucauauuuguccucuauuggagaacagagaacuguugccaaacugaaccuacagagaugugccaugagcuccauucaccccagauugagcgcgaacaacagaccaaaggaugacgucagaguccaacucaggaagccaaugagcugacuuacagagcaugggugaacuuauguuauggaacaggaguuacaggagcucaggugaccccccaaagaagccauaccaccgaaaacuaucaccccagugugcauaaugacuuccucauagcuacauagaaaguguccaguucccauuucgguuaccuuauaccauacucuaucacuuccugggaccaugagagauuagggccaaagcuuuaggcagaacuagauucaguuggagggauguguaggaaggagagugggugacccuccccaucccuucccuaaugauggagcaucagcaggccugauuuugagguucucuuauaaaauaucacaacugcucugaugacaauggcaaucaguaguccuuaugcucagaggauaauguuuuagaaggaagucauccuguacuucagugauuaacaucaacagucaaaguccaacuuaaagcccccagcagggagcuucugaggcuugcucaacagugggccuuuuccugucgagccacggcugcuguugcuacugcuucauccucccccccuccucccccuccucccccuccuccucuuccugcugcugaugauucuucuccuccucuucuuuuccuuccuccucuucuuuuccuuccucuucuuccuucuccuccuuccucccccuccuccucuucuucccccucauccuccucagacagacagacaaaaugcucuguguguggcuuuuccccucccaggccaaagcaguucuccaaauguuguaucugcagggcacaaucauugcuuuaaucuaagugcaucuccaccguauuuuaauuuucuucaaggaugaauccuggcuuaggacuuggaaaaucugguuucuaguucugcuaaaaagaaaacacuuaaccuugccucuuuuccaaguagggaauaaaagggcuccugucacaguuaccuccgaauagugaccaucagcauugaugucucuaauauauuugaaagugcauaugaguguguggaauuauguaaauaaaauauaaagacagacaggcagauucaaagacuucaaaaguaugaauugacucauccuaaggaguaaaucuuccacccuaccuuaccugcaaaccaccaaaucagucauauucaaauuccaagucccuuuuagugcuacucaaaacauuaaguguauugcccuaaaaagauaaacacugguaaugggucuuugaaguaggaacugguuuugcuggcuuucucuccauccuguccccuucaaagucaucaaagcaacuuucuaaaagugugaaugucuuacaaguagcuucuaauggacucgcccuucacucugcuccucacuaaucagagguaaccugacuuuuacauuccuaauuaugccuccuucagagagcacuaagacuaacauugguuuuaaaugguccuaaugcauccuugcuuuuaaccaggcugcucugagccucgcacauccugaugguagcacaguccccagaacgcaug

SEQ ID NO: 7397 - RNA, 968 nt, Mus musculus
guucuuuuuuuuuuuuuuuuuuuuuuaugcuuaccaugcaacaaaaccuuuauuaacauuuuuaacagagguucagcuauuauugaaacuuguaauuucuaaacuuaaauuggggcaaguggcuagagugcagaguaaugccaucacugcccacugggaaugcagaccgaauaauuaauagccaccccucagacggaggaccaggugcagggucgacucuuucuggauguuguaaucagagagagugcggccaucuucuagcugcuugccggcaaagaucagccucugcuggucaggggggaugcccucuuuauccuggaucuuggccuucacguucucgauggugucacugggcuccaccuccagggugauggucuugccagucagggucuucacgaagaucugcaugccaccccucagacggaggaccaggugcaggguugacucuuucuggauguuguaaucagagagggugcggccaucuuccagcugcuugccggcaaagaucagccucugcuggucaggggggaugcccucuuuauccuggaucuuggccuucacguucucgauggugucacugggcuccaccuccagggugauggucuugccggucagggucuucacgaagaucugcaugccaccccucagacggaggaccaggugcaggguugacuccuucuggauguuguaaucagagagggugcggccaucuuccagcugcuugccggcaaagaucagccucugcuggucaggggggaugcccucuuuauccuggaucuuggccuucacguucucgauggugucacugggcuccaccucuagggugauggucuugccggucagggucuucacgaagaucugcauuuugaccuguuaacaaaugugaugaaagcacaaaccgcccagcgcgucgaaacacccucacagaaagaccgccgaaccggacaaagccucucgucacucgaguu

SEQ ID NO: 7398 - RNA, 965 nt, Mus musculus
guucuuuuuuuuuuuuuuuuuuuuuuaugcuuaccaugcaacaaaaccuuuauuaacauuuuuaacagagguucagcuauuauugaaacuuguaauuucuaaacuuaaauuggggcaaguggcuagagugcagaguaaugccaucacugcccacugggaaugcagaccgaauaauuaauagccaccccucagacggaggaccaggugcagggucgacucuuucuggauguuguaaucagagagagugcggccaucuucuagcugcuugccggcaaagaucagccucugcuggucaggggggaugcccucuuuauccuggaucuuggccuucacguucucgauggugucacugggcuccaccuccagggugauggucuugccagucagggucuucacgaagaucugcaugccaccccucagacggaggaccaggugcaggguugacucuuucuggauguuguaaucagagagggugcggccaucuuccagcugcuugccggcaaagaucagccucugcuggucaggggggaugcccucuuuauccuggaucuuggccuucacguucucgauggugucacugggcuccaccuccagggugauggucuugccggucagggucuucacgaagaucugcaugccaccccucagacggaggaccaggugcaggguugacuccuucuggauguuguaaucagagagggugcggccaucuuccagcugcuugccggcaaagaucagccucugcuggucaggggggaugcccucuuuauccuggaucuuggccuucacguucucgauggugucacugggcuccaccucuagggugauggucuugccggucagggucuucacgaagaucugcauuuugaccuguuaacaaaugugaugaaagcacaaaccgcccagcgcgucgaaacacccucacagaaagaccgccgaaccggacaaagccucucgucacucga

SEQ ID NO: 7399 - RNA, 1936 nt, Mus musculus
ggagucacguggacccagaggccccgccccacucaccgaagagcccgcccgccccuccuccauccucccaccccggcuggguccagccccugcgagcgaggccaaccuccgcgcccgcagcuggagccccagccgucugggaguuguccccgccugcucugaggaacucucggcgggacaccagccacuggcgcggcucucggucguagucgcugcacgcaggggacguggggcacgucucuaccugcggcgcgcagugcaaugcaucuggccagguucggggacggguuaucugaagccugaggaucagggugcacuugaagacgcgucucuuuacagcgccgacaaagcuuaagugcagccgagagaggaaccgaaaagacaguuuaccaaagccucacgacagcguuccaugaaaaggaaagcgcauagggacccuccaagggcgcgcgcgcgcgcgcgcgcacacacacacacacacacacacacacacacacacacacacacgcaaacacacucgcacacuccagcacuuccuccacagggucuccgagaggccaaauaaugcuucuagcgacaggcagccgaccccuagcggaucuaacuuccagccagaagacucugaccccgucgccaacucaguccgccgcgggggugucgggguuugagcggugugggaaaguuagaaggagcggcuucugaaguacugucuaguagccccgccagaguccccgcaccgugucugccaaccucagcguccgcuccagccaagcagauccuucagaaaccggucggcggugccauucaaggcagagggggugggcggggggugggggguggacgucugagcuucuaacuccggacagauuccaaaacaggcgucgccaaagaaagagcgcaucacauuuuuuuucagaucucagaguugcaaaggcuuuacaacuccuacccggcacggaaaggagaccccaagcgcgaucccaagcgucuacaaacccgagaacagcuuucggccugcacucgaccucucccucuggcuuggcuuacuuuuuaaaccaccuccacccccaccgccacccccgcgcgcgccacuuccuucccccaccccuuuccuccuuuugcaccagcuacagaaucgcggcuaagauuccuccaagaaauucaccaacacaacucgggugggguugggggggggggugaccugacuauccuaagaugccuggccuguucuaaccucggaagcgcaacucuuguuccaacaggucuuugcacgggguccauccgaggaccggagucccaggacucccccgcuccagagcccgcuccaccccgccucuuugccucacuuaggaacucgacguguccagcugguuuucaaccuaaccucucccccccccccgcaccggccccaguuuucgaggcggggggcacuuucgggaaaccuuugagaaagaaguguaaaggauggagagucacguccuuccuggcggcgguggcugcccagcgccaucccacacugcugcccugggugcagagaccgcgggcgccccugagcgacaguccgcucucaccaccaucagcgcagcuuucugagacgauuucucuauuccccgaccagcgucgccgcugggaauaacugggaaagcgcuggaaagggcaaagggcuuauuguugauuuguuuauuugcuuuuaagggggaaagagauggcgauaugcuagcgacuggcgcacgcggagcgagggcaccguggaaccgccgacgcucaggauccccggacaauccugugccuuuggcgguguguggagcgcucucgacguuaaagcccaguaaauagacgaaggacuuguuucaauuucaacuucacaaggaucccuuucuaaucacuccuuucuucccugauuuuuuuuaauuaaaaaauacagaucaaaguaaau

SEQ ID NO: 7400 - RNA, 11131 nt, Mus musculus
aacaguguaccaggucugcugcccucugcugugauacaacaccgaauucaugacucaagcauuaggaggaucuguacagaacacuuauguucacgaugguggcagcacucgcagugugcuccaauacagacuaugcuggagaacuuggagacccuagaugugcucguuuauuugggaucuucauuaucuggacacagaucuugauagugaaucucuugaugauagauacgcagcuaauuuaucccggaauucaugaagauaguuauauugcugaaaaagaguaaagauauguugaauauaccgcagaaaaguaggaucaguguagacuccauacuuagcuaagagcaaauguuucugaaccuuuaauuggacuugggaaggggaggagaugcuggcugcgggaggcgugggaggggcagauucuguagacuccguccuuugcugcugggacuaagauucaaagugaaucugcuguccaguguggaagggccuaccuuucugcugguguuuuucccccacugaacacugaggagggcauucuuuguaacaacaaugacacagucuaagagugacuggugcuuuugaugacaguccauuuggaauaauuuucauaaaaaauuaaaaaaacaaaccacuauauagauaagcuaaguacuuuaagcaguuuauugaaguuuaaauaucuuuccaaaagauagcucugacagccaucauuccugauaaugaacuguacugcuagcuuuccuugggagagguggugagggccccuuagccacaaaauaccuagguaaugggcccaacacccauauuaguguggcuuccauucucggugacacggaagaugugacacauguauaauucauaccuaucugauuggauuuuguuugaaagaggaacuuccuaaauuugaagcauuugauguuaacagaauaaagggagcucuaguuucagagccuguguagagaagugcaucagguaagguuuauuuugugaguggcuauauuuaaaccuugagaggcggguugcuuggcugguaagggugaauguauaguaagucuugguacuugaagcuggacuagaccucuaaccccagggaggcagacucagagucaggcagccaagggugagggcuccugaguaccacucuggugacaaccuaaagcuuagacagagcaccuggcacaguaagacaugaacuuuagaggcgugcacaagcagugucaucagugggcuuggguaacaugauuugucacagccugugguacugcugcccuguugcucaaguguuuaggagaauggaagguauccaguauccauggcaacguacaauaaaguauugcucuacuguuuugacagcauucaucaacaucucagcggcacaguaggguguauaaauugcuugggauacaacuccacccaagaaaaauguuuauaguagccauuuccuggcugagucugagcaucagcauggguacugacugggacagaggcugaacaaucgcagaucccuaagaggguaaagugcagaauuuaauuguaaguagaaaagauaaaccuguguguguguacacguguguguguguguguguguacacguguguguguguguguguauacacgugugugugcaugugcaucacagcuuuggaaauugagcuuauggcucucuuacacccauugcauuguauuugaaagaggccaccaaugcagcagacagaacagcccaguucuuaccuugauggucuguaucgccccagauccucugacaucucgaaggcugucuauggcuugcuguggugagauugagucagacaaguauaggaggagacaagcagcuacugagaacaugacagaaaagaacggacuauuaagaaacuggcuugauuuuguugcagacuugauagucaguuggacuuccguugcagcaaacuccauccagugugagcacacggacugaaagauaaaagacugaggcccuuuauccugcacucccgaaaguuagccucgucuagccgcacagcugcuauaagcaguggcccacacauuucugugugaaugugugcucuguuucuccugggucuggagcuaggaguggaguuuugaggcaugguaacucuggagcugaggaaaagaagagcuuugcagagcaguugcacugugcugcauucccagcagcagcagcagcagcagcagcagcagcaacagcagcagcagcagcagcagcagcagcagcagcagcacagguuccugguucuagggcugcucacugauuuugcacaccacagccacccugcaggcugccauuguggggcaucgcuuuccgugcugucugccuguguauuuuggggacauguuuccucagauccuuugcucacuauuuaaaauugccacguuggucuauguauacugaguuguauauucccuuaucaaauacauggugugcaauuuuucuuuuccuauucuauauauggccuuucauuuugacaauguucuuucuuuuacaaagguuguuaauuuggaucuuguuuauacuguuuuauaauaauuacuacagugaggcauuucuuguuuuuuuuguuuuguuuuuuggcagcacucuuuaaaauuaacagacaguaaauaacuauacuucguugcuauuauuccuucuuuguuuggguuugguaaacuuauauugugguuuuucucuccucucuauauagcgugagguaagguccccaaacaggaguugccuacuuugaaguuaaacaguuaaugaaaauauauuucuuaccaagacaggaucuuccaaguccuccguaacaacugaaagggaaagagaguuuugaaguuuguuuauuuucguuuucucccaaguuacaacucaagacuuacucucucugccuucuguuuaccucuccaacucuggguacagcaccuugcacucagaucagcauugcugaguuaucaccagaagcaguacaugcucauucauguugucagguguucugaauuccucuaagggucaaagagggccuuagugacuacugaaccccaaacccuacaucugagaagcggaacaaguaggaaucaagacucuguccuuuugguaaaaucugaguaguucuggagcaagugccaacauacaaucauccuuccuuccccugaugcaagcacagagguagucacaaaggacugggcucggguccugacacuggccaagguccucgagcuugcuuucuuuuaucugugagaugguguuacuaauagaaccuguaucagagugagcguugcacguggcaguguuuauaaagggcucagaacacaggcuggagagagaaaccucugaaugcuaguggaaauggccuaccaccaaacaguucugcaaaacuacaccuuccaggaaaacaacgaucaaagcuggaaaacauuccuuuaaaucaccuucaaagauccucaaaagcauauuguagggaaauagggaaaagcccagccgucagccaccacuuaggggagccugacgcguucucccaauccaggaucacccauccgccgagcuuuucuguuuaagcaucagguaggaaguuuggcugcuggaaccugcuugggguagaauuuccugagccuuacuaaacucaacugccuugauaucugcaaagauacaaguugcuuuaggaucuuugaaaaacaaguuuagaaucuguuucaaaaaaugggccuaaacacucuuauuuuuuaaauagcuacaucugauacuauuuuacauauacuuacaaagaaauuauacacaguuguguauucugaaauuuugccuuuggguuaccucaugauggguaugcuguuuuuuaugggacucuaccaugcaaggcuuuuucaugggugcuggggucagccucaggcccucauaccucaguggcaagcacuuugccaacugaugcucuuaauagcccauugaagucauauuucaaaagaccacuuacugaauagggaauuuuuuuuucugugaauuuugaaagacaagcaagugacuuccuugcuacugaaaaggcugagaugacaaguuaagagacacgacagaccaggagcaaugccacaggaggaaaggagaaaugucucuacucuaaacacucgcagcucugcuuguggccaguaguacccuugaaguguggaagcaggaaguucaugagugcuuccuuccucggucccaggccugucgugcucuucucaugcauuggcuuuguccugacggcagaggagggagagcugcugugugguacccagggaagaacguacuguaucaggguuuuccgguuguuuuugaggcagguggccagcuccuccaugauuucccagcagcugccaaugucgggagucccuccaucugggaucggaugaugaugggugacaauuccauauuguugguagagguccagaagguuugggacucuauauuuugacagcuccccucuggugcagaaaacaaacacgucuuggaucccguagcucuuuaguucuucugccaacagaccaagacacacacagacgcgugcauaaaacaggacacauuuaaauacgaucaagagagagaauagggaguuauguucuucaaccaaacuaguaacaggugcaacuuuguaaaugugaaauaccuaaugaaaauaccuggaacaaaagcugauuagaacuaaaccagauugauuggugaguaaaaugcuuuuaagugauuggcugauguuauugauauuuuugcauaaaaacuuagguuuuuuuucccccuugcaauaaauacugucuuaacauuuaaacucuugagaaggaauagauagcaucauuuuuaagucucuccuagcccuaugaaaucagucauguugacacucaggcaagcaucacauuaucucuagccauagcucuuguguucuuccccuguucugugccgugccacacuaauguggauuuacuucuguugacuaggucucgagaaaguaagacauuagcugcacuaaccuuauaugguuuagcucuuuucaucuuaauagugggaaccaagaaguauuuuuauaagauuuuauccuggaacuuaaaaaaaaagacuuucuuuuuuuuuaauauuuauuuauuuauuuauuuuauuauauguaaguacacuguagcugucuucagagacuccagaagagggcaucagauuucguuauggaugguugugagccaccaugugguugcugggauuugaacucaggaccuuuggaagagcagucagugcucuuaaccccugagccaucucuccagcccaagauuuuccuuuuuuaacugugcauauaaauguaugucaggauggggguaaaugcacgugugugcaggugccuguggaggccagagggcuucggaucucugggaucugggguuacagguaguccuaagcuacccgaugugggcucugggaacugaauacuggucaucugcaaaagcagcacccacuuuuaaccacucucuagcuucuggaccuucuuuacggcacuauucauucuggauuauucauuucaaaauaaauaauucccagccccaacugucaacauucaucuagucuaaguacaaaguuuugucaguugaaguacacuucauacaccuuguuuuaacggcaaagagaauaaagaucaaaaugauuuuacuaauaauuugcaugauuuuauauuuucucucguguggagauauauauauguguguguguauuauauauauaugauauuccuaguaauauauaauguaauauagauaauauauaugauaggaaaguagaacagagauuaugugggggaaggaaaagaucuaaagagagaaggaagguggaaaugaaggcaauguggccuaaacauuguauauuuuuacaauuguaaaauaauuuuaacauguaguuaaguuaguaaagcuuucagaagagggaguaauuuucuauaaugucuucuguccgcuguaugguggcuuucagggacauucuaggucuuccucaccagguauuuugaucuguucuauauaauggauuuuaugugugacuucauuguuuaaaaaaaaaaaaguuaaugaaaaaacuagaaucuucuuuuuauaaaagcugcuaaauaaauaggaaauucuaaaauguguaauaguaguucugaaccaaugauuuaaauaguauugcuuauaacuuacauguccuccaaaugaaacauguaagcuaacuacuaucguuguauguguaccaaaugcaggacauauuuguaaauuccacaagggucaauucaaggauuagucucuuuuuguccuuuuuguuuuugcuauccucuggcuggccugaagcuugcuguggaggccaggcuggccuugaauacacagauaucugccugucucuuugcuggggucaaaggcagguuuucuauuuacauacuuuucucccucaaacagacauagucugccauguguguauaacuaggacugcgaaaaaguuguguucauguaaaugaugacuccucggccuguuacagauaccucuucacauucgagaaguucacagagaugccaaaagaauuuauuuuauauauugagaagagaauacaguuugacagauuucaggcuuaaaacaagacuaguaguaggcuuuugucacagugaaccuaccuguaucuuucugaauauuucuucuaacaucuuuaaacuuacaaccuauagauaaggcaaguaaaaaaacgaaucaguuguuuauaaucaguuuuuuacaaucaguuguauaagaaagcauauuugaacauauguacaugcuacuguaaaaagucauuuuacauggcuauucauguuucaauuccauuuuaacuguacauauuaauuucugacucuuagaaacauagcuguggagacugguaaauuucacuaaaggaguccaggagcaggaguuccuggccauggucuuaaccucauuuguaccacugaauugggaaaguuagaaauguagcccuggaugcagaagguguuccugaaggcuucucuaaacaagcucaccggucuguaugcacugagccacccgucagcucaccaagaucugcccucauauuaguaggaagccaucgaguguucucaccuaccuggaagagcacauaaaccgagaaacugggaacaauucacucgcgacagagguagccugugaagggaaauuuaucaagcuuaguuuuuaaaauuguacaaauggaaauugagccugcccaacaagagcaucugccccagaguaaggaaggcugcauuaacaucuacagcagucacaaagcaccaguccauaguuagcguggggaucagggaaggccugcagugagcaaaaguacggaaauggggacugaccuacuuuaaugccaaguaaaucuaaaagagcaaguugagaguuuaccaugaagguaaugguuccugaacacucuacagguagagccagcaacccugugguaugaucccaaaagcuuagggccaaaugcuuuucaguuucaagaugcuagaaggauugcauagaccugaccaacugaacaucccaauuugaauaccuaaaagucaaaauucucaaaauaaaaauaucuucucaaguguuugugugauucucacgaaaguuuugcacuugggcuauuugagauuucagaagcggagguacucagucaauaguaaccuuaguugaaugaacuggaaaauuccaucuuaauauuaauuuugcaguguuaaacuuuucuggguaaaaucgccuuauagauauaauuucauaugaagagaacaggauaccauucuuuauugugaauacuuuugauuaaaauggaaaauguuucuagaccucacaguccuaguuuacaguacccacggacagaggcuccccaccugugugucaggagaugaguacugagaaaggccagcgccaucauagaaacaacagcugggauggaaaacuagacuuaguuuugaauaaaagguaauacuuauuugaugacagaguaaaagacaauacucaguccucacucuuccuguggagggaaagggaucagaaguuuaauuuucggugcugggacaugaguuaagccauauccugguaagacuacuggcuuuauggggaugagagguacgguuuaguugcugguugcagacacccuggcgugaucauaagucucacgccaugacuugggaacugauugacgaugguccaccuaacugcaccaagaacugccuaagggacuggcaaggugcaccaguccuggagguccuaaccuaaagaacagacuauggaaggugagggggaggagugcuuggcugacuggaaaacauguugggguaugucccucccuggcuacuucauguuaccauucuacucugcuuccuggcaaccauggucagaguuccuguguccccccauguaccugcccccugcuacaguggauggaaauaucaaaaaugaugggcuaaaaugaaccuuccucccuuaagucauguaugucagguagaaauaguuauacugauacagcuuuuauuuaaauggucugcuaauaggcccaucaucgugaccaguauuaaguaggauuuaauuuacugauuaauuauuaaauauaccauuuugggcauuacuguuucucucagaagcauuuuuuuuuuguuuuuguuuguuuguuuguugagauaggguuucuguguagccuuggcuguccuggaacuugcucuguagacuaggcuggccuugaacucagaguuccaccugccucugcugggauuaaagcugugugcuaccaccacccagaugguauuacuguuucucuaacucuaaaaagaauacauaaaucuugguuggagaucauuuuuaaaaaaaucuuccucuauuuacuugcaguuacaaagagguuuuuuuuuccccccucaauguguaaaggauuaaaagaggaaagaguaguuuuauuccuaucagauaauaauauaaaacauggagaaagaaaaucucuuaaagauuaaaauucuuuaacugacacagagaauacuugauauugucaguugauguaacauuaaauacuguaacucaccacugaaaugcugacauaccaugaaauuugaauuggagucuguucuucaucaacagguucuucgucugaagaaucaaacucacuugcuuguauugaaaugggcuucaaaagaaaugcuauauuaaauuacuaaaaggaacauuugcauauaauuuccacauagcugauccaugauuaaacacccacugaauuaauauuugcaguuuucucagucauuaaucugggcuaucagaucagcaauaucaauagugaacuauuacugcugacuauuugauuaaucacaguacuacuguacauuggguagaacugggcuuagaccaaaagacuaucuggcuccuggaacugguccuuggauaauaucagacaaggcaccuaaguuuauccucuaucagcuuuccucaauucugaaguaccauuugcccauuccaucucagacauuccuuagacccucugauguuugugcucugaagaccugaagacccugugauaugcugucuaccuucaacacagcuagagagacagcggugugcaagguuacaggauggcaaagguguuaaacuagcagaaaccaugugcuguagaguggaaggaaugacugagcauuuagggaacagggaaggguuucuuagagaccauugagcuaagcucugaaggaagaaccugcagguuuguagguagacuaggaaguuaaagcagucagugugaaaauucaagagcuaaggcagguaugauggugcaaagcuuugaugucagcauuggggagacugaggcacaaguucuagagcagugguauacauggccaggcuggcucaaaagaaaacacaauauggguggaaggguggaggauuguguauucaguagagaugacccagaagagacaaagccaguggacacugcucauccccuuucuaaaacaaaaacaaaaacaaacaaacaaacaaacaaaaaacccuuuccacucccuaauuggaaccaucugagaucagacauuugaacaacacguguauacaaaaauauuaguuuuaaagaaugucaaaaggagaaaguagacugcggcugugugauucccacauccauccagaucuaccccuucccaggcagcaguggacuacagaggacucacuugugcuugccagaggagguagaucucaagagaggaggaaauagcgagcucuacguguguucaguuccucuauaccagaggucagauagcucacucuuccucuggcaacaaugcagucgguaggcagcugacacaguggacacaagacuugcaagaguaaccaccugacugcuuggcuuucaagcucuucuagaaaggucuugcuggaggaacaggugauaacuggcugaaauuauagauugcgguuucuuuggauugcucuuugguauaaaacacaacggaacccaaaugaagccuuuaaguggagugucagcuaugagguagaaacgauaugucagguggggcuuccaagucauggcuaagaccccuuuucuuucuccuauaaaaccagauuuuaagcuugugugacuuuucacuccaccccucucagccugcuguggauaaaugcuaacaggcuuagacgucccugccuuccucaggcccagggauucugaccugcaggaaacaagacgcagugcccugagcuuucugagggaggguggcuaucgugaugucacucacaaacggggucguuacagccucugcaucugaggcaucaagccacccacaaccccggccgugacagccucugcaucugagcugucaagcugaauggcuuggcccucucuggcagggucgucgugaggccccucaggugggcagcgaaccgcagugccacagaucugccacucagccuccccgacgcgcagggcgguuacugugcgaaucgcaccgcuggccgcccagcaacgcagccgaggcgguccagcgucuggccccguggcgaggauccuucgggucccggacagccccacucaccggcuucaucgcgggucgccacucgccguaaccagugccgccgcccucgcagccuuuaggacaccgcccgcgaagagcccgcccccgucaguccauugguccgcccacg

SEQ ID NO: 7401 - RNA, 12847 nt, Mus musculus
cgcgcgggcggcccucugcgcaagcgcgccgggaggaggccgcggcggcaguggaggcugaggccgggggaagugaaugguuuuacccagagggccgugcgccgccuuucuccgcuggccccggcgcgcccggcagcuccuccccggccauggcguucacuuucgcggccuucugcuauaugcuggcgcugcugcucaccgccgcgcucaucuucuucgccaucuggcacgugaguagccggggcagggggaaagagggcgagcgacggcgcagccucuugcagcucccggcccggggcugcguggggccccagcugccggcgcgcgccaggacguggccuggcugcuagggccguggacgcugcgcgcucccgggccgggguccggagggcauggcgugcggggucccgguguccacgccgccgcgugcgggcccaggccgcgcuccgcuauucgcgagcagggcugggcggggcgggcaggcgggcggcuccgugucuacgccgggcccgcgcgcacggcuuguccgcgucccccgucucgauggaugcccagugcgcaccgagcggugacucucggcgugaaguuuuccuaauuuuuauccuugaauuaccgauuuccuuuuaaggcuuccucggagcacggccaaaaucggauauuauaaguuacuuuagcuccauuuccaacucugcuuugcagcacucgaugggcgauuuucuaguagaacacggugguugagagacgaguuccuggugaacuuugaggcagcuuggauugauuacuucguuggccacaucuccgaguuuuccccugaagucauacuuuggaucgcgagagcuuuuucaggagacagccucccaagccaccucugugguaugggcugcaugauuuaguagagggaguuuuaauuugauuuugaaaauccucagaaacuuuuggcuccucauauguccuugcaggguggacgugcauucuuacugugcucugucccuggugacaguucuauugagacagacuuuugagugucucuaccgcuuagcaccacugaaagagcucucugggagaucagcaauucucaaaaguugagcucauuuguuucuauccucccaguacuuucuggaauaauggcauaauuugaaugauggggcgaguucaaccucguguaaauacuaagucagguuucaucaccauccugugcgugauuaaauggcagcagauuaaaugguugcagaagucuccgaaguagguagauagauaccaaggguccuucuugcuaaggagugugauuguauuuagagccuauuugccuguggauggggaaugcugggguccgguguucacuuugucagaaauaacugcuacuucacacaacgcucauuaguuuuaacuaagauuggaagagcaucuucugcucuuuggaggaagaacaggaagauggauagcuuucgagcuggccccauuguuguuuccaaugaaaguggagugucuggcuccuuuccaucuguaacuuuaagucauuugcucuuuuuauaaauguccucuggaaugguggagauuaguggaagagagcugggcacuuccccacguuuuccacauucuguguuuggcuuaagaaacagccgggcguggucgcgcaggccuuuaaucccagcacucgggaggcagaggcaggcggauuugaguucgaggccagccuggucuacaaaguugaguuccaggacagccaggacuauacagagaaacccugucucgaaaaaccaaaaagaaaaaaaaaaaaaaaagaaacaccugcaauuuuuuuuaaaauggguuacuuuauuagaaaggaaugugucaaggugaaauagauaauuuuaaguccuguuauaggauuaaagaaaguugugccacagauuaguggagagcuuuuagauuuagagguuccuuaguucagauaauuacuguacuuuggggaaaauuauuuuaaguauaugucuguugugcauuauuagaaaaccauucagcaaucuuuuuacucaaaagaucccuagguaccagcugaaagaaacuguucaacuuaaaaguuaguuuugacuaggggugugcccacuuggccaaguaccugccuaacaugcacaaaacccuacacuucuuaguacugcauaagucccaccgcauaaacugcauaaacugggcaugggguguacaugugaucccagcacuggggccauagugacaggauccugaauuccuucugcauuugauucugaguuacaugaaguccugccuucagagauggcuauaugcuaauauguuauuuauuugagucaaauuuaaccagcuaaauacaaguauugcaguuaugauucuugaguuuucuguuacuaaaguagacuuaggaauguaucccacacaauaugauguaccugacuguuaauauucauaauugaucaaagcuuaucuccuucaaacuacacauuuauaauuuuuaacauuuauuguguuagaaauugguaacaaaggaaauccuuuuuuuuuguuugcucuuuugguuuucgagaaaaaucuauuuuguugaguucuguacauuaaaaaauuuuaguguuuuuuuuuucuauuacuaaaagcuuccauucauucaauaaugugcugcacauuaauauuuuagacccugagccauaguaacguacagaauaaaaucuuugcugcugugaauauuacauuuuuuauuguuuuuuuuuaaacucaagaugauuuuauuuuugcaguccuagaaguaauagacugauaaauaucauuugagauguaaacgaaugaaugauuaauuaaaaaaaagucacauggagcugggguccccggggaggcuuuccugugccuuucugcacuccuugcuuccccuccuccaggugugagcuguaagcugaaaaagaccauuuucaggcaagugggaagguaugguguaaauugucuagcugacuccacaccugguuugaggccccauuucugcuguugauggaaucccuggggagucccucagagcuucaguucuccucucgggcaccagacaagugcuggcggcuggcauagccucugcgugagcaagggggcuuggaaaaaaauguuuuuuuuuaauuuuaguuuuccaaguaauuaaauuuguaucauuucccuccauuucuuuuucuucuuccaucuccucccaugccaccuccucucaacuuccuggccuccuuggauguacauuuuaauauucaguuaucuuuaucuccuauucucguuagggguuuuaguacagaggguuagaagauguguaucuuacacacuccuagggaguaagagaaaccugugcucuucugagaucaagaacuugaagugagcacagugaaagcuagaaauagguaacuauugauugugacagugaggagugcuguaguagcacacaucuaaagagagguggguggcuggggacaccaacugaaggcuccccacaaaccucccaccuugacuccugacaccugaguuaaugccgcaggugguacggauccccaccuuggauucuuugaaggauucuguguaaggguaucgagacacuuaggauuaaaauuauguuccgcuagaagcaugggcaagcucagcuuuauccauguguguaguuggcauccuuugaauucuuugaguccacucuagagucccaggguucugagccaugggagaaggcugcacagacaauuaauuacaaauggucuuucucccugaggccauacacgccauuggggcagacaaacaugcaugcagauacaguauugagagugagaggcgccauacuggcggguuacaagagaagagcugcagacaaguauacaguaaucucugcccgaagaaaacggggaacggcuacagaaggagggguucaggagggggaaggaaaccuugcuuaaauagcuguaucaguaggaaaagcucaugucacacagagaaagcggcuugcagggaaacauuggguaaacugcaguuaaggucacggugggugcagaagauuuagucaugauguaggaaaucgugcguggucaugaugacgugucuucaggucuuuaaucugauucucgcucuuuuuagcacauucgcgggacuguaaauugaugcugaaauguuguuacaccuuuguuuauuuaguaauguuuugaugguuggggcaagcuuguugcugcuuucuacuaaagugagugguccuaaauguuguaauucuauuuuagaucauagcauuugaugagcugaagaccgacuacaagaacccuauagaccagugcaauacccugaacccuguaagucacaacaucacuuucaucuuuagauuuuuaaaaaaccuauuugcuuuuaauuugauauaacuuuaaaaaggccaguauucucaguagcaugauauaucugaauguuuugaaguaggcagaauaaaguucucuuuccugucacacuugacuguuguguuauuaaucugccaaagaucuugucagcugccauacuaacauucuuccaaucugcuuuuuacauugucggccaaagacaguugaaaaggucaaaaagauuaaaagagucaaaauugcacuaaagguguguacugcuuuuagcugaauguuugaaugccacgucaccugguggggagggcuagggcauucgucuccguaucguuucgcucagugugcuugcauugccuguugagauuaugaguccaugaaacuucacauucuaugcaaauguuugcuugcuggcccaggcaaguagggaaagcuguuaaaugcuuaugcauuuuuuauguuacagccauaggcacaucuguauuaaauuacuuagcacaauguuugaaaguuggucaauauaaaaucacaucacuaguggggaaauuauucucagcccgugacuuggacacguggacuguaguguggacuuagcugccguauccaguuucagcuuugguguugucugguggagacugggcuccugugcaggugcucucucagccuuugugucagucagcucugugcuugccacucggaaucuugguuguggagauaccaucuuuuggucucaagaugccagaauuuuguagcuagcaguuuguauacaggugucuaugugguaauuucuaguauauuguauuuaccucaaauuucuaaaacaggucugucuuacguuggccuguguuagauuuauugauaauguggcuccauuguguuuuggguugauuuuuaaauacauauuugguaucugaaggaagauucuucucuggucuguagguuugauuuugccugauuggucagaagcuaaagaguugcuugugauaaagccacagauuagaaagcagcagcugacccucaaagcuacugcagaauaggaggggaccauggcccuugcauccuuaugcucugacuuggagaagccccccaaagcuagcuugcuacuuuauccuuguuucucagguaaauguagaugccuuuuacaguaagaccauguaggaacaaccacaaguuuggauguacuggcuucccugcuuguaggaaguuaagcccgagaagauguuuugugguuggaaaguaacaggugugcauugcaggacaucuuuccccagucguuaaaaccaguugucaagaagucagaagcugggaucuuuuaaguuguuaauaauauauuguguuuucuggcaguugacaugccagauauugaagugaugagguuacagcuagagucacgugagcacuucugggugccaggcucugcacagaagcguucucccugcagcucuuuauucagggaccugaaguuauucucaugaggaggacacuagguugaguugcucuaugagguacagguagugugaccauggcuaaugucagagagguuaaggcagagaccauaguuauaagcuagacagccugauuuuugacacuuaaacuguguuuuucuaauuucuuauccuuaagagggaggcauuuuauuguagcagauagugugugauuucuggcuuuucuuaauggaaagaaagucauaccgagaaaagacaagugcuugagccgacugcagcuccaggaggggaggccauuguuccggccugggagcuggauuugcauagggugccgaugauuggcugacgagcagugcaucugacaguuuucccuauugaaauuuguuuuacaguucugccaaaguaugggggaagauaaguauuuuuuaaaauguaaacuuaauaagggaauauaguuuuccaugguucaguacuaaucauuucagccauguuuugcaugagguaauuuuuuuuucuagguacuaggcuuuaugaccuuucgguuguaaauaggauagauuuugugguaauugaaugguugaaaagcucugauuuuagcuaggugguggugaugcaugccuuuaauccuagcacuuggaaggcagaggcaggugaauaguucaaggccagcuuugucggccgagcaaaguucuaagacaaccaacagccagggcuacacagagagacccugucucugaaccccacccccccccaaaaaaaaaacaccaaaacacaaaaaccaaaguaaacccaaugcaaagcucugaugggucagaagcacuucaugaauguucuggguguuucugaggagcgggagggguagaagcugcagggccugugguagugcucucucuaaggacaagguaggcgcgccggggagugagccucaaguuucuccccucaccccagucuaagugcaauugcaaagcaguuaguuuuguuaggucuuaggcccuagagcugaagaaggcuugucaggguuugaggcagaguuucagagauguccuuuugauaaaaaauugaccuuaaauuaaaucauacaugucuauaucauauguuuauauaugcguauguggagcuuaucuuaauuauuuauuauauugcuuaaauugguagcaaauacucugguuagugccuuaguuggcucuacuagaauuuuauguaagauaauguucaugaaaauguugauacugggcuggggauagcucggugaaaggaggcuuggcuagggugugugaccgugggugugauuuccagugcuggggaaguuagguggccaugugccuuuccccuggagaagcagugugggcuuuagaagaggcuugagugugcgcgauggacgaucugacuccugcagcguggcccacucaggaagggccucacucacacugcuuuagccuguugggaagccacgugauaaauggggcuuugcaccugugacuuagagauuuuggcuagagcugucaucaaacaguuuugauguuuuauuuaauaacacauuagauuagacugagccauuuaggauaaaagugauuuaaaacaagucauugucuucaucauuuuauaaaugcauguuaugccauuugaauuaauuuuuccucacuacuuaucaaaaggcuuguuuucuuuugaguuuugcgguccuacugucuucuuccaugcagcauuuguggacaggcaggcauaggggaacccaaaggcaacguaauagugggaacucuggaaccuggcaauuccuuucaugguuacaaguugugacuuuucccuccuacauugcagaaagugugugugugucucucucucucauugugugccucaguguccuccccagcugugcugagauguuggcugguuggcuuuccauugaacaacuuggggggggggagugaugugacucgcuaaauauuguacauguagcauucuugguuugcuuacggcuuaaagacacauaaacuuguaaaugggagauuauuuuauggauuuuuuuuaucaugucgcaugugcucagguuauuucauuuuugaauuauuacuacugagugauggaaauacaagcauuccacuuuaccuacaaauaauuaaacauucuggauguuaaucacaauuuaauuugcugcucuaagaauuugaguucuaaauuucucaucuuacuuuucuagugaaagcuuuuuauccucuggccaguuugcuuagaaucauacuuuugguaaaaugccaaauauggaguaacacucaguagcaucuuugauuucugauucucagaagacagugguguuuuaaaauggaaacuugguugccaguugcucugcagcgagcagcugcccuguugagcgagcacugugauaacuaaagaccugcuguguuuccuuccagcuuguccuuccagaguaccucauccacgcguucuucugugucauguuucucugugcggcagaguggcugacccugggccucaauaugccccuuuuggcauaccauauuuggagguaauauuuagauacgcuucaaauaguuccuuaauuaaauguuaauuuugcugugguugauacagucaucauugauacugugugucuccaugaagguugaaaguuauuuagcauugacucagcucaggucaguaagcagagagcucucagugcccuuguaggacuucacuauuccucaaaggaccuuagucacagccaagugcauuuacauccaagugaauuuucaugcacacaugcauguacaugugaauucacacagauuaacauagagcacuucuaguccucagaacauuuucugagcccagcaucaaguuguuaccuccaugccuuuugcccauuuuaaacuucauauagaucaagauguacaaugugugucuuuuucauguuuaaauacguuaaagacuauuuugauguaaagugcuauugugucuguaacugaaugaaccuugucagaaaagcuguacucaugguaggaagggcagggaugcaaagcaagugaacagugagcccuuggggccccugggccaagggcccucaccuucugggcauguaaaguuacguggagauacaauguuaaaccccucaggccggagagguucucagcauuaagagcaccagcuguccuucuagaagaccuggguucaguuccuagcacccacaugguggcucacaacgucuguacucuaguuucagaggaucugaugcccucuucuggccggugugggcacugcaugcgcguggugcacauguauacacguagacaauacacuccuacagaaaaguaaaucugaaaggaaggaagcaagaaggaaaacaucugaguucucuuucccaguuccuguuuuuacuggauuucugaaaucucagagaccauaugugaucugcauggcuguucucuucuuauggucucuaguuuuaagauuaagaugguuuaaaauaagauaaauuguuguaucuguaaguaaaaaugugccuugucucuggagcccgaucccuguagcaaaugcuggacaggaaagacccccuccccacuugaaggccauuccccuucccauauccuaaugacugugucugucucagguauaugaguagaccagugaugagcggcccuggccucuaugacccgacgaccaucaugaaugcagacauucuagccuacugucagaaggaaggauggugcaaacucgcuuuuuaccuucuagcguuuuuuuacuaccuauacggguaaguuugaaacgucuccagaggaacuuggugcaggcauacaucuggccagcaaguagcaugaagccaaugucaggaagagggucagggcacacuguugauaaagaauaaucuguuuccaugacguaacaguguugaggggacaggguugcauggguuuguaaaaguguaguacuuaucauauuuggagcuaauauucagauauacuuuaaaugacuuuaucaucuuuucagauaguguucuauugcucacuauaugguuuuucauaaacuguguguccugcccuuaauuuucuaacuugcuugaaucugaaugggaugaacgagguggccuugggucacagggugcuggucucauuuccccucuuuaaggcuuucucagcuucuguaccauaggugcccuggacagagccauucuugugugacacuuuuauagguuauggguguucagcagcacccuggccuuuacccacaagauucuagcgguaaccuucccagucaagacaaccauggauguuucuagguguugccaaaugcccguguguggcaaaacuacaguaguugugaaccaguguuauagguuuagcacaguaaaccagaugcgccaaguaugggagacaggaaacugcuugaggcuuacauggugacccugucucaggaacagcaacugaagaguauuccggugagugugcaggaagcuagacagguuuggucagggucaggucaggacagccugggccaguuuuguacuucuuucuucuuuugcuacagaguacccuaugucaaacaaaucagaacaacagcagaguagcacgggauccugaaaauggaaggaagauuguuuuuaaacuguauaaguguacugcagaggucucuccuuuuaauuuucaagauuuuuuuuuuuaaauguaguuauacugggguaggagagauagcucagcaggagggguccucgcagcugauuccugaggacccgccuggucucucagcaccgcauggagggucacagccaucuauaacucaguuccagggcguucgaugccuccuucuggccuuggaggguacuguacacauguagugcacagacaaacaugcaggcaaaacaccuagacacauaaaauuaaaaaaaaaaaaucuuaaaaauuagcuauuuuaaguuaaauaauuaagcaucuauuaacuuacauuuauuaucuauuaagcuucuguucacauuugucucuauauauuccauuauagacaaggacaaagggaguuuguguugugaaguugucuuaugugcaccuagagcugaaguauaguuaauagguucuguccuuuuggucgugacgcucaccuuuuaagcuacaccaucucagcugugacuagauuuugaauggugaaacucuguuuugcaguuucuucccgauuuucauguucuuaauuuuuuuagcuaacuuguagauacugcuggaauguaguaggcauguaaaauauacuucugagagagcaaaccuguguaaauagcugcauuggagaugcacauuuguggggaaugcucaccaggacaugaaggcacacacacacaaguccaugugugcucagcucuucgcuucguuuggagauaaauaagagugggcucuuugcaccaucccccaugccucucuuccuuuuacauuuuuuuuuuuuuuaauuuucugagaauuccauguacuauguuuuggucacauuuccucuuuccuggccccucccagugccuuuguaauaucacuguugauauagaauggcccuugguacuuuuugagccuagaucauauauuuacugccccuguguguguguguguguguguguguguguguguguguguguguguguguguguguacacccuuugcuguccccauuccuguugccuagagccguuuaguaggguaggauugggaugguccuccuuuguucccuugcauaaaaugggaccagugacagcaccggccuccugaggcugcuuggagagccgagugacaucaugcccaggaaggaccuaacagcuguggacaggccgcaucuccagagauguucccuccugugacucggugcuguuccagaguagcguuugaauugcuccugugagcgagcuuugcuucucacugggguucagcugcaucauucugcuugcuaaaacuggaaaagaaauagggacaacaggccgguguccaugcuaguuaaaaucacugacaacgugucggugaucuuccugggacgcugauagcugugagcugacuguguaaaggcuguaugagggcugucuaccuuguuguaaugaguauuggaauuaauaauaauucuucucuuucguuucagcaugaucuauguucuggugagcucuuagaacaacacagaagaaucgguccaguuaagugcaugcaaaacgccaccaaugaagggauucuauccagcaagguccuguuuccaagaguagccuauggaaucugaucaguuacuuuaaaaaaugacuucuuauuuuuuaaauguuuccacauuuuuugcuuguggaaagacuguuuucauauguucuacuuggauaaagaauuuaaauggaauuacguauaaauuaauauaaaaugauuaccucugguguugacagguugaacuugcacucuuaaggaacagccauaacccuccgaaugauugcauuaauuucugaccgcccucagcccguuggaagcuugguuuagaggacuuguugggcucauuuugguuuuauugaaaugccaucuaaauauguuagcuguagauaggaggugcuucuggugaacugaaagugucugacucgugaggaacaugguagguuccucacuuaucacuguagaugauucuauauggacacaacaguaagaagaauggggccucgucccugucgacuugaauauuaucccuauguauugcaugagaggggucucccucauuccaucagaguaauacacuugcuuuaauucuuaagccuaagugauacaaacaugccgaauuaccuguaaagaaugcauuuaaagcuauucuaaauggguuuuuauuuguaagacauuauuuacuaggaagcuggugauauuaaugcuuacuguucuaauccaguggccaagguauuaagaauuugcaaguauuuuagauuuucgaaaaugaaugagagaacuguguaaacaccccgcuguuccuucagugcaacacaauaaaacucugaaaugaagaugcuuugcugugcauuguuugaaagauuacaaacagcuguuucucaaacccucucaauccaucauaauaaaauacauaauauugucaucuuuagaaguaaau

SEQ ID NO: 7402 - RNA, 2019 nt, Mus musculus
guuuugaguuuauaguguucuuaaggaaaaagauucucuauacccuaacuucucugaugaccaucauauuuuacauuauguuugcuuuuucagguaauaaggauugcagucuauucuaaugccaauacuugauuuuuuuuuuuuuuaaagcucccucuccugcccuuccuaccacuccaccucaccuucaggucugcauuaccuugagaagccugcagucggggucagaaauggucagucccucucuagcaucccgccuuacuccuuuacccaggugucucuggucccucuucaguuagaggggacucaugcagcaaugagacaaaaagggaaaccugauagcugaccugauagcagucaucugaagugacucugagugccagugucaugccagcucuguccccucugagguacuuuugguaguuugguuuuggcugcagguucugugacucagguuauggccccuugcuaguaguuuuccagcuggcugucccugccgggguuugguggccaugcuagacacuuuacuuuuccagccuugggccccauaguccuacucguacccuguugugaguuaccucucagcucuguccccuacauaucucuuaccuuauuuugccccaucccccuaacccagcaugacaaccuuuucuagccagauacuucugccacuggcuuuucuguucugaacugggccucucagggccuggcccugcuuguccaucccauggcagccauacgucaccaucccaucaugucuuaauucucugaugccaccucuuuccaucugaugaaaucuuuccuaaguuuuguaacugggcugcuugagggcucucaggauaguaugggaacuuuuuguuguuauuuuuaaagcaacuaacucagacccacuuugauacaaaauuuuuuuuuuuaaucuuucaacacuccuguguauuuuaacucucaccuggaguacuugguaagccacagauuucuggcucuagcucugcaauuucugauuaaguaggucuagaaguuugcauuucuaacaaaugcccagguagaggggccacaucaggguaaucuugaaaguuuuaacuuauucaacagauggugugcuugcuugugguuuuaugccuagcuaaaucucuuuucauauuuuugguaugaacuagaugcaggcuugauuuuucacacuaauacccaaucaugagcuauggugcuaugaauauuuauaugaaauagauauuucucauuaaaccuguuuucuuuagagaagaaauuuucaaacgaaaucuuguugacuuaauuucagugauagaucuuuguguaguuucuagagagaagcaucuaaguuguguucugccuguaauauuuuauuuauauaaauaugacaagaagcguugguaaucaugcgaugcuauccuugcucuauggucagcugaacuggagcuguaccuaucaggguuucccagacaaacaguacaacauacacacacacacacacacacacacacacacacacacacacguauguauguauacuuccacucaguauacauacuuguacacacaggauuaucucuuaggauugauaaguguuugguuccagcaucccucuuuggauacagcauuuacauaugaccugugugaauccuucuguacacauccaccuguagguugcuguggugccuaacacaauguuauuccuacauaaguaaucacuauguugcauuauuuagggaauaauagcaagaaaagacuauaaaugcucaauauagaugaaacuuuuucuauguauuuguuuuaaaucuauaguugguugaauccauagcucuggaaugcgcggagagccagauaucgauccauccaaaucuguuucacuuacuaugaagaauuggccugaaugaguauagcucugaaaagacauggggucuucccauagcaugcuagagacucgggaaagcuggaaguucgauucucacaucaguccaguggccuaagaacagggaagccagugguguaaauaccagccca

SEQ ID NO: 7403 - RNA, 2921 nt, Mus musculus
auuuuuaaaagauuuauuuuuauuuuaaaauuuuauaucucuaaucuaucuauccauccauccauccauccauccauccauccaucuaucuaucuaucuaucuaucuaucuaucuaucuaucuaucuaucuaucuuugucuguguggggauaugcaaauguacucgugagaaaccagaagcagaugcccgagcuggaauuacagugauccugggccacuggauugggagcugggaaccgaugcuagucuucuggaauagcaggaccacucucagcugcugugcugccucuccagccuccacauuuuuuuuuucuuaauuagacaugaguagguguauuaaucucuuuucucagcugcuggacagaccaccugccaacaguguaagggaggcaaaguuucuuugacuccaggauuucagacuagagugugucauagcaaggaaggugugucccugagcauguagcucaggcuccucacaaucauagcagaucaggaugcaguggaagcagggucaggugacaacccccuuaggcucucccccaggcaccuaccaccuuaaucugggucucagcuccugaagaucccccagauucuccaaacagccacacaucuggggaccaaauguucaaauauagccuacuggagccauuucacauucaagcacuaucagucaagauguguaggagugggcgugucaaaugagaccucagggucuuuguuuuaaagagauaucauccugucuccaacaaagcggaaggcaaggacugccccccccaagaggggaagagagagagagaauaaaccuauauuguauuuuugggaaggaagaggagaagaaggaagagaggaaagaccaaggaugagcaaaagcaaaaaaccauugauauauguguauaaaacaacacucauuacuuuguaaauuuaccuaaaauuuuauuuuaaaaagaacaagaaaaacagggcaugccaacccaggacuuuuaccaguggaauuagauuuuugcuauagaaaagucauuggugguggaggagagagucaccgugugugcagaauacacaggacagguccugcagagagggucaccgugugugcagaauacacaggacagguccugcagugagggacacugugugcagaguacacaggagagguccugcagagagggacacugugugcagaguacacaggagagauccugcagugagggacacugugugcagaguacacaggacagguccugcagagagggucaccgugugugcagaauacacaggagagauccugcagagagggacacugugugcagaguacacaggagagguccugcaguaagggacacugugugugcagaguacacaggacagguccuguguuagacacauauuucaguggcuguaguaaauccaagcaggaaaugguaaagacuugagcuaaaucuccgcuccuguuuguuuagagaguuccucaggauaagcuaggcuggcuucccguuccuuuauuucugauuuggagcuggcucucgugucuggauuggugaauuguucuuuucugauuuguaucuuccaaagcauuacuuuauuuauuuuuuuucuuuucuugcuuccucucuucuuuacacuuugggaaauguuuacuuuucuuucauuacauuauauuuacuauggcccaugcuugcagaggucugaagacaacuguauucuccuuuuaccacgugguuccagaagguuccaguuagguugucaggccugguagcaagugccuuuagccaucuuguuggcuuacaucuuacaucucuuuacuguagguucaguggggguugaguggggacaaagucauuccuauguauuuaauguuacuuuaccugcaacuuauguuuuuguuucacgauaaacaucccuuuucguuuuacuguaauaaaauugccuucagauuggcuaccugcaauggugugauugcaucuaacacaguauuucuagacucuagucucuaaaaaaaauuaaauauacauaaaguccuaccuccaugauuuagccuaaguaaguaaauuagcuuuauggauacucacugcagugcuugaugugguaguaaaaaacauuccaacaaccaagcauagcuuaaauaaacauacuuuuacaauucaauaucuacuaaugagaaaauuuacauagaaacaagcuuaaauagcaguacuccagaaaacacaaggcuauuuggucaaggucacuggacgaagcuaacucuucuuuuugaagcacacauuuccuggugacuugagagcauggcaugaaaccuuuccuuaagcguccuaauguccacucuccccuucuuccucaguaacaggaucggauuugugaugggagguguuucuccuguuuaugcuguaacuagggaucacauuagggcuuaaguaaaagaaauauaaaagugguuuuaggagaaacuuccgggaggcuucuuugaggcacugaugacaagagugaggaaaggaagcagacauuaagcuacuuccuguacuaagaucuccuaauaaacaaacaaaaauuaguuacuaaaaccuucaaagaucuggcuaauucuaauuggagaagaaaaaagagggccgagggaguacguaugccgauuuuccuuugaauaaacuuacuuugcaaagguugauaagguuacaaaaaaucgcucgcgguagugaccucuuuucggguuuuccgcgacaauccgcaaaucgagaccauuccuuucguagaccauuccgucgcgccgaugccggcccuugucccauucccaaauuugucuaggguuugcaggguuuccaggauaccucguguaucugaggaucugcauuaacuuaaauuuuggccccagaugucaguuaggaauuugagaacagagcccggcuggcggaauucucucaggccaccaaucc

SEQ ID NO: 7404 - RNA, 2705 nt, Mus musculus
gccucccggaagcccgccuagccaagacagugugcugcaaaguuagagaaagacugucuuuaaaaauagggugagaaaaacauaagacacacaacgugggggugggggggugggggaguacccacaucagauaaauuuauagaagcauuagagcugucuauuucaugaauuggaaaacauuugcaaaucucugcauaaauuauauggucacuuuucacccaaccauucaaugaguauguaugggacacuuauucugugcuggguccucaagaaggaaugcuaaagacagauggcaaucuucauccaacauggaagcuuauaugacagaggaguauuuaccauauaaagaauuauaugaacgaaaucuacauuccucaacguuuguaauuauuuaauauauuaagaaaauauaaauauucaauauucauuguauauggcauauaaaaaugugugauauuaccguaaggugugauuucuucccuaacaagguagggcuucugaggaugguugucuuguuucucucuuuucuacaauaagcuuagaaaugaaaacacaacaugcugcaugcgcucacgacugccguccccaaguuagauguccuuaagacuugcagugaugauguucauguagagcgcugucccacagccugaaggcccugcacuggauuccuagcaccacagaggagaagggagcacugcacuguaaaccuuaggucugccccucccagcaacagaugcugagccccuugggcuucuuccuaccgucucuuccuacggucaggacccaggcucccccccucagcucuuagcuuccuugacaguccagacaacauuuacauuucagauucuucagguuggcauauaaagacuagguuuugagcauuuucugccucuuugggcuccuuuucaauagaucuacuaauucauucaacaagaagcacuuaucaaauauagagcauuaugcuggucacagagggauuggaagguaggagaagcagugaucuuuugacucucuaacugaaagcccgaaguguauuugugauauacauguacagaugcauacacacacacacuaaacacacacucacgcauaugcaguaucaagugggucauguugaggcaagauucagaguugagaaagcccaaaagaggcaggccuucugacaggaaaugaagaaagccaccaugguucuguuaccuucugagucugagcuaguguuaauggaaugaauugcuuuagccgagauggacaaaauuuuaaacauagcugacagccaguaagacguggauguauagauauuguuuguauccauaugguuucuggagaaguccauguuuguguguuuuaaguccacauucauuuuggcaguagguaagacaaggcgagcaaaggcccuccuccaucuugcaacugagugucagcagcaagccaucccauggucucuaaguuaggaauaucccuuucuggaugaccugguaauacaauuuuuagaacucuucuaaaguaaaagcacuauuaguguaagacaaacaguauuaaaguauaagauagacaaaaaaauguuuauuucagcaucauuugaaauagcaagaacagaauagaaucaugggucaguaaaccuucaaaugucuaccucagugcacauguuuuugaaaguaaauuauauuugagaacagugcuuccaaaugcaacagauuaauggacaccucgaggugcauauaaguaaauuaacaugugaacaaauauagccagaguaucaaggguaggauggguacugaguguuugccagcuaauguuccaacuuuucaacauuuagaaauccuuacaguaagagauucaauaggaauaggccaaugcuauacaauggccuggaaauuuuaugcuccaaaaucuaucuuacaguucuauuuuugugauuaagaaagucagcucuaauggguaaggagguugaacauuuuuaaagaaacgguucuucuauuugugucaggaaaauucaaaagcacucugagauuccuucucacuccagcagaauggcugugaucagggaagcaacugacaagugcuggcuggaaaggcugcagagugugaggauguauccacugcugguaggguauuaacuagugcagcgacuauggaaaucagacugggggggggcagguccuucaaaguggguaagagguaacuagugugugacccagcuucccuacuccugagcuucucccaaaauacuguaucugccacugagauacccacacacccauguguucugcuguucuguucacaauagcaugggaauggagccagccuagcugucccucaaugaugacuggguaaggagagcaugacauauacgcacaagggaauguuacucaguugucaagaaaacugaagcgaugaaauuuacagaaauaaguguuguaacugaaaaggaucauauugaguaaggugagcuagucucagaaagauacaaaugucauuuguaccauggaaguguaaaggaauuagggauggagggggagcccaagggagauaggagggccaagaagaggagaagaaaaggaacaaccaagacauauucuugaaaacugcuauaaugagauucauuuuucuguaagcccuaagucauuucccaaccugagccccagcuuuauugguaauaacccagccucagugccauuaugacuaauaaauuccucaguacaucu

SEQ ID NO: 7405 - RNA, 18482 nt, Mus musculus
aaaugccaaacacucuuuauucgagggaaguuuucauugaacggacuuuuuuuuuuuuuuuuuuuuuuuaaagaagguucuguuuucacagaauaccucuuggaacugaugaguuugugcuaauguucucaucugguuaaucuucuaagccuuuuuauugcugugguucacacacacacacacacacacacacacacacacacacacacacacacaccaaauaauccccuuuuaugggcagccuccuccuaagcccuuucaggggcagaggaugcaaaucaaguagaaagugcaggagcacuguggucuccagcuauggcagugucucuguggaccagcccuuuccagguuccagggaagaugacauuguuggggacaucaugcagacaaguuaagucauuuuauaggaagacaaacggcacaguaggggcuggagaaacagccuagugggcaggugcuugccacacaaacauggggaccugaguucaaauugccagagcccauguaaaaagccacguacuguagcgcgugccgguaaucccagcgcuaggagaguggacacaggcagaucccuagaguuaucagggcaccccaucuagccauauaagcgagcuccagguucaggagaccgucucaaaagauaaaauggagaauaauaacuaaggaagacaccugaugccaaccucuggccucuacucgcacagacgcucgcaugugcacaguguacacauacaggcgcaaauaagaacuauaaaaugaaugaaggauaaaagcuccugugaugugacucagggaugcagggggaaggcaccgcaucaucuuuaucccagaugaccguccaccgugguccacagugccaacuuggagaugcuucugaugucugcucuucucuguuuccuugguaacugcuguccucgcuugucgaagccccuuuucucuuggccuuccuuuccucucuucuuucccugaggccccugcaaugaaacgcaaaagcacacccagguagagggcugugaaucuuucuucaggcucucuggguuuugccuaugguguguggccugagguuuugggaaaagaucuuccaagccccuuauagaagggcuccaggagcugcagugggaagcuccacuguuagaguccgaggcguguacuaagagaaaaguacacagcccuuccucagggguucugaaguucacacucccccuccucuucugucuccccuucuccacucaccccuucccuaagccuuaccaucccucugucacagaugcagggaggcuaugcaaauuauuuucucaaggcgcuaggauggcauuuauugcaagugguaacugugaaaccuauggugcucgccugugcguggcacccccugaaguugccaguguacagcuuucacgacugcaaauaguaagccuggcuuuccucggaagacauaucacaugguuggaauucaagccuuggacuuaagcuaguugagacuuucacacuccuggcuccucacuuucacaacucugaagguuuagcauuaaggugugggccagagagcuaagcaggagugggccccaccucuagagaugucucagacauccccacagcagagggaccucgacacacacuccuucucuccgaagacuguugagccccacgcacaggcucaggaugacaccacaggaagucauaccuguaggcuagcagaugcuucagcaucccaaacuggcagggaccacugguucccuucugcgaaaucccucccuaagucgucauaacuuguacacauaugcuuguccauucuuagauguguauacagagaaagagcgcagagauaaaauuuggaaaaucuaaauaaaauaaaauaaaaggacuauaucaaagucagugucuucacuguaacguccuguuagaccuuugcaaauuguuaccaguuuaggacccgacaagguacauaugugaucuugcuagaucuuuuuuuuuuuuuuacaaaugcaugugaaccuauaauuaccucaaugaaaauuucaauuaaaaagugugucucuuccaagucccaccuagcagaauuuucaauaugacccuugagcgugaaggccaggacaucccuguagugggcucacugacuugccaugucaccuagguccucagcuuucccuggaaugcccaggcacuccuaucuucuccuugagucuuguauugugacuagagaugcucccuccacuggaccuagcaggccauggugggaacugggcuggccaugcuggcuggccucuagagcuuggcaaagccaaagacggccucuguaauuagcucaucaccccccuccuccggcaguuacugagcacaccaucucuucuaccugcgaugaccgauccgugccucucucugccuauguugugaagccccaucaguggcaacaugcacuggcguggguaccucuucacugcccucuugccucucgucagaccaucugacgcuugccaggggaggccaucaaaagugauauagcgugguucugcuguguuuagguccccaguacccaccaucuaagguccuuugaugguuggggauacugcuaggaacuauguagaacccuuguggaaacaggcagcagaggaucacugagcggucaucagcaacucugucucacucauagcuuccugucucugaagcacaugucccuccccacagacacacccuuugcagccugaccaauucucuaacauuucaaagagccauggguaauuaaauuacccuucugccaccugaagcuucaacgccugauacgcacaacaucugccuuugcuuucccugccuuuaccccuguucuugcagcagagaguuuggaucagcugucuccaucccucuggcugcacagugugggcaggaacaggucuuuggccuuucaucaaggacuugcaguaagagagaaauaauuccaaagaaacaggugugaaugccacaguuccauuugcuuuucuaugagaccccuucucugucuuuccaggccugcgccugccucucauccuacacccuagggucuacugccugucucuccauuugauaaucugucauuccaccucucuugucccuucccaucuucccaucauccccuccugaaucuuccuugcuuagcauccaaccagcuccaucgacaagccguuuugugucuuuaugaaaccacccuugacuuccaaggccgaguuauacauuccucccucccuguucauucuuucuugggacacacugguuagagccaccaucacuccaggcaucauuguugacuuaugugucuguaauguaaauucuaaaaugugacuauuugggagauuagagcaguugcaucuugguuccugggcuuaauauggcuccuguuaaaaaacaaaaacaaaaacaaaaaaccaaccucuccagauguuagaugggugauaaugucagugaguguguggguguguguguguggguggguggguggguggguagauaggaaaaugaguggauggauggguagguaggguaggugaauggguggguguguagguggcugaguggauggaugagugguggcuagguggguggcuaggugggugaaugguagguggguggaugaauaagugaauggacagguaggugggcaugcaagugaguuagcaaauaaagccuucaucuuagagaccaguauguugaaagugcuggccaugcugguagacagcuagcccagagugguuuugcucaguaguccucugguuuccuccacagacgggguugaccggaccuccacaaucuagaaacugaagaugacagugaccgcgcuggccgugaaauggacugcugcgggcccagugucagccaucuucaggguugcagagacucuuccaagacacuuugcagccuuuuuccccuggucccucgcccauuuugauuuugugagagcguaggucauccuuguaaacauaucaguagaccugggguugguuauguugucauuuguuucugucaggggaugggacgguaugcaggguggggaggggacucucgggggaauguggggcugggaggggguggagggaugcuaguagcuuccuggauggaaauggaguggggaagaguauugcuaggugagauaugcaagagacacacaggagggagguagaagcccugcccuggggagccuucucagaacccggcuucacagucaggcugcagaagacagcggacacaagcaaggagagcaagauggcagccagccuguuuguggcuccccugaccggauuuccccgaggcccggcuugaaacaaccacaagagagggcuauauggcaccaagggcaagaggaagaaauucccuccagcaaacuuucagauaaacuuugauuuguguauuguuuacauaagaauuuuaaaggguacauaauguguagaguguggauagaacuucucuucauacuaugguuuuuuuuguaaaagacugauuauuguuauggauucauucugucucaucuauuuuuauaauagcagcaggguugucuuuuaaaaaaaaaaaaaaaacggcugccaagcucugcuucuugggaaggugauuacagucaaguaggccucaaguuaccgucuucgaccaugaggugggaggaguguguggauggguuugaaggauaaggauguggcugagaugaacagaguacuagguguggacaccaggaugauggcgcugugugaucaguucuggauuugcucguaggcuaucuagagaugauaaacucugcaaccucuuucugggcuggauuugcaucccacgcaagaccuguuuuuugcuucccacccuccccacaggcuccauccuaccagccccggucucccuccacagacacacacguggauaacagucccucuagagaaggaaagacagggguugaugguuuucuuuugcaugaagccugacacugaaacaucugugauggagacuuugcaggagccuaggccugggagucuuaucucuucucacuccaucucugccaaaggagaauggcccagcaguagugucacagagagaaugcagagaugcaauagguccccgugguccagcuccaccaugggaggaagaggggacaauggaaacagaagcaggaaagguuaaguuccugagagaagugguugcucucucuaugcaugugagucagagauuugcuguguugugggaugguuuauccaaccacgcacagaaaagagaaaacccucacacguacauuacacaguucgagauuaacuguaacaccgugugggaauagaucuauuucuuaagggcaacaaagaauaguucagaauuuaaugcaauggaggauaucagagggaauccaaaagaaauuaugugccacacuggagaauuagcugcguaaaugugacaguaugagugaguagccggaggcaugaucuagaacauaauauaaggccugucuaguaaauggguaagacagauuccucuuuaaaaaaaaaaaaaaaagugacauuuaaaaccagaccaugcaaaugaccuugccuaugguuauuuuuuuuuucaaguuaaugaagugcacacagauucuaaaggccuuaauaaaaauccacacaacuguguuugccugucaagauuacagguggacaaccgagccgagccuuggaugcuacaacagagauuucgaaguccuuuuacagugcagggccaaggacaccuuaagaagguugagcuuuuagugaucauggacgacuuggaucaucaccccaaucagcacuuuauaacaacaccagaaacaaaagaugcaggacacuccuugggugacccagucuugaagaugcaaauucacgugcagaaagaggcagcauguuuaauuuuuauauguagauagauagacuuuuuuuuuuuaaccaagugccauuaacauucaucccucgugucccuuuccaagcucaguguuggggaaggagcugggauggaggaucccaugucaggcagaacagguuaaaaugucgaaggccaaagggaaggccagagggucugaggaaguguuuggaggaugcuggaaagguuaacagagaggaacaauaggacuccucauccuguaggaaagagaagguguuuaaguccgcuacacgcaacgcacguacccauaaggucaugggauauucagaaaccaguuugugaacacaaucacacgagugcgaaucuuuuaagaggaagaagaccauagaguauauuugcaaaucugaauuucuauuuauuccuucauugaauauagaagcaaugguuaucugauuauuagagauauuauuuuggauaugucacuuauuaacucgcuauggcugguacccaugauaaagucuguuauuaguaacaacagaauucuuuuuuuaaaaaaaaaaagaaaaaaagaaaagcuuauuuuucauugacuguauagauuuaucuacuuaguugugguuugcuauguuaguguuuuuauuuuuauuuuuuaaguuguguucugaugauuuuuaagaaccuccccccccccaccuugauuugaguccuguguugacuacagguauacagcucaauuuaaaaauccuaaagcaaagaaauuuuauuuauaaaaaaaaauuuuaaaaagagucgagcaguugcaugccugaggcugugaagucaggccuugagcagugagcugcagugccuuuuuuuguauuuacccauugaccaccccgccccaacacagcuguuuuauauuaaauaguaaagguuugaaacuuuccgaguaaagucuauuucacugcauagguucuccccaucuccaccccaccccacccccgcccccacccgcaccccaggcgcccugauuuaagcagcaugucugcacugucugagacacaaugcuggucuacaauaucauggggugauguuuuauuggugcuuuuuuguucauaguguuuucuuaccagaaaacaguaggaagaaacacaaacuauacaagacacaacacgacgcugcugaugguuuguuuuguguguuccccacccccaccugcuuuuugaguuucacuuucuuauuacacaaauccagcaagcaaaguaguggccggugggucccgccugccugccugccuagggcugcuauuugcaucaagcgcccagccuggguugagcugaaggucucuuucugguacccaggccgggagccagccgcagcugggccccaccucccauucucccgaugcgacacugagggaaaccagaguuucuuuugaggugucgcuggcugccuuuuacagagugggagucuucucugggccuuccuuuccucugugccuaguagcuagcuagcgcuggugcaagguuuguagaucugugcaccccagagcugggaugagggcugagcgagggaggggaggaaaguggauucuguugggcgcccuuccucucuagccugaguggggagaacccagggugcucaggugugccuaucauaaacagaaccugcagaaggauaaguuguacacagagcugugaugauaucuguguuggcuuuguuuuucaguuuguuuuucuuuucuuuuuuuacaacucaucagagauguuugcaaagcgacuuuuuuuuuaauccuuuaucuugacuuaaagguaaauauguaucccucugggaggagcaaaaagaaagcaggaguguuagugauggcaaacaggagacuuccucccuuauuaauauauaacccucauguauuuaugccuaacgcaagcugacuuucaaagagcuuccuuucguugcaugcccugugcaggcaucuguauuguacaugcaugccuuuuguccugguuuccuguauaaaguuagugaacaaagaaauauuuuugccuaguucauguugccaagcaaugcauauuuuuuaaauuugucauacauggaaagagcauguuuguuacaugugaaagcucuacugaugcagauacacuaauguuugaacaugcuguucuuugcaaguguacaguuuucaaauguuguuaucagugacaacacccuuguggucuaaacuugcuacaauguauuuauuauucauuuccucccacagaaauaagaaucauggcuauauuucauaugguuauauugagagugaagggaaaugauuaauacaagguuuuguaacacugguguguaugcgugugucuuuucacucucucuccucuuuuuguaaauaugauuaacuauuuaaaaaaaaaugucucuuagaaaucagcccucacugaagaaccaacaugaacuccacccacgugaccauaccacgugaccacaccaugugaccacaccaugugaugcccaccauuagcugccuacuccuuucugagacagguuggggagaggaugagcagaaugaacaugguuugaucugugcccagaauauccagugaauguuuuguccaagguaaaugcaaacuacuacaugguccauaacuuccucccucacuugacugccuuuggcacaucuugcaccuuuaucauagcauauagaaacugccaccuuggaaucuugggacuuccccuacaugugguuuggaccccauucuaacacuuguaacuccaauauaaugacauauaauacaugguaagcucugaguacugggugguuaagaguaugaguggagaggcagacuuuagauugacaucuggcuucagcauccucuagcuauguaaugagggcaacacucuuaaccucuugaccuaugaugacucgaccuuuaugucuuuggaccuccaagccaaagagaagugaagacaaaacaugagacagaggcuauucccaccugcaaccuugcaaccacagaggucucuaagauagccucacucgagacgggaucaaugaagucuuaguguucaguugcugugaaaagacaccacaaccacggcaacucuuacuaaagaaaaacauuuaauuggggcuggcuuauggguucagagguuuaguccauuaccaucauggcaggcaaucuggcagcacacagagcagacauggugcuggagaggcagcugagaguucuacaucuggaucugcagcaggaagagugacacugggccuggcuugagcuucugaagccucaaaaccuacuucaacagggccacaccucugauaaugccacucccuauaagucuauggggggcauuuucauucaaaccaccacaaaugaccacacagcaacuccccuuucuucgggcucaacaguuuaaaacacauuuuuuuuuaaaaaaaaucuaaauuggugcuugaaagcauacagaaauaccucauacccuaagauuaaaaaaaaugaaauuccucauaaaguuaaaucuuuauaacucaaaugagcaauaagacagacacacaagaaaauauuggaccuugcuuuuaaauguacagaaugggaagaaacgaauauuagagaccagggcucaggggagcgggugguuagcacugccuggaguagagcugggccagcugauccuggcagcaaggcuagugcucucuggcuuuguaaagggauguucaauccuggaaaaagggccuacacaguggaaagcucccagggcaucccacagcccuugcaccaaagagauguaauuccacuuauuaaaaaaggaauuggagcaggcaguaauggugcaggccuuuaauccuagcacuugggagacagaggcagauggaucccugaacuucaaggccagccuguucuacauagugauuccagaccagcucugacuauagagagaagccaaaaaagagaacugccacauuuauaccaucaugauauagaaggggucacagguagauuuaagaaucuaaaaggccacaggcaaguuaucaacucacagucauugaacaauccugggggaaauccacacucuaggaaaauguccugacucaucccauuggucagucaccacgucuaucacccacagaacaguguuuccuacagacaauuugcaucccaccacagaccugcagagaguauuucacagauguuacagcugcugucaacuugacagaauucugaaucaucugggaaccaccucugggcacgccugugagaggugagcucuccugcacugagaugagguuugcccacuguggguggcaccaucccuuagcugggaucuuagucaguauccauagacggggaacagagcagcaacacucauguauccuuuacucucuguucugauucugugaccagcugccuggagccauugccucucuaacuuccccauuaugaugaacugcaaccuucaaacuguaaacugagauuagcucuuucucccuuaaguugcuuuuauuggaguauguuuaucacaacaaugggaagagaaucuaagacauaagacaacagacuuguacaagcaucucugcucucuauaauuucuguucacauaucuugacacuugagcccacaccuuccuuccuugaggguuuuuuucucugagcccuuagcaguagcucuggaaugcccuaacccauucuccaaacuccacuugugguuacugguuggcuuuucccauuuaacagaauuccaacucuugucagguacaauaaaaauuaaacucacacuggcacccugccgcauuuuaugagaucaagcagacaaaauuaaucuauccaauuucugcacagcuacuguguucuacuuugcuagucucugaggacaaucaaccggaagagauagaugguaggguuuugguucuaauauaccacuaagccagaccaacaacacccccagaacagaagucacucauggaucucagagauaucuagaaauuggcccaagaaugaagaccaguuagaccaugagucaugucucagagcugcaaacaaaacaggugggaauguaggggcgacaggugagaacagggaauggguguaugggccacaagugggaauaggaagugaguguaugggugauaggugggaauaggaagcaggcguaugggcaugucacuucugaaacagaagucuuuggaacagucuguuauuauagcaguguuccuaagccacccuccaaacuacucuacuuccucauccuuggcuccuggccuucguggauugagaauggaggguggcucguguguguguguguguguguguguguguguguguguguguguguguguguguguguguguauguacagugugugugucugugaguggggacucugugcgugugcaugugugugugugugugucuguauguuugugugucuguggguggggacugugugugugucuggugggggacugugugugugacugugugucuguugcagcaggaaauuuagacuaagaaaacugggagauaaagaugacaucacuguggcugagggcucuacuggaacaaaugauuguguccuccacgcucuagccuguccaguccuucucuugggccagccuuguccaaguggcuucuguccacaaacacugacucuucuaugucuucaacuauggaauauuuuaagcucuuaaguggcuccuacuucaacuuuuaaaaacagccaggaagaauuuuuagaaacuuuauaaagcuugaacuuuauacauaaaaagaugucccuggaccugcaggaacaaucaguggggacccagggcaggagagagagagagagagugggagggacaagagacaugaagaaugagagcaagucaaucauacugaucaagcucugaaaacuuuauucaggaguggcaauguaagcauaagcaagaggaggcuccaagggagaggggaagagcccgggggcucucugaagcucagguggcaaucuucagcuccuggaaccaacggucacaguguucucuuuucccauaaacacuauuacuuauuacuguuaugaccacgaauguucucucaggauuguuuauguaagcuagaaaauauccacaaggccauggcuguuucuauuucacucagagagcauguucuuuauauugcauuuuuaauuuuuaauuuuuuuuguuuuuggcuuuugguuuguuaaguaugaugcaggaaaaacaaaaugauacuuggucucucagcagacuuggugggacuucaagcaaacagcuaacaguccuggaggaccuacaggcaaacauaaucaauacaaagaguuuuaacaucccuucucugaaccucccaagcaucuccuaacauugaccugugaguccuugacuugcaagauggaguguaucuacacguguggcugagagaacacagacauguauuacagaugaucccauguccguuacuaaauacaucaagccaaucuccgaaugaagagcagagagccaacagccuucuuucgccccuauucucugaggcucggacagcaccgucuccuaacaacaacccugccuaguucugccuagauccagaaucugagcacuuauauauguccuuaauauguccuuauauugucuccagcagaagguguagcccagauuaaagguguguuccuuaaacucggagauucaaucuucuggaauccauagccacuaugccucaagaucuccauaccaagauccagauaaggaucuccaaaccuccagauaagggucacuggugagccuuccaauucuggauuguaguucauuccaaauauagucaaguugacaaccaggaauagccacuacaauccaccccuugucaacuugacacaaauaauaucucauguucacaugaaacaauaacaagguugugaauacgccuaacaugauauaacuaucccucguacaaucgcaaacgcauuuguaaauuuacaauggggcauucauauuacuuuauaauccucguuucugcaacugguuacguggcuuuaauugguauuuauaacuaccuuccucuacuacccauucuguauuuccuucaccuucagccagcaccucagcaggucuuggcucuuuuccuggaggauuuuaccugcagcucaguccagucuauccagguuugccucuaggguguucauguucacccugcucuucaaaaccccgagauuucaggauucagcauuagguccaggcuuugacgucuccccuguaugugugacauccugagauuaggaugccaaccagagagcaucagcaccaagguucucuggggcucacuggggaaguucagaguuacggugagcucgacacacaggacaaaaccugaguugcucagaacauccccacuccccgggugccuucagccucagcuuaagucauaugagccuaggaagcagucuaucguaggguaaagcaaaugggacccagcugcuccauaguaugaaguaauggcccuuacagcccagguggaacuguagauagagcucugcucuggucucuggggucccuggaaaagccuccucauucaccauuccuugccccuuggaagaagcuuccaaacaccccaaugcuaggagcaggcgccacaggacgagccuccagucaucaguggcucacagaaccaccuauuuaaacagauauccgggcacugggcucucucagaggagugaaggaaaucagaugaaaggguuccaaaucuggauuuagcauaaaaaugaaggaaagaggugcccuaauuauuccuccuuaaacuccuggcagugcaauguggagggagacuccucccaccugggaaggagagaagagaaaaauccaggcuuugcaugugaagaguagagccaaaauccgaccacauuucacauaacaccugauccguuaaccagguuagcugucuccgucacugccccucagcguuaaacagaagcaaacgccaccuucucacagacagguacaacagaaaagcaaauguagcuagccuucugcccuggaacucagugcagaaccucugccaggagccagaaagcuaggcagaauuccacagaaucugacuagaggccagagacuaugccaucuggacccgcccagacccagguccagaagggguuacccuucuuaggcagucacugaaaaacaccaaauguggauuuguaaccaacuugcgccugagggcucucuacucgugaaauacuggcaaaguagcaaccagagacuugugacaaacggaugcuuaagguuccaucugaaaaucaaacggcagaagugaccacaggcucugaagaaagauaggcguccugcuuacaauuccuggaaggcaagccacagacaagggcagaugcugaaaucaggaguaaacagagcccuuuguugugcagagaacaucaaacaccagcaagcaucccaaucgcccagagagagaccucuaaucccugcacucagguggcagagaugagcuugaaggcagccuggucuaaauauugaugccuuuaaaaaaaaaaaaaguaaagauccagggaggaggucgagauagcucagguucuauuucaguuucugguuuccugcacuuauaucagggagcucacagcuacuuccagcuccaagagauccaacuucucuggccucuaugggcaucuacacucauaaacacacauucacacccacauucuagcucucuuugaaucagacacccucuucugugcacauacugaaugcucuuacacagccaaaacacacugacacagaccuguaaauaaagauaaauuaaaaaaaaaaaaaagacagaugcugccuaugagaaacucgcuucaccucuagagacggccacguugaaguggagguggagaaaagacaguccucgcaaauagaaucugaaaauggcggaaguaccccauuggaucagauaaauuagacauuaaguccaaaggauaagaagauacaacgaagaucaguaauuagcaaugaauugauuuggcaagaggaaauaccacuauaaauguauguaugccuaguaaccuaauuuuagaccuacauguguaagaaaugcuaacaugccugaaggaaggaauaaguaauauccaagugacagcacacuuuagcauuguaagagccaugcggacaggaaaggaauagcaaacuuacacuguaucccagaccaaacggacggcucagacaucugcagacuguuccauccaaaucuauagaauacauagucuucccacuggaacacagaacacucuguaugccaugucauauccucaaggcaaaccuuaacacauuuuaaaaacuugaaauuauguuguguccugaaguaucaagaagaaauuaagaagaaaauuuaaaauuuuucaugagaauggaaacacaucacaccaaagccuacgggauccaggaaaagcagcucccggaggaaggcuuaggggagagggugauauuagcugaagaggaaguacgggacaugugagacucgaagaggaaaagaguaggagauucucaaggagacaaguggagcaaggagggugggggagauggggagggagagccacgggagcaugcuucguucaaaaauguaguuacgcugugugucugauacagcauaugcugauuauuuuaauuauaauaaaaagaagggugcuuguaacaacagugccuacaccagaaguagcagauuucaaaugagcacucuaucauucaguuccacggaacuagaaaaacaggaauaacucaagagaauacuagguggccauugcagucucacaaacagucucacagccacucagcaacuugcuaaaaaucccagacgccucagagcucagauccaggugugucugucccaaauucugcaggaagagucuaugacacgucugaggccccggggacaucauaggaacacuggguacagagauacuguggugagucucccagccuccccuccucucccagccucuccagcugccauugcagacagagaccccagaaacucugcaaggugccuaucucagggacauuuuggucaaacacaguccaaggugguggaggaagccacauagcuguggguuccaccuagcugacucauucagaugugacccucacugaugcuugggcucuguccccagggagucuggcucaauuguucuggaucaugacugaggcaggugguuaggcuuccaggugacucugauaagcagugagugugagagccaggcacccuuaagagcaguguuucucagccuguauaucauauccugcguaccagauaucuauauuaugauucauaacaguagcaaaauuacaguuaugaaguaguaaugaaguaauuuuauggugguagggggucaccacagcaugaggaacuguguuaagguugagaagcaccgcuuuagcggaaggcacuucucguuacugaaguggucugugaaaggugucugcagccucgagagaugcaggagaagaggaaccauagguaguuuuguuugagaauaaaaaacaagucugugccucacacuacuccaaggcacccugccuucagccucccccaggccaggcagaauaaacuggacuuucagcaccaccacuucucaaguuuaucuuucugcugacuugggauggagcuugcauuacccgccacaaggacucugguuucuuucuuuccuucuuucuccuuuugucucucuuucuuucucuuucuuucuuucuuucuuucuuucuuucuuucuuucuuucuuucuuucuuucuuucuuucucuuuaaaaaaaaaguuauuuacuauguaugcaguuuucugucuacauauaugccuacacgccagaagagggcaccagaucucauuacagauaguuaugagccuccaugugguugcugggaauugagcucaggaccucuggaagagcagucagugcucuuaaccucugagccaucucuccagcccaaggacucugucuuauaaaguccauaaucuuaauuagcuuggugaguuuguugccugcaaugcccagcacacggugcuugggugaauuagcuuggugaguuuguugccugcaaugcccagcacauggugcuugggugaauuagcuuggugaguuuguugccugcaaugcccagcacacggugcuugggugaugcaguaacugggauucccuggcccgagucuacgcaucugacuuaaauuagacuccucuccaucagcaaaugcuccuaaaacaucgguuccuuaaaagcacaccgguucggcucuucuugggcagugaacccuucauguggcaacugggacccaauuggucguagcugucaugaaugagacaauugccauuugcauggcaggggaagaaaggcuuuucuuccacgaaagcgcaguguguuucugcucacacuucaaccaccaaagcaacagaaggccauaacaagcacuaaggggugugggaaguacagccccucuuugcccagaaagggacuuugagugucagggcggcaugauaccuuccucucagaauggcucaaagggcuggagggcccagcauccucggcuggccaaggcccaucccugcuguauggacauuguccuauuagagagagaaacuggauugcugcaucucuggagguccuugggucuggaggaguguaccgugacauuguuggaugagguaagaaucgacucaucugcccccugccaucguaugaccagagucucagagucaggccccugcucacauucacccucauccucaccuccauaagaucccaccagucccugggcaccaacucccuccauggcaccucuccagcuggccgacaagcuguaguucacucugcucagaugcagauaagggucacgaacugcccgcaggugugcacucugaagcgacuucugccuucagggcccuuugagcugcuccgacucagucugcuguucaaaggcugguucacuggagagucugcaggaagccggcaagccugagccuuugagaacugccugcacagcuacagggaaaggaacagcagagagggcagaacgcuggcugcugcuucucacagcucucaccagcuguggggagugacacggccucagcacagacaccacacacacacacacacacacacacacacacuccuacuacacuauacauaccauaccacaguauauacacacuacauacaguaucacaccauauaccacuacacuauauauauauauauauauauauauguguguguguguguguguguguguguguguguguguauacaacagcauagcacaacacacacacaucuauuauacuauauauaccacaccacagcacauacaguaucacaccauauaccacuacacuacacauauacagcaauauacaacauauugccauaccucacacauacacaaaucauaccacacuacacacacauauuacaucauaucccacuacaccacacauacgcaauauuaugccauacaauaccaaagacauauacaacauacaucaaccaccuaaaauacacacacaucauaacacagcacacgaacaacauaucauaccaccucucuucucucucucucucucucucucucucucucucucucacacacacacacacacacacacacacacacacacacggcuccuccaggccagguaggcggaguuccucccauccugcuccugugacccaug

SEQ ID NO: 7406 - RNA, 1037 nt, Mus musculus
uagaucccucggucgccugguucccgggggacccuccccaucgaaagcucuagagccgccaggccccccgggaccccgcgucuucgcaucgucucccgccagccucgcgccccgccgcaggcgcccaagcggacucacccggcaggauccgaguccuaggcgcggcacaguggcggcggugaguccagagagacgggcaauggagacccgcugaaggccugauggaccgagacgacagcgacacggcuccuccuggcaccggaaaaggaagcggggaggccgaccuggccgcccguuauuuccgcccgccccgcccagcuugcacugcgccuccagccggccgcccacgaaacugcaggcagggccgcguggcuccgggagccugggcuguuucccucuggguggagcgcgggaagguuucccugcuuccugaguccaaaagacccaaaggaaacccccuggccggugaugcucaccgcaacccagggacugaaagcggaguuuggauucucuguguuuagagguuuuuguagacaggcuccaagcuggcugucaguaguccuguuaaaaucgaggguaaagagaugagggaaaagggaagucuuucuaaaggucuugcgaaugaaaacuuuuaaaagcauaugucugcagagacugaguuguauaaguuggaauuucaguacuguggaaagauuggaauguugcagguccaggggcuaauuaccuuaucuugggcuagugcuagcccuccagaauagccaccucugugucaaaacuaauaucuuguggcaauaagauuaaaaaccuuuuaggucuauuaacaggcaacuagccucugccaauccaaaagcuaagaaugucaucggauaaugucuuagauguauagaaaagcuuccucuaucuugauguacccuccaauguauccauccaccaguguguuuuaaacuuugccuugauuuauagcguucucuguucuguaaaacuaaaaaccucgugauacugguuccauguugggacauggaauuugagguaaccua

SEQ ID NO: 7407 - RNA, 29759 nt, Mus musculus
cuguacagcucauccaugauccugaguucugguugguccuccuuuuggaucuucucccucauuaggccuggagcuaaaucagguaaccacugucauauuuccuucuggauuccuuucuagcucuguaucucugaaggaugggucuuaugacuccagauauuccaaguuauucacacacuaaaagguuauuguuuuuguuuggguuuugccuuguuuuaaaaacauggucuagccaauuuuaaacuuucaaaaacuguucaaguuuaggggaaacuauuuggaaaaugauacagggaguuugauuuuuuuguuuuuuuguuuuuuguuguuguuguuuguuuuucaagacaggguuucucuguguagcccuggcuugauuuuuuuuauuuuucuuuuuuugauuacucuucuaaucccaauuguauuuaaacagacccuggagaaggggcaaaguuagccagguuguagucaccaacuuuugauuauaggcaacuggcuccuauaacccaggcucuaggcccuacauggcuacugacccuguccuuucuaaggcagacuucagucucaagguggagugugaggaaaacaucaguugguacccagcaggcagcucugagugcuggcagugugacuugggagaaagaguucagaccuuaucaguggacacccugaugaagccauucuugagaaucauugguccaacuggaccuccggcuuuacuucuguucccuucuaugguuuagaggcauaucaaaaaaaauuuuuuuucugauauaaaccuccucuuucugaagaaucuuuuuuuuuugaaaaaaaaaaaaaaaaccacccaaaucuuuauuguauagaauauauauaaaauccuccaagaugcuacucucucauuuccccaucuuccucuucuucuucaaugccucugauguagaggacauuauuacaccuuuuuagaacuucaccuagauguucagacagcuccccaucuauguacucuucuguauuugcaagcugcauguucauguagccauccauggagaccagguacuccaugccccacuuaaguuucaccaucacuggcuuuccugucaguccauugagagaagucuugggauugagggguaaacucaucgcgaccacuggcgagcgcugcaccccacuagcugucgaccccgccgcugcccgccccucgugacggugaccggagcggcugcugcuacacgcaagcgacccgcgcuaagagaaaauccuuucugaagaaucuuaggaggaaauccuaacuaucgaguucaaauucucuuagaacaugacccagaggagagggaaggacagaagccaauagaacucaguuuucuggcugugcuuacagcuagauuucugugauuacacgcuugaaaucuguuagcucacgaggcugccacaggaggacuggaacucgagggaaauggaggcuacguagaagcacuauccauuaaaagcugauuucaaaaacauuuaucgccgggcgugcgcccagcacuugggaggcagaggcaggcagauuucugaguucgaggucagccuggucuacagagugaguuccaggacagccagggcuauccugucucaaaaaaaaaaaaaaaaaagaaaagaaaagaaaaaaaccccacauuuaucuuugauuuacaucuucaguuuguuuguuuguuuguuuguuuguuuuuacugaugucgggaguguuagccugcuaugggagguuuuugcucaacccucucugguuauggagguauagcaaguauauccccaaccaagacaaagucgggcagaggcguuaaaagauuuucuucaaauuccacagcuuuuaagaaggaaggugagucaaacuucaguuaguuugagauccaacucucucccaaccuugcuccuugcaguuuuagcccaaaaccuaaaaguaaccuuaaugaaugaaaugaaaucccuuguucuguucccgcaccuucacugagaaugcuugggcacuuauuacuguauuuugcauaacguagaggcuucguuuggcgccacuccaaggguugaacugcgcagccgccaaggagugugggaaguaggacaagaagaucccugguuccuagauucuccgccucugagcuccagccccaaccucuggaccgcccccuuucccgccccggccuucaggccccgccuccgagcccaggaugcaccuggauaaaaacaaaaucccacgugacuggcccugagcucagaucaucauggcgucucccagugggaagggaucuuggacgcccgaggcuccugguuuugggccgcgggcgcuagcacgggaccugguggacucgguggacgacgccgagggccuuuacguggcuguugagcgguguccucugugcaacaccacucgccggcgguugacuugcgccaagugcguccagagcggugauuucgucuauuucgacggccgcgaccgggagagguacggcggccgccacggcccuauuguuucugcuucucugauuccucuggcccagccaccagaggcuggaggcuggacacccuaggccgggcccaggagcccugcgaguguggaaaagagaauggagcugcuuugcgcuggcgcuuuguugccaguggcagggugggggugggugcuaggugaacguagguugcuguuccccaccacccaccagaguuucucuaggguccucuuggguacuuggggaaaggaaauacaguccuucuggagaagucuguguagaggagucuuaguucucccauucagaagcguaguuuuaccuuuucccgucuucagacauaaauacauuuuacagaaggaauccgcagagaacuaaauugguuaggagggcuugaaccuugguugucugugucacagguggauacagcucuuugugaacgaggaccaggacuagguuacuuccuucuguaaucccaaaguugauuuugucacuggggauacuggacuguguuuuugaguugcaaguccuuaguuaaaagaacugcguuuaaggaaauauuuugucuuucuuuugaauuaagauauuagaaaacugaaugcuuagcugaagaaucuuuuacuccuaacguuuguuucaacaauaacgaaauagguaacuuuuuaguauguuuguuugagacagugucucacuauguagcucucucuggguggccuggaacucacuauauaaauaagacuugccuggaacucggagagauccuucugccucugcuuccugagcgcugggaaaagugugugugcuauuauguccagauaaaacaauuuuuuaguccuaaauuugaagcauuuauuuuuuuacaacaacccaugcaaguuauugccagccgauuacuugaggagacuuguacguaguaaaugccuuguuccaaggccccaaacaguuaaaacccagacauccuggauccauauacgggugcauuuaacugcaaggcuauguaacauguaaauuuuggggguguuuuaauccccauuauuccugugaauggggcucauuucuuuuucuucugaaaauacugguguaacagcaucuuuuuaaguucauugcuguuuuauggauccacaugaugauuuuaguacguuauagcucuaaaaguuaaaccaguuuuguuuuaagaaaaacaaguaggagauaggaaugucucauuguugagucuuaugaaauauuuagcuucuacauuuuccuauuuuuaagauuuauuuauuuuauguauaugaguacacuguugcugucuucagacacaccagaagagggugccagaucucauuauggaugguugugagccaccaugugguugcugggaauugaacucaggaccuucgguauagcagucagugcucuuaacugcugagccaucucuccagcccacauuuuccuauuuuuacucuuguaauuucaauaccaucuagaugcugaagacugccacuuuuuuuugggggggggguguuugagacaggguuucucuguauagcccuggcuauccuggaacucacuuuguagaccaggcuggccucgaacucagaaaucugccugccucugucuucugagugcugggauuaaaggcgugcgccaccacgcugggcuugaagacugccacucuugaauauccaacccagacgagcaugcuauccaguacuguguuugacuuuaacuccuuuugucuccuguuugugauaguaaucacuauuuuuaaaaauucuuuuaaaaaggauuuauuuaauguaugugaguacacugucacucucuucagacacagaagggcaucagaucccauuacagauguugugagccaccauaugguugcugggaauugaacucaggaccuguggaagagcagucagugcucuuaauggcugagccaucucucaagccacguaguaaucacuauuuuaacauggcaaucugaacuccuaguuuuauauuaauaaauguguuuuucacaucaucucuauacaguaaauugcaauacccuccuuuuauucagacuaaaaaaaccuuccaguccucaguaagccaccauaucuaaucucaucagcagauucuagcucuucaaaguuuccccuaaaucugauccuuuccaagaggauuauugcuucccauccccuucuuguguaguuaaccuguuacagagguaaugccacgccacucuucuguucauacuuucugaugguucuguuuuacucaaagugaaagcugcaaucuuacuuuguuuuguuauuguuucugugagucaggguuucucuguauaacaucccuggcuguccuggaacucacuuuguagaccaggcuggccuggaacuuagagauugaccugcagagacauguaccaccacgcccagccuugauucuucaagccuggguuccucuguguagcccagacugucauggauguuauucuggaaacuaggcaggccugaaacucacugagaucgcccgccucugccucugccucugccucugccucugccucugccucugccucugccuccugagugcugggacuaauuucaugugccaucaccaccuggcaaaagcugcaaucuugagccaaaguuccaaauauaauuccuuugaccuaaucucuuguuauuuuucuuccuuauuaagggagaaaaugguuuccuggcuucccugucaguucaagaacaucccugccucagagccuuugaaguuacagauagcuaagaacucuuguaguaaccauggcugcuucuguuuccuucagaacucugcuuacauauuaaagauucuuuggacccuuuaaugcucuuauuccuacuuaugugccuuauugucuuaucaccaugugauaacuuacugauugucugauccccucggguguagacucugagggcaagauaguauuuuguaaacuauuguauccucauauagcagacuaaagaauuuaguuuuuuuuaaagauuuauuuauuauuauacauaaguacauuguagcugucuucagacaccccagaagagagugucagaucucauuaugggugguugugagccaccaugugguugcugggauuugaacucaggacauuuggaagagaagucagugcucuuaccugcugagccaucucuccagcccccaagaauucagucuuuuaguccuccuaagaccacuuuucugguuguuuuuuuagacaggauuucuccgaaucguggcugaccucaaccucccaucugccucugcauccugccugcuguauaaaaggugugaggaacagaccacuggccagcccugagccuccuucuguuaucauuuacaguccccugguuacuaaagccagaagucugagaguuuucuugaacuuuacuuuuucccucuaacucaaggcagcagccaguuuaauucaguccaaccccagagaauaucuugagucugucuaccaucccucauuccuagauugggggcuggagagauggcucagcaaguaagagcacugacuucucuuccggagguccugaguucaauucccagcagccacaugguggcucacaaccaccaggucuauguagucacauguaauccugucuagugugcauacauaaccacccuugauuuuucaccuucagaaaaguaggcaagaucacgucaaccuguuacuuacacccuucucuugcuuucgacugcaguuauaauauauuauaccucuugccuacuuauuuuugguuguuccucccuuacccauauuccuucucccuuauacuugaaccuuccgguuauuaauauucuuccacgaucauaggucauaucaugaguuuugucacccuccacugcauuuccuaaagcuucuuuugcccccaacccgugaacuccuuuccaguuuucuggucugagccggaaguaauucucucucucucucacacacacacacagacagagacacacagagacagacagauagagagggaaacuagggucuguauaugagugagaauauguuguauuagucuuuggaaaccaguguuaacucauuuaauacuacauuccaucuauuuuccugauaauuucauuuuauuuauggccaaauaaaauuccaccgugcacaugcaguacauuuuuguuauuaucucuugguggacauccagcaugcucaccugaaguuaaaugucccuucugaucuucccugcaagacucuccaucauugcugcuuuggcacuuggugcauuuugcggugggauaaugccuccuacguguguaauguuauuugaguaaaaugccagcauccaaauugucuuucccugaaggcacagcuucuuguucugucacaucaucagcucagugauacagugauacagugacaugcucauaagcauggucaaggagguaggugcuccuuuccaaacagugcuguaagugugccuaaugguagaguguuuaccugguauguaugugcaaagccuuccucugaccgcccagcauugcaaacucggaagcacaaucuuacauagaaaguuguggcuaacucugaguauuaagaugaguuuucuggagagggaugcucuuagaguuuaucuauuuuccuaacgaagcagaaaagugaagaacaaguaagucucucagccauuugcaccuuagaggaccaccacaguggucacucauccuccccuuucagaagcuauuugucagccuucuuucguuuucagagcauuacccagugucuaauaggaugaaagaaucucuucaggcccgauagcuagccacuuuuuagagcuccaguugcaugucaguacauggcucaacuccccuaguaaauugcugaggagaaaggcaccugcucucaagcauuuaacugauucuggcagcccuugaacuucgagagcaaagguugcuugugcuacugucucauuuauaaauaauucugcagucugcuugccuuucaacuccuuuuacuuuuacuucauggaaaccucucucugacuggaaauaaagccuggagccucacagcaccauugcacccuggguuaaccuagacuagcugaagagguggcagcucggggaaaacuagauaaugaaguagacagugucaauaaugagguugguuauucagaagaacuuuguguuuugguuuugggggaugaccuggcacuauguagcccaggcuagucuugaauuuggguaauccucccaucucagccugccaagugcugggauucugggguuauucucuuccaucugaacuuuaacacacacacacacacacacacacaccccucauaggaacagagaggagcauguuucugcuugucaucccugaggugggaagcaguucuuccagcagagucccugugucccauacuacuggauguuuaugcugucuuaacaggagcccaauucuucuggauuauucuuuaccuaacucucaaaauagcacuguuacacaauagaaaacugucagguuguguaaucucuuuccucaaauccaggaaagacuuguugauugcuucaugguagguagaugacugggaguggaaaguugaucugggcagcugggggucugccugauguguuagaagccaggguuuuccuagugugcaauagagagagagaaagaccauuuucuggccauaugauacgaugaggcuucaguguuucuuaggaacggauguaaucuucaccaaugacuuagaaauacaugcuuguaucuuuuacccagaagcagaaauacaggacuauggaaauugagcuggguuuaagggauaaggaaaaaguuuagauguuaccauagguuucaagggaaaugcauggcaaaagugcauuuagaugccucuguuuuuccccaguaucuuuuugguugucuauguccuguggaaaugguuuccggggugucagaugacuggcugaacaggaaagaauauauguuuguaagacuuuucucuaaaaauuauuuuucuuauguguauagguauacauguuuaucagaaauuguaggcuugaacugaagugacugagagggggcauuuacaguuucguauucuauuaacaaguacucucaacagcauggucagaacuagagacugcagugugaaauggaagaagccggguggagauagagacggaccuacagucuuacuugcaugugugaucuaagaguuggucucagucgguuacagggccaaggaggagggagaguagugaaagcuuggucaguuaucgccagguaagagcugcaaguccugcugugaaguagaaugacuauagauaguugcuuuuaaaagucaugaaagacuucaauuaucuguaccauaaagaugcgauaaaugcuugggagauugauaugccuaagcaaauguaaacaugacacaauccauuuauuuaugacaacaucacauuuuuaaaauuaaaaaauguuuuagacuuauguauuuugugaauaugagcauuuuacccacauguauauguuucugauguguguuccugguguguguagguuagaagagggcuuuggaccaccuggaacucaucacauaugauugugagcugccaugugggugcuuggaauuaaaccugaguccugcaagaauaaaugcuuaaccauugagucagcccugauuuuuaauuuuuaauaugucaaauuuuaaauuaagagagagguaaguuauucuaaauugccacuuuaaccuaaaaacuaaauucaaauauauagccagaagaccaacacaccuagaaaaacaguuagcaguggugugauaugccuuucuuugcuauuuuauaagcuuccaguggaaauaaaucuacuuuacaaguuguaaauauucagccaggcacuggugcauacaacuguaaucgcagugcucgaaaggcagaggcagguggaucucaauaaauuccaggccaaccuggucaacauaccgagauccaggaaagggaggaaggacuauauagauccuuucucaaaagucaaaacagaacagaaguuguagggacucaauuuguagaggaaagcaggauuaaauuaaguuuggcaguuaugauucuuuucauaaugaaagccucaacuacuuugauucagguucacauuaauggugcugugcauacucauguguucuuugggagcauuauuugggagguagaggcaggcagcucccucagaauucaagcccagccuggucuguauaggucagccagggauacagaaugucucaaaaacaacaaaaguucauguuaguauucugcuauguguauuuugggaaacagguacaggacagaaucuacaagcacuggagugaggaaagagcuuuccagcugacagcuugguuagauaccugguggugagcagagugugcacccucuuguguuuacuucccggauucuagguauuucccuaggaauuugcagaaguggucagccgggggauugguggaaucucauuaaccuggggcaggggaaggacaugcaaauaaaccaagguuugguuugguuuuguuuuaaacagguuuauugacaagaaggaaagacuaagccaacuuaagaacaagcaagaagaauuucagaaagaguaagucuuuaaagucuuuuaaucuguagaaguuugucuguugcuucugugugcagauuugugaauugccaccccauuuaguagacuaucuuuuuuuguuguuguuguuucuuguuuguuuguuuuuguuuuugguuuuuugagacagggugucucuguguagcccugguuguccuggaacucacucuguagaccaggcuggccucgaacucagaaaugcgccugccucugccucccaagugcugggauuaaacgcgugcgccaacaugcccggccagauagaauuuuuuuuguuuuuuguuuuuuuguuuuuugagacaggguuucucuguauagcccuggcuguccugaaacucacucuguagaccaggcuggccucgaacucagaaauccgccugccucugccuccccagugcugggauuaaaggugugugccaccacgccuggcuagaauguuuuaagaugcagauucuuggacuccuagccucugacacucugauguaguaagucuaggguaaggcccaggacugaguuguuaguuggccccuuaugacauuuuuuaccuuagauuuaaguuuaagaauuuuuguagagagcuggacagaugcucggugguuaagagcaccgacugcacuuccagaaguucucugaguucaauucccagcaaccacaugguggcucacaaccaucuuauaauggaaucugaugcccucuucugguguaucugaagggagcagugguguacucauauauauauaauacaaauaaaucuuaaaaaaaaaaagaauuuuuguugacccuucuguccuaaacugaccugguagcucuccuguagugccugguggucuuugguccuuacuacagcuguucuuagccagggguggcaguaugcaaaagacugaguucgagauuaaccugggcacauagcaagagccaguuuugaaaacaaaagcaaaaacuaggcaggccuggagagaugggucagccuuccagaggcccuggguuucauuccuggcauccccguggaggcucagcaacagucugcaaguccagcuccaggagacuggccugaugccccaccuggcauuuccucaggcccagguacacccauggcgcauacacauacacauguagacagaacaccuguauacauaauacagaauuuuuuuuugguuuugcuuuguuuuucgagacaggguuucucuguauagcccuggcuauaaccuuuguagacuaggcuggccucgaacucagaaauccgccugccucugccucccgagugcugggauuaaaggugugugccaccaugcccagcuaauacagaauuaaaaaaaaauagauuuauaucuuuugaguuuuauaagacugucaguaaggguuuccaucugucucuuucccauacagaguacuaaaagcuauggaaggaaagcggcuuacagaucaguugguaagucccaagaaguauuuaagcuaauuuucuucauauaugagggugcauauuuuuuaaauugguggcacuuaaagaaauaauuauuuaauuuaguuuuucaccacauuugacagccugguguuuacauuuauuuguaguauggccuucuaaacuuuacauggagauaugccaaauggaauagccaauuaaauuauacaacuaucauaaaggauaauuauacaaaucugcuguuggcaaacuaauauagaaccaauagagcaaucguuuuguaacgauuacucaaaauaaacacaugauuaaaguaaaauacuaaagauuuagcaagagcugugcauggguuugcaugccuggaaucuuaguuuuugggaggggaugauaagaggguuggggcuuggagccagcuggaccuacaugagacuacaguuuuuaucaaaaagaaaaaauaauuuagcaguggacuuaagcaguuugagguuguuagggccuuuagaagccacacacaaaagcauuuuggcauaguaaacuaauuuaaaggcuuugcauauuaaacaaaauuaaccacuaagguggugaaugaacacagguguguaaguuagaggcauuugaccccuuuccccugucugcagcaucagagacacuugacuuggggauaguuugugcugcugacagagaacucguguggucaacaaguuccuccugagaaaugaacacagaacacggauacuuauggguagugaacuaaaguuaguaaaggcaugcucuagguucaggaguugagaggaaacuguggccuguggagcuagcugccuuugucucagcgaaucuuauaacuuuguccaguuaauguggcaaaucaauuuuaaugguguaaaaaugugguuaguauguauauauguauccaaaggaacuaugucugcgauauaauuuucaaugaaaaaagguaggaaacugucauuccuuugugucuguacuuuaaauauacucuaaaugauauagccggccaggcauuagcccugaaguguagccugccggagggcugcgugcugacaaagcaaaaagcuuaucccugacaagguggagggacucaauacaguggccaacuguuuccugcagugucuagcgguugcaucauguauaauuuuaugacaguuaaagaauauaaaugacucauucugugaguauuauaaauaaauaagauguucaauaaaauuuuuucuaaaaucuuucuaacacgucucagccugacuuagugaugcacgguggagaggcuaacgcaggaagaucaugaguuuguaggucaggcuggacuguauuauagcaucguccucacaagauaaaagugggagcagauguauuaagguucgcuaaaggaacagaagugauagaacaaaucuguauauauguagaagggagacuuauuagcauggcuuaccugcugugcuccagccagucuuaacaguggcuguccaccagaguccaggaauucaguaucuguucaguccaugaggcuggucuguaguacaugucagaauccucaggaagucggcucugauacuucugaaggaauaccucagcagcaggggagaugaccuuggcgaugacaaugaggacaagcaggcaugucuuuuauacagagggcaugaggugagcccagauuuaggauaggucuucaaaccucagauggucgguguuaaagcugggucuuccuaccugauucaaauaauccaguaaccaaauaucccucacauguaugcccaguugcuggguuuuucauugauuccgaauggagucaaguugacaacaaaguccacuaccccuugucagcuugacauacaaucauauuugcuuaugucacacuuaauuuccaaauaaaaacaauaacuaggucauaauuauaccuaacaugauauaaauaccccauauacaguugcaaacacauuguauauuuuaggcuagguagauucccuugagggacauucuauuaguaucucauaacuuagauaugagaaccauugauauuaucucaauugauguugcauuacaugauaaagucuguacaagcauguucuuaacagaauaugacagaaauagccaugucaguuauaacccauauuguugcggcuggucagguggccuuagcugguauuuauuauuacuguccucuacugcccagccguguccuccaccuucagcaagcaccucagcaggucuugguucuuuuccuggagaguaacccguauuuucauaccugaagagucuguccccuuuguuaucuugccugguuuggauuguuguaguuucccagggcaugggagcaccaagauaagaccaaaaggaucuacugcauuccagacagaucuaucuuucuucuguugaggggaagcaaaccaguuuccccuuggaaaucuggaucggucacccuaaccuaacuaacacuaacacuguauuccuuucucuuagccuauuggcuuaagggcaccagaagccugaaguaguuagcaggacucugagcuucaagaucaagggaauguuugugguaucuccuggcaggaauacucugcaaguaaaacaucugggccaugggaacaggaaguaaaaacuuuccuagugggugaccagaacugagugaaaccauucccaucuccauuccuggauuacuggacuuguggauccuggcuaugggagaaacuguaccauauauugaauucugauucagagcauuauauugccuucugaagaacccuggcccagccuuucaggcugcugucaccuaaauuggcacuguaacugugucuucaaaaggcuguuacaucuuucuaucaggcuagcugauucaggaugaugggaacauguuaauaagaccagugaagugggccagauggcucaacggguaaaggaccgaauaagccugagcugaucuccacuccccacuccuccucccaucccccaucccugacauccacagaacagucagugccuccaugaguguuccaugccccaccuccacaccagcauuuauggacaaauaaaaauaaacagcaacccccugccaucaguucugcaucuugugucaugggacugcuuauguaaauguuaacacuguaaauacuuuuucuuuuguuuuuucgagacaggguuucucuguauaacccuggcuguccuggaacuaacucuguagaccaggcuggccucaaacucagaaauccaccugucucugccucccaagugcugggauuaaaggugugcgccaccacugcccagcuguaaauacuuuuaauuaccuacgauuaaggagacaauacaaaaauaauugugcauuaacuaacaaguuguuucuauuuucgcaacaaaacaccacaaccaaggcagcuuauaaaagagagcaccuaaugucucagaguauuaagaguccauugugugugugugugggggggggggucggugcuggagagauggcucagcaauuaagagcacugacugcucuuccgaagguucugaguucaauucccagcagccacaugguggcucacaaccauuuguaauggggaucugaugcccucuucuggugugucugaagacagcaacaauguacucacauacuugaaacaaaucauuaaaaaacaaaaaagcauuccauuaugggaaaugaaagaacagcugagaacucauaucuuuauccaugacccugaggcagagagagagaggauacuggggucauuugaaaacccagagccugcccucagugauaacaccuucuccagcaaggccauaccuaccgccuuaucuuuccaagaucauccaccaaccgggaccaaauauccaaacagucuaagccugugggccauucucauucacaccacccguguguccuauaagcugugaugcuuuauucacuagggaaagcggugccuggcugugccauuccuagugauguccaggacgguuuuauguuccauguacuuuucugagucaucugaauguagaccuagguuggugcuuuggugaugacacugacauucggaaucugcucuguccuuguggcagcuacuaggcaugggugcuauugacccuaugacauuuggauaguauauagggaaauuaaucuuuauguauucuaauuauuuuaugauggguuugaagcaggauuuuauauguagcucaggguggccuugaaguccugaaccuucuguuucuacaucccaaaagcgaggauucuaguuguauaucccacaugcagcuuagccagauugguagguagcuauguacuggguaagggaaguuuagaagcauuuuucucugugcucuaacccgugagaaagaucuauguaaguuucuuucucauugauuucccagcagcuacuguauggaaccagaaaauacguuccccuuuguaaucuacuguaggucaacacagucgugacaaauggaguuacgagcuuuuucuucauugcguccuaagguggacugugaaaucaaguauauaaucccaugagacugacaauugugacaucuguuguguauuuuuuaagagauggaaaauaaugucaugcaagaugaggauugaacagcugaagcaaacaauauguaaaggaaaugaggaaaugaagaaaaguaagugaucacuuuccugggaguggcuuggggcgaggcgggggggggggggggggguggagcuggcauggaguuggcuaguuuucaaauguugugaguacacaccuuccucaaaggagcagugagcugaggcaggagggagagaccgugcccuuauguagccuguuuccuguuucuguucagucugggauccacccccuucaauuaacccaaucuagaaacucccugacaaacauagccagggguuuaucccuuguggugcuugauccugucagguugguguauugaccgucacagggugugagugacuugauccugucagguugguguauugaccaucacagggugugagugacucuggaaacuugauuauggguugcagauaucaaauccccaauuugaaaugcuuguaauuauaaguguuuuggauuucaguuuucuuugauacugggaauguguguguguguguguauugagauaugcuguugggaccuaucuaaagaugaaauucguuucuauguggaauuaaaauuguagcauuuuugucagcagucaaaaugucuggguuuuaaggcuaggcguaguggcacacaccguuaaucgcagugcucggacagaggccggccugguuuacacguacaggacagccagagcuacauagugagauccugucuuaaaaugaaggggggggggggagaaaagaaaccucugguuuuagagcauuccacucuucagauuuauguauuuauugagaaaggauuuugcucuguagcccagguuagccagagauucacaagccucuucucaucucuagugccaccguguacagccccauaguccagauuauucuaccagggaagccuaacucugcuugcuuuuuuucuuuuuuuuuaaaaaagacguauuuauuaucuauguacaccauucugccugcaugaaugucuauaggccagaagagggcaccagaucucauuauggguggcugugauccaccaugugguugcugggaauugaacucaagaccucuggaagagcagccagugagugcucuuaaccucuuagccaucuccccagccccacuugcuuuccucuuuaagauauuuacauagccacccccacccccaggccuucacuauagugccuuucaugcucuaaguuccuggcuugcucaccaccacuauaaaaaccaaacccuggggcacauuugcagagucugacuuggcacuuacuugugaugcucaggcaggaaugugaaaccguggcuuuucccuccagugaauucacauccauaaaaccugugcugguuucacauuacagauaccugcuucagauguuaccauaggugcugaccgaauuucaugaccucugggaaaccuuaccucauuggacacguuucuuuucuuuuuucuuuuuuuuuucuuuuucuuuuuuuguuuguuuuuugagacgggguuucucuguagcccuggcugugucagaacucacucuguagaccaggcuggccucgaacucagaaauccaccugccucugccucccaagugcugggauuaaaggcgugcgccaccacacuuguuguggucaagcaccauaccaagucagcuuaugaaagaaaacauuugacugggcuuaugauuccagaggugguggccaugaugguggagcaaaggcaagggucuugccaagggucaguaaauaucaugggcaugauggaaucuuuaaacuaaguaaaaguaaacaacuuguaugggacugaccaauccugggaugguuuuacccagacaucugcauggagcuggcuugggaaaaggguguuucugagaggagauggggaacuaagaaagcucaugccagugcuaaccugcaagcuuagguccucagagacaguggcuguguccacaggugcuugugaggugccugauacagucugcuuaggagguggcaaggcuucaguggguauggcaugaagaacuaagagagucguguacugcagaagccagaagaaaggcaguacgugccacaagccagccugccugccugccugccugccugccugccugccugccugccugccuuccuuccuuccuuccuuccuuccuuccuuccuuccuuccuuccuuccuuccuuccuuccuuccuuccuuccuuucuuucuucuuuagauuuguuuauuuuauguauaugaguacacuguagcugucuucagacacaccagaagagggcaucagauccccauuacagaugguugugagccaccaugugguugcugggauuugaacucaggaccuuuggaagagcagucagugcucuuaacuacugagccaucucuccagccccgaggcagagccuuucaaauaaggaaaaucuggaaauuggggaaaauaggaccaaauccggcacauuagcagauggguaggauuuugaacaacaguguguggauggguguuagcaggcuuucccugacauugaguggguccaucugagaagaggaucgugaguguggaaggaggcacagaaaauagcgaggguaaaagagaucuguggcuaugccuguuuggagguucagaaguuuggucuguguuugagaacugccagguauuaucuguaguuuauagauugugcaagagccaugcauggugacacacacaugaagucccaucccagcauucagcauguugaggcaagagagaggaucauguacgcacaugcacacccauucacucaaggggugcagagaggggggcaguggguagguuggagauggguggcacuuaagugagauguaaucagaaggaacgguggggauggagagaaagacuuaagucaacuguacaccagcuaaugggaccaguguagggcgacugcugggccggcacacagguccggaggaagugguuccuaggugucugucguuuguuuuugugacucagaugaagcuuaacuugaguacagugacccuaacaagcuucagacucuguguaggaaggcccuagugaaguuccucugcgugcacacucgugagcguggaggggagcggugcagagcugcugacaggcucacauggcuuccugugcagauucugaaggucuccucaagaacaaggaaaagaaccagaagcuuuacagccgagcacagcggcaccaagagaaaaaggagaagauucagcggcacaaccgcaagcuuggggaccugguggagaagaagaccauugacuugaagagucacuaugagcgguuggcgcggcuucgaaggucacacauccuagagcucaccuccaucauauucccaaucgacgaagugaagacuucugggagguacaguaagaaggcucaggggugggcaggugcugagcauugucuucucaguguucagcacuuuuacugggccucauuugagggucgguaggcuuuccugauaaugaaacuugauucuuaucuuccucagcuaacaguaaauaaaagggaggcagucgggaagaggggugggguggcuuguguucugucacagcuuucagguuacauucuggcucaaacuccuggggaaaccaucuguuuagucaugccagucagggcauuuauuaguugugagcaugugagacacacuguugaacccacaaaccugauuuccuugucuguuaaguggaggcugaaaucaccugcaauacugagugugaacuaguacauagacaaggccuagacuuagcguugucuggaguggcuguuuauucuauaagcuguugaggaaacagcacugugacucuagagcauaggggcucucaggaaauggggguagagaggacagugguuuucuuucccuuccugccucccuacccucuuagcagucaccugggugcuuuugacaaguucacuuuggucuagugguucaaaccuauaauccuagucucuuggaggacgagacugguggauugcaaguugaaggccagccugggcaacuuauucagauccuguuucaaccuuaaaaaggggcuagcuguagcucagcucuugccuagcaugagccccucguagguucagucuccaccacuaccaaacaaacaaacaagguggaacugggagcagagugcgcacucgguccacugcaucucaguauucugguuggcggguguggaaaucaccgucaaaaucucacaugcucuccaccugagggccaugugucuccuggcucucuugcucugacuggacugacaguaggugacuaguaaccauucuuucuugucucucccucagucuccgcuuugguguguugccagauuuggcuccuuaaaaacuuaccagaucugaguuuugcuuccaacuuaaaaacccauucccucccugauguuuccauguacucugugucugguaaagcugcuccuggugccacagaccugaggucacagauagauagcugggagacuuacacaggcagacugcaaguucagccuugccuggacaaccuaaagagacccugcuucaauaucaaaagugcaaaggggcuggggauguugcucagugguagagcccuuaggcagcaugugagcaaaaggccuagguucagucccucagugcuaguagaaaggcuagauauaaaguugggaaguauucuggaucaguggaaaaaguuaaauuacuaccaguuggcauagagaccacuggucaggccucugagagaggcuaguagugcagaagccuugugcuaacauuauguccugauggaucagcaggcacccgagcgagcauccuacgccacaaaagaggaucuugacagugcucuuguggcugcaggguugggucugcagaugaguuacuaacuaguacugcaggguaaaugaccugauuucuguuccacuguagcuggguaugauggcacauaccuauaaccuuagcucuaaggaugcugagucaggaggaccaggaauucaaggccagccucuguguuacagcaaauuccaggccagccuggcaugcacgagccccugucuuacagacugacgauuuuauuguguuuuauuuugcucugggauucaguaugaggauuggaucuaggccucccaauuuuuaucauugcauuuuccuaaguagguaauuugggugaaacuuuaaaagucuugcaacuuuuucauaagguugacauuuuuauaccaagaaaacaugugccuaucuaguuguguagcaaauaguggcuuguggucacaguaggccacacaguccuccggugcugcaccauguagugauguggucugcaugaacaugagcguccucuccugcucaugugugccacacacacacacauguguauggcugggcaagacaugaagaaaaccucuccugcucuucuccuagcuuguaauguuuucuuagcaugcauuagauguauacuguggcugcgguauaaucuuggcuguugguugcagagacccugcagacgugucuucagagacugacagugccaugaccucaagcauggugagcaagcuugcugaggcccggaggacaacuuaccucucuggaagaugggucugugaugaccacaauggugacaccagcauuagcaucacaggcccguggauuagccuaccaaacaacggggacuacucugcuuacuacaauuggguagaagagaagaaaacaacccaaggaccuggugagaagcaaaacuaaucuuugaaagugcauuuguguacauauuuugugagauaaacuuuacgugccggagugaagaaugcugccgugagcaguuggauuaaguguguguacagcauucguucgccaggugugagcucuguucaucucaaaccuuugcugagagcaggggagagcccugugcucugcuuuccagccagugauggugaggucauacaguguacaguguuuucucugcucuguuugcuuuagccuucucuuucaaagcucuuguuauggcguauguuaguccuccauugcuucuuacguguggcuaaauacuauuccauuguauggauauuccauuguauggauauaccauuguauggauauaccauuguauggauauaccaugcaguauagucaucacuugaugacuggugauuacucacuucuguguuaguauuaauucauagagaaaggcagacaaaagaauucugguuacacaugacuguugucccagcuuucgggauggcugagucaugaggauuguccagaguucaaggccagccugagcuauauagccaagccuuaccuuaucucuuauguagggaagaagggagaggaaaucucauguuuguagaguaucuugccuuuugccuuuuggcuuuaucuuacagcuucacccuauuggaguauuaaauggauauugaaauccccuaccguuugucuucuguggagaaggauggcucauuuagucauucagcauauguuucugauacagcuaccacacaaaguuuucauugggcaaauguuuagugagggugugcuuugugccaugggcaguguuagguggccugaggaagcuggggagccuuuuguccuuccuggagagauggcuuuuguccugguuucauuucugguauaaagcgcccugaaggaaaaaggcaagcagcuucguggagaaaggcuucauuucaucuugcacuuccagauuacgguucagccuugggaaaaggugaaggcaagaguucagcucccucucuguacucucgcccaguccauggggacacuccagugggcuaaaucuucccaugucaguuaacagaaccaagacacccgcagacaugcccacaggcaauccccauugauccugucuccuggggcuuggcugaguuaaguugguuuugaaaucuaacccucccagauugugaggaaguggccaagggaccauacucuuggucggugcugagagaagagccagcagauuugggguaggcagagguacagaggaagugauaacgcuuccaucuugggaaguggucuuauguagcucaggcuggccuccuacccuagccucccaggguugguauuuacagguaugagccacuacaugagcuagguuggucauuaaucauuuaggugauagauuaccaggcccagucaguguagaccauuuuuuaugcuuggccuauuuuggacuuuuguguccgaccauggaauaagugugacgucuagauauuaguauuguaauucuaacacugcaagugaaaaccuaccugacgugugugugcacucacagacauggagcauaacaaccccgccuacacuaucagcgccgcgcugggcuacgccacgcagcucgucaacauugugucucacauacuugacaucaaucuucccaaaaagcugugcaacagguaagucccugcaguggcagugcuaucugucauugucacccguccaccucugucuuccuggugugcccuuucacuggcugagagaaaagccagcgucccaagaagguuggacuacaacaugaggcugguucugaggaugaccccaucuccuacaggcacagacggggucugaagagcccacagacuccaucugguucuuggggaaauaacugaaggagaaaggaggaauccggagucuucacgccgggagcugagggauuuuaucagugggguguggaggggguuauuuuguucuuauggaaaccuaguguuuaaauguuuaaagacacagucucgcagugcacguuaagagugccaccucuaguuacccuggcauuucuagcacacauaaacaucauggaauuguagcagccuauacuuguguuuugcuuuuuguauuuaaguaggaucucaucguacagcccagcuggucucaggauccuccugccucgguaucugguugcugggcuuuuaggugugugcucaaguaauucauagccagaauuuacaaauguacugugauaagggccugugggcaucacugagagcaggaggugcaugugcuugcccucuucugguuuuguuuuguuuuucuuuuuugguuuguuuuuuuugguuguuuuuuuuuuuuuuuuuuuuuuuuuuuuggguuucugagacaggguuucucuguguagcccuagcugcccuggaacucacucuguagaccaggcuggccucaaacucagaaauccgccugccucugccucccaagugcugggauugaaggcgugcgccaccacgccuggccccuccucuguuuuuauauacugcggauugaacccagaugggcggauugaacccagaugggcgcauucuauuccucugagcuacagccccagcccagggccucaaguaggaagggagcaagccacguauggggacaauaaggaagaaaacuguaagcagagaaggcacagagucccaggaagagaggcagaagaggugaagaggagcgcgugcacacgcgcgcgcacacccaccccuuggagucuacagcugucacucugaaaugaguggguugggguugguccccuguuggccugcgcuccagagguggaguugcucagucaccuagguacuugcauuugcaguuucuguagguggguggggaugccuccagaggagccuaggaagggucugucucaggcagucuacuaaggaggaagaaugugcuguguugcucugaacuguaguucagagauagccuucagaaagaacauuuuaacagagagcuuccucagagugagugaucuuagaagcugugugcuugucuuacagcgaguucuguggcgaaaaccucagcaagcagaaacugacacgcgcagugaggaaacugaacgcaaacauccuuuaccuuuguucuucucagguacgagcccgugcuuucaacucguguuuuauuugcuguguauuugaaaggacuaauggagccuuugcuuuuuccagcauguaaaucuggaucaguugcaaccacugcacacacucaggaaccugaugcacuuggucagcccgcgcucugagcaccuaggcagguaagcugcuguguggcuuccccuaagccugcuuucucuggggcugcgcuucagccguucucacuggcauagucuccaggguccccaagucccucuuuuuguggggaggacaaacguuguacaguacugugugcaaggaaacagcgggucguguguggggcucugggaucccuuuguagucguuucugacagaaaguugucgugcaguccauuuagcaugugaugugugguagaggagccggguucccuggcugcugccuugugcuucucuagacgcucacuugguuuuuuucuaaccugccccuggaagcugugccuucucuuguacauuuucuuuugggcuugcauauucugugucuuugggauuucuuuuccucaccaggucaguuuggucaccacuuguuagaauucauacagugagcuagcuggucugaaauuuaucagcuuaaagaacagaaaucaguaacaucagaugugcuccgugcgcuguggucugcucuagaugacuucuugguugcuaagcccaaggagcacaaacgggauaggcuuaucuuuggcacccugcucuagccuuacccauuguccuugcucucaucagcaugggcacguuuguguagagacaggacauaccucauguguauauucuuuggaaaaugagcuuuuacucaaaccauaaacugagauuuugcucaaacuguaagcuaauguaagcacucuuauugguguuuguuacuacaguauauuaaaugagguuuugagcuggcugagguggcaaaugccuguaaucuggccacucaggaagcugaggcaagagaaccacaaauuaaggcuagccugagcaacuuaggaucuuuccuucagaggggcagggguguggcugagccuagcaugugcagagcuuaaauuuguuuguugauuuauuugcauuuuggacucaucauauuuucaauucccaaguuggggagcagcuguaggaaaaaaccagugagguguuacagggcguguaguucuagaguggccuguuggugcggaugaagaguaguuuugacgaacugaggccugaagucuguuaucugaggccugaagucuguuaucguucucucagcuaagacaaggccagcaagaacuucagcagaugggcagacaaaccgauuccaagggcagagggagaguaagaagggcuggccccuuuccaaacuguggauaugaaguuaauuuuaaaaaaagauauuuuggggguggggucagcaagaagguuuauuagauaaagggacuugccaccaaccuuguugaccuuaguucucccugccacacauguaaaaggagagaaaugacucccacaaauuguucuaggacuuccacaugcuugcuauugcauucccaccccaauaacacaaauagacaaacaaacaagcacaccaguguuuguuuaaucucagaauuuaagaaacccaggcaaaaggauugugacuaaggucagccuggggccacuuaguaagcucaucucaaggaccacacccuauauaucuuuauauuuauagacccuucauauaaacauauaaacaguaugcauaccauagaaaagagagcugggucuugaagcagaugaugugcccgcagauguguuucagcugagucacaugaugaugcucaacaggguuucccuaguuggcuuucaagggagggaaaaguuguccucgugcuguauccuauauauaaaaacaaguuccacauauaaaagauccuguuuaaaauacuacauaaaaaaccuaauaggaaagacuauuuuauacucauaggguagggaaagaaauuuuaaccaagcccuaaacucaaaacuaaguaaaacagaggagccacacauuacugugcagggacucacucucuuuaguaagaaaggccucacaccuuaaagagacaaugauaaacagguuugcaacaucuacaguagagaaaauaaaaaucuagagucagucuuucaaucaguaauggaaaagaaaccuaguaaaaagauagacaagggagucagauuucucaaucaugaauaaagacauggggcuaggggcagagcucagugggcuaaggggcucuuugugcaagcacaggaucucaaauucaguuucccgaauccauggaaaaagccaggugaaugagguggccacaucuguagugagauggaaggccagacaggagaaucacccaucuugccuggugugcacaaguucuaaaaaaaaaaguaggugagaaauuccugaaagcuguccugcggccuccacaugcaugccugcucccuucugcucauugacugcuauucaugcacacacucacaugcacacacucgcaccuucgcacacacauucacgcagaaggaaaugcagcaaggugagucucuuuccucuuucauauccaauaaaugucaaacucaaagaacugugggggugggagaacgguggugucuuacgaagccccucugucugcacacaggucaggacccuuugaaguucgagcagaccucgaggaguccauggaauuuguggacccuggaguugcuggagaaucagacgcgaguggagaugagcguguaagcgaugaggagacugaccugggcacagacugggagaaccugccaagcccccgauucugugacaucccuucccagccgguggaagugucccagagccagagcacccagguguccccacccauugccagcagcagcgcuggugggaugaucuccuccgcugcggccucggugaccucuugguucaaagcuuacacuggacaccgcuaacgaguugggaccaaaaaugcugauuuugugucucagagucuuucccacugcacucucauaaccuugucuguguaguugcgauagagcuuggaagcuaucgccaggacaagauuagugucagggccugagcucggggcuccugggcccagguccucaguaugcugguuccugggugcagagucucccugacacuaaguccuaggcuuugaucagaucacaaagaaguguuucuugguaaugaggaaugaaagacaaaggcugaguuuguuuuucugucauccucuugagagaccagccagcaggccagcagcaguuuggccucauccgggagaggugguugucuggggaaggaggaaaugaaagcuuauugcuuauugcuuauugucagucauugugcgucacauuccugauuuccuacuacacaccaaagaaaccaaauucuuuauuucuguagacccauaucugcgaauggggagucugcugggaugguuagaugucuaaacaguucucuuguauucugaagggagauaagucauugggauugucuguacuacacucacuuccuccaucauucccuggaugggcuaaaugcuacccgagcguuggcugaacacuuacguggucacucgcuugcuguccgguuucuuccuugguggugguggugggguuaacuaguagcagguguuuccagggaacucuuccuucuuguuccugaggucuucuugucccuggggucucugagacugaagacagcaccuuaugcagaguguagcgcggagcagcugucccaggaaaugcucagcuaucaagggauuuccucagaggucauucuaaugacaaucuuauagaaagcuauaaaaagagaggcauuauguucaagucauaaggaguucuuuuuuuauuuuuaguaacuucaaaaaggaaguucuguguaacagacuccugcaguccugugagaaagcaccccccuccccuggccuugucaccauauccuccuguugugacuggugugaugguaccucagccagguccuucagcagucugccacgcccuggcuucuguugacucacacugugguugguacuuugccugcagauugaggugcuguggcgcuuuggcaguuauuagaaguguaggaaggacuucauccugcccagguuccccacguucccaagcucuagauacccagcuguggagcaggcggcuggagucuguucugugcucagcucugcgacugcugggcucguguuuuaccaccuacuucuaggacuuacagacugagugcgcugggaggaagcuacagaaagugcagaggccaccaacuaccgccuacagcaauuuaaccacaguugcagaaagcacagggcuggguggccuuguuuuauuucauaucaaucagaggcacuuuugucaucgucccucacaguaagugaccagcacggacugccuaggcugcucaaguccuugggguuuuguuauuuugcacuggauccaccuguuguaaauagucuuaaauacacauuucaaccacuguuugguuccuacacucuuugcugcucauuaaaacuuuuuguguaggugucagaaccguacacaaacagcuuucuagaaaaaaaaaaaugaagcugguguuuuguuuuuuuuuuuuaaaccgaaagccauagaaguugaucauguuuuccauuuaaaaaugauuucuuggaacaagguaauacuaauagacacucagaggcaccacaugggcugcuuuacauggucuuacguagaaccaagaaauguaacuuaccaugguaugggggucagcauugggugggguucaggugugcauugggaaagcugcaacgucagaacccccuugcugcgacugaaacuuccaggucagguugaucacacagauguuuucuaaaccuuuguuguauuacugcaauaaauccuuuaacaguac

SEQ ID NO: 7408 - RNA, 2240 nt, Mus musculus
acaagcacaccaguguuuguuuaaucucagaauuuaagaaacccaggcaaaaggauugugacuaaggucagccuggggccacuuaguaagcucaucucaaggaccacacccuauauaucuuuauauuuauagacccuucauauaaacauauaaacaguaugcauaccauagaaaagagagcugggucuugaagcagaugaugugcccgcagauguguuucagcugagucacaugaugaugcucaacaggguuucccuaguuggcuuucaagggagggaaaaguuguccucgugcuguauccuauauauaaaaacaaguuccacauauaaaagauccuguuuaaaauacuacauaaaaaaccuaauaggaaagacuauuuuauacucauaggguagggaaagaaauuuuaaccaagcccuaaacucaaaacuaaguaaaacagaggagccacacauuacugugcagggacucacucucuuuaguaagaaaggccucacaccuuaaagagacaaugauaaacagguuugcaacaucuacaguagagaaaauaaaaaucuagagucagucuuucaaucaguaauggaaaagaaaccuaguaaaaagauagacaagggagucagauuucucaaucaugaauaaagacauggggcuaggggcagagcucagugggcuaaggggcucuuugugcaagcacaggaucucaaauucaguuucccgaauccauggaaaaagccaggugaaugagguggccacaucuguagugagauggaaggccagacaggagaaucacccaucuugccuggugugcacaaguucuaaaaaaaaaaguaggugagaaauuccugaaagcuguccugcggccuccacaugcaugccugcucccuucugcucauugacugcuauucaugcacacacucacaugcacacacucgcaccuucgcacacacauucacgcagaaggaaaugcagcaaggugagucucuuuccucuuucauauccaauaaaugucaaacucaaagaacugugggggugggagaacgguggugucuuacgaagccccucugucugcacacaggucaggacccuuugaaguucgagcagaccucgaggaguccauggaauuuguggacccuggaguugcuggagaaucagacgcgaguggagaugagcguguaagcgaugaggagacugaccugggcacagacugggagaaccugccaagcccccgauucugugacaucccuucccagccgguggaagugucccagagccagagcacccagguguccccacccauugccagcagcagcgcuggugggaugaucuccuccgcugcggccucggugaccucuugguucaaagcuuacacuggacaccgcuaacgaguugggaccaaaaaugcugauuuugugucucagagucuuucccacugcacucucauaaccuugucuguguaguugcgauagagcuuggaagcuaucgccaggacaagauuagugucagggccugagcucggggcuccugggcccagguccucaguaugcugguuccugggugcagagucucccugacacuaaguccuaggcuuugaucagaucacaaagaaguguuucuugguaaugaggaaugaaagacaaaggcugaguuuguuuuucugucauccucuugagagaccagccagcaggccagcagcaguuuggccucauccgggagaggugguugucuggggaaggaggaaaugaaagcuuauugcuuauugcuuauugucagucauugugcgucacauuccugauuuccuacuacacaccaaagaaaccaaauucuuuauuucuguagacccauaucugcgaauggggagucugcugggaugguuagaugucuaaacaguucucuuguauucugaagggagauaagucauugggauugucuguacuacacucacuuccuccaucauucccuggaugggcuaaaugcuacccgagcguuggcugaacacuuacguggucacucgcuugcuguccgguuucuuccuugguggugguggugggguuaacuaguagcagguguuuccagggaacucuuccuucuuguuccugaggucuucuugucccuggggucucugagacugaagacagcaccuuaugcagaguguagcgcggagcagcugucccaggaaaugcucagcuaucaagggauuuccucagaggucauucuaaugacaaucuuauagaaagcuauaa
